United States Patent 9,254,311 (MODIFIED POLYNUCLEOTIDES FOR THE PRODUCTION OF PROTEINS) - sequence listing, part 13

SEQ ID NO: 25652 - DNA, 2265 bp, Artificial Sequence
  Description of Artificial Sequence: Synthetic coding sequence
atgaaggtgatcgtgatccacagaaagatgttccagagagcccaggagctgagaagaagagccgaggactaccacaagtgcaagatcccccccagcgccagaaaggccctgtgcaactgggtgagaatggccgccgccgagcacagacacagcagcggcctgccctactggccctacctgaccgccgagaccctgaagaacagaatgggccaccagccccccccccccacccagcagcacagcatcaccgacaacagcctgagcctgaagaccccccccgagtgcgtgctgacccccctgccccccagcgccgacgacaacctgaagaccccccccgagtgcgtgctgacccccctgccccccagcgccgacgacaacctgaagaccccccccgagtgcctgctgacccccctgccccccagcgccgacgacaacctgaagaccccccccgagtgcctgctgacccccctgccccccagcgccgacgacaacctgaagaccccccccgagtgcctgctgacccccctgccccccagcgccccccccagcgccccccccagcgccgacgacaacctgaagaccagagccgagtgcctgctgcaccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccttccacccccagagaatgatcatcagcagacacctgcccagcgtgagcagcctgcccttccacccccagctgcacagccagcagatgatcatcagcagatacctgctgagcgtgtgcggcttcagattccaccaccagcccatgatcatcagcagacacctgcccagcgtgagcagcctgcccttccacccccagctgcacccccagcagatgatcatcagcagacacctgcccagcgtgtgcggcggcagattccacccccagagaatgatcatcagcagacacctgcccagcgtgagcagcctgcccttccacccccagctgcacccccagcagatgatcatcagcagacacctgcccagcgtgtgcggcggcagattccacccccagagaatgatcatcagcagacacctgcccagcgtgagcagcctgcccttccacccccagctgcacccccagcagatgatcatcagcagacacctgcccagcgtgtgcggcggcagattccacccccagagaatgatcatcagcagacacctgcccagcgtgagcagcctgcccttccacccccagctgcacccccagcagatgatcatcagcagacacctgcccagcgtgtgcggcgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagaccccccccctggccacccaggaggccgaggccgagaagcccagaaagcccaagagacagagagccgccgagatggagcccccccccgagcccaagagaagaagagtgggcgacgtggagcccagcagaaagcccaagagaagaagagccgccgacgtggagcccagcagccccgagcccaagagaagaagagtgggcgacgtggagcccagcagaaagcccaagagaagaagagccgccgacgtggagcccagcagccccgagcccaagagaagaagagtgggcgacgtggagcccagcagaaagcccaagagaagaagagccgccgacgtggagcccagcctgcccgagcccaagagaagaagactgagctag

SEQ ID NO: 25653 - DNA, 810 bp, Artificial Sequence
  Description of Artificial Sequence: Synthetic coding sequence
atggacgagatcgagaagtaccaggaggtggaggaggaccaggaccccagctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaaccaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagcgagtacctgaccgtgaaggtgatcagcctgcacctggtgttccagatcggcgtgatcttcctgcagtag

SEQ ID NO: 25654 - DNA, 570 bp, Artificial Sequence
  Description of Artificial Sequence: Synthetic coding sequence
atggtgcagggcagcagcagaaccgccagacccctgcccgcccccgcctgcggcctgagccccggccccgactgcaacgccagctggcaggacagagccgccgacttctgccccgtgagagccgtgtgcaaggtgggcccctgcccctgctgccagctgaagaccgaccccagactgggcaagagaaccggcctggacctgttcagcgtgtggagcagaagcgccatgctggcccccgccggcagcgtgctggccatgcccaccctgagaccccccagaaacagcgtgggcgacagcggcgcctgctgcctgagaaccaccggcctggacatcagcaaggtgctgcccgagagcttcctgagctgccccctgctggagctgccctggcacctgagcagctgggtgctgaaccccggcctgcccaccctgagaaccccccacgccagctacagctgcttcgccgcccaggccagaagccccgagagagccgccggcggcgcctggcccctgaccggcaagccctggcccagaaccggcatcctgagccccagccacagcgagatcctgtag

SEQ ID NO: 25655 - DNA, 684 bp, Artificial Sequence
  Description of Artificial Sequence: Synthetic coding sequence
atgagccaccacaccagaaccctgggcgtggtgctgagcccccagcagggcgcccccgccggccccggcggcggcctgggcaccccctaccacagccacccctgcaagcccagacaggtgcccgtgagcgagagccagccccccccccacaccatgcaggtgggcagatgggccggcctgggcgtgggccaggccgaggccaccagcgtgagactgggcctgcacggcctggaggccgtgttcccctacctgggccacgacctgcagggccccgccgtgagccacggcgacggcctggccggcgtgggcagagagctggccctgctgctgggcggccccgagcagagaggcgccaagcacagagccaaggtggtgcagggccacctgatcgactgcctgctgctgtgccaccccgtggaggacagaagcagaggctgctgcttcaacgccaccaccagaagagaggccgagggcctgtgcagagccagagtgctgagagagggcgtgaccagcaccctggccgtgctgcaggccgacagcagcctgggcgtgagcagcaccagaagaaccgccgccggcggcgccgccagagccgccgcccacggccagagctgccccagagccacccccgccaccacccccagccccggcagccccagacagggcagactgagcatggagtag

SEQ ID NO: 25656 - DNA, 1023 bp, Artificial Sequence
  Description of Artificial Sequence: Synthetic coding sequence
cccgtgcccggccccaccagcagcgccaccaacgtgagcatggtggtgagcgccggccccctgagcagcgagaaggccgagatgaacatcctggagatcaacgagaagctgcacccccagctggccgagaagaagcagcagttcagaaacctgaaggagagatgcttcgtgacccagctggccggcttcctggccaaccagcagaagaagtacaagtacgaggagtgcaaggacctgatcaagagcatgctgagaaacgagagacagttcaaggaggagaagctggccgagcagctgaagcaggccgaggagctgagacagtacaaggtgctggtgcacgcccaggagagagagctgacccagctgagagagaagctgagagagggcagagacgccagcagaagcctgaacgagcacctgcaggccctgctgacccccgacgagcccgacaagagccagggccaggacctgcaggagcagctggccgagggctgcagactggcccagcacctggtgcagaagctgagccccgagaacgacaacgacgacgacgaggacgtgcaggtggagctggccgagaaggtgcagaagagcagcgcccccagagagatgcagaaggccgaggagaaggaggtgcccgaggacagccaggaggagtgcgccatcacctacagcaacagccacggcccctacgacagcaaccagccccacagaaagaccaagatcaccttcgaggaggacaaggtggacagcaccctgatcggcagcagcagccacgtggagtgggaggacgccgtgcacatcatccccgagaacgagagcgacgacgaggaggaggaggagaagggccccgtgagccccagaaacctgcaggagagcgaggaggaggaggtgccccaggagagctgggacgagggctacagcaccctgagcatcccccccgagatgaccagcgtgggcagcagcgagaagggcggccccagaggcaacagaagccaggcccagcagggcgccgccggctag

SEQ ID NO: 25657 - DNA, 11424 bp, Artificial Sequence
  Description of Artificial Sequence: Synthetic coding sequence
tgacccggccccaccagcagcgccaccaacgtgagcatggtggtgagcgccggccccctgagcagcgagaaggccgagatgaacatcctggagatcaacgagaagctgcacccccagctggccgagaagaagcagcagttcagaaacctgaaggagagatgcttcgtgacccagctggccggcttcctggccaaccagcagaagaagtacaagtacgaggagtgcaaggacctgatcaagagcatgctgagaaacgagagacagttcaaggaggagaagctggccgagcagctgaagcaggccgaggagctgagacagtacaaggtgctggtgcacgcccaggagagagagctgacccagctgagagagaagctgagagagggcagagacgccagcagaagcctgaacgagcacctgcaggccctgctgacccccgacgagcccgacaagagccagggccaggacctgcaggagcagctggccgagggctgcagactggcccagcacctggtgcagaagctgagccccgagaacgacaacgacgacgacgaggacgtgcaggtggagctggccgagaaggtgcagaagagcagcgcccccagagagatgcagaaggccgaggagaaggaggtgcccgaggacagccaggaggagtgcgccatcacctacagcaacagccacggcccctacgacagcaaccagccccacagaaagaccaagatcaccttcgaggaggacaaggtggacagcaccctgatcggcagcagcagccacgtggagtgggaggacgccgtgcacatcatccccgagaacgagagcgacgacgaggaggaggaggagaagggccccgtgagccccagaaacctgcaggagagcgaggaggaggaggtgccccaggagagctgggacgagggctacagcaccctgagcatcccccccgagatgctggccagctaccagagctacagcagcaccttccacagcctggaggagcagcaggtgtgcatggccgtggacatcggcagacacagatgggaccaggtgaagaaggaggaccaggaggccaccggccccagactgagcagagagctgctggacgagaagggccccgaggtgctgcaggacagcctggacagatgctacagcacccccagcggctgcctggagctgaccgacagctgccagccctacagaagcgccttctacgtgctggagcagcagagaatcggcctggccgtggacatggacgagatcgagaagtaccaggaggtggaggaggaccaggaccccagctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaaccaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgagcagagagctgctggacgagaagggccccgaggtgctgcaggacagcctggacagatgctacagcacccccagcggctgcctggagctgaccgacagctgccagccctacagaagcgccttctacgtgctggagcagcagagagtgggcctggccgtggacatggacgagatcgagaagtaccaggaggtggaggaggaccaggaccccagctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaaccaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacgagatcgagaagtaccaggaggtggaggaggaccaggaccccagctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaaccaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaaccaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaaccaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaaccaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgagcagagagctgctggacgagaagggccccgaggtgctgcaggacagcctggacagatgctacagcacccccagcggctgcctggagctgaccgacagctgccagccctacagaagcgccttctacgtgctggagcagcagagagtgggcctggccgtggacatggacgagatcgagaagtaccaggaggtggaggaggaccaggaccccagctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaaccaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgagcagagagctgctggacgagaagggccccgaggtgctgcaggacagcctggacagatgctacagcacccccagcggctgcctggagctgaccgacagctgccagccctacagaagcgccttctacgtgctggagcagcagagagtgggcctggccgtggacatggacgagatcgagaagtaccaggaggtggaggaggaccaggaccccagctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaaccaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgagcagagagctgctggacgagaagggccccgaggtgctgcaggacagcctggacagaagctacagcacccccagcggctgcctggagctgaccgacagctgccagccctacagaagcgccttctacgtgctggagcagcagagagtgggcctggccgtggacatggacgagatcgagaagtaccaggaggtggaggaggaccaggaccccagctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaaccaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgagcagagagctgctggacgagaagggccccgaggtgctgcaggacagcctggacagatgctacagcacccccagcggctgcctggagctgaccgacagctgccagccctacagaagcgccttctacgtgctggagcagcagagagtgggcctggccgtggacatggacgagatcgagaagtaccaggaggtggaggaggaccaggaccccagctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaaccaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaaccaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgagcagagagctgctggacgagaagggccccgaggtgctgcaggacagcctggacagatgctacagcacccccagcggctgcctggagctgaccgacagctgccagccctacagaagcgccttctacgtgctggagcagcagagagtgggcctggccgtggacatggacgagatcgagaagtaccaggaggtggaggaggaccaggaccccagctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaaccaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaaccaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaaccaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaaccaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgagcagagagctgctggacgagaagggccccgaggtgctgcaggacagcctggacagaagctacagcacccccagcggctgcctggagctgaccgacagctgccagccctacagaagcgccttctacgtgctggagcagcagagagtgggcctggccgtggacatggacgagatcgagaagtaccaggaggtggaggaggaccaggaccccagctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaaccaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgagcagagagctgctggacgagaagggccccgaggtgctgcaggacagcctggacagatgctacagcacccccagcggctgcctggagctgaccgacagctgccagccctacagaagcgccttctacgtgctggagcagcagagagtgggcctggccgtggacatggacggcgagtacctgagcatgaaggtgatcagaatccactag

SEQ ID NO: 25658 - DNA, 258 bp, Artificial Sequence
  Description of Artificial Sequence: Synthetic coding sequence
gagatgcagaaggccgaggagaaggaggtgcccgaggacagccaggaggagtgcgccatcacctacagcaacagccacggcccctacgacagcaaccagccccacagaaagaccaagatcaccttcgaggaggacaaggtggacagcaccctgatcggcagcagcagccacgtggagtgggaggacgccgtgcacatcatccccgagaacgagagcgacgacgaggaggaggaggagaagggccccgtgagcccctag

SEQ ID NO: 25659 - DNA, 753 bp, Artificial Sequence
  Description of Artificial Sequence: Synthetic coding sequence
gagatcgagaagtaccaggaggtggaggaggaccaggaccccagctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaaccaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgagcagagagctgctggacgagaagggccccgaggtgctgcaggacagcctggacagatgctacagcacccccagcggctgcctggagctgaccgacagctgccagccctacagaagcgccttctacgtgctggagcagcagagagtgggcctggccgtggacatggacggcgagtacctgagcatgtag

SEQ ID NO: 25660 - DNA, 300 bp, Artificial Sequence
  Description of Artificial Sequence: Synthetic coding sequence
atgagacccaagaccctgagaaacagcgccgccagaagcagaaaggagcccggcttcctgaaccaccacatggagggcagctgcctgcagctgggcgagctgagcagcgtgggctactggatggagagccacagcgtgacccaggccggcgtgcagtggtgcagcttcggcagcctgcagccccccccccccagattcaagcccttcagctgcctgagcctgcccagcagctgggactacagaagaaagaagggcagctggctgggcagcaagctggagttccccatgctgtgcggctag

SEQ ID NO: 25661 - DNA, 300 bp, Artificial Sequence; identical to SEQ ID NO: 25660
  Description of Artificial Sequence: Synthetic coding sequence

SEQ ID NO: 25662 - DNA, 321 bp, Artificial Sequence
  Description of Artificial Sequence: Synthetic coding sequence
atgagacccaagaccctgagaaacagcgccgccagaagcagaaaggagcccggcttcctgaaccaccacatggagggcagctgcctgcagctgggcgagctgagcagcgtgggctactggtggcccttcggccaccccggccccgcccagggccacctgcccgtggccgtgtgggccagctgggtggtggccggcatcagcatcgccctgtacctgcccccccaccccgagggcagatacgagggccccttcaagagacacaccaagaccttcagaagcgcccagtgcgccgactgcctgacctgcgccctggagccctag

SEQ ID NO: 25663 - DNA, 453 bp, Artificial Sequence
  Description of Artificial Sequence: Synthetic coding sequence
atggagaacaaccccagccacaaccccgtgagccccagccccttccccaccagaatcagcgcccccctgaacatgagccagagccacttcagagagaactggctgatgctgaagaagagcctggagggcaagctgtgccccagcagctgcggcagcctgaagtgcagagccagcagaagccccagcgtgggcaccggccccagcctgcccatcgagtgcttcctgtacatgaagacctggagcagcctgcagatgaccgtggccagcgaggaggacaagagaagagagaagacccagaacgccggcctgcccctgttcttcgccagcaccgtgggcaccgtgaccctgcccagcttccaccacctgcagctgcacacccacacccacaccctggtgccccagagcctgttcggcacctgcctgaccgcccacctggagaccagatggagctag

SEQ ID NO: 25664 - DNA, 486 bp, Artificial Sequence
  Description of Artificial Sequence: Synthetic coding sequence
atgggccacagacccaacctgggccagcccccccaccccaacgccgtggccgccgccctgcacgccagcctgtgccccgccaacagaggcacctgccccctgggcaagcccggctaccccggctgcctgtggttccagcccctgctgctgttccccggctgcctgtgcagccccgacggccccttccccagagccgtgttcaccagcgccggcaagggccccctgcagaccgacctgggcagaggcagagtgccccccagagaccagcagacccccaagagcagaccctgccccagagcccccgtggccagcaacagacagagcggcggcagcgccgtgagcgcccccctgagcggcgccagaagagcctggaagagcgccttcgccgccccccccagaagcagactgagaccccagaagggcgtgccctggaccgagaagagagccagaggcggcggcagagccggcccctgcagaagaacctag

SEQ ID NO: 25665 - DNA, 321 bp, Artificial Sequence
  Description of Artificial Sequence: Synthetic coding sequence
atgcacagcagaccctgggcctggggcgccagcgagatgtgcttctgcttcttcgagatgggcagcttctgctgccccagcagaagcaccgtggccagaagccagctgaccgccgccagcaccagctgggcccaggtgatcctgcccccccagccccccgagtgcctgctgctggtgttcatgatgacctggggccccggcatcctgcacctgtgctgcagcggcgccagccccgcccccggcgcccaccagccccagctgagaagagaggccctgatctgcagagccaagcagctgtgcttccacgtggaccccgcctag

SEQ ID NO: 25666 - DNA, 246 bp, Artificial Sequence
  Description of Artificial Sequence: Synthetic coding sequence
atgtgcagctgggaggtgaccaccccccagggcctgggcaccagcagcgccagcgaggagagcctgaccgacgaccacagactgctgaaggtgatcagccagggcagcttcgccgaggtgaaggccgccggccccgcccacagccactgggaccaggacggctgcggcggccaccccaacagagccgccggcctgctgcagccccccggcagcgtgctgcagggcccctacgacgagggcccctag

SEQ ID NO: 25667 - DNA, 720 bp, Artificial Sequence
  Description of Artificial Sequence: Synthetic coding sequence
atgagcgaccccgagggcgagaccctgagaagcaccttccccagctacatggccgagggcgagagactgtacctgtgcggcgagttcagcaaggccgcccagagcttcagcaacgccctgtacctgcaggacggcgacaagaactgcctggtggccagaagcaagtgcttcctgaagatgggcgacctggagagaagcctgaaggacgccgaggccagcctgcagagcgaccccgccttctgcaagggcatcctgcagaaggccgagaccctgtacaccatgggcgacttcgagttcgccctggtgttctaccacagaggctacaagctgagacccgacagagagttcagagtgggcatccagaaggcccaggaggccatcaacaacagcgtgggcagccccagcagcatcaagctggagaacaagggcgacctgagcttcctgagcaagcaggccgagaacatcaaggcccagcagaagccccagcccatgaagcacctgctgcaccccaccaagggcgagcccaagtggaaggccagcctgaagagcgagaagaccgtgagacagctgctgggcgagctgtacgtggacaaggagtacctggagaagctgctgctggacgaggtgaccttcctgatgcagaacagagagcccctgaccaccctggccgagttcctgcccgagctgggcaacagcagcaagcccctgaccagagagtag

SEQ ID NO: 25668 - DNA, 516 bp, Artificial Sequence
  Description of Artificial Sequence: Synthetic coding sequence
atgctgaccagcaagctgagaagcaccctgcagaccctgcagggcctgggcctgaccagcagctgcctgctggacatcttcagcagcgtgagcacccacatcagaaacctgccctgcctgaacctgaccctggccagcagctgcctgcagagaatccagatcatgcagggcgccggcagaaagagaaacagaggcagagccgagaagcagaaggcctgcgccatcagcttccaggtggacttcagcaagctgcacatcctgggcgccggcagaggcagaatcctggaggagaagcagggcatcctggtgagacaggccaacgccgactgcctgagagacctgggcctgaagagcgccttcgagctggccttcagaagaagcagcctggtgttcagccccagagccaagggcctgaagagcagcgccgaggacagaagatggcccctgttctggcagaacatggtgagcatcttcggcgccagatgcaaggccagcagcgcccagaccagctgctag

SEQ ID NO: 25669 - DNA, 1218 bp, Artificial Sequence
  Description of Artificial Sequence: Synthetic coding sequence
atgcacatcaacagcctgcacatgcagctgaacagccacagaatctgcaacagcacccacaccgtgtacgccaaccagctggccctgagaatgcagctgaacagccactgcgtgtgcaacagcaccagaaccgcctacgccaaccccctgaccgcctacgccacccagctggccctgagaatgcagctgagcagcctgtgcgtgtgcaaccccgccagaagcgcctacgccacccaggtggccctgagaatgcagctgagcagcctgtgcgtgtgcaacagcgccagaaccgcctacgccacccagctggccctgagaatgcaggtgagcagcctgtgcgtgtgcaacagcgccagaagcgcctacgccacccagctggccctgagaatgcagctgagcagccactgcgtgtgcaacagcgccagaagcgcctacgccacccagctggccctgagaatgcagctgagcagcctgtgcgtgtgcaacagcgccagaaccgcctacgccaccagaaccgcctacgccacccagctggccctgagaatgcagctgaacagccactgcgtgtgcaacagcaccagaaccgcctgcgccacccagctgaccctgagaatgcagctgagcctgctgtgcgtgtgcaacagcaccagaaccgcctacgccaaccagctgaccgcctacgccacccagctggccctgcacatgcagagaaacagcacccacaccgcctacgccacccagctgaccctgtacgccacccagctggccctgcacatgcagttcaacagccactgcgtgtgcaagagcacctactgcatctgcaacagcacccactgcgtgtgcaacagcaccagaaccgcctacgccacccagctggccctgagaatgcagctgaacagccactgcgtgtgcaacagcgccagaaccgcctacgccacccagctgctgcaggtgctgatcagcggccacttcctgttcctgaccaccacccccagccagtacttcagcagcctgaagagcgcccaggacgaggccctggacagcagaacctgctgcatgcccctgggcctgctggaggtgtgcagactggccagccccagactgcaccccgccctgagctgcctgagctgcgagaaccccgtggccagcgccagccccggcagcgacttctgcctgctgcccagcagcgccgcccccctgggcccctgcctggagtag

SEQ ID NO: 25670 - DNA, 411 bp, Artificial Sequence
  Description of Artificial Sequence: Synthetic coding sequence
atgagacaggaggtggagggcagaggcagaggcagccacgagctgatcatcaccgacaagagatgcggcgtgtgcggcggcagcctgagctgcatcgtgtacctgtgcatcagcctgaacttcagcagaatcaagaagctgaagaagtacacctggcccggccccaccagagacagccccaacgccagcctgcagcccggcagagccaagttcgccttcagccacgccagccacacccccctgcacagccagctgggcgccctgcagaccggcaagccccaggccctgctggccagcgccaaccccctgagcagaagcatgggcccccccgaccaccacctgaccaccctgatcctgatcagcctggagacccccttccccggcctgctgagcagcggctgcttcccctag

SEQ ID NO: 25671 - DNA, 1008 bp, Artificial Sequence
  Description of Artificial Sequence: Synthetic coding sequence
atgcagctgctgggcctgctgggcctgctgtggatgctgaaggccagcccctgggccaccggcaccctgagcaccgccaccagcatcagccaggtgcccttccccagagccgaggccgccagcgccgtgctgagcaacagcccccacagcagagacctggccggctggcccctgggcgtgccccagctggccagccccgcccccggccacagagagaacgcccccatgaccctgaccaccagcccccacgacaccctgatcagcgagaccctgctgaacagccccgtgagcagcaacaccagcaccacccccaccagcaagttcgccttcaaggtggagaccaccccccccaccgtgctggtgtacagcgccaccaccgagtgcgtgtaccccaccagcttcatcatcaccatcagccaccccaccagcatctgcgtgaccaccacccaggtggccttcaccagcagctacaccagcacccccgtgacccagaagcccgtgaccaccgtgaccagcacctacagcatgaccaccaccgagaagggcaccagcgccatgaccagcagccccagcaccaccaccgccagagagacccccatcgtgaccgtgacccccagcagcgtgagcgccaccgacaccaccttccacaccaccatcagcagcaccaccagaaccaccgagagaacccccctgcccaccggcagcatccacaccaccaccagccccacccccgtgttcaccaccctgaagaccgccgtgaccagcaccagccccatcaccagcagcatcaccagcaccaacaccgtgaccagcatgaccaccaccgccagccagcccaccgccaccaacaccctgagcagccccaccagaaccatcctgagcagcacccccgtgctgagcaccgagaccatcaccagcggcatcaccaacaccacccccctgagcaccctggtgaccaccctgcccaccaccatcagcagaagcacccccaccagcgagaccacctag

SEQ ID NO: 25672 - DNA, 432 bp, Artificial Sequence
  Description of Artificial Sequence: Synthetic coding sequence
atgagactgcagaagaccagatgcggcagcgccgccagcccccccaacaagcagcagaccgagctgcccgccttcagcgtgatgcccagacccgccggccagcacgtgtggccctggagaggcgagagaatgagactgcccggcgccgccagcagcctgttcagcaactacttcagcctgccctacgtgatctacctgagcatcagcgacctgaacgtggagtgcctgatcttcagcgtgttcgacagccagcaggtgcacaccagctaccagagcaacggcctgcacagaaacggcatgttccacgactgcctggaggtgagcaagcaccccttcctgggcctgaccctgaccctgtggctgtgcgacctgagcagcagcggcttctacatgagcggccacgagcccctgtggaacctgagccccctgtag

SEQ ID NO: 25673 - DNA, 633 bp, Artificial Sequence
  Description of Artificial Sequence: Synthetic coding sequence
atgagcagagccggcagccaccccaagcccgccatccccggcagaggcggcgagaagctggccctgctgctggccatgctgggcggcagatgctgccccgccggcggccccgagagccacacccccagaaagccctggccccccatcagaagagagagacccggcctgagaagccccaagcccagagaggaggccggccccagagccgacagcaaggccgccagccccgccctgttcatgggccccggcagcagaggcagaagaagaccccccagctgggccagaagaagagccagaggcggcagaggcagctgccccgagccccacgtgagagccggccccagattcttcatcgccctggccgcccccgccgccagaggcctgagagtgagcagccagggccccggcctgtggagaggccccgccgccagaaaggagggcgtggccagagtgggcgtggccgccggcctgagactgagacccagaggcagaggcagaaagaccacccccgccctgagcggccaccccgccagattccccctgcagcccggcgacagcagagagagaagcagaaaccacagagccctggagctgacctggcagcccagaggcgccaaggccggcggcgcctag

SEQ ID NO: 25674 - DNA, 633 bp, Artificial Sequence
  Description of Artificial Sequence: Synthetic coding sequence
atgagcagagccggcagccaccccaagcccgccatccccggcagaggcggcgagaagctggccctgctgctggccatgctgggcggcagatgctgccccgccggcggccccgagagccacacccccagaaagccctggccccccatcagaagagagagacccggcctgagaagccccaagcccagagaggaggccggccccagagccgacagcaaggccgccagccccgccctgttcatgggccccggcagcagaggcagaagaagaccccccagctgggccagaagaagagccagaggcggcagaggcagctgccccgagccccacgtgagagccggccccagattcttcatcgccctggccgcccaggccgccagaggcctgagagtgagcagccagggccccggcctgtggagaggccccgccgccagaaaggagggcgtggccagagtgggcgtggccgccggcctgagactgagacccagaggcagaggcagaaagaccacccccgccctgagcggccaccccgccagattccccctgcagcccggcgacagcagagagagaagcagaaaccacagagccctggagctgacctggcagcccagaggcgccaaggccggcggcgcctag

SEQ ID NO: 25675 - DNA, 1881 bp, Artificial Sequence
  Description of Artificial Sequence: Synthetic coding sequence
atgaagatgcagaagggcaacgtgctgctgatgttcggcctgctgctgcacctggaggccgccaccaacagcaacgagaccagcaccagcgccaacaccggcagcagcgtgatcagcagcggcgccagcaccgccaccaacagcggcagcagcgtgaccagcagcggcgtgagcaccgccaccatcagcggcagcagcgtgaccagcaacggcgtgagcatcgtgaccaacagcgagttccacaccaccagcagcggcatcagcaccgccaccaacagcgagttcagcaccgccagcagcggcatcagcatcgccaccaacagcgagagcagcaccaccagcagcggcgccagcaccgccaccaacagcgagagcagcacccccagcagcggcgccagcaccgtgaccaacagcggcagcagcgtgaccagcagcggcgccagcaccgccaccaacagcgagagcagcaccgtgagcagcagagccagcaccgccaccaacagcgagagcagcaccctgagcagcggcgccagcaccgccaccaacagcgacagcagcaccaccagcagcggcgccagcaccgccaccaacagcgagagcagcaccaccagcagcggcgccagcaccgccaccaacagcgagagcagcaccgtgagcagcagagccagcaccgccaccaacagcgagagcagcaccaccagcagcggcgccagcaccgccaccaacagcgagagcagaaccaccagcaacggcgccggcaccgccaccaacagcgagagcagcaccaccagcagcggcgccagcaccgccaccaacagcgacagcagcaccgtgagcagcggcgccagcaccgccaccaacagcgagagcagcaccaccagcagcggcgccagcaccgccaccaacagcgacagcagcaccaccagcagcggcgccggcaccgccaccaacagcgagagcagcaccaccagcagcggcgccagcaccgccaccaacagcgagagcagcaccaccagcagcggcgccagcaccgccaccaacagcgacagcagcaccaccagcagcggcgccggcaccgccaccaacagcgagagcagcaccgtgagcagcggcatcagcaccgtgaccaacagcgagagcagcacccccagcagcggcgccaacaccgccaccaacagcgagagcagcaccaccagcagcggcgccaacaccgccaccaacagcgagagcagcaccgtgagcagcggcgccagcaccgccaccaacagcgagagcagcaccaccagcagcggcgtgagcaccgccaccaacagcgagagcagcaccaccagcagcggcgccagcaccgccaccaacagcgacagcagcaccaccagcagcgaggccagcaccgccaccaacagcgagagcagcaccgtgagcagcggcatcagcaccgtgaccaacagcgagagcagcaccaccagcagcggcgccaacaccgccaccaacagcggcagcagcgtgaccagcgccggcagcggcaccgccgccctgaccggcatgcacaccaccagccacagcgccagcaccgccgtgagcgaggccaagcccggcggcagcctggtgccctgggagatcttcctgatcaccctggtgagcgtggtggccgccgtgggcctgttcgccggcctgttcttctgcgtgagaaacagcctgagcctgagaaacaccttcaacaccgccgtgtaccacccccacggcctgaaccacggcctgggccccggccccggcggcaaccacggcgccccccacagacccagatggagccccaactggttctggagaagacccgtgagcagcatcgccatggagatgagcggcagaaacagcggcccctag

SEQ ID NO: 25676 - DNA, 393 bp, Artificial Sequence
  Description of Artificial Sequence: Synthetic coding sequence
atggagggcagagaggtgtacctgtggtacagcgtggacagcagaggcgacttcctggtgttcctgtgccccatcttcttcagcttcagcttcagcgaggtggagagcctgagccccagactggagtgcagcggcaccatcagcgcccactgcaacctgtgcctgctgggcagcagctacagccccgccagcgccagcagagtgaccggcatcaccggcatgtgccaccacgcccagctgatcttcgtgttcctggtggagatggagttcagacacgtgggccagaccagcttcgagctgctggccagcagcagcccccccgccagcgccagccagagcgccggcatcaccggcgtgagccactgcgcctggcccctggcccagtacctgtag

SEQ ID NO: 25677 - DNA, 459 bp, Artificial Sequence
  Description of Artificial Sequence: Synthetic coding sequence
atgcccgacctgaagatgcaggaggtgaagaagatctgctacgagctggccctggcctacttccaccacggccaggccgagatcgaggccctggccaccctgaaggtgtgggagctgtgccacacctacggcaagcccgagggccccagagacgcctggagagccgtggccagagacttctgggacaccgtgggcgaggaggagggcggcggcgccggcagcggcggcggcagcgaggagggcaccagaggcgtggaggtggaggacctgcaggcccacatctgcaagctgatgggcatcctgcagcaggtgaagctgcagaacagcagcaaggactgggagctgcaggccctgcaggacagaatggtgtgcatggagagaatcatccccctggcccaggaccacgaggacgagaacgaggagggcggcgagttccactgggccccccccgagggctag

SEQ ID NO: 25678 - DNA, 498 bp, Artificial Sequence
  Description of Artificial Sequence: Synthetic coding sequence
atgagccacccccaggccaccagcaacctgcagcacaccgtgagcaacagcgacaacatcggcagcagcgccggcagatggacctgggtgcccctgacctggaccgacaccagcaagatgagcatgagaggcctgctggacctgttcagcttccacagctgcatcctgaagaacggcagcgagcccgaggagccccaggacagcgccaagaccgacacccagctgagccccgccaccctggccctggagagagaggagcacagcagcagacacgtgcccagcgtgctgagcaagaccatgagcagagccagcgccgagctgacctgcaccgccggcagacagggccccggcccccccggcagccacagccaggccccccacatgctgccccagcccgagcccctgctggcctgcgcccccgccatgtggtgcagaagagagccccagcccatcggcggcctgcagcccccccacctgagactgcacctggagagctag

SEQ ID NO: 25679 - DNA, 375 bp, Artificial Sequence
  Description of Artificial Sequence: Synthetic coding sequence
atgctgcccagcaaggccttcgagttcgccaccgtgaagagcatgcacggcatcttcggctgcggcctggccctgccccccgtgttcgccgccgagctgctgtacctgaccagagcctgcgccagcgacgagcagcccttcatcaccgccctgagacccccccccagacccccccccagcgccctgcagttcatcagcagactggtgcccatcgccacctgcggcctgggcggcccccccgacatcctgagcttcggcagccccgtgacccccgagctgctgcccttctggggcgcccacatctgcgacaccctggtgtgccccgtgcacttcctgcacctggagttcctgagctgcagccacatcagcatctag

SEQ ID NO: 25680 - DNA, 267 bp, Artificial Sequence
  Description of Artificial Sequence: Synthetic coding sequence
atgagaagccagggccagggcggccccggcgcctggagaagaatggagagctggagcgccgagcccgccggccccggccagggcagactgggcagcccctgcgaggccgccgagcaggccagcttcgagaagaccgtgatcggcgtgggccaggccagagccgccctgagcgaggaggagcacagagtgtgggaggccgccgccggcgtgggcggcctggagcagtggggctgctgggaggccggcgtgaccagcggctggggctag

SEQ ID NO: 25681 - DNA, 447 bp, Artificial Sequence
  Description of Artificial Sequence: Synthetic coding sequence
atgagcagcttcgtggtggtgatgggcttcctggtggagatgaccagcagaaagaagaacaacgtgaaggaggaggagatggagtgcgccgtgacctacctgagaaagggcggcggcatctgcagcttctacttctacttctacctgttcttcatcttcatctacctgttcttcctgagatggagcctggccctgagccccagactggagtggagcggcgccatcagcgcccactgcaacctgagactgcccggcagctgccacagcagcgccagcgccagcagagtggccggcaccaccggcgccagacaccacgccctgctgatcttctacatcttcagcagagacggcgtgagcccctggagcagaagcccccacctggtggtgtgccccccctggccccccaaggtgctgggcctgcaggcccccgccaccacccccggctag

SEQ ID NO: 25682 - DNA, 375 bp, Artificial Sequence
  Description of Artificial Sequence: Synthetic coding sequence
atgaccctgaacgagcacgccgccttcaagcacctgttcaacaaggcccacctggccccccccctgatccacctgaccctgagcggccacagcacctgcttcagagagcacagagtgggcggcaaggtgaccgaccagcaggaccccaaggccgaggagttcttcctggtgcagaacaagatgaagagcctgccctgcctgctgctgagcacccagaccagacagcccagcgacttcagcatcttcagcccccccttcccccccgtgtacagcaccaagccccccctgagcagctggcccgtgctgaacgagctgctgggcaccccccccagaagaggcggcggcagagccgagggcctgctgaccagccagtag

SEQ ID NO: 25683 - DNA, 429 bp, Artificial Sequence
  Description of Artificial Sequence: Synthetic coding sequence
atgagaatcagaaccagcttcttcatgagcgccgccctgggcggcagacccccccccgccagaaccgagtggacccccctgaccagaagcacccaccccaccgccccccccgccagcctgttcggcagaagaggcccccccagaagacccctgagctgcttccccgccagagagcccggccagagacagctgagactgctgagacccagcggcctgtggagaagaagaagaagaagaagaagaagaagaagaagaagaagaagaagaggcagaagacacgccgccagagacaccagattcagaaacgccaacgccctgtgcgccggcaccgccctgcccctgagcggcagaagaagcgccggccccggcagcctggcccacccccccctgggcaccgccacccccgagaccctgggccccggcatctag

SEQ ID NO: 25684 - DNA, 1977 bp, Artificial Sequence
  Description of Artificial Sequence: Synthetic coding sequence
ctgaagaccccccccgagtgcgtgctgacccccctgccccccagcgccgacgacaacctgaagaccccccccgagtgcgtgctgacccccctgccccccagcgccgacgacaacctgaagaccccccccgagtgcctgctgacccccctgccccccagcgccgacgacaacctgaagaccccccccgagtgcctgctgacccccctgccccccagcgccgacgacaacctgaagaccccccccgagtgcctgctgaccccccccccccccagcgccgacgacaacctgaagaccagagccgagtgcctgctgcaccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccttccacccccagagaatgatcatcagcagacacctgcccagcgtgagcagcctgcccttccacccccagctgcacagccagcagatgatcatcagcagatacctgctgagcgtgtgcggcttcagattccaccaccagcccatgatcatcagcagacacctgcccagcgtgagcagcctgcccttccacccccagctgcacccccagcagatgatcatcagcagacacctgcccagcgtgtgcggcggcagattccacccccagagaatgatcatcagcagacacctgcccagcgtgagcagcctgcccttccacccccagctgcacccccagcagatgatcatcagcagacacctgcccagcgtgtgcggcggcagattccacccccagagaatgatcatcagcagacacctgcccagcgtgagcagcctgcccttccacccccagctgcacccccagcagatgatcatcagcagacacctgcccagcgtgtgcggcggcagattccacccccagagaatgatcatcagcagacacctgcccagcgtgagcagcctgcccttccacccccagctgcacccccagcagatgatcatcagcagacacctgcccagcgtgtgcggcgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagaccccccccctggccacccaggaggccgaggccgagaagcccagaaagcccaagagacagagagccgccgagatggagcccccccccgagcccaagagaagaagagtgggcgacgtggagcccagcagaaagcccaagagaagaagagccgccgacgtggagcccagcagccccgagcccaagagaagaagagtgggcgacgtggagcccagcagaaagcccaagagaagaagagccgccgacgtggagcccagcagccccgagcccaagagaagaagagtgggcgacgtggagcccagcagaaagcccaagagaagaagagccgccgacgtggagcccagcctgcccgagcccaagagaagaagactgagctag

SEQ ID NO: 25685 - DNA, 588 bp, Artificial Sequence
  Description of Artificial Sequence: Synthetic coding sequence
atgaacagcgtgttcagacagcccggcagcaacttcagcttccccatctaccagcccagcgccagcgtgacccacggcctgagcttcttctgcgaggtgagcccccagatgctgaccccccaggactacagaggcaagcagcagggccacagaggctgccccggctgcatggtggccatggacacctggcccgccgtgctgcccgagctgcccggcttctggggcgagggcagcggcggccaggcctggggcgccagaggcgagcccctgctgcagaaggccaactgcctgctggaggccgtgagactgttcctgaactacagacccctgggcgccgagggcggcgagctgaccttcggcaagagactgctggtgcccaccgccgtgagctgcgcctacgactgcgtgagcagcagcgccttcctgggcatccagctgctgggcgaccccaccagaagccccggccactgctacagacaggacttcaacggcaccctgagactgagagagggcaagggcctggtgcagagccacaccggcaccctgtgggccggccccctgcaggagggcacccagggccagacctag

SEQ ID NO: 25686 - DNA, 453 bp, Artificial Sequence
  Description of Artificial Sequence: Synthetic coding sequence
atggccgtgagcagaatgagcaagtggagactgagcagagtgggcggcagcagaagcctgcccgccgagatggaggtgctgggcgaggtgtggtgcgtgagagccgaggagcagcccatgaccggcctgggcatcgtgtggcacagccccctggacaaggccctggagacctggagcctgcagcagcagcccgacttcagcctgggcctgggccacctgggcctgggcaccgacgccacctggatgcagagcttccccggcagcggcggcgacgcccaggccggcaccggcgtgagcggccccctgagactgtaccccaacctgctgtgcgacttcggccccagacagggccccctgtgggccctgctgctggagaagagacagatggccggcaccggcggcagccccgccctgctggcctggagaagcgccagctggagagccctgggctag

SEQ ID NO: 25687 - DNA, 342 bp, Artificial Sequence
  Description of Artificial Sequence: Synthetic coding sequence
atggccgtgagcagaatgagcaagtggagactgagcagagtgggcggcagcagaagcctgcccgccgagatggaggtgctgggcgaggtgtggtgcgtgagagccgaggagcagcccatgaccggcctgggcatcgtgtggcacagccccctggacaaggccctggagacctggagcctgcagcagcagcccgacttcagcctgggcctgggccacctgggcctgggcctgtacatcctggccagctacctgctgtgccccagacagccccccagccagcccgacggcccctgcggcagccccaaccccgtgagcggcgccaagaagaccaccgtggcctag

SEQ ID NO: 25688 - DNA, 228 bp, Artificial Sequence
  Description of Artificial Sequence: Synthetic coding sequence
atgcacatctacttcaccgccgagctgctgaagagaagaaacgccaagcccaccttcagcatgagcagcatgcaggccgccagaagcatccccaagagcatgaacgtgcacagcatgcccagcttcctgtacagcagctgcagcagcaccaacatgtggtggctgaagaactgctgcagcttcagcctggtgaagctgatgcacagctgcagcagactgctgaactag

SEQ ID NO: 25689 - DNA, 561 bp, Artificial Sequence
  Description of Artificial Sequence: Synthetic coding sequence
atgtggaaccagcagggcagacccggcatcagaaaccagttcagcctgttcttcttcctgacccagagcctggccctgagcctgagactggagtgcagcggcgccatcagcgaccactgcaacctgagactgctgggcagcagcgacagcagcgccagcgccagcagagtggccggcatcatcgacgtgagacacatgcccggccagcacggcgagaccctgagcctgctgaagatccagaagctggccggctgcggcggcagccacctgtacagccagctgctgggcagactgaagtgggaggacggcctgagcagcggcggcagaggctgcagcgagctgagaggcagacactgcgcccccggctgggtgaccgccagactgtgcctgaagaagaagaagaagagaggcggcggcaagaccaagctgtacagcgtgggcctggagttcaacatctggaaggtggacatctggaacgccctggtgcccctggacctgtggttcagcctgaagggcgagagcagaaccatcgtgctggagagcagcgaggtgagaacctag

SEQ ID NO: 25690 - DNA, 459 bp, Artificial Sequence
  Description of Artificial Sequence: Synthetic coding sequence
atgcccagccagccccacctgagcgcctgcagcgtggagagccccggcgccgccgccagactgacccagagacacctgaccggcgtggccagaggcggcggccagaccggcaccttccacatgggcctgctgcccagcagacaggagtgcgcccccgtgagcgccctgaccctgaccaccaccatgggcagactgttcagcgtgcactggcagatctggggcccctgcagcccctgcatcgtgtaccccaagggcgacagcgagcagagcgccagcaagagcaagcaggccttccccctgctgctgagaaagggcatggagtggcccctgagcgcctggctggagagcagcagccccgccccctgcatgcccctgtggagaagaaacagcttctgggagagcagacccagcccctgcagaatcagaggcctgtgcagcatgagaccccacggcctgtag

SEQ ID NO: 25691 - DNA, 84 bp, Artificial Sequence
  Description of Artificial Sequence: Synthetic coding sequence
atgagccccgccctgaccttccccagaagatggatcgccgagggcctggtggagaacctgaacccccccggcgccgacgcctag

SEQ ID NO: 25692 - DNA, 159 bp, Artificial Sequence
  Description of Artificial Sequence: Synthetic coding sequence
atggccgccagaagcctggccagaagagccctgagagtggccggcggcgacgccagaagcggcggccccgtggccagagacacccagctgggcgcccagtggagatggatcgccgagggcctggtggagaacctgaacccccccggcgccgacgcctag

SEQ ID NO: 25693 - DNA, 381 bp, Artificial Sequence
  Description of Artificial Sequence: Synthetic coding sequence
atgcccaacttcgccaagagcctgttcatccaccccatcaacttcttcctgctgttcagcaccgagttctgcagcgtgagccaggccggcgtgcagtggagagacctgggcagcctgcagcccctgcccagcagattcaacagagtgagctgcctgagcctgcccagcagctgggactacagactgatgcccgtgatccccgccctgtgggaggccaaggccggcggcagccccgaggtgagaggcagcagactggcctggagcaagtggcagaaccccgtgagcaccaagaacaccaagaagccccagaactgccccggcatggtggcccacgcctgcagccccaactacagcggcggcggcggcagaagaatcacctag

SEQ ID NO: 25694 - DNA, 501 bp, Artificial Sequence
  Description of Artificial Sequence: Synthetic coding sequence
atgaccgccggcaccgtggtgatcaccggcggcatcctggccaccgtgatcctgctgtgcatcatcgccgtgctgtgctactgcagactgcagtactactgctgcaagaaggacgagagcgaggaggacgaggaggagcccgacttcgccgtgcacagccacctgccccccctgcacagcaacagaaacctggtgctgaccaacggccccgccctgtaccccaccgccagcaccagcttcagccagaagagcccccaggccagagccctgtgcagaagctgcagccactgcgagccccccaccttcttcctgcaggagccccccgaggaggaggaggacgtgctgaacggcggcgagagagtgctgtacaagagcgtgagccaggaggacgtggagctgcccagaggcgccttcggcggcctgcaggccctgaaccccaacagactgagcgccatgagagaggccttcgccagaagcagaagcatcagcaccgacgtgtag

SEQ ID NO: 25695 - DNA, 1164 bp, Artificial Sequence
  Description of Artificial Sequence: Synthetic coding sequence
atgtacagatggaagctgagcagccacgagccctgcagcgccacctgcaccaccggcgtgatgagcgcctacgccatgtgcgtgagatacgacggcgtggaggtggacgacagctactgcgacgccctgaccagacccgagcccgtgcacgagttctgcgccggcagagagtgccagcccagatgggagaccagcagctggagcgagtgcagcagaacctgcggcgagggctaccagttcagagtggtgagatgctggaagatgctgagccccggcttcgacagcagcgtgtacagcgacctgtgcgaggccgccgaggccgtgagacccgaggagagaaagacctgcagaaaccccgcctgcggcccccagtgggagatgagcgagtggagcgagtgcaccgccaagtgcggcgagagaagcgtggtgaccagagacatcagatgcagcgaggacgagaagctgtgcgaccccaacaccagacccgtgggcgagaagaactgcaccggccccccctgcgacagacagtggaccgtgagcgactggggcccctgcagcggcagctgcggccagggcagaaccatcagacacgtgtactgcaagaccagcgacggcagagtggtgcccgagagccagtgccagatggagaccaagcccctggccatccacccctgcggcgacaagaactgccccgcccactggctggcccaggactgggagagatgcaacaccacctgcggcagaggcgtgaagaagagactggtgctgtgcatggagctggccaacggcaagccccagaccagaagcggccccgagtgcggcctggccaagaagccccccgaggagagcacctgcttcgagagaccctgcttcaagtggtacaccagcccctggagcgagtgcaccaagacctgcggcgtgggcgtgagaatgagagacgtgaagtgctaccagggcaccgacatcgtgagaggctgcgaccccctggtgaagcccgtgggcagacaggcctgcgacctgcagccctgccccaccgagccccccgacgacagctgccaggaccagcccggcaccaactgcgccctggccatcaaggtgaacctgtgcggccactggtactacagcaaggcctgctgcagaagctgcagacccccccacagctag

SEQ ID NO: 25696 - DNA, 672 bp, Artificial Sequence
  Description of Artificial Sequence: Synthetic coding sequence
atgttccccgtgagcagcggctgcttccaggagcagcaggagaccaacaagagcctgcccagaagcgccagcacccccgagaccagaaccaagttcacccaggacaacctgtgccacgcccagagagagagactggacagcgccaacctgtgggtgctggtggactgcatcctgagagacaccagcgaggacctgggcctgcagtgcgacgccgtgaacctggccttcggcagaagatgcgaggagctggaggacgtgagacacaagctgcagcaccacctgcacaagatgctgagagagatcaccgaccaggagcacaacgtggtggccctgaaggaggccatcaaggacaaggaggagcccctgcacatcgcccagaccagactgtacctgctgagccacagacccaacatgcagctgtgcagagaggccgcccagttcagcgccgtgggcgaggccagcagaagaggcgccgtgcccctgcagcccagaggccacccccacgagcccggcgagggctgctacagacacgaccagcagagcctgcacagaccccccgaggtgcacggccccagctacctgctgcacccccaccccgccgccggctggctgcccgtgagcagcggcaccgtgctgccccccaacccccccaacaagcagtgcatcagctag

SEQ ID NO: 25697 - DNA, 390 bp, Artificial Sequence
  Description of Artificial Sequence: Synthetic coding sequence
atgttccccgtgagcagcggctgcttccaggagcagcaggagaccaacaagagcctgcccagaagcgccagcacccccgagaccagaaccaagttcacccaggacaacctgtgccacgcccagagagagagactggacagcgccaacctgtgggtgctggtggactgcatcctgagagacaccagcgaggacctgggcctgcagtgcgacgccgtgaacctggccttcggcagaagatgcgaggagctggaggacgccagacacaagctgcagcaccacctgcacaagatgctgagagagatcaccgaccaggagcacaacgtggtggccctgaaggaggccatcaaggacaaggaggagcccctgcacatcgcccagaccagactgtag

SEQ ID NO: 25698 - DNA, 528 bp, Artificial Sequence
  Description of Artificial Sequence: Synthetic coding sequence
atgagactgcccggcgcccccgccctgcccgacgccgacttcctggtgcacctgcacttcctggtgcagaccagctggttcatctgcaacttcctggtgagaatcccctgggccagcgccctgcccgacgcccccgccctgctggtgatcctggagaagaccttccccgagcacgccacctgcagaggctgctgggtgagcggctacctgtgctggaccgcccccggcaactgcatctgcagcgccaacgtgggcttcctgaagatcgagaacacctacagacagatccaccacacccacatgcacagacacacccacacccacaccgacaagagcatcacccacacctgcaccgacacccacacccagagccagagacacagactgaccagcagagccctgagactgttcatcctgaacgccatcaccgacaccagcaagttcggcgccgccgtgttcttctacgtgtactgcctgttcgccgacagcgtgtacaagttcttccccttcctgccccccttcagatag

SEQ ID NO: 25699 - DNA, 1941 bp, Artificial Sequence
  Description of Artificial Sequence: Synthetic coding sequence
atggaggtgatcaacctgaccaccctgcccatgatccccgtggacgagcacctggccgtgagcctggtggccagaaacaccatggtgaagaccgtgagaaaggagctggagaacaacccccccagctgcctgatcggcagcatgcaccaggtgaaccagaagatcgccgacatcaacctgagaaccgagcccagcgccaacagcctggccatcgagagattcgagctggagaagaaggccctgagagagaagaccagaagcagccccgaggacaaggtgaagagacagagaaagagccagtacagctgcaagggcagcgagctgagacacgccagaagcagcgtgatcaagagaaagaccgccgacaagaacctgctggccgagctgtaccagtacagcaacttcaacagcagcaagcccaacaagctgcccaacggcgtggacttctgcgacatggtgggcaacgtggtgagagccgagagagactgcctgagcggcaagcacttctgcagcggcagagagctggagaagttcctgagcagcagcagccccagagccatctggctggacagcttctggtggatcttccacgagagataccagcccaacaaggagctgcagaacaacctgttcgacagaatcgcccagcactacgccctgctgctgttcagagtgcccaagagccacagcgaggaggccctgctgaagagactgcccagcctgctgagcaaggccgtgtacaccagcttctgctgctgcttcccccagagctggttcgacacccacgagttcaagagcgacatctgcaacaccatgagcctgtggatcagcgtgggcacctaccccagcccccagagctacgacagctgggactacagcgagctggaccccgagagattcagaagagaggagctgatgctgtacagaagaagactgaccaagggcagagagttcagcctgttcgccggcaagagagccttcagccagaagcccgcccagagcagaaagttctaccacccccagagcagcagcgccaacagccccagcgagaagaccagcagcgccaagcagaacagcgagaagagcctgagaatgcagaacaccgccaaggagcaccactgccagaccctggtgctgaagaagcccacccaggaggtgaagagaatcagcgaggccagagagtgcgagaacatgttccccaagaagagctgcgccgcctgcaagagccccgagctgaccagcaacctgttcaacatctacggcaagagccccctgatcgtgtacttcctgcagaactacgccagcctgcagcagcacggcaagaacgtgctgatcgtgagaagagagaagaccaccagcacccccgactgcacccccacctacaccgacgtgatcagcgagaccctgtgcagcatgaagaagagaaaggacaacctgaaccagctgtaccagcaccactggaccgagtggaactacttcgacaagcacctgaaggagctgcaggacaacttcagcagagagatgaagaacatcgaccccaaggccgccgacaccaagaaggccaaccacatgttcatcccccccagcgccgtgaacgaggagagccccgacaagaagaccaagggcagcctgcagagagagatcgagttcaagggctgcagcaacaagaaccacggcaagggcagaagcgtgaacatgagaggcaaggaggagagagagagagaggagaagcagaagctgaacatcagcttccacagcctgcccagccccgaggagctgcacaacctggagcccggcagcgcctacagaatcagagacatcagcgccaccagaacccccctgagaagacccagcagctgggagcccagcctgatctaccaggagcaggtgctgctgaagacccacaccctgagcatggaggaggacaagttcagatgctag

SEQ ID NO: 25700 - DNA, 876 bp, Artificial Sequence
  Description of Artificial Sequence: Synthetic coding sequence
atggacgtggtggaggtggccggcagctggtgggcccaggagagagaggacatcatcatgaagtacgagaagggccacagagccggcctgcccgaggacaagggccccaagagcttcggcagctacaacaacaacgtggaccacctgggcatcgtgcacgagaccgagctgccccccctgaccgccagagaggtgaagcagatcagaagagagatcagcagaaagagcaagtgggtgaagatgctgggcgagtgggacacctacaagaacagcagaaagctgatcgacagagcctaccagggcatccccatgaacatcagaggccccatgtggagcgtgctgctgaacatcgaggagatcaagctgaagaaccccggcagataccagatcatgaaggagaagggcaagagaagcagcgagcacatccagcagatggacctggacgtgagcggcaccctgagaagacacatcttcttcagagacagatacggcaccaagcagagagagctgctgtacatcctgctggcctacgaggagtacaaccccgaggtgggctactgcagagacctgagccacatcgccgccctgttcctgctgtacctgcccgaggaggacgccttctgggccctggtgcagctgctggccagcgagagacacagcctgcagggcttccacagccccaacggcggcaccgtgcagggcctgcaggaccagcaggagcacgtggtggccaccagcctgcccaacaccatgtggcaccagagcgccagcagaagaagacccggcgtggccagaggccacgtgttcggcaccggcagcctgatgcccggccccggcatgatgaccctgtgcagcagcatcctgggccccctgtag

SEQ ID NO: 25701 - DNA, 420 bp, Artificial Sequence
  Description of Artificial Sequence: Synthetic coding sequence
atgttcctgctgaagaagagcagcgagaagggctggtaccccgtgaaggagagcagagacagaggccccagaagatggagccagggcctgagcagaaagaagagaaccttccccaccaagagctggagaaagaagacccccggcctgctgctgcccctgcccagcggctggcagcacggcagcctgagagccggccaggtgctgcacctggacggcgccggcggcgacagcgaggccgacgtgctgatgatgctgagaagactgatcagaggccaggtgaagggcaccctgggctggagagtgggcatcgccgtgcccaccacccccaccctgggcggctgccccagaagactggaggtgtggtggtggctgctgctgctgctgctgctgctgctgctgctgctgctgctgctgctgtag

SEQ ID NO: 25702 - DNA, 666 bp, Artificial Sequence
  Description of Artificial Sequence: Synthetic coding sequence
atgagcgccctggtgttcttcccccccagcagccccctgcccatcgccttcttcccccccagcagccccctgcccatcgccttcttcccccccagcagccccctgcccatcgtgttcttccccagcctgttcagcatcttcctgccccccccctacccccacctgctgctggccgccgccagcagctgcagagccttcctgagcccccaccacctgctgttcctgttccccaccgtgctgagccccagacccctgctgagcctgagcagccccagagccttccccaccaccgtgttcagccccgtgttcttccccagccacagattcctgcccatgagcagccacagactggccgccgccagcgtgagcagaaacctgctgcccaccttcttcagccccccccccatcgtgttcttcccccagcccctgatcctgagacacctgctgcccctgcccaccttcagccagcagagactgcccgccgccttcttcagccccagaaccctgttcagccccctgcccctgcccaccgtgttcgcccccgacagactgctggcccaccccctgctggccctgagcaactgcctgagccccagaagcgcccccagagtgagaccccccgtgagcctgagactggtgtgcctgtgcgcccagcccgccccctag

SEQ ID NO: 25703 - DNA, 1749 bp, Artificial Sequence
  Description of Artificial Sequence: Synthetic coding sequence
tgacccggccccaccagcagcgccaccaacgtgagcatggtggtgagcgccggccccctgagcagcgagaaggccgagatgaacatcctggagatcaacgagaagctgcacccccagctggccgagaagaagcagcagttcagaaacctgaaggagagatgcttcgtgacccagctggccggcttcctggccaaccagcagaagaagtacaagtacgaggagtgcaaggacctgatcaagagcatgctgagaaacgagagacagttcaaggaggagaagctggccgagcagctgaagcaggccgaggagctgagacagtacaaggtgctggtgcacgcccaggagagagagctgacccagctgagagagaagctgagagagggcagagacgccagcagaagcctgaacgagcacctgcaggccctgctgacccccgacgagcccgacaagagccagggccaggacctgcaggagcagctggccgagggctgcagactggcccagcacctggtgcagaagctgagccccgagaacgacaacgacgacgacgaggacgtgcaggtggagctggccgagaaggtgcagaagagcagcgcccccagagagatgcagaaggccgaggagaaggaggtgcccgaggacagccaggaggagtgcgccatcacctacagcaacagccacggcccctacgacagcaaccagccccacagaaagaccaagatcaccttcgaggaggacaaggtggacagcaccctgatcggcagcagcagccacgtggagtgggaggacgccgtgcacatcatccccgagaacgagagcgacgacgaggaggaggaggagaagggccccgtgagccccagaaacctgcaggagagcgaggaggaggaggtgccccaggagagctgggacgagggctacagcaccctgagcatcccccccgagatgctggccagctaccagagctacagcagcaccttccacagcctggaggagcagcaggtgtgcatggccgtggacatcggcagacacagatgggaccaggtgaagaaggaggaccaggaggccaccggccccagactgagcagagagctgctggacgagaagggccccgaggtgctgcaggacagcctggacagatgctacagcacccccagcggctgcctggagctgaccgacagctgccagccctacagaagcgccttctacgtgctggagcagcagagagtgggcctggccgtggacatggacgagatcgagaagtaccaggaggtggaggaggaccaggaccccagctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaaccaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagctag

SEQ ID NO: 25704 - DNA, 474 bp, Artificial Sequence
  Description of Artificial Sequence: Synthetic coding sequence
accctggccgaccacagacacagaggcaccgacttcggcggcagcccctggctgctgatcatcaccgtgttcctgagaagctacaagttcgccatcagcctgtgcaccagctacctgtgcgtgagcttcctgaagaccatcttccccagccagaacggccacgacggcagcaccgacgtgcagcagagagccagaagaagcaacagaagaagacaggagggcatcaagatcgtgctggaggacatcttcaccctgtggagacaggtggagaccaaggtgagagccaagatctgcaagatgaaggtgaccaccaaggtgaacagacacgacaagatcaacggcaagagaaagaccgccaaggagcacctgagaaagctgagcatgaaggagagagagcacggcgagaaggagagacaggtgagcgaggccgaggagaacggcaagctggacatgaaggagatccacacctactag

SEQ ID NO: 25705 - DNA, 516 bp, Artificial Sequence
  Description of Artificial Sequence: Synthetic coding sequence
atggccgagatgagagcctggagacccctggtgagacccagcctgcagtgcgtgaagctgggcagagccaccgccagatggtggtgggtggtgaaggtgaagccccacgacaaggacgccaagatgaagtaccaggagtgcaacaagatcgtgaagcagaaggccttcgagagagccatcgccggcgacgagcacaagagaagcgtggtggacagcctggacatcgagagcatgaccatcgagggcgagtacagcggccccaagctggaggacgacaaggtgaccatcaccttcatgaagggcctgatgcagtggtacaaggaccagaagaagctgcaccagaagtgcgcctaccagggcctggccctgagccccagactgaagtgcagcggcaccatcaccgcccactgcagcctgaacctgctgggccccagagacccccccaccagcgccagccaggtggccgtgaccgagggcatgcaccaccacacctggctgatcttcctgttcctgtag

SEQ ID NO: 25706 - DNA, 96 bp, Artificial Sequence
  Description of Artificial Sequence: Synthetic coding sequence
atgctggaggccatcctgggccccgtgagcaacagcctgtacgtgagcggcaagacctgccacggcagcagaagcgtgttcagcagcgccaagtag

SEQ ID NO: 25707 - DNA, 225 bp, Artificial Sequence
  Description of Artificial Sequence: Synthetic coding sequence
atgagcaaggcccacccccccgagctgaagaagttcaccgacaagaagttcagcctgaagctgaacggcggcagacacgtgcagggcatcctgagaggcttcgaccccttcatgaacctggtgatcgacgagtgcgtggagatggccaccagcggccagcagaagaacatcggcatggtggagatcagaggcaacagcatcatcatgctggaggccctggagtag

SEQ ID NO: 25708 - DNA, 1893 bp, Artificial Sequence
  Description of Artificial Sequence: Synthetic coding sequence
atggaccccagctggagaagaagcagccacagctggccccagcccatgcccgacagcggcagagcccccgtgagaccccacctggccaagctggaggaggacgtgtggccctgcccccagttccaccagaccaaggccgccagcggcccccccttcgtgaacgaggccaacagcaagtggctggacgcccactacgaccccatggccaacatccacaccttcagcgcctgcctggccctggccgacctgcacggcgacggcgagtacaagctggtggtgggcgacctgggccccggcggccagcagcccagactgaaggtgctgaagggccccctggtgatgaccgagagccccctgcccgccctgcccgccgccgccgccaccttcctgatggagcagcacgagcccagaacccccgccctggccctggccagcggcccctgcgtgtacgtgtacaagaacctgagaccctacttcaagttcagcctgccccagctgccccccaaccccctggagcaggacctgtggaaccaggccaaggaggacagaatcgaccccctgaccctgaaggagatgctggagagcatcagagagaccgccgaggagcccctgagcatccagagcctgagattcctgcagctggagctgagcgagatggaggccttcgtgaaccagcacaagagcaacagcatcaagagacagaccgtgatcaccaccatgaccaccctgaagaagaacctggccgacgaggacgccgtgagctgcctggtgctgggcaccgagaacaaggagctgctggtgctggaccccgaggccttcaccatcctggccaagatgagcctgcccagcgtgcccgtgttcctggaggtgagcggccagttcgacgtggagttcagactggccgccgcctgcagaaacggcaacatctacatcctgagaagagacagcaagcaccccaagtactgcatcgagctgagcgcccagcccgtgggcctgatcagagtgcacaaggtgctggtggtgggcagcacccaggacagcctgcacggcttcacccacaagggcaagaagctgtggaccgtgcagatgcccgccgccatcctgaccatgaacctgctggagcagcacagcagaggcctgcaggccgtgatggccggcctggccaacggcgaggtgagaatctacagagacaaggccctgctgaacgtgatccacacccccgacgccgtgaccagcctgtgcttcggcagatacggcagagaggacaacaccctgatcatgaccaccagaggcggcggcctgatcatcaagatcctgaagagaaccgccgtgttcgtggagggcggcagcgaggtgggccccccccccgcccaggccatgaagctgaacgtgcccagaaagaccagactgtacgtggaccagaccctgagagagagagaggccggcaccgccatgcacagagccttccagaccgacctgtacctgctgagactgagagccgccagagcctacctgcaggccctggagagcagcctgagccccctgagcaccaccgccagagagcccctgaagctgcacgccgtggtgcagggcctgggccccaccttcaagctgaccctgcacctgcagaacaccagcaccaccagacccgtgctgggcctgctggtgtgcttcctgtacaacgaggccctgtacagcctgcccagagccttcttcaaggtgcccctgctggtgcccggcctgaactaccccctggagaccttcgtggagagcctgagcaacaagggcatcagcgacatcatcaaggtgctggtgctgagagagggccagagcgcccccctgctgagcgcccacgtgaacatgcccggcagcgagggcctggccgccgcctag

SEQ ID NO: 25709 - DNA, 474 bp, Artificial Sequence
  Description of Artificial Sequence: Synthetic coding sequence
atggtgggcagaatgaagctgctgcccaacagaatcagaaccctggccctgaccgccatcggcgtggtgctgctgggcgtggacgaccccggcgcccccagcgaccaggtggaggtgcacctggagctggacctgcccacccagctgaccagcgtgtggcaggtgatgagcaccgtgcccctggcccccctgcccggccagctgagcctgctgggcccccccggcgccctgggcttcccccagcagggcggccccacccagctgcccctgctgctgagagaggtgggcgtggagcacaaggagcacatcggcggcagaagatgcggcggccccagacccgccctgagcagctaccccggccacctgctgctgcagggccccagagtgctgcagcccctgggcgagagacccggccacctgcagaaccacgccgcccagggcaagggcgacctgggccagagcgacagcgagtag

SEQ ID NO: 25710 - DNA, 738 bp, Artificial Sequence
  Description of Artificial Sequence: Synthetic coding sequence
aaggagggcgaggaggaccagaaccccccctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaaccaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgagcagagagctgctggacgagaagggccccgaggtgctgcaggacagcctggacagaagctacagcacccccagcggctgcctggagctgaccgacagctgccagccctacagaagcgccttctacgtgctggagcagcagagagtgggcctggccgtggacatggacggcgagtacctgagcatgtag

SEQ ID NO: 25711 - DNA, 258 bp, Artificial Sequence; identical to SEQ ID NO: 22735
  Description of Artificial Sequence: Synthetic coding sequence

SEQ ID NO: 25712 - DNA, 927 bp, Artificial Sequence
  Description of Artificial Sequence: Synthetic coding sequence
atgcacacccaggtgtgcgcccacacctacatcagaatgcacagacacctgtgcacccacatgcagatccacccccagcaccccatctgcgccacccacagacacagatacatggagaccgacgcccacaccggcctgtgcacccacatcagaatgcacagacacctgtgcacccacatgcagatccacccccagcaccccatctgcgccacccacagacacagatacatgaagaccgacgcccacaccggcctgtgcacccacgtgtgcatgcacagacacctgtgcacccacatgcagatgcacccccagtaccccatctgcgccacccacagacacacctacatggagaccgacgcccacaccggcctgtgcacccacgtgcacatgcacagacacctgtgcacccacatgcagatgcacccccagtaccccatctgcgccatccacagacacacctacatggagaccgacgcccacaccggcctgtgcacccacgtgcacatgcacagacacctgtgcacccacatgcagatgcacccccagtaccccatctgcgccacccacagacacacctacatggagaccgacgtgcacaccggcctgtgcacccacgtgcacatgcacagacacctgtgcacccacatgcagatgcacccccagtaccccatctgcgccacccacagacacacctacatggagaccgacgcccacaccggcctgtgcacccacgtgcacatgcacagacacctgtgcacccacatgcagatgcacccccagtacagaatctgcgccacccagacctacgtgcacggcgacagatgcacctacagaagcatgcacacctgcacccacgcccaggcccccggccacaccctgtacctgctgatctgcagcagccccccctgcagactgctgggcagatag

SEQ ID NO: 25713 - DNA, 300 bp, Artificial Sequence
  Description of Artificial Sequence: Synthetic coding sequence
atgtgggagcactggctgggcgacagcggcgtgggcctgctgatgagactgagaagcgacgtgagccaggtgtgcctgcagctgaacgcctgcgtggaggtggaggaccccctgcccggctggctgacccactgcctgcccggcagagccggctgctggtgggaggccagcgtgcccttccacggctgcttccagtacagctgcggcatcccccccgagcaggtgatgaaggagaacaaggccgaggccgccgtgctgttcaccgccagcttcagaagccacgtgcccagcgacctgtag

SEQ ID NO: 25714 - DNA, 315 bp, Artificial Sequence
  Description of Artificial Sequence: Synthetic coding sequence
atggccgccctgatcccccagggcttcagctgcctgagcagagtgctgggctggtggagcagacagcccgtgctggtgacccagagcgccgccatcgtgcccgtgagaaccaagaagagattcaccagccccatctaccagcccaagttcaagaccgagaaggagttcatgcagcacgccagaaaggccggcctggtgatcccccccgagaagagcgacagaagcatccacctggcctgcaccgccggcatcttcgacgcctacgtgccccccgagggcgacgccagaatcagcagcctgagcaaggagagatag

SEQ ID NO: 25715 - DNA, 366 bp, Artificial Sequence
  Description of Artificial Sequence: Synthetic coding sequence
atgagcctgaccttcagaagacccaagaccctgagactgagaagacagcccagataccccagaaagagcacccccaccagaaacaagctgggccactacgccatcatcaagttccccctggccaccgagagcgccgtgaagaagatcgaggagaacaacaccctggtgttcaccgtggacgtgaaggccaacaagcaccagatcagacaggccgtgaagaaggtgtacgacagcgacgtggccaaggtgaccaccctgatctgccccgacaaggagaagaaggcctacgtgagactggcccccgactacgacgccttcgacgtggtgaccaagctgggcagccccaagctgagccccgccggctag

SEQ ID NO: 25716 - DNA, 1569 bp, Artificial Sequence
  Description of Artificial Sequence: Synthetic coding sequence
atgtggccccagcccagactgcccccccaccccgccatgagcgagaagacccagcagggcaagctggccgccgccaagaagaagctgaaggcctactggcagagaaagagccccggcatccccgccggcgccaacagaaagaagaaggtgaacggcagcagccccgacaccgccaccagcggcggctaccacagccccggcgacagcgccaccggcatctacggcgagggcagagccagcagcaccaccctgcaggacctggagagccagtaccaggagctggccgtggccctggacagcagcagcgccatcatcagccagctgaccgagaacatcaacagcctggtgagaaccagcaaggaggagaagaagcacgagatccacctggtgcagaagctgggcagaagcctgttcaagctgaagaaccagaccgccgagcccctggcccccgagccccccgccggccccagcaaggtggagcagctgcaggacgagaccaaccacctgagaaaggagctggagagcgtgggcagacagctgcaggccgaggtggagaacaaccagatgctgagcctgctgaacagaagacaggaggagagactgagagagcaggaggagagactgcacgagcaggaggagagactgcacgagcaggaggagagactgtgcgagcaggaggagagactgagagagcaggaggagagactgagagagcaggaggagagactgagagagcaggaggagagactgcacgagcaggaggagagactgcacgagcaggaggagagactgtgcgagcaggaggagagactgagagagcaggaggagagactgtgcgagcaggaggagagactgagagagcaggaggagagactgtgcgagcaggaggagagactgagagagcaggaggagagactgtgcgagcaggaggagagactgtgcgagcaggaggagagactgtgcgagcaggagaagctgcccggccaggagagactgctggaggaggtggagaagctgctggagcaggagagaagacaggaggagcaggagagactgctggagagagagagactgctggacgaggtggaggagctgctggagcaggagagactgagacagcaggacgagagactgtggcagcaggagaccctgagagagctggagagactgagagagctggagagactgagagagctggagagaatgctggagctgggctgggaggccctgtacgagcagagagccgagcccagaagcggcttcgaggagctgaacaacgagaacaagagcaccctgcagctggagcagcaggtgaaggagctggagaagagcggcggcgccgaggagcccagaggcagcgagagcgccgccgccgccagacccgtgcccggcgcccccgtgccccagggcgcctggatgtgcggccaggccggctggaccccccaggagcaccccggcctgagcggcgaggccgtgggcaccggcgaggccgccggcggcgccgaggaggccgcctgccacagcttcagagccgccgagaacagagagctgaacatcaccatcatctag

SEQ ID NO: 25717 - DNA, 783 bp, Artificial Sequence
  Description of Artificial Sequence: Synthetic coding sequence
atgctgagaaacgagctgcagttcaaggaggagaagctggccgagcagctgaagcaggccgaggagctgagacagtacaaggtgctggtgcacagccaggagagagagctgacccagctgagagagaagctgagagagggcagagacgccagcagaagcctgaacgagcacctgcaggccctgctgacccccgacgagcccgacaagagccagggccaggacctgcaggagcagctggccgagggctgcagactggcccagcacctggtgcagaagctgagccccgagaacgacgaggacgaggacgaggacgtgcaggtggaggaggacgagaaggtgctggagagcagcagccccagagagatgcagaaggccgaggagagcaaggtgcccgaggacagcctggaggagtgcgccatcacctgcagcaacagccacggcccctgcgacagcaaccagccccacaagaacatcaagatcaccttcgaggaggacaaggtgaacagcagcctggtggtggacagagagagcagccacgacgagtgccaggacgccctgaacatcctgcccgtgcccggccccaccagcagcgccaccaacgtgagcatggtggtgagcgccggccccctgagcagcgagaaggccgagatgaacatcctggagatcaacgagaagctgagaccccagctggccgagaagaagcagcagttcagaagcctgaaggagaagtgcttcgtgacccaggtggcctgcttcctggccaagcagcagaacaagtactag

SEQ ID NO: 25718 - DNA, 303 bp, Artificial Sequence
  Description of Artificial Sequence: Synthetic coding sequence
atggccaagaacaagttcagaggccagaagagcagaaacgtgttcagaatcgccagccagaagagcttcaaggccaagaacagagtgaagcccatcaccgccaacctgaagaagatccacatcatgaacgacgagaaggtgagcagagtgaacaaggccttcggcagcgtgcaggaggagctgccccacttcagcaagggcctgagcctggacctgctgcagaaggagctgatcccccagcagagacaccagagcaagcccgtgaacgtggacgaggccaccaagctgatggcccagctgtag

SEQ ID NO: 25719 - DNA, 1659 bp, Artificial Sequence
  Description of Artificial Sequence: Synthetic coding sequence
atgctgaagagcagaatcagcatgagaagcagacaccccagaagagccatcagcgagggccacaagagcgagggcaccatgccccccaacaaggaggccagcggcctgagcagcagccccgccggcctgatctgcctgccccccatcagcgaggagctgcagctggtgtggacccaggccgcccagaccagcgagctggacagcaacgagcacctgctgaagaccttcagctacttcccctaccccagcctggccgacatcgccctgctgtgcctgagatacggcctgcagatggagaaggtgaagacctggttcatggcccagagactgagatgcggcatcagctggagcagcgaggagatcgaggagaccagagccagagtggtgtacagaagagaccagctgcacttcaagagcctgctgagcttcacccaccacgccggcagaccccccgaggaggtgccccccccccccgtgcccgcccccgagcaggtgggcatcggcatcggcccccccaccctgagcaagcccacccagaccaagggcctgaaggtggagcccgaggagcccagccagatgccccccctgccccagagccaccagaagctgaaggagagcctgatgacccccggcagcggcgccttcccctaccagagcgacttctggcagcacctgcagagcagcggcctgagcaaggagcaggccggcagaggccccaaccagagccacggcatcggcaccgccagctggaaccacagcaccaccgtgccccagccccaggccagagacaagcccccccccatcgccctgatcgccagcagctgcaaggaggagagcgccagcagcgtgacccccagcagcagcagcaccagcagcagcttccaggtgctggccaacggcgccaccgccgccagcaagcccctgcagcccctgggctgcgtgccccagagcgtgagccccagcgagcaggccctgcccccccacctggagcccgcctggccccagggcctgagacacaacagcgtgcccggcagagtgggccccaccgagtacctgagccccgacatgcagagacagagaaagaccaagagaaagaccaaggagcagctggccatcctgaagagcttcttcctgcagtgccagtgggccagaagagaggactaccagaagctggagcagatcaccggcctgcccagacccgagatcatccagtggttcggcgacaccagatacgccctgaagcacggccagctgaagtggttcagagacaacgccgtgcccggcgcccccagcttccaggaccccgccatccccacccccccccccagcaccagaagcctgaacgagagagccgagaccccccccctgcccatccccccccccccccccgacatccagcccctggagagatactgggccgcccaccagcagctgagagagaccgacatcccccagctgagccaggccagcagactgagcacccagcaggtgctggactggttcgacagcagactgccccagcccgccgaggtggtggtgtgcctggacgaggaggaggaggaggaggaggaggagctgcccgaggacgacgaggaggaggaggaggaggaggaggaggacgacgacgacgacgacgacgacgtgatcatccaggactag

SEQ ID NO: 25720 - DNA, 528 bp, Artificial Sequence
  Description of Artificial Sequence: Synthetic coding sequence
atgaaggtgaccaccaaggtgaacagacacgacaagatcaacggcaagagaaagaccgccaaggagcacctgagaaagctgagcatgaaggagagagagcacggcgagaaggagagacaggtgagcgaggccgaggagaacggcaagctggacatgaaggagatccacacctacatggagatgttccagagagcccaggccctgagaagaagagccgaggactactacagatgcaagatcacccccagcgccagaaagcccctgtgcaacagagtgagcctgctggtgttcctggccttcggccacagcctgcccggccaggacatggacaccttcttcagcctgagactgtgcgcccaggccctgcagagagagatggccgagagaaaggccgcctacaagcaccacagccccatccccgtgggcaacagagtggcccagaagcacctgcacccccaccccgtgggcccccccagcaacatcctgagcgtgagaggcagcatcttcgtgatcgccaacggcccctag

SEQ ID NO: 25721 - DNA, 228 bp, Artificial Sequence
  Description of Artificial Sequence: Synthetic coding sequence
atgagcaagctggtgtacctgtacatgctgagagtgtacatcagcaacatcaacagcaacagcgtggtgtacatcttcatcagcatccccgtgacccacagcctggacaactggaccttcctggtgagcttcgagatcggcaagtacgagagcagcaacttcgtgctgttccacgactacagcggctacgtgagacccctgagcatcccctacgagctggagggctag

SEQ ID NO: 25722 - DNA, 390 bp, Artificial Sequence
  Description of Artificial Sequence: Synthetic coding sequence
atgctgtgcccctgcatccaggagagcaccttcgagacctgcctgttcatggccgtgagcagaatgagcaagtggagactgagcagagtgggcggcagcagaagcctgcccgccgagatggaggtgctgggcgaggtgtggtgcgtgagagccgaggagcagcccatgaccggcctgggcatcgtgtggcacagccccctggacaaggccctggagacctggagcctgcagcagcagcccgacttcagcctgggcctgggccacctgggcctgggcctgtacatcctggccagctacctgctgtgccccagacagccccccagccagcccgacggcccctgcggcagccccaaccccgtgagcggcgccaagaagaccaccgtggcctag

SEQ ID NO: 25723 - DNA, 288 bp, Artificial Sequence
  Description of Artificial Sequence: Synthetic coding sequence
ggcagaaaggagggcgaggaggaccagaaccccccctgccccagactgaacagcgtgctgatggaggtggaggagcccgaggtgctgcaggacagcctggacagatgctacagcacccccagcatgtacttcgagctgcccgacagcttccagcactacagaagcgtgttctacagcttcgaggagcagcacatcagcttcgccctggacatggacaacagattcttcaccctgaccgtgaccagcctgcacctggtgttccagatgggcgtgatcttcccccagtag

SEQ ID NO: 25724 - DNA, 543 bp, Artificial Sequence
  Description of Artificial Sequence: Synthetic coding sequence
atgggcctgggcgccgtggagcaggaggccgccctggccggcgaggcccccgccgcccaggtgcccaccgagggcgtgggcggcagcggcatggccggctgcagaagcagagccctgcccctgggcaaggccgccagagcccccggcgagatcgagagaagcgccggcggcagcgccctgctgggcgaccccgtgcaccccccccagcccctggccagagtgctgagccccagcctgcccggcgccggcagagcctgcagactgctgagagtgagagccgccaagctgacccccacccagaacagcagctggcccgccagcgtggcctgcagccccggcagctgcagccacctgagcctgcacaccagcctgcaggccgagggcgccggcagcggcctgggcaagcccagaaagggcctgccccagtgcagcggcggcctgaagggcagcagcagcgccgccaaggtgggcgcccaggccgaggaggcccccagagccagcgagggcagcgaggactgccagcacgccgtgaccagccactag

SEQ ID NO: 25725 - DNA, 390 bp, Artificial Sequence; identical to SEQ ID NO: 25722
  Description of Artificial Sequence: Synthetic coding sequence

SEQ ID NO: 25726 - DNA, 417 bp, Artificial Sequence
  Description of Artificial Sequence: Synthetic coding sequence
atgatcttcccccagatctacctggactacttcaagatgagacaggactactgccagagcctgaacgtgtggagctacctgccctggatcttcttcagcttcggcctgggcttcatcaacaacctgaacatcatcagctacagaatcaccaaggaggaggtgaacctgatccacctgagactgcagcccaagatccagagcaacagcagcttcagcctgagctgcttcttcttcatgttcctgctgctgatcgccgccagaatcctgcacagaatcagcatcgagatgtacgagatcctgtggagcctgcacgtgagaatcgcccagtacgtgaccatccagttccagagagagcccaccttcgtgagattcaccgaccagggcgtggtggaggaggtggagctgcagatcagatag

SEQ ID NO: 25727 - DNA, 504 bp, Artificial Sequence
  Description of Artificial Sequence: Synthetic coding sequence
atggagcaggagcacatcccccactggatccagaccagcgccttcagcggcggcctgggcagaagctggtgcaagatcagatgcatggccagagccggcctgcccgtgcacatggtgaacggcgaccccgacaccggcagacccctgctgaccgcccccggcgccaagcagccccccagaggctggagaagacaggccggcagcagctgcagcagagccagaggcgtgtggagaggcgccctggccagcagacagggcgcccagagaggcagcaagggccccggcgtgagccaccagagctacggcgtggagggcctgggcagcagcgtgtgccccgtgacctggcacctgagagccctgcccagacagctgtgcgacgccagccaccagaccgcctgcatcaagagcggcgtgtgcagcagcctgaagtggagaagacccgaggccctggacagaagaagccacatcctggagggcagcgtgctgggccacagatgcccctag

SEQ ID NO: 25728 - DNA, 1158 bp, Artificial Sequence
  Description of Artificial Sequence: Synthetic coding sequence
atggcctacctgggcccctaccccaccagcagacagcccccccagatgagactgctgccccacaacagcctgcacagacacagcagcatcgtgaccatggccagcctggaccccgcccccgccagccagcccagcctgcaggccctgaacttcctgaagagcaccagccccggccccgcccacgccagcctgcagcccctgcaggcccagctgctgcacctgggcggccccagcagacccagcctgtgcctgcccagcgccagcaccgtgcccaccagcgccagccagcagatcctgcacgcccagcacctgccccactgcggcccccccaagcccagcagccagcccttcagcagcttctacacccccagcagcagactgcccgtggccagcagcggcccctggggcagcttcctgaccaccgccttccccggccccgtgttccccttcagaagacccctgagagcccagaacctgctgaagagcgccagccccgaccccctggcccccagcggcagaagcctgagagcccagctgttcttcctggtgggcagccccggccccatccccgccagccagcagcccctgtggacccagtgcctgcccatcagctggagaccctggagcgcccacagcttcctgaagcccagcagccccggccccggccaggccagcagatggcccctgcaggacgagctgctgcccagcgacggcatcagcagaccccagatggtgagcggcagatgggccccccccagacagggctgggccagcagaagacccccccaggcccaggtggtgctgaagagcggcagccccggccccgccagccagcaggtgagcaagctgttctggctgaacagctgccccgcccccaacagactgtgcagacccagaaccttcagcagccaggccctgagagcccacctgctgccccccggcggcctgtacagcagcagcaccggctggagaaccgccagcgccggccccagcctggccagccagggccccctgcaggcccagctgctgccccccagaagaccccccggcgccaagagcctgcccgccagccagcagcccgcctgcggccccgccccccccagcagatggcccgtggacgcccagctgatgcccctggccccctgccccgaggcctag

SEQ ID NO: 25729 - DNA, 423 bp, Artificial Sequence
  Description of Artificial Sequence: Synthetic coding sequence
atgggcggccccgagaccaagggcctggagggcgacccccacatgcaccacttcctgctgttcaccgtgtgctgggagagcagcagagccctgtgccagatgccccaggaggagaaccccccccagtgcaccgtgaaggacgacaccgccctgctgcccaacgacaccagacccagctggtgcctgtacatggtggacgccggcagcgtgggccccagcgtgctgggcctggtgagaagagagagcacccaggagcagagcgccagcgagagaagcagcgtggccccccccgccggcgccaacagagacagccacagacccctggccgactggcccaccctgcccaccagcctgctgaccagcagcctggtgttccagaagggcgagaccaccatcaaggacaagagaaagggcagatactag

SEQ ID NO: 25730 - DNA, 375 bp, Artificial Sequence
  Description of Artificial Sequence: Synthetic coding sequence
atgacccccaacgagcaccccgccttcaagcacctgttcaacaaggcccacctggccccccccctgatccacctgaccctgagcggccacagcacctgcttcagagagcacagagtgggcggcaaggtgaccgaccagcaggaccccaaggccgaggagttcttcctggtgcagaacaagatgaagagcctgccctgcctgctgctgagcacccagaccagacagcccagcgacttcagcatcttcagcccccccttcctgcccttctacagcaccaagccccccctgagcagctggcccgtgctgaacgagctgctgggcaccccccccagaagaggcggcggcagagccgagggcctgctgaccagccagtag

SEQ ID NO: 25731 - DNA, 465 bp, Artificial Sequence
  Description of Artificial Sequence: Synthetic coding sequence
atgggcctgtggcagcagatcagcaactgcatgcccgacctggccctgtgcagcgacatcaagttcttcctgagatgcctggagagatggctgaacagaaacagcagcgccctgcagctgcccgccagaagcacccagaaggagatcatcagcgccttccccaccaaggtgcccagcagcagccactgggactggctggacagcggctgcagcccccagaaggccagcagaagcagagtgggctgctgcctgaccagagaggcccagggcgtgagagagctgccccccctggccaagggcagctgcgagggcctgtgcagagaggagagaggcatccccgcccagatcctgtgcttcccccacggcctgtgcaacccccagaccagaagattcccctgggtgcccgccccccccggcccctgggtgagcagcaagaagctgggcagccacctgggcagacactag

SEQ ID NO: 25732 - DNA, 168 bp, Artificial Sequence
  Description of Artificial Sequence: Synthetic coding sequence
atggtgcagagcgccagcgtgagcaaggccggcaagggcagcagcagcagccacggcgtggccgccgccctgaaccaggacctggaccccgaccccaagtgccacgtgttcaacgtgagcagccagagatgccagatgggcagcgcccagccctgcctgtgctgctag

SEQ ID NO: 25733 - DNA, 621 bp, Artificial Sequence
  Description of Artificial Sequence: Synthetic coding sequence
atgcaccacaacaagcaggccaccgagaacgccaaggaggaggtgagaagaatcctgggcctgctggacgcctacctgaagaccagaaccttcctggtgggcgagagagtgaccctggccgccgagcccaaggccaaggaccccttcgcccacctgcccaagagcaccttcgtgctggacgagttcaagagaaagtacagcaacgaggacaccctgagcgtggccctgccctacttctgggagcacttcgacaaggacggctggagcctgtggtacagcgagtacagattccccgaggagctgacccagaccttcatgagctgcaacctgatcaccggcatgttccagagactggacaagctgagaaagaacgccttcgccagcgtgatcctgttcggcaccaacaacagcagcagcatcagcggcgtgtgggtgttcagaggccaggagctggccttccccctgagccccgactggcaggtggactacgagagctacacctggagaaagctggaccccggcagagaggagacccagaccctggtgagagagtacttcagctgggagggcgccttccagcacgtgggcaaggccttcaaccacggcaagatcttcaagtag

SEQ ID NO: 25734 - DNA, 498 bp, Artificial Sequence
  Description of Artificial Sequence: Synthetic coding sequence
atgagctgcagcagaagcagaagcctggaggccagcagcagcagaggcaccctgcccgccagctgggtgagaggcagcagatgcctgggcagcagcttcgccgacgagggccaggcccccctgcacgccgacagacccagattcttcggcaccgtgctgaccagcttccccagcgagaagctggccgccaaggccctgctgtggggcgccctgaacttcttcctgggccccaactggagcgagagcgagttcccctggcccagcttcctgcccatcctgggcgccggcggcgccgtggacttcctgcccagagacctgttcatcatcttcctgtgcagcgtgctgcccagacccagcgccgtgcccgccagcccccccagccccttcagcctgctgccccccttccccaccctgcccctgagccccttcagcctgagcagaatcctgggctgcagcaaccagagagccgtgagcctgttcttcccccactactgctag

SEQ ID NO: 25735 - DNA, 1158 bp, Artificial Sequence
  Description of Artificial Sequence: Synthetic coding sequence
atggcctacctgggcccctaccccaccagcagacagcccccccagatgagactgctgccccacaacagcctgcacagacacagcagcatcgtgaccatggccagcctggaccccgcccccgccagccagcccagcctgcaggccctgaacttcctgaagagcaccagccccggccccgcccacgccagcctgcagcccctgcaggcccagctgctgcacctgggcggccccagcagacccagcctgtgcctgcccagcgccagcaccgtgcccaccagcgccagccagcagatcctgcacgcccagcacctgccccactgcggcccccccaagcccagcagccagcccttcagcagcttctacacccccagcagcagactgcccgtggccagcagcggcccctggggcagcttcctgaccaccgccttccccggccccgtgttccccttcagaagacccctgagagcccagaacctgctgaagagcgccagccccgaccccctggcccccagcggcagaagcctgagagcccagctgttcttcctggtgggcagccccggccccatccccgccagccagcagcccctgtggacccagtgcctgcccatcagctggagaccctggagcgcccacagcttcctgaagcccagcagccccggccccggccaggccagcagatggcccctgcaggacgagctgctgcccagcgacggcatcagcagaccccagatggtgagcggcagatgggccccccccagacagggctgggccagcagaagactgccccaggcccaggtggtgctgaagagcggcagccccggccccgccagccagcaggtgagcaagctgttctggctgaacagctgccccgcccccaacagactgtgcagacccagaaccttcagcagccaggccctgagagcccacctgctgccccccggcggcctgtacagcagcagcaccggctggagaaccgccagcgccggccccgccctggccagccagggccccctgcaggcccagctgctgccccccagaagaccccccggcgccaagagcctgcccgccagccagcagcccgcctgcggccccgccccccccagcagatggcccgtggacgcccagctgatgcccctggccccctgccccgaggcctag

SEQ ID NO: 25736 - DNA, 510 bp, Artificial Sequence
  Description of Artificial Sequence: Synthetic coding sequence
atggtgcccagagcccccccctgcgcctggctgagacccggcagaagagcccaggccggcgagggccccagagaccccggcaacgccgcctggagaaccagaagaaccggcttccccgaggccaccggccccgccagacacctgcagctgctgtacgtggacttcggcagatggacccacggcagacccgtgcccctgtgcagagccggctggagaccccagtgccccggcgccgccgccgccctgggcctggccggcctgggcgaccacatctggccccccggcagaaccgtgccccaggacccccccgcctgggccccccccagcagcctggcccacagcctgggcgcccccgtgggcgccggcgccgccggctgcccctgcggccccgccatccacagacccgcccacgccgccagccccagcacctgcctgcccacccccccccagccccccaccagccacctggaggagaccatgggccccgccccccccgcccccggctgctag

SEQ ID NO: 25737 - DNA, 783 bp, Artificial Sequence
  Description of Artificial Sequence: Synthetic coding sequence
atgggcgacaacctgtggctgggcctgagagcccaggacccctggagagccctgagacccgcccagagccccagagcctgcagaccccacgccgactgcggcgaccagggcttcagaagaaaggcccagaccccccagctgaacccccccaccgaccacaaggtgcccgagcagagagacgagggcgccgtgcacctgctgagcagacccggcagagccagaccccagatcagaagagcccccgccccccacaacagcagaaccaccaccgccggcggcctgcccagcatcagacccggcagacccgagcccccccccgccctgagcgaccacctgggcgccggcctgagcgtgctgagccaggacggcgccgtgagaatccccccccagggcctgcccgacctgctggagctgagaagagacgcccccaccctggagagcagacccgccgccgccgccctgagcctgctgttccaggccgccagcagcgccgccagaagagccatgagccccgcccaggagacctacagcagcagcccccaccccctgagaagactggacagattcagacccctggaggccacctggggcggcccccactggaagcccctgcccggcatccacagcgtgcccaaggcctacagcaccgagaacagcagaagcggcagatgcaagcccggcctggtgggcgcctgcagagccagccccacccccgacaccccccccggcgtgggcgccgagcagagcagcggccagcccctgaccaccagatgcagaacctag

SEQ ID NO: 25738 - DNA, 1224 bp, Artificial Sequence; identical to SEQ ID NO: 25644
  Description of Artificial Sequence: Synthetic coding sequence

SEQ ID NO: 25739 - DNA, 390 bp, Artificial Sequence
  Description of Artificial Sequence: Synthetic coding sequence
atgtgctgcaactactacggcaacagctgcggctacggcagcagctacggctgcggctacggcagcggctacggctacggctacggcagcagctacggctgcggctacggcaccggctacagctgcggctacggctgcggctacggcagcggctacggctgcggctacggcagcagctacggctgcggctacggcaccggctacagctgcggctacggcagcggctacagctgcggctacggcagcggcagcggctgcggctacggcaccggcttcggctgcggctacggctgcggctacggcaccggctacggctgcggctgcggcagcggcagcggctactgcggctacagacccttctgcttcagaagatgctacagcagctgctag

SEQ ID NO: 25740 - DNA, 144 bp, Artificial Sequence
  Description of Artificial Sequence: Synthetic coding sequence
atggccctgccccagggcctgctgaccttcagagacgtggccatcgagttcagccaggaggagtggaagtgcctggaccccgcccagagaaccctgtacagagacgtgatgctggagaactacagaaacctggtgagcctgtag

SEQ ID NO: 25741 - DNA, 1170 bp, Artificial Sequence
  Description of Artificial Sequence: Synthetic coding sequence
atgctgctgccccccggcagcctgagcagacccagaaccttcagcagccagcccctgcagaccaagctgatgacccacaacggcctgttcagacccatcccctacgtgaccgccgccagcgccgacgaggccaccgccagccagcagcccccccaggcccagctgcacagatacaacggcctgttcagacccagcagctgcctgcccgccttcagccccggccccgagctgagccaggtggacctgaccagacccagcagctgcttcttcgccgccagccccggccccgcccccgccagctggtggcccctgcaggcccagcccctgccccccgtgagcctgtacagccccaacgtgtgcctgaccgccgacagcagcagacccgccagcaccagcctgtggaccccccaggccaagctgcccaccttccagcagctgctgcacacccagctgctgccccccagcggcctgttcagacccagcagctgcttcaccagagccttccccggccccaccttcgtgagctggcagcccagcctggccagattcctgcccgtgagccagcagcccagacaggcccaggtgctgccccacaccggcctgagcaccagcagcctgtgcctgaccgtggccagccccggccccacccccgtgcccggcagacacctgagagcccagaacctgctgaagctggacagcctggtgcccaccgccgccagctggtggcccatgaaggcccagaacctgctgaagctgacctgccccggccccgcccccgccagctgccagagactgcaggcccagcccctgccccacggcggcttcagcagacccaccagcagcagctggctgggcctgcaggcccagctgctgccccacaacagcctgttctggcccagcagctgccccgcccacggcggccagtgcagacccaagaccagcagcagccagaccctgcaggcccacctgctgctgcccggcggcatcaacagacccagcttcgacctgagaaccgccagcgccggccccgccctggccagccagggcctgttccccggccccgccctggccagctggcagctgccccaggccaagttcctgcccgcctgccagcagccccagcaggcccagctgctgccccacagcggccccttcagacccaacagctag

SEQ ID NO: 25742 - DNA, 780 bp, Artificial Sequence
  Description of Artificial Sequence: Synthetic coding sequence
accagcctgtggaccccccaggccaagctgcccaccttccagcagctgctgcacacccagctgctgccccccagcggcctgttcagacccagcagctgcttcaccagagccttccccggccccaccttcgtgagctggcagcccagcctggccagattcctgcccgtgagccagcagcccagacaggcccaggtgctgccccacaccggcctgagcaccagcagcctgtgcctgaccgtggccagccccggccccacccccgtgcccggcagacacctgagagcccagaacctgctgaagctggacagcctggtgcccaccgccgccagctggtggcccatgaaggcccagaacctgctgaagctgacctgccccggccccgcccccgccagctgccagagactgcaggcccagcccctgccccacggcggcttcagcagacccaccagcagcagctggctgggcctgcaggcccagctgctgccccacaacagcctgttctggcccagcagctgccccgcccacggcggccagtgcagacccaagaccagcagcagccagaccctgcaggcccacctgctgctgcccggcggcatcaacagacccagcttcgacctgagaaccgccagcgccggccccgccctggccagccagggcctgttccccggccccgccctggccagctggcagctgccccaggccaagttcctgcccgcctgccagcagccccagcaggcccagctgctgccccacagcggccccttcagacccaacagctag

SEQ ID NO: 25743 - DNA, 1791 bp, Artificial Sequence
  Description of Artificial Sequence: Synthetic coding sequence
atgaagatgcagaagggcaacgtgctgctgatgttcggcctgctgctgcacctggaggccgccaccaacagcaacgagaccagcaccagcgccaacaccggcagcagcgtgatcagcagcggcgccagcaccgccaccaacagcggcagcagcgtgaccagcagcggcgtgagcaccgccaccatcagcggcagcagcgtgaccagcaacggcgtgagcatcgtgaccaacagcgagttccacaccaccagcagcggcatcagcaccgccaccaacagcgagttcagcaccgccagcagcggcatcagcatcgccaccaacagcgagagcagcaccaccagcagcggcgccagcaccgccaccaacagcgagagcagcacccccagcagcggcgccagcaccgtgaccaacagcggcagcagcgtgaccagcagcggcgccagcaccgccaccaacagcgagagcagcaccgtgagcagcagagccagcaccgccaccaacagcgagagcagcaccctgagcagcggcgccagcaccgccaccaacagcgacagcagcaccaccagcagcggcgccagcaccgccaccaacagcgagagcagcaccaccagcagcggcgccagcaccgccaccaacagcgagagcagcaccgtgagcagcagagccagcaccgccaccaacagcgagagcagcaccaccagcagcggcgccagcaccgccaccaacagcgagagcagaaccaccagcaacggcgccggcaccgccaccaacagcgagagcagcaccaccagcagcggcgccagcaccgccaccaacagcgacagcagcaccgtgagcagcggcgccagcaccgccaccaacagcgagagcagcaccaccagcagcggcgccagcaccgccaccaacagcgagagcagcaccaccagcagcggcgccagcaccgccaccaacagcgacagcagcaccaccagcagcggcgccggcaccgccaccaacagcgagagcagcaccgtgagcagcggcatcagcaccgtgaccaacagcgagagcagcacccccagcagcggcgccaacaccgccaccaacagcgagagcagcaccaccagcagcggcgccaacaccgccaccaacagcgagagcagcaccgtgagcagcggcgccagcaccgccaccaacagcgagagcagcaccaccagcagcggcgtgagcaccgccaccaacagcgagagcagcaccaccagcagcggcgccagcaccgccaccaacagcgacagcagcaccaccagcagcgaggccagcaccgccaccaacagcgagagcagcaccgtgagcagcggcatcagcaccgtgaccaacagcgagagcagcaccaccagcagcggcgccaacaccgccaccaacagcggcagcagcgtgaccagcgccggcagcggcaccgccgccctgaccggcatgcacaccaccagccacagcgccagcaccgccgtgagcgaggccaagcccggcggcagcctggtgccctgggagatcttcctgatcaccctggtgagcgtggtggccgccgtgggcctgttcgccggcctgttcttctgcgtgagaaacagcctgagcctgagaaacaccttcaacaccgccgtgtaccacccccacggcctgaaccacggcctgggccccggccccggcggcaaccacggcgccccccacagacccagatggagccccaactggttctggagaagacccgtgagcagcatcgccatggagatgagcggcagaaacagcggcccctag

SEQ ID NO: 25744 - DNA, 1434 bp, Artificial Sequence
  Description of Artificial Sequence: Synthetic coding sequence
atgctgttcagctgggtgaagagacagagaaagagccagtacagctgcaagggcagcgagctgagacacgccagaagcagcgtgatcaagagaaagaccgccgacaagaacctgctggccgagctgtaccagtacagcaacttcaacagcagcaagcccaacaagctgcccaacggcgtggacttctgcgacatggtgggcaacgtggtgagagccgagagagactgcctgagcggcaagcacttctgcagcggcagagagctggagaagttcctgagcagcagcagccccagagccatctggctggacagcttctggtggatcttccacgagagataccagcccaacaaggagctgcagaacaacctgttcgacagaatcgcccagcactacgccctgctgctgttcagagtgcccaagagccacagcgaggaggccctgctgaagagactgcccagcctgctgagcaaggccgtgtacaccagcttctgctgctgcttcccccagagctggttcgacacccacgagttcaagagcgacatctgcaacaccatgagcctgtggatcagcggcacctaccccagcccccagagctacgacagctgggactacagcgagctggaccccgagagattcagaagagaggagctgatgctgtacagaagaagactgaccaagggcagagagttcagcctgttcgccggcaagagagccttcagccagaagcccgcccagagcagaaagttctaccacccccagagcagcagcgccaacagccccagcgagaagaccagcagcgccaagcagaacagcgagaagagcctgagaatgcagaacaccgccaaggagcaccactgccagaccctggtgctgaagaagcccacccaggaggtgaagagaatcagcgaggccagagagtgcgagaacatgttccccaagaagagctgcgccgcctgcaagagccccgagctgaccagcaacctgttcaacatctacggcaagagccccctgatcgtgtacttcctgcagaactacgccagcctgcagcagcacggcaagaacgtgctgatcgtgagaagagagaagaccaccagcgccaccgactgcacccccacctacaccgacgtgatcagcgagaccctgtgcagcatgaagaagagaaaggacaacctgaaccagctgtaccagcaccactggaccgagtggaactacttcgacaagcacctgaaggagctgcaggacaacttcagcagagagatgaagaacatcgaccccaaggccgccgacaccaagaaggccaaccacatgttcatcccccccagcgccgtgaacgaggagagccccgacaagaagaccaaggagggcaagggcggcgagggcaagagaagagagaccgaggtggagcacttcttccccctgaccagcaagccctag

SEQ ID NO: 25745 - DNA, 546 bp, Artificial Sequence
  Description of Artificial Sequence: Synthetic coding sequence
atgagcgagctgcccttcaccatcgccagcaagagaatcaagtacctgagaatccagctgaccagagacgtgaaggacctgttcaagaagaactacaagcccctgctgaacgagatcaaggaggacaccaacaagtggaagaacatcccctgcagctggatcggcagaatcaacatcatgaagatggccatcctgcccaaggtgatctacagattcaacgccatccccatcaagctgcccatgaccttcttcaccaagctggagaagaccaccctgaagttcatctggaaccagaagagagccctgatcgccaagaccatcatcagcaagaagaacaaggccggcggcatcaccctgcccgacttcaagctgtgctacaaggccaccgtgaccaagaccgcctgctgctggtacctgaacagagacatcgaccagtggaacagaaccgaggtgagcgagatcaccatccacatctacaaccacctgatcttcgacaagcccgacaagaacaagcagtggggcaaggacagcctgttcaacaagtag

SEQ ID NO: 25746 - DNA, 1737 bp, Artificial Sequence
  Description of Artificial Sequence: Synthetic coding sequence
atggccgaggagacccagcacaacaagctggccgccgccaagaagaagctgaaggagtactggcagaagaacagccccagagtgcccgccggcgccaacagaaacagaaagaccaacggcagcatccccgagaaggccaccagcggcggctgccagccccccagagacagcgccaccggcttccacagagagggccccaccagcagcgccaccctgaaggacctggagagcccctgccaggagagagccgtggtgctggacagcagaagcgtggagatcagccagctgaagaacaccatcaagagcctgaagcagcagaagaagcaggtggagcaccagctggaggaggagaagaaggccaacaacaagaagcagaaggccaagagagtgctggaggtgcagatccagaccctgaacatccagaaggaggagctgaacaccgacctgtaccacatgaagagaagcctgagatacttcgaggagaagagcaaggacctggccgtgagactgcagcacagcctgcagagaaagggcgagctggagagcgtgctgagcaacgtgatggccacccagaagaagaaggccaaccagctgaaggagagcttccagcaggtgcagctggagagagacgagtacagcgagcacctgaagggcgagagagccagatggcagcagagaatgagaaagatgagccaggagatctgcaccctgaagaaggagaagcagcaggacatgagaagagtggagaagctggagagaagcctgagcaagctgaagaaccagatggccgagcccctgccccccgagccccccgccgtgcccagcgaggtggagctgcagcacctgagaaaggagctggagagagtggccggcgagctgcaggcccaggtgaagaagaaccagagaatcagcctgctgaaccagagacaggaggagagaatccaggagcaggaggagagactgagaaagcaggaggagagaatccaggagcagcacaagagcctgcagcagctggccaagccccagagcgtgttcgaggagcccgagcacctggaggccgccagccagcagaaccagcagctgaccgcccagctgagcctgatggccctgcccggcgagggccacggcgagcacctggacagcgagggcgaggaggccccccagcccatgcccagcgtgcccgaggacctggagagcagagaggccatgagcagcttcatggaccacctgaaggagaaggccgacctgagcgagctggtgaagaaggagctgtgcttcatccaccactggagagacagaagacaccagaagacccaccacctgctgagcgagcccggcggctgcgccaaggacgccgccctgggcggcggccaccaccaggccggcgcccagggcggcgacgagggcgaggccgccggcgccgccgccgacggcatcgccgcctacagcaactacaacaacggccacagaaagttcctggccgccgcccacaaccccgccgacgagcccggccccggcgcccccgccccccaggagctgggcgccgccgacaagcacggcgacctgagagaggtgagcctgaccagcagcgcccagggcgaggccagagaggaccccctgctggacaagcccaccgcccagcccatcgtgcaggaccacaaggagcaccccggcctgggcagcaactgctgcgtgcccctgttctgctgggcctggctgcccagaagaagaagatag

SEQ ID NO: 25747 - DNA, 1824 bp, Artificial Sequence
  Description of Artificial Sequence: Synthetic coding sequence
atggccgaggagacccagcacaacaagctggccgccgccaagaagaagctgaaggagtactggcagaagaacagccccagagtgcccgccggcgccaacagaaacagaaagaccaacggcagcatccccgagaaggccaccagcggcggctgccagccccccagagacagcgccaccggcttccacagagagggccccaccagcagcgccaccctgaaggacctggagagcccctgccaggagagagccgtggtgctggacagcagaagcgtggagatcagccagctgaagaacaccatcaagagcctgaagcagcagaagaagcaggtggagcaccagctggaggaggagaagaaggccaacaacaagaagcagaaggccaagagagtgctggaggtgcagatccagaccctgaacatccagaaggaggagctgaacaccgacctgtaccacatgaagagaagcctgagatacttcgaggagaagagcaaggacctggccgtgagactgcagcacagcctgcagagaaagggcgagctggagagcgtgctgagcaacgtgatggccacccagaagaagaaggccaaccagctgagcagcagaagcaaggccagaaccgagtggaagctggagcagagcatgagagaggaggccctgctgaaggtgcagctgacccagctgaaggagagcttccagcaggtgcagctggagagagacgagtacagcgagcacctgaagggcgagagagccagatggcagcagagaatgagaaagatgagccaggagatctgcaccctgaagaaggagaagcagcaggacatgagaagagtggagaagctggagagaagcctgagcaagctgaagaaccagatggccgagcccctgccccccgagccccccgccgtgcccagcgaggtggagctgcagcacctgagaaaggagctggagagagtggccggcgagctgcaggcccaggtgaagaagaaccagagaatcagcctgctgaaccagagacaggaggagagaatccaggagcaggaggagagactgagaaagcaggaggagagaatccaggagcagcacaagagcctgcagcagctggccaagccccagagcgtgttcgaggagcccgagcacctggaggccgccagccagcagaaccagcagctgaccgcccagctgagcctgatggccctgcccggcgagggccacggcgagcacctggacagcgagggcgaggaggccccccagcccatgcccagcgtgcccgaggacctggagagcagagaggccatgagcagcttcatggaccacctgaaggagaaggccgacctgagcgagctggtgaagaaggagctgtgcttcatccaccactggagagacagaagacaccagaagacccaccacctgctgagcgagcccggcggctgcgccaaggacgccgccctgggcggcggccaccaccaggccggcgcccagggcggcgacgagggcgaggccgccggcgccgccgccgacggcatcgccgcctacagcaactacaacaacggccacagaaagttcctggccgccgcccacaaccccgccgacgagcccggccccggcgcccccgccccccaggagctgggcgccgccgacaagcacggcgacctgagagaggtgagcctgaccagcagcgcccagggcgaggccagagaggaccccctgctggacaagcccaccgcccagcccatcgtgcaggaccacaaggagcaccccggcctgggcagcaactgctgcgtgcccctgttctgctgggcctggctgcccagaagaagaagatag

SEQ ID NO: 25748 - DNA, 258 bp, Artificial Sequence
  Description of Artificial Sequence: Synthetic coding sequence
atgatccagcaggaggagatcagaaagctggaggaggagaagaagcagctggagggcgagatcatcgacttctacaagatgaaggccgccagcgaggccctgcagacccagctgagcaccgacaccaagaaggacaagcaccccgacccctacgagttcctgctgctgagaaagatcaagcaccccggcttcaacgaggagctgaccatcaccctgctgatcatccagaagcacgtggccggcctgagccacttctag

SEQ ID NO: 25749 - DNA, 1713 bp, Artificial Sequence
  Description of Artificial Sequence: Synthetic coding sequence
atgaaccacttcagaaagatggaggtgatcaacctgaccaccctgcccatgatccccgtggacgagcacctggccgtgagcctggtggccagaaacaccatggtgaagaccgtgagaaaggagctggagaacaacccccccagctgcctgatcggcagcatgcaccaggtgaaccagaagatcgccgacatcaacctgagaaccgagcccagcgccaacagcctggccatcgagagattcgagctggagaagaaggccctgagagagaagaccagaagcagccccgaggacaaggtgaagagacagagaaagagccagtacagctgcaagggcagcgagctgagacacgccagaagcagcgtgatcaagagaaagaccgccgacaagaacctgctggccgagctgtaccagtacagcaacttcaacagcagcaagcccaacaagctgcccaacggcgtggacttctgcgacatggtgggcaacgtggtgagagccgagagagactgcctgagcggcaagcacttctgcagcggcagagagctggagaagttcctgagcagcagcagccccagagccatctggctggacagcttctggtggatcttccacgagagataccagcccaacaaggagctgcagaacaacctgttcgacagaatcgcccagcactacgccctgctgctgttcagagtgcccaagagccacagcgaggaggccctgctgaagagactgcccagcctgctgagcaaggccgtgtacaccagcttctgctgctgcttcccccagagctggttcgacacccacgagttcaagagcgacatctgcaacaccatgagcctgtggatcagcggcacctaccccagcccccagagctacgacagctgggactacagcgagctggaccccgagagattcagaagagaggagctgatgctgtacagaagaagactgaccaagggcagagagttcagcctgttcgccggcaagagagccttcagccagaagcccgcccagagcagaaagttctaccacccccagagcagcagcgccaacagccccagcgagaagaccagcagcgccaagcagaacagcgagaagagcctgagaatgcagaacaccgccaaggagcaccactgccagaccctggtgctgaagaagcccacccaggaggtgaagagaatcagcgaggccagagagtgcgagaacatgttccccaagaagagctgcgccgcctgcaagagccccgagctgaccagcaacctgttcaacatctacggcaagagccccctgatcgtgtacttcctgcagaactacgccagcctgcagcagcacggcaagaacgtgctgatcgtgagaagagagaagaccaccagcacccccgactgcacccccacctacaccgacgtgatcagcgagaccctgtgcagcatgaagaagagaaaggacaacctgaaccagctgtaccagcaccactggaccgagtggaactacttcgacaagcacctgaaggagctgcaggacaacttcagcagagagatgaagaacatcgaccccaaggccgccgacaccaagaaggccaaccacatgttcatcccccccagcgccgtgaacgaggagagccccgacaagaagaccaaggagggcaagggcggcgagggcaagagaagagagaccgaggtggagcacttcttccccctgaccagcaagccctag

SEQ ID NO: 25750 - DNA, 366 bp, Artificial Sequence
  Description of Artificial Sequence: Synthetic coding sequence
atgaccggcgtgtgcgaccacgcccagctgatcttcgtgttcttcgtggagatggagttcagatacgtggtgcccggctggagccagacccccgagctgagacagagcgcccacctgagactgcagaagtgctgggactacagacccgagcccctgtgccccagcccctggctgatcgacagccacctgctgcccgagagcctgcagggccaccccttcgtgtgcgtgtgcgtgctgatcagcccctacaagaacacctgccacaccagactgggccccaccctgctgaccagcttctacctgaaccacctgtacaaggaccccatcagcaagtacagcaccatcctgagaagctgcaacatctag

SEQ ID NO: 25751 - DNA, 474 bp, Artificial Sequence
  Description of Artificial Sequence: Synthetic coding sequence
atggccccccaggcccagcccctgcccctgctgggcaagtgcaaggccagcaacgcccccacccccagaccccccagaagacccacctggaagagaaagagcggcaaggtgagcaccaccgtgccccagccccagaccgtgcccggcagctggcccagagagagagagagaaagagagagagagacagaatcaacagcctgctgctgcagatcatcggccacagcaagcaggccctgcccggccccggcgagcccgcccagagactgacccccgcccccgccgaccccggcggcagaggcgagcagggcggcgtggccgcccagggcgccggcctggccgccggcagaagaagcgccgtgggccccagcaagctgtgcaacctggtgagcgccagcggcgccctggccgtgttcagcatcaccggcatgtgccccggcagagacgtgagcgacggcctgagaatgggccagtag

SEQ ID NO: 25752 - DNA, 507 bp, Artificial Sequence
  Description of Artificial Sequence: Synthetic coding sequence
atgaagggcaacaccaacagcgccgtgacccccgcccccaagtgccactggctggaggacctgccccccgtgagaagacagcacagatgggtgctgagccccctgagacccgccgccctgagaagactgcagctgctgagcgccgacagaagacccctgagaagaaccggcgccccccccgcccagggccccgcccagcacccctggagcagaggcccccccagaagaccccccagaagcgtgaagctgtgcagagcccagcagtggcccgagaccagagccgaccccctgcccgccggcaccagacagggcgagagccccctgcccagaggcagaagacccgacctgggccagggcagacccagcgccagaagactgcccagcggcccctggacccacagaaccagaaccagagtgagaggcagcctgagagccgccgccagaagccagaacgccagaagaggcagccccgccagacaggccgccaagcccaagctggaggcctag

SEQ ID NO: 25753 - DNA, 807 bp, Artificial Sequence
  Description of Artificial Sequence: Synthetic coding sequence
atgagaagagcccccgactgggtgcagagacaggccgcccccggcagcaagtgcagagtgccctggcagagaagagagttccccagcagaggcggcagaaagcagccccagcccggcagcagacagagaaagcagaaccccatcagcctgcccggcgagcagaacggcagaaaggccaccccccaggccggcgccctgggcgccctgggcatcagaggcatccccagcctgtgccagagcgagggcaccagatggagcagaagaggcagaagatgggccgagagatgcccccccggcgtgctgggcgccggcagaagcctgagagcccagagaagcagactgcacagcagacccccccccctgagccccctgagaaagcccggcggcagcaaccagcccagaagcgccgccgccgccggcacccacgaggcctgcctgcaggccagcggcaccaccagaggctggaagtaccacgccctgcccctgagactggaccccagaagcggccacgccggcagcgccctgaaggccggcagctgccccagactgggcggcggcggcagaggcagaggcgaggccggcgcccccagcagattctggctgcccagaagcctgcagcagctgctgcccaacgagcccagaaacgccgacgtgcagaccctgcaccccacccccagccacaccagaagaggccagagaaccggcaagggcgccagaggccccagattctggaagagcaagaacagccccgccaacagacagagcagcgccctggacttctggatcaccaccagcatcagcttctag

SEQ ID NO: 25754 - DNA, 327 bp, Artificial Sequence
  Description of Artificial Sequence: Synthetic coding sequence
atgctgctgaccagccagaccgtgttcttcttcttcttcttcttcctgagacagagcctgaccctgctgagcagcctggagtgcaacggcaccatcagcgcccactgcatcctgagactgctgggcagcagcaagagccccgccagcgccagcctggtggccggcgtgaccggcatgcaccaccacgccagactgatcttcgtgttcctggtggagatgggcttccaccacgtgggccaggccggcctggagctgctgaccagcggcaacccccccgccctggccagccagagagccgagatcaccggcgccagctacagagcctag

SEQ ID NO: 25755 - DNA, 324 bp, Artificial Sequence
  Description of Artificial Sequence: Synthetic coding sequence
atgagacccaagaccctgagaaacagcgccgccagaagcagaaaggagcccggcttcctgaaccaccacatggagggcagctgcctgcagctgggcgagctgagcagcgtgggctactggtggcccttcggccaccccggccccgcccagggccacctgcccgtggccgtgtgggccagctgggtggtggccggcatcagcatcgccctgtacctgcccccccaccccgagggcagatacgagggccccttcaagagacacaccaagaccttcagaagcgcccagtgcgccgactgcctggtgcagtgccccgccagcccctag

SEQ ID NO: 25756 - DNA, 465 bp, Artificial Sequence
  Description of Artificial Sequence: Synthetic coding sequence
atgagagacatggagagagccggcgtgaccagagtgagacagagcctgaagacctgggtggagcacggccccttcagcggcgaccccggcctgcccagaagcgtgagagtggagctgctgaccctggtggccggccccgccagaggcagaagcggccacagacagccccccccccagccccagagcctgagaagacccctgtggctgagccacagcgaccccagcctgaagttcagaaccctgggcctgagagagggcagcggcgccgagtgcctgccccccggcaccttcctgcccttcagctggagcttcagcgcccccgagctggcccacctgagcaacgccagagccccctggatccccctgcccggcgccttccagatccagcagaagcagatcttcttcttcctggagagcagaaccaagagcggcatgagaagcagaggcggcaaggacagcaagtag

SEQ ID NO: 25757 - DNA, 723 bp, Artificial Sequence
  Description of Artificial Sequence: Synthetic coding sequence
atgaacaagcagagaggcaccttcagcgaggtgagcctggcccaggaccccaagagacagcagagaaagcccaagggcaacaagagcagcatcagcggcaccgagcaggagatcttccaggtggagctgaacctgcagaaccccagcctgaaccaccagggcatcgacaagatctacgactgccagggcctgctgcccccccccgagaagctgaccgccgaggtgctgggcatcatctgcatcgtgctgatggccaccgtgctgaagaccatcgtgctgatccccttcctggagcagaacaacttcagccccaacaccagaacccagaaggccagacactgcggccactgccccgaggagtggatcacctacagcaacagctgctactacatcggcaaggagagaagaacctgggaggagagcctgcaggcctgcgccagcaagaacagcagcagcctgctgtgcatcgacaacgaggaggagatgaagttcctggccagcatcctgcccagcagctggatcggcgtgttcagaaacagcagccaccacccctgggtgaccatcaacggcctggccttcaagcacgagatcaaggacagcgaccacgccgagagaaactgcgccatgctgcacgtgagaggcctgatcagcgaccagtgcggcagcagcagaatcatcagaagaggcttcatcatgctgaccagactggtgctgaacagctag

SEQ ID NO: 25758 - DNA, 732 bp, Artificial Sequence
  Description of Artificial Sequence: Synthetic coding sequence
atggagagaagatggctgagcctgagaagcagcagctgcagcgcccccagactgaacaccgcctggggcatgagaagcagcccccaggccaccagcagcagcagcagaaacgccgccagcttcctgagactgttcagagccaccagaagagcccccagcctgtgcagactgagcctgtgcagatggcccgccaccagcgtgaccctggccggcaccttccccgccctgctgagaagagacaacaccctgagctgcttcagcagcagaagactgagcagagtggccgccagagccagcagctggggcaagagccccagcagatgcagcagcagcaagcccagaagccccaacacccagagcggcaccagcagaagcagcagccacctgaccagaatcaccttcagatggagcagaagaaagacctgcaaggagaagggcagcctggccggcgagtggagcaagctgagcagctgcaagtgcaccagctgcgacagccccggcggcaaggtgatcagccagatggccagcagcctgagcgacagcaccagcctgagcagcaagaccgtgagcggcagacccggcagcatgcagagagccagcagcagcagacccgccgccctgagatgcagcttctgcagaagcttcagcggcgtgcacagctggctgagactgagctgcttcagaagactgagcctgaccagcgacagaaagaccgccaagagactggagtag

SEQ ID NO: 25759 - DNA, 4041 bp, Artificial Sequence
  Description of Artificial Sequence: Synthetic coding sequence
atggacaacaagagagacaaggccaaggccggcgccgccgccagaacccccgccgccagagcccccggcctgctgacccccagaccccccggcagccccagaccccccccccccgtgacccccgccgccctgagagtgctgggcgccgccggcgccgtgggcagaaagcccctggccgagagagccggcggcatcggcggcgccaccatccccgagagcgcccccagagccggccccaccagaagcgccggcaccagcagcagaaaccccgccagcagaccccccgccagcggcagaggcgagagagccccccccgccaagaacaccagccccggccccgtgagcagccccggcagagccagcggcaccaccagacccggccccctgggccagaagggcctgagaatcagcgccgaggagaccgtggccagaggcaaggccaccgaggcccccaagagaagcgccctgagcgccggcgccagaagagacaccagcggccccacccccggcacccccagccccgccatggccagaagaagcagagccgccggcaccgaggtgggcctgcccagacccgcccccagcgccagacccagaccccccaccgagggccccagaaagagcgtgagcagcgccagcgagcacagcaccaccgagcccagccccgccgccagaagaagacccagcgccggcggcggcctgcagagacccgccagcagaagcctgagcagcagcgccacccccctgagcagccccgccagaagcggccccagcgccagaggcacccccagagcccccgcccaccccagccagcccaagcccaagggcctgcaggccctgagacccccccaggtgaccccccccagaaaggacgccgcccccgccctgggccccctgagcagcagccccctggccacccccagccccagcggcaccaaggccagacccgtgcccccccccgacaacgccgccacccccctgcccgccaccctgccccccagcccccccgtgaccccccccccccccgccgccctgcagagccaggccccccccaccctgcccgccaccccccacagcagcagcctgacctgccagctggccacccccctgcccctggccccccccagccccagcgccccccccagcctgcagaccctgcccagcccccccgccaccccccccagccaggtgccccccacccagctgatcatgagcttccccgaggccggcgtgagcagcctggccaccgccgccttcgtggccagcgtgagccccagcgtgagcagccccctgcagagcatgccccccacccaggccaaccccgccctgcccagcctgcccaccctgctgagccccctggccaccccccccctgagcgccatgagccccctgcagggccccgtgagccccgccaccagcctgggcaacagcgccttccccctggccgccctgccccagcccggcctgagcgccctgaccaccccccccccccaggccagccccagccccagcccccccagcctgcaggccaccccccacaccctggccaccctgcccctgcaggacagccccctgctggccaccctgcccctgcaggccagccccagccccctgaccaccgtgagcctgcaggacccccccctggtgagccccagcctgctggccagcccccccctgcaggcccccccccacccccaggccccccccagcatgaccaccccccccatgcaggccccccccagcctgcagaccatcccccccatccaggtgccccacagcctgaccagccccagcctgcaggccccccccagccccctggccctgagcagcctgcaggccaccaccagcctgggcagccccaccctgcaggccacccacagcttcctgaccatgagccccagacagacccaggccagcctgatcagccccagcagacccgccagcaccccccccgacagcccccccctgcaggcccccctgagcctgcccgccagcccccccctgcagaccagcctgagccccgccgtgagccccctgagcagccccctgaccatccaccccctgcaggccctgagcagcctggccagccacagcccccaggcccccctgagcagcctgatcatgccccccctggagacccagagcagcctggccccccccagcctgcagaccccccccgccagcctgaccaccccccccctggagaacctgcccagcctggcccccccccccctgcagaccgccagcgcccccctgaccaccccccccctggagaacctgcccagcctggcccccccccccctgcagaccgccagcgcccccctgaccaccccccacctggagacccccccctgccccgccccctgccccctgcaggccccccccagccccctgaccacccccccccccgagacccccagcagcatcgccaccccccccccccaggccccccccgccctggccagcccccccctgcagggcctgcccagcccccccctgagccccctggccaccccccccccccaggccccccccgccctggccctgccccccctgcaggccccccccagcccccccgccagcccccccctgagccccctggccacccccagcccccaggcccccaacgccctggccgtgcacctgctgcaggcccccttcagccccccccccagcccccccgtgcaggcccccttcagcccccccgccagcccccccgtgagccccagcgccaccccccccagccaggccccccccagcctggccgccccccccctgcaggtgccccccagcccccccgccagcccccccatgagccccagcgccaccccccccccccaggcccccccccccctggccgccccccccctgcaggtgccccccagcccccccgccagcccccccatgagccccagcgccacccccccccccagagtgccccccctgctggccgccccccccctgcaggtgccccccagcccccccgccagcctgcccatgagccccctggccaagccccccccccaggccccccccgccctggccaccccccccctgcaggccctgcccagcccccccgccagcttccccggccaggcccccttcagccccagcgccagcctgcccatgagccccctggccaccccccccccccaggccccccccgtgctggccgcccccctgctgcaggtgccccccagcccccccgccagccccaccctgcaggcccccagaagaccccccacccccggccccgacaccagcgtgagcggccccagactgaccctggccctggcccccggccccccccccccccccagcagaagccccagcagcaccctgagcggccccgacctggccggccacagcagcagcgccaccagcacccccgaggagctgagaggctacgacagcggccccgagggcggcgccgccgccagccccccccccgacgccgagctggccgcctgccaccccgccgcctggagcagaggccccgccccccccctggccttcagaggcgcccccggcgcccccctgccctggccccccgccaccggccccggcagcgccgacggcctgtgcaccatctacgagaccgagggccccgagagcgccacccccgcccccggcgccctggaccccggccccagccccggcaccagcggcggcaaggccgccgccggcgccggcgccggcgccagcagcagaagccccaagcaggccagactgggcgagctgcccctgggcgccctgcaggccagcgtggtgcagcacctgctgagcagaaccctgctgctggccgccgccgagggcgccgccggcggcagcggcggcggccccggcggcgccgagggcggcggcgtgaccggcggcgccagagccgccctgagcgacgccgagctgggcagatgggccgagctgctgagccccctggacgagagcagagccagcatcaccagcgtgaccagcttcagccccgacgacgtggccagcccccagggcgactggaccgtggtggaggtggagaccttccactag

SEQ ID NO: 25760 - DNA, 2010 bp, Artificial Sequence
  Description of Artificial Sequence: Synthetic coding sequence
atgttcaccctgagcctgctgagcagaggccacggcaagctgggccaggacaagcagaagctggaggtgtacttcgagcccgaggactacctgaactggagaagccccgaggactacgtgcccgtgagcaagccccaggacaagaacaacgccagccagcacagctggagcctgttcctgcccaagaccttcagcaccagaaagggcgccctgatcctgtacagcgagggcttcgccatcagcgcctggacccccaaggagagaagaaagggcccctactgccccagaggcccctggagaaagctggacctggagctgcacaccctgcaggacctgaaggaggccatcctggcctacggcagacagcagggcgagcaggacagagcctggcagccctacctgcacttcagaagccagctggagagccaggcccagagacagatccagcccggccacagcgccaagagatacctgagaggcctgctgagaacctggccccccgacgccatgtacagactgtggtgcgccggctacatcaaggacagcgtgctgctgcaggacagccagctgaacgtgcccaagaagctgagaccccagcaggacctgagcggcgtgccccccaagtaccacctgctgcccgtgttccccagcttctggatccagcagggcaagagcttcgagcagagacagcagggcctggacgagggcgaggccggcgccgccggccacgtggaccagggccccctggccaagaaccacggcagccagggcaccagactgccccccagaagaaagcagccctggcaggaggacgagacccaggccgaggacaccagcatcgagaaccacctgtgcctgtacgccagcaaggagagctacaacgagaagacccagcagaccagcagaaaggccttcggccacggcagaatcgaccacagctggctgcccagcgacaagagccacatcaccttctgcggcggcgccttccccaacagaaaggccgacctgagcgacaagcagagaaacgtgaagctgcacaaggccagaagcagccacctgctgcaggtgctgcccgccgagagaagcctgttcccccccgtggccagcgccaccggcagcagaatcatcacccccggcgaggtgaagaagaagaaggcccccaaggccctgaagctgccccccatcagcgaggagccccccagagtgctggagcccctgaagagccagttcaaggccaacgagccccccaccgagctgttcatcctgcccgtggagatccactaccacaccaagcagccccccaaggagaaggcccacagaagaggcgccccccaccccgagagcgagcccgagagcagcgaggagagcacccccgtgtggagaccccccctgaagcacgccagcctggagaccccctgggagctgaccgtgcacctgcccgtggacgccagcagagacaccctgagcccccagggcagcagcagcctgccccccgccagcctgggcaacctgaccctgaagggcagcaaggccagacacaccagagtgcacagccagggcaagggcgtgtggaagggcgacgacgacgcccccccccacgacgtggccccccccctggacctgctgccccccatcaagggcaagaagagccccgagagccagaagggcgtggacagccccagaaccagcgaccacaacagcccccccagcctgcccaacatgagagtgcccagaagagccctgcccgccgcccaggaggacagcagcgaccccaccctgggccacttcctgctgggccccgacggcgagaaggtgtgcctgagcctgcccggccacacccagaccgaggccctgcccagcggcaaggcctacgagagcgtgaacagcaacatcagccacgaggaggagggccccagcagccagcacttcctgaaggacatggccgccgccgccagcgaccagggcaaggacgacgacctggagaccttcagccccaagaacagcctgtag

SEQ ID NO: 25761 - DNA, 411 bp, Artificial Sequence; identical to SEQ ID NO: 25670
  Description of Artificial Sequence: Synthetic coding sequence

SEQ ID NO: 25762 - DNA, 381 bp, Artificial Sequence
  Description of Artificial Sequence: Synthetic coding sequence
atgcccacccagcccccccccggcagcggcgaggtgagacagagccccagcggcaacggcgccctggtgcccaccggccagggctgcagaggcagaaacctgcccatccagggctacagccccgagggcagacccaccgccagcagccagcccgccggcgcctggcacagcgagagcagccagaagggcaccgcctgccccctggccctgggcagaggcggcgccagaggcggcggccagagaaagagcagaagcggcgccagagcccccggccagcccgccgaggccggcctgagcgccagccccgagaagaccagacccgagggcagagccgagagaggcagagccgtggtgtggcagagccagcccaacagatggtag

SEQ ID NO: 25763 - DNA, 699 bp, Artificial Sequence
  Description of Artificial Sequence: Synthetic coding sequence
atgttctgctgcctgggctacgagtggctgagcggcggctgcaagacctggcacagcgcctgggtgatcaacaccctggccgaccacagacacagaggcaccgacttcggcggcagcccctggctgctgatcatcaccgtgttcctgagaagctacaagttcgccatcagcctgtgcaccagctacctgtgcgtgagcttcctgaagaccatcttccccagccagaacggccacgacggcagcaccgacgtgcagcagagagccagaagaagcaactgcagaagacaggagggcatcaagatcgtgctggaggacatcttcaccctgtggagacaggtggagaccaaggtgagagccaagatcagaaagatgaaggtgaccaccaaggtgaacagacacgacaagatcaacggcaagagaaagaccgccaaggagcacctgagaaagctgagcatgaaggagagagagcacggcgagaaggagagacaggtgagcgaggccgaggagaacggcaagctggacatgaaggagatccacacctacatggagatgttccagagagcccaggccctgagaagaagagccgaggactactacagatgcaagatcacccccagcgccagaaagcccctgtgcaacagatgcacctacaacctggtgctgcccggcagcgagaagaagtactacagccacgcctag

SEQ ID NO: 25764 - DNA, 636 bp, Artificial Sequence
  Description of Artificial Sequence: Synthetic coding sequence
atggcctacctgggcccctaccccaccagcagacagcccccccagatgagactgctgccccacaacagcctgcacagacacagcagcatcgtgaccatggccagcctggaccccgcccccgccagccagcccagcctgcaggccctgaacttcctgaagagcaccagccccggccccgcccccgccagctggtggcccctgcaggcccagcccctgccccccgtgagcctgtacagccccaacgtgtgcctgaccgccgacagcagcagacccgccagcaccagcctgtggaccccccaggccaagctgcccaccttccagcagctgctgcacacccagctgctgccccccagcggcctgttcagacccagcagctgcttcaccagagccttccccggccccaccttcgtgagctggcagcccagcctggccagattcctgcccgtgagccagcagcccagacaggcccaggtgctgccccacaccggcctgagcaccagcagcctgtgcctgaccgtggccagccccggccccacccccgtgcccggcagacacctgagagcccagaacctgctgaagagcaacagccccggcccccccagcgccagcagatggcaccagcaggcccagctgtag

SEQ ID NO: 25765 - DNA, 654 bp, Artificial Sequence
  Description of Artificial Sequence: Synthetic coding sequence
atgaccctgctgcccagactggccctgagagaggaggccgccagaagaggccccctgagagcccccgtgcagcccggcctgggcgagagaagcccccagagacacagagagcccaagcagggcagagtgagccagagatggcaccccgccagagagcccctggccgccaccggcttcctgcacggcctgggccacctgggcagagccgcccagagccccagagccagctgctgcatcctgtggcccggcacctggggcgaccccctgagaaccctgggcagaagccagagagaggtgcagaccgtgtgcaccggcgtgagcggcgaccaggcccagaaggagcaggacggccacctgctggcctggagaaagatcctgctgcccggcaagaagaccacccccagaggcatcggcctgggctgcagaaccctgagccaggccaccgcccccttcctgctgcagaactggggcagaaagagagccttcagacccggcagcgagaaccccagcagcggcaccagcagacccagcagaggcagactggaggccagaagcagcggcctggacgaggcctgggaggcccagagactgaccggccacggcagattccccagccccagaaaggagaagagcctgcagagaggcctgggctag

SEQ ID NO: 25766 - DNA, 336 bp, Artificial Sequence
  Description of Artificial Sequence: Synthetic coding sequence
atggtgagcctgtgggtggaggacaccttcctgagccccggcttcggcttcgcccacgtggcctgcagcggcctgggcatgaagcagaagagaaaggccgccagcagcgagcccaccagcgaggtggccctgggcggcagcgccggccccgtgagaagccacctgcaccccgagggcctgctgtggtgcagcagatgcttcttcagcctgagacccaagggcaccgagccccccggcagaagcgccggcctgcagggcgccaccgagagaagcggctggaccagcgtgcaggcccaggcccaggcctgcgagaacctggtgcccgccgccgtgtag

SEQ ID NO: 25767 - DNA, 5103 bp, Artificial Sequence
  Description of Artificial Sequence: Synthetic coding sequence
atgaccagcgcccagtgccccgccctggcctgcgtgatgagccccctgagattctggggcccctggcccctgctgatgtggcagctgctgtggctgctggtgaaggaggcccagcccctggagtgggtgaaggaccccctgcagctgaccagcaaccccctgggcccccccgagccctggagcagccacagcagccacttccccagagagagcccccacgcccccaccctgcccgccgacccctgggacttcgaccacctgggccccagcgccagcagcgagatgcccgcccccccccaggagagcaccgagaacctggtgcccttcctggacacctgggacagcgccggcgagctgcccctggagcccgagcagttcctggccagccagcaggacctgaaggacaagctgagcccccaggagagactgcccgtgagccccaagaagctgaagaaggaccccgcccagagatggagcctggccgagatcatcggcatcatcagacagctgagcaccccccagagccagaagcagaccctgcagaacgagtacagcagcaccgacaccccctaccccggcagcctgccccccgagctgagagtgaagagcgacgagccccccggccccagcgagcaggtgggccccagccagttccacctggagcccgagacccagaaccccgagaccctggaggacatccagagcagcagcctgcagcaggaggcccccgcccagctgccccagctgctggaggaggagcccagcagcatgcagcaggaggcccccgccctgccccccgagagcagcatggagagcctgaccctgcccaaccacgaggtgagcgtgcagccccccggcgaggaccaggcctactaccacctgcccaacatcaccgtgaagcccgccgacgtggaggtgaccatcaccagcgagcccaccaacgagaccgagagcagccaggcccagcaggagacccccatccagttccccgaggaggtggagcccagcgccacccagcaggaggcccccatcgagccccccgtgccccccatggagcacgagctgagcatcagcgagcagcagcagcccgtgcagcccagcgagagccccagagaggtggagagcagccccacccagcaggagacccccggccagccccccgagcaccacgaggtgaccgtgagcccccccggccaccaccagacccaccacctggccagccccagcgtgagcgtgaagccccccgacgtgcagctgaccatcgccgccgagcccagcgccgaggtgggcaccagcctggtgcaccaggaggccaccaccagactgagcggcagcggcaacgacgtggagccccccgccatccagcacggcggcccccccctgctgcccgagagcagcgaggaggccggccccctggccgtgcagcaggagaccagcttccagagccccgagcccatcaacaacgagaaccccagccccacccagcaggaggccgccgccgagcacccccagaccgccgaggagggcgagagcagcctgacccaccaggaggcccccgcccagacccccgagttccccaacgtggtggtggcccagccccccgagcacagccacctgacccaggccaccgtgcagcccctggacctgggcttcaccatcacccccgagagcaagaccgaggtggagctgagccccaccatgaaggagacccccacccagccccccaagaaggtggtgccccagctgagagtgtaccagggcgtgaccaaccccacccccggccaggaccaggcccagcaccccgtgagccccagcgtgaccgtgcagctgctggacctgggcctgaccatcacccccgagcccaccaccgaggtgggccacagcaccccccccaagagaaccatcgtgagccccaagcaccccgaggtgaccctgccccaccccgaccaggtgcagacccagcacagccacctgaccagagccaccgtgcagcccctggacctgggcttcaccatcacccccaagagcatgaccgaggtggagcccagcaccgccctgatgaccaccgcccccccccccggccaccccgaggtgaccctgccccccagcgacaagggccaggcccagcacagccacctgacccaggccaccgtgcagcccctggacctggagctgaccatcaccaccaagcccaccaccgaggtgaagcccagccccaccaccgaggagaccagcacccagccccccgacctgggcctggccatcatccccgagcccaccaccgagaccggccacagcaccgccctggagaagaccaccgcccccagacccgacagagtgcagaccctgcacagaagcctgaccgaggtgaccggcccccccaccgagctggagcccgcccaggacagcctggtgcagagcgagagctacacccagaacaaggccctgaccgcccccgaggagcacaaggccagcaccagcaccaacatctgcgagctgtgcacctgcggcgacgagatgctgagctgcatcgacctgaaccccgagcagagactgagacaggtgcccgtgcccgagcccaacacccacaacggcaccttcaccatcctgaacttccagggcaactacatcagctacatcgacggcaacgtgtggaaggcctacagctggaccgagaagctgatcctgagagagaacaacctgaccgagctgcacaaggacagcttcgagggcctgctgagcctgcagtacctggacctgagctgcaacaagatccagagcatcgagagacacaccttcgagcccctgcccttcctgaagttcatcaacctgagctgcaacgtgatcaccgagctgagcttcggcaccttccaggcctggcacggcatgcagttcctgcacaagctgatcctgaaccacaaccccctgaccaccgtggaggacccctacctgttcaagctgcccgccctgaagtacctggacatgggcaccaccctggtgcccctgaccaccctgaagaacatcctgatgatgaccgtggagctggagaagctgatcctgcccagccacatggcctgctgcctgtgccagttcaagaacagcatcgaggccgtgtgcaagaccgtgaagctgcactgcaacagcgcctgcctgaccaacaccacccactgccccgaggaggccagcgtgggcaaccccgagggcgccttcatgaaggtgctgcaggccagaaagaactacaccagcaccgagctgatcgtggagcccgaggagcccagcgacagcagcggcatcaacctgagcggcttcggcagcgagcagctggacaccaacgacgagagcgacttcatcagcaccctgagatacatcctgccctacttcagcgccgtgaacctggacgtgaagagcctgctgctgcccctgatcaagctgcccaccaccggcaacagcctggccaagatccagaccgtgggccagaacagacagagagtgaagagagtgctgatgggccccagaagcatccagaagagacacttcaaggaggtgggcagacagagcatcagaagagagcagggcgcccaggccagcgtggagaacgccgccgaggagaagagactgggcagccccgcccccagagaggtggagcagccccacacccagcagggccccgagaagctggccggcaacgccgtgtacaccaagcccagcttcacccaggagcacaaggccgccgtgagcgtgctgaagcccttcagcaagggcgcccccagcaccagcagccccgccaaggccctgccccaggtgagagacagatggaaggacctgacccacgccatcagcaccctggagagcgccaaggccagagtgaccaacaccaagaccagcaagcccatcgtgcacgccagaaagaagtacagattccacaagaccagaagccacgtgacccacagaacccccaaggtgaagaagagccccaaggtgagaaagaagagctacctgagcagactgatgctggccaacagactgcccttcagcgccgccaagagcctgatcaacagccccagccagggcgccttcagcagcctgggcgacctgagcccccaggagaaccccttcctggaggtgagcgcccccagcgagcacttcatcgagaagaacaacaccaagcacaccaccgccagaaacgccttcgaggagaacgacttcatggagaacaccaacatgcccgagggcaccatcagcgagaacaccaactacaaccacccccccgaggccgacagcgccggcaccgccttcaacctgggccccaccgtgaagcagaccgagaccaagtgggagtacaacaacgtgggcaccgacctgagccccgagcccaagagcttcaactaccccctgctgagcagccccggcgaccagttcgagatccagctgacccagcagctgcagagcctgatccccaacaacaacgtgagaagactgatcgcccacgtgatcagaaccctgaagatggactgcagcggcacccacgtgcaggtgacctgcgccaagctgatcagcagaaccggccacctgatgaagctgctgagcggccagcaggaggtgaaggccagcaagatcgagtgggacaccgaccagtggaagatcgagaactacatcaacgagagcaccgaggcccagagcgagcagaaggagaagagcctggagctgaagaaggaggtgcccggctacggctacaccgacaagctgatcctggccctgatcgtgaccggcatcctgaccatcctgatcatcctgttctgcctgatcgtgatctgctgccacagaagaagcctgcaggaggacgaggagggcttcagcagaggcatcttcagattcctgcccagaagaggctgcagcagcagaagagagagccaggacggcctgagcagcttcggccagcccctgtggttcaaggacatgtacaagcccctgagcgccaccagaatcaacaaccacgcctggaagctgcacaagaagagcagcaacgaggacaagatcctgaacagagaccccggcgacagcgaggcccccaccgaggaggaggagagcgaggccctgccctag

SEQ ID NO: 25768 - DNA, 4908 bp, Artificial Sequence
  Description of Artificial Sequence: Synthetic coding sequence
atgaccagcgcccagtgccccgccctggcctgcgtgatgagccccctgagattctggggcccctggcccctgctgatgtggcagctgctgtggctgctggtgaaggaggcccagcccctggagtgggtgaaggaccccctgcagctgaccagcaaccccctgggcccccccgagccctggagcagccacagcagccacttccccagagagagcccccacgcccccaccctgcccgccgacccctgggacttcgaccacctgggccccagcgccagcagcgagatgcccgcccccccccaggagagcaccgagaacctggtgcccttcctggacacctgggacagcgccggcgagctgcccctggagcccgagcagttcctggccagccagcaggacctgaaggacaagctgagcccccaggagagactgcccgtgagccccaagaagctgaagaaggaccccgcccagagatggagcctggccgagatcatcggcatcatcagacagctgagcaccccccagagccagaagcagaccctgcagaacgagtacagcagcaccgacaccccctaccccggcagcctgccccccgagctgagagtgaagagcgacgagccccccggccccagcgagcaggtgggccccagccagttccacctggagcccgagacccagaaccccgagaccctggaggacatccagagcagcagcctgcagcaggaggcccccgcccagctgccccagctgctggaggaggagcccagcagcatgcagcaggaggcccccgccctgccccccgagagcagcatggagagcctgaccctgcccaaccacgaggtgagcgtgcagccccccggcgaggaccaggcctactaccacctgcccaacatcaccgtgaagcccgccgacgtggaggtgaccatcaccagcgagcccaccaacgagaccgagagcagccaggcccagcaggagacccccatccagttccccgaggaggtggagcccagcgccacccagcaggaggcccccatcgagccccccgtgccccccatggagcacgagctgagcatcagcgagcagcagcagcccgtgcagcccagcgagagccccagagaggtggagagcagccccacccagcaggagacccccggccagccccccgagcaccacgaggtgaccgtgagcccccccggccaccaccagacccaccacctggccagccccagcgtgagcgtgaagccccccgacgtgcagctgaccatcgccgccgagcccagcgccgaggtgggcaccagcctggtgcaccaggaggccaccaccagactgagcggcagcggcaacgacgtggagccccccgccatccagcacggcggcccccccctgctgcccgagagcagcgaggaggccggccccctggccgtgcagcaggagaccagcttccagagccccgagcccatcaacaacgagaaccccagccccacccagcaggaggccgccgccgagcacccccagaccgccgaggagggcgagagcagcctgacccaccaggaggcccccgcccagacccccgagttccccaacgtggtggtggcccagccccccgagcacagccacctgacccaggccaccgtgcagcccctggacctgggcttcaccatcacccccgagagcaagaccgaggtggagctgagccccaccatgaaggagacccccacccagccccccaagaaggtggtgccccagctgagagtgtaccagggcgtgaccaaccccacccccggccaggaccaggcccagcaccccgtgagccccagcgtgaccgtgcagctgctggacctgggcctgaccatcacccccgagcccaccaccgaggtgggccacagcaccccccccaagagaaccatcgtgagccccaagcaccccgaggtgaccctgccccaccccgaccaggtgcagacccagcacagccacctgaccagagccaccgtgcagcccctggacctgggcttcaccatcacccccaagagcatgaccgaggtggagcccagcaccgccctgatgaccaccgcccccccccccggccaccccgaggtgaccctgccccccagcgacaagggccaggcccagcacagccacctgacccaggccaccgtgcagcccctggacctggagctgaccatcaccaccaagcccaccaccgaggtgaagcccagccccaccaccgaggagaccagcacccagccccccgacctgggcctggccatcatccccgagcccaccaccgagaccggccacagcaccgccctggagaagaccaccgcccccagacccgacagagtgcagaccctgcacagaagcctgaccgaggtgaccggcccccccaccgagctggagcccgcccaggacagcctggtgcagagcgagagctacacccagaacaaggccctgaccgcccccgaggagcacaaggccagcaccagcaccaacatctgcgagctgtgcacctgcggcgacgagatgctgagctgcatcgacctgaaccccgagcagagactgagacaggtgcccgtgcccgagcccaacacccacaacggcaccttcaccatcctgaacttccagggcaactacatcagctacatcgacggcaacgtgtggaaggcctacagctggaccgagaagctgatcctgagagagaacaacctgaccgagctgcacaaggacagcttcgagggcctgctgagcctgcagtacctggacctgagctgcaacaagatccagagcatcgagagacacaccttcgagcccctgcccttcctgaagttcatcaacctgagctgcaacgtgatcaccgagctgagcttcggcaccttccaggcctggcacggcatgcagttcctgcacaagctgatcctgaaccacaaccccctgaccaccgtggaggacccctacctgttcaagctgcccgccctgaagtacctggacatgggcaccaccctggtgcccctgaccaccctgaagaacatcctgatgatgaccgtggagctggagaagctgatcctgcccagccacatggcctgctgcctgtgccagttcaagaacagcatcgaggccgtgtgcaagaccgtgaagctgcactgcaacagcgcctgcctgaccaacaccacccactgccccgaggaggccagcgtgggcaaccccgagggcgccttcatgaaggtgctgcaggccagaaagaactacaccagcaccgagctgatcgtggagcccgaggagcccagcgacagcagcggcatcaacctgagcggcttcggcagcgagcagctggacaccaacgacgagagcgacttcatcagcaccctgagatacatcctgccctacttcagcgccgtgaacctggacgtgaagagcctgctgctgcccctgatcaagctgcccaccaccggcaacagcctggccaagatccagaccgtgggccagaacagacagagagtgaagagagtgctgatgggccccagaagcatccagaagagacacttcaaggaggtgggcagacagagcatcagaagagagcagggcgcccaggccagcgtggagaacgccgccgaggagaagagactgggcagccccgcccccagagaggtggagcagccccacacccagcagggccccgagaagctggccggcaacgccgtgtacaccaagcccagcttcacccaggagcacaaggccgccgtgagcgtgctgaagcccttcagcaagggcgcccccagcaccagcagccccgccaaggccctgccccaggtgagagacagatggaaggacctgacccacgccatcagcaccctggagagcgccaaggccagagtgaccaacaccaagaccagcaagcccatcgtgcacgccagaaagaagtacagattccacaagaccagaagccacgtgacccacagaacccccaaggtgaagaagagccccaaggtgagaaagaagagctacctgagcagactgatgctggccaacagactgcccttcagcgccgccaagagcctgatcaacagccccagccagggcgccttcagcagcctgggcgacctgagcccccaggagaaccccttcctggaggtgagcgcccccagcgagcacttcatcgagaagaacaacaccaagcacaccaccgccagaaacgccttcgaggagaacgacttcatggagaacaccaacatgcccgagggcaccatcagcgagaacaccaactacaaccacccccccgaggccgacagcgccggcaccgccttcaacctgggccccaccgtgaagcagaccgagaccaagtgggagtacaacaacgtgggcaccgacctgagccccgagcccaagagcttcaactaccccctgctgagcagccccggcgaccagttcgagatccagctgacccagcagctgcagagcctgatccccaacaacaacgtgagaagactgatcgcccacgtgatcagaaccctgaagatggactgcagcggcacccacgtgcaggtgacctgcgccaagctgatcagcagaaccggccacctgatgaagctgctgagcggccagcaggaggtgaaggccagcaagatcgagtgggacaccgaccagtggaagatcgagaactacatcaacgagagcaccgaggcccagagcgagcagaaggagaagagcctggagctgaagaaggaggtgcccggctacggctacaccgacaagctgatcctggccctgatcgtgaccggcatcctgaccatcctgatcatcctgttctgcctgatcgtgatctgctgccacagaagaagcctgcaggaggacgaggagggcttcagcagagacagcgaggcccccaccgaggaggaggagagcgaggccctgccctag

SEQ ID NO: 25769 - DNA, 1701 bp, Artificial Sequence
  Description of Artificial Sequence: Synthetic coding sequence
atgaagatgcagaagggcaacgtgctgctgatgttcggcctgctgctgcacctggaggccgccaccaacagcaacgagaccagcaccagcgccaacaccggcagcagcgtgatcagcagcggcgccagcaccgccaccaacagcggcagcagcgtgaccagcagcggcgtgagcaccgccaccatcagcggcagcagcgtgaccagcaacggcgtgagcatcgtgaccaacagcgagttccacaccaccagcagcggcatcagcaccgccaccaacagcgagttcagcaccgccagcagcggcatcagcatcgccaccaacagcgagagcagcaccaccagcagcggcgccagcaccgccaccaacagcgagagcagcacccccagcagcggcgccagcaccgccaccaacagcgagagcagcaccctgagcagcggcgccagcaccgccaccaacagcgacagcagcaccaccagcagcggcgccagcaccgccaccaacagcgagagcagcaccaccagcagcggcgccagcaccgccaccaacagcgagagcagcaccgtgagcagcagagccagcaccgccaccaacagcgagagcagcaccaccagcagcggcgccagcaccgccaccaacagcgagagcagaaccaccagcaacggcgccggcaccgccaccaacagcgagagcagcaccaccagcagcggcgccagcaccgccaccaacagcgacagcagcaccgtgagcagcggcgccagcaccgccaccaacagcgagagcagcaccaccagcagcggcgccagcaccgccaccaacagcgagagcagcaccaccagcagcggcgccagcaccgccaccaacagcgacagcagcaccaccagcagcggcgccggcaccgccaccaacagcgagagcagcaccgtgagcagcggcatcagcaccgtgaccaacagcgagagcagcacccccagcagcggcgccaacaccgccaccaacagcgagagcagcaccaccagcagcggcgccaacaccgccaccaacagcgagagcagcaccgtgagcagcggcgccagcaccgccaccaacagcgagagcagcaccaccagcagcggcgtgagcaccgccaccaacagcgagagcagcaccaccagcagcggcgccagcaccgccaccaacagcgacagcagcaccaccagcagcgaggccagcaccgccaccaacagcgagagcagcaccgtgagcagcggcatcagcaccgtgaccaacagcgagagcagcaccaccagcagcggcgccaacaccgccaccaacagcggcagcagcgtgaccagcgccggcagcggcaccgccgccctgaccggcatgcacaccaccagccacagcgccagcaccgccgtgagcgaggccaagcccggcggcagcctggtgccctgggagatcttcctgatcaccctggtgagcgtggtggccgccgtgggcctgttcgccggcctgttcttctgcgtgagaaacagcctgagcctgagaaacaccttcaacaccgccgtgtaccacccccacggcctgaaccacggcctgggccccggccccggcggcaaccacggcgccccccacagacccagatggagccccaactggttctggagaagacccgtgagcagcatcgccatggagatgagcggcagaaacagcggcccctag

SEQ ID NO: 25770 - DNA, 375 bp, Artificial Sequence; identical to SEQ ID NO: 25730
  Description of Artificial Sequence: Synthetic coding sequence

SEQ ID NO: 25771 - DNA, 816 bp, Artificial Sequence
  Description of Artificial Sequence: Synthetic coding sequence
atgttcctgagcgaggagaagctgcactacagaagcgccagaaccaaggagctggacgccctgctgggcgacctgcactgcgagatcagagaccaggagaccctgctgatgtaccagctgcagtgccaggtgctggccagagccgccgtgctgaccagagtgctggacctggccagcagactggacgtgctgctggccctggccagcgccgccagagactacggctacagcagacccagatacagcccccaggtgctgggcgtgagaatccagaacggcagacaccccctgatggagctgtgcgccagaaccttcgtgcccaacagcaccgagtgcggcggcgacaagggcagagtgaaggtgatcaccggccccaacagcagcggcaagagcatctacctgaagcaggtgggcctgatcaccttcatggccctggtgggcagcttcgtgcccgccgaggaggccgagatcggcgccgtggacgccatcttcaccagaatccacagctgcgagagcatcagcctgggcctgagcaccttcatgatcgacctgaaccaggtggccaaggccgtgaacaacgccaccgcccagagcctggtgctgatcgacgagttcggcaagggcaccaacaccgtggacggcctggccctgctggccgccgtgctgagacactggctggccagaggccccacctgcccccacatcttcgtggccaccaacttcctgagcctggtgcagctgcagctgctgccccagggccccctggtgcagtacctggactggcccagagtgagcggccaggagggcggcgactag

SEQ ID NO: 25772 - DNA, 372 bp, Artificial Sequence
  Description of Artificial Sequence: Synthetic coding sequence
atgcagagcgagaagccccagggcctgttcctgcagctgaaccccaacgccagcagcaccgagacccagctgctggtgcccgccctggagagcagagacaccctgccccccacccactgcttcatggccggcaccgagagccccctgggcaacccctggcccctgagcctgccccccccctgctggaccggctgcgtgctgcccgcccccagaggccagagaaagcccggccccctgggcctgagcatcttcatcagcctgggcaacaagagacacagaagcggcaaccacgtggtgagagagagcgagcagcccctgagccagggcaacccccaccagggctggggccccgacaccagaaagggcagatag

SEQ ID NO: 25773 - DNA, 102 bp, Artificial Sequence
  Description of Artificial Sequence: Synthetic coding sequence
atgctgaacttcgacatcagcgccgcccccagaaagaccgccctgatgaagctggagaccatcatccacagcaagctgctgcagggccagaagaccaagtag

SEQ ID NO: 25774 - DNA, 102 bp, Artificial Sequence; identical to SEQ ID NO: 25773
  Description of Artificial Sequence: Synthetic coding sequence

SEQ ID NO: 25775 - DNA, 2025 bp, Artificial Sequence
  Description of Artificial Sequence: Synthetic coding sequence
atgcagttctacaccctgaagatcatcctgaaccacaaccccctgaccaccgtggaggacccctacctgttcaagctgcccgccctgaagtacctggacatgggcaccaccctggtgcccctgaccaccctgaagaacatcctgatgatgaccgtggagctggagaagctgatcctgcccagccacatggcctgctgcctgtgccagttcaagaacagcatcgaggccgtgtgcaagaccgtgaagctgcactgcaacagcgcctgcctgaccaacaccacccactgccccgaggaggccagcgtgggcaaccccgagggcgccttcatgaaggtgctgcaggccagaaagaactacaccagcaccgagctgatcgtggagcccgaggagcccagcgacagcagcggcatcaacctgagcggcttcggcagcgagcagctggacaccaacgacgagagcgacttcatcagcaccctgagatacatcctgccctacttcagcgccgtgaacctggacgtgaagagcctgctgctgcccctgatcaagctgcccaccaccggcaacagcctggccaagatccagaccgtgggccagaacagacagagagtgaagagagtgctgatgggccccagaagcatccagaagagacacttcaaggaggtgggcagacagagcatcagaagagagcagggcgcccaggccagcgtggagaacgccgccgaggagaagagactgggcagccccgcccccagagaggtggagcagccccacacccagcagggccccgagaagctggccggcaacgccgtgtacaccaagcccagcttcacccaggagcacaaggccgccgtgagcgtgctgaagcccttcagcaagggcgcccccagcaccagcagccccgccaaggccctgccccaggtgagagacagatggaaggacctgacccacgccatcagcaccctggagagcgccaaggccagagtgaccaacaccaagaccagcaagcccatcgtgcacgccagaaagaagtacagattccacaagaccagaagccacgtgacccacagaacccccaaggtgaagaagagccccaaggtgagaaagaagagctacctgagcagactgatgctggccaacagactgcccttcagcgccgccaagagcctgatcaacagccccagccagggcgccttcagcagcctgggcgacctgagcccccaggagaaccccttcctggaggtgagcgcccccagcgagcacttcatcgagaagaacaacaccaagcacaccaccgccagaaacgccttcgaggagaacgacttcatggagaacaccaacatgcccgagggcaccatcagcgagaacaccaactacaaccacccccccgaggccgacagcgccggcaccgccttcaacctgggccccaccgtgaagcagaccgagaccaagtgggagtacaacaacgtgggcaccgacctgagccccgagcccaagagcttcaactaccccctgctgagcagccccggcgaccagttcgagatccagctgacccagcagctgcagagcctgatccccaacaacaacgtgagaagactgatcgcccacgtgatcagaaccctgaagatggactgcagcggcgcccacgtgcaggtgacctgcgccaagctgatcagcagaaccggccacctgatgaagctgctgagcggccagcaggaggtgaaggccagcaagatcgagtgggacaccgaccagtggaagatcgagaactacatcaacgagagcaccgaggcccagagcgagcagaaggagaagagcctggagctgaagaaggaggtgcccggctacggctacaccgacaagctgatcctggccctgatcgtgaccggcatcctgaccatcctgatcatcctgttctgcctgatcgtgatctgctgccacagaagaagcctgcaggaggacgaggagggcttcagcagagacagcgaggcccccaccgaggaggaggagagcgaggccctgccctag

SEQ ID NO: 25776 - DNA, 4908 bp, Artificial Sequence
  Description of Artificial Sequence: Synthetic coding sequence
atgaccagcgcccagtgccccgccctggcctgcgtgatgagccccctgagattctggggcccctggcccctgctgatgtggcagctgctgtggctgctggtgaaggaggcccagcccctggagtgggtgaaggaccccctgcagctgaccagcaaccccctgggcccccccgagccctggagcagccacagcagccacttccccagagagagcccccacgcccccaccctgcccgccgacccctgggacttcgaccacctgggccccagcgccagcagcgagatgcccgcccccccccaggagagcaccgagaacctggtgcccttcctggacacctgggacagcgccggcgagctgcccctggagcccgagcagttcctggccagccagcaggacctgaaggacaagctgagcccccaggagagactgcccgtgagccccaagaagctgaagaaggaccccgcccagagatggagcctggccgagatcatcggcatcatcagacagctgagcaccccccagagccagaagcagaccctgcagaacgagtacagcagcaccgacaccccctaccccggcagcctgccccccgagctgagagtgaagagcgacgagccccccggccccagcgagcaggtgggccccagccagttccacctggagcccgagacccagaaccccgagaccctggaggacatccagagcagcagcctgcagcaggaggcccccgcccagctgccccagctgctggaggaggagcccagcagcatgcagcaggaggcccccgccctgccccccgagagcagcatggagagcctgaccctgcccaaccacgaggtgagcgtgcagccccccggcgaggaccaggcctactaccacctgcccaacatcaccgtgaagcccgccgacgtggaggtgaccatcaccagcgagcccaccaacgagaccgagagcagccaggcccagcaggagacccccatccagttccccgaggaggtggagcccagcgccacccagcaggaggcccccatcgagccccccgtgccccccatggagcacgagctgagcatcagcgagcagcagcagcccgtgcagcccagcgagagccccagagaggtggagagcagccccacccagcaggagacccccggccagccccccgagcaccacgaggtgaccgtgagcccccccggccaccaccagacccaccacctggccagccccagcgtgagcgtgaagccccccgacgtgcagctgaccatcgccgccgagcccagcgccgaggtgggcaccagcctggtgcaccaggaggccaccaccagactgagcggcagcggcaacgacgtggagccccccgccatccagcacggcggcccccccctgctgcccgagagcagcgaggaggccggccccctggccgtgcagcaggagaccagcttccagagccccgagcccatcaacaacgagaaccccagccccacccagcaggaggccgccgccgagcacccccagaccgccgaggagggcgagagcagcctgacccaccaggaggcccccgcccagacccccgagttccccaacgtggtggtggcccagccccccgagcacagccacctgacccaggccaccgtgcagcccctggacctgggcttcaccatcacccccgagagcaagaccgaggtggagctgagccccaccatgaaggagacccccacccagccccccaagaaggtggtgccccagctgagagtgtaccagggcgtgaccaaccccacccccggccaggaccaggcccagcaccccgtgagccccagcgtgaccgtgcagctgctggacctgggcctgaccatcacccccgagcccaccaccgaggtgggccacagcaccccccccaagagaaccatcgtgagccccaagcaccccgaggtgaccctgccccaccccgaccaggtgcagacccagcacagccacctgaccagagccaccgtgcagcccctggacctgggcttcaccatcacccccaagagcatgaccgaggtggagcccagcaccgccctgatgaccaccgcccccccccccggccaccccgaggtgaccctgccccccagcgacaagggccaggcccagcacagccacctgacccaggccaccgtgcagcccctggacctggagctgaccatcaccaccaagcccaccaccgaggtgaagcccagccccaccaccgaggagaccagcacccagccccccgacctgggcctggccatcatccccgagcccaccaccgagaccggccacagcaccgccctggagaagaccaccgcccccagacccgacagagtgcagaccctgcacagaagcctgaccgaggtgaccggcccccccaccgagctggagcccgcccaggacagcctggtgcagagcgagagctacacccagaacaaggccctgaccgcccccgaggagcacaaggccagcaccagcaccaacatctgcgagctgtgcacctgcggcgacgagatgctgagctgcatcgacctgaaccccgagcagagactgagacaggtgcccgtgcccgagcccaacacccacaacggcaccttcaccatcctgaacttccagggcaactacatcagctacatcgacggcaacgtgtggaaggcctacagctggaccgagaagctgatcctgagagagaacaacctgaccgagctgcacaaggacagcttcgagggcctgctgagcctgcagtacctggacctgagctgcaacaagatccagagcatcgagagacacaccttcgagcccctgcccttcctgaagttcatcaacctgagctgcaacgtgatcaccgagctgagcttcggcaccttccaggcctggcacggcatgcagttcctgcacaagctgatcctgaaccacaaccccctgaccaccgtggaggacccctacctgttcaagctgcccgccctgaagtacctggacatgggcaccaccctggtgcccctgaccaccctgaagaacatcctgatgatgaccgtggagctggagaagctgatcctgcccagccacatggcctgctgcctgtgccagttcaagaacagcatcgaggccgtgtgcaagaccgtgaagctgcactgcaacagcgcctgcctgaccaacaccacccactgccccgaggaggccagcgtgggcaaccccgagggcgccttcatgaaggtgctgcaggccagaaagaactacaccagcaccgagctgatcgtggagcccgaggagcccagcgacagcagcggcatcaacctgagcggcttcggcagcgagcagctggacaccaacgacgagagcgacttcatcagcaccctgagatacatcctgccctacttcagcgccgtgaacctggacgtgaagagcctgctgctgcccctgatcaagctgcccaccaccggcaacagcctggccaagatccagaccgtgggccagaacagacagagagtgaagagagtgctgatgggccccagaagcatccagaagagacacttcaaggaggtgggcagacagagcatcagaagagagcagggcgcccaggccagcgtggagaacgccgccgaggagaagagactgggcagccccgcccccagagaggtggagcagccccacacccagcagggccccgagaagctggccggcaacgccgtgtacaccaagcccagcttcacccaggagcacaaggccgccgtgagcgtgctgaagcccttcagcaagggcgcccccagcaccagcagccccgccaaggccctgccccaggtgagagacagatggaaggacctgacccacgccatcagcaccctggagagcgccaaggccagagtgaccaacaccaagaccagcaagcccatcgtgcacgccagaaagaagtacagattccacaagaccagaagccacgtgacccacagaacccccaaggtgaagaagagccccaaggtgagaaagaagagctacctgagcagactgatgctggccaacagactgcccttcagcgccgccaagagcctgatcaacagccccagccagggcgccttcagcagcctgggcgacctgagcccccaggagaaccccttcctggaggtgagcgcccccagcgagcacttcatcgagaagaacaacaccaagcacaccaccgccagaaacgccttcgaggagaacgacttcatggagaacaccaacatgcccgagggcaccatcagcgagaacaccaactacaaccacccccccgaggccgacagcgccggcaccgccttcaacctgggccccaccgtgaagcagaccgagaccaagtgggagtacaacaacgtgggcaccgacctgagccccgagcccaagagcttcaactaccccctgctgagcagccccggcgaccagttcgagatccagctgacccagcagctgcagagcctgatccccaacaacaacgtgagaagactgatcgcccacgtgatcagaaccctgaagatggactgcagcggcgcccacgtgcaggtgacctgcgccaagctgatcagcagaaccggccacctgatgaagctgctgagcggccagcaggaggtgaaggccagcaagatcgagtgggacaccgaccagtggaagatcgagaactacatcaacgagagcaccgaggcccagagcgagcagaaggagaagagcctggagctgaagaaggaggtgcccggctacggctacaccgacaagctgatcctggccctgatcgtgaccggcatcctgaccatcctgatcatcctgttctgcctgatcgtgatctgctgccacagaagaagcctgcaggaggacgaggagggcttcagcagagacagcgaggcccccaccgaggaggaggagagcgaggccctgccctag

SEQ ID NO: 25777 - DNA, 2262 bp, Artificial Sequence
  Description of Artificial Sequence: Synthetic coding sequence
atggagttccacagagtggcccaggccggcgtggagctgctgagcagcggcgacccccccgccagcgccagccagagcgtgggcatcatcggcgtgagccactgcacctggcacatcaacttccagggcaactacatcagctacatcgacggcaacgtgtggaaggcctacagctggaccgagaagctgatcctgagagagaacaacctgaccgagctgcacaaggacagcttcgagggcctgctgagcctgcagtacctgatcctgaaccacaaccccctgaccaccgtggaggacccctacctgttcaagctgcccgccctgaagtacctggacatgggcaccaccctggtgcccctgaccaccctgaagaacatcctgatgatgaccgtggagctggagaagctgatcctgcccagccacatggcctgctgcctgtgccagttcaagaacagcatcgaggccgtgtgcaagaccgtgaagctgcactgcaacagcgcctgcctgaccaacaccacccactgccccgaggaggccagcgtgggcaaccccgagggcgccttcatgaaggtgctgcaggccagaaagaactacaccagcaccgagctgatcgtggagcccgaggagcccagcgacagcagcggcatcaacctgagcggcttcggcagcgagcagctggacaccaacgacgagagcgacttcatcagcaccctgagatacatcctgccctacttcagcgccgtgaacctggacgtgaagagcctgctgctgcccctgatcaagctgcccaccaccggcaacagcctggccaagatccagaccgtgggccagaacagacagagagtgaagagagtgctgatgggccccagaagcatccagaagagacacttcaaggaggtgggcagacagagcatcagaagagagcagggcgcccaggccagcgtggagaacgccgccgaggagaagagactgggcagccccgcccccagagaggtggagcagccccacacccagcagggccccgagaagctggccggcaacgccgtgtacaccaagcccagcttcacccaggagcacaaggccgccgtgagcgtgctgaagcccttcagcaagggcgcccccagcaccagcagccccgccaaggccctgccccaggtgagagacagatggaaggacctgacccacgccatcagcaccctggagagcgccaaggccagagtgaccaacaccaagaccagcaagcccatcgtgcacgccagaaagaagtacagattccacaagaccagaagccacgtgacccacagaacccccaaggtgaagaagagccccaaggtgagaaagaagagctacctgagcagactgatgctggccaacagactgcccttcagcgccgccaagagcctgatcaacagccccagccagggcgccttcagcagcctgggcgacctgagcccccaggagaaccccttcctggaggtgagcgcccccagcgagcacttcatcgagaagaacaacaccaagcacaccaccgccagaaacgccttcgaggagaacgacttcatggagaacaccaacatgcccgagggcaccatcagcgagaacaccaactacaaccacccccccgaggccgacagcgccggcaccgccttcaacctgggccccaccgtgaagcagaccgagaccaagtgggagtacaacaacgtgggcaccgacctgagccccgagcccaagagcttcaactaccccctgctgagcagccccggcgaccagttcgagatccagctgacccagcagctgcagagcctgatccccaacaacaacgtgagaagactgatcgcccacgtgatcagaaccctgaagatggactgcagcggcgcccacgtgcaggtgacctgcgccaagctgatcagcagaaccggccacctgatgaagctgctgagcggccagcaggaggtgaaggccagcaagatcgagtgggacaccgaccagtggaagatcgagaactacatcaacgagagcaccgaggcccagagcgagcagaaggagaagagcctggagctgaagaaggaggtgcccggctacggctacaccgacaagctgatcctggccctgatcgtgaccggcatcctgaccatcctgatcatcctgttctgcctgatcgtgatctgctgccacagaagaagcctgcaggaggacgaggagggcttcagcagagacagcgaggcccccaccgaggaggaggagagcgaggccctgccctag

SEQ ID NO: 25778 - DNA, 372 bp, Artificial Sequence; identical to SEQ ID NO: 25772
  Description of Artificial Sequence: Synthetic coding sequence

SEQ ID NO: 25779 - DNA, 876 bp, Artificial Sequence
  Description of Artificial Sequence: Synthetic coding sequence
agcgccggcggcggcggcgccggcagcagactgcaggccgagatgctgcagatggacctgatcgacgccaccggcgacagcacccccgacgagcccgacgtgcacttcagcaagaagttcctgaacatcttcatgagcggcagaagcagaagcagcagcgccgagagcttcggcctgttcagctgcatcatcaacagagaggagcaggagcagacccacagaaccatcttcagattcgtgcccagacacgaggacgagcccgagctggaggtggacgaccccctgctggtggagctgcaggccgaggactactggtacgaggcctacaacatgagaaccggcgccagaggcttcttcaccgcctactacgccatcgaggtgaccaaggagcccgagcacatggccgccctggccaagaacagcgactgggtggaccagttcagagtgaagttcctgggcagcgtgcaggtgccctaccacaagggcgacgtggtgctgagcgccgccatgcagaagatcgccaccaccagaagactgaccgtgcacttcaacccccccagcagctgcgtgctggagatcagcgtgagaggcgtgaagatcggcgtgaaggccgacgacagccaggaggccaagggcaacaagtgcagccacttcttccagctgaagaacatcagcttcagaggctaccaccccaagaacaacaagtacttcggcttcatcaccaagcacctggccgaccacagattcgcctgccacgtgttcgtgagcgaggacagcaccaaggccctggccgagagcgtgggcagagccttccagcagttccacaagcagttcgtggagtacacctgccccaccgaggacatctacctggagtag

SEQ ID NO: 25780 - DNA, 2055 bp, Artificial Sequence
  Description of Artificial Sequence: Synthetic coding sequence
atggcctgcctgggcttcctgctgcccgtgggcttcctgctgctgatcagcaccgtggccggcggcaagtacggcgtggcccacgtggtgagcgagaactggagcaaggactactgcatcctgttcagcagcgactacatcaccctgcccagagacctgcaccacgcccccctgctgcccctgtacgacggcaccaaggccccctggtgccccggcgaggacagcccccaccaggcccagctgagaagccccagccagagacccctgagacagaccaccgccatggtgatgagaggcaactgcagcttccacaccaagggctggctggcccagggccagggcgcccacggcctgctgatcgtgagcagagtgagcgaccagcagtgcagcgacaccaccctggccccccaggaccccagacagcccctggccgacctgaccatccccgtggccatgctgcactacgccgacatgctggacatcctgagccacaccagaggcgaggccgtggtgagagtggccatgtacgccccccccgagcccatcatcgactacaacatgctggtgatcttcatcctggccgtgggcaccgtggccgccggcggctactgggccggcctgaccgaggccaacagactgcagagaagaagagccagaagaggcggcggccccggcggccaccaccagctgcaggaggccgccgccgccgagggcgcccagaaggaggacaacgaggacatccccgtggacttcacccccgccatgaccggcgtggtggtgaccctgagctgcagcctgatgctgctgctgtacttcttctacgaccacttcgtgtacgtgaccatcggcatcttcggcctgggcgccggcatcggcctgtacagctgcctgagccccctggtgtgcagactgagcctgagacagtaccagagacccccccacagcctgtgggccagcctgcccctgcccctgctgctgctggccagcctgtgcaccaccgtgatcatcttctgggtggcctacagaaacgaggacagatgggcctggctgctgcaggacaccctgggcatcagctactgcctgttcgtgctgcacagagtgagactgcccaccctgaagaactgcagcagcttcctgctggccctgctggccttcgacgtgttcttcgtgttcgtgacccccttcttcaccaagaccggcgagagcatcatggcccaggtggccctgggccccgccgagagcagcagccacgagagactgcccatggtgctgaaggtgcccagactgagagtgagcgccctgaccctgtgcagccagcccttcagcatcctgggcttcggcgacatcgtggtgcccggcttcctggtggcctactgctgccccttcgacgtgcaggtgtgcagcagacaggtgtacttcgtggcctgcaccgtggcctacgccgtgggcctgctggtgaccttcatggccatggtgctgatgcagatgggccagcccgccctgctgtacctggtgagcagcaccctgctgaccagcctggccgtggccgcctgcagacaggagctgagcctgttctggaccggccagggcagagccaagatgtgcggcctgggctgcgcccccagcgccggcagcagacagaagcaggagggcgccgccgacgcccacaccgccagcaccctggagagaggcaccagcagaggcgccggcgacctggacagcaaccccggcgaggacaccaccgagatcgtgaccatcagcgagaacgaggccaccaaccccgaggacagaagcgacagccccgagggctggagcgacgcccacctggaccccaacgagctgcccttcatcccccccagagccagcgaggagctgatgcccctgatgcccatggccatgctgatccccctgatgcccctgatgcccagacccagcgagctgggccacgtgcacgcccaggcccaggcccacgagaccggcctgccctgggccggcctgcacaagagaaagggcctgaaggtgagaaagagcatgagcacccaggcccccctgtag

SEQ ID NO: 25781 - DNA, 372 bp, Artificial Sequence; identical to SEQ ID NO: 25772
  Description of Artificial Sequence: Synthetic coding sequence

SEQ ID NO: 25782 - DNA, 2025 bp, Artificial Sequence
  Description of Artificial Sequence: Synthetic coding sequence
atgcagttctacaccctgaagatcatcctgaaccacaaccccctgaccaccgtggaggacccctacctgttcaagctgcccgccctgaagtacctggacatgggcaccaccctggtgcccctgaccaccctgaagaacatcctgatgatgaccgtggagctggagaagctgatcctgcccagccacatggcctgctgcctgtgccagttcaagaacagcatcgaggccgtgtgcaagaccgtgaagctgcactgcaacagcgcctgcctgaccaacaccatccactgccccgaggaggccagcgtgggcaaccccgagggcgccttcatgaaggtgctgcaggccagaaagaactacaccagcaccgagctgatcgtggagcccgaggagcccagcgacagcagcggcatcaacctgagcggcttcggcagcgagcagctggacaccaacgacgagagcgacttcatcagcaccctgagatacatcctgccctacttcagcgccgtgaacctggacgtgaagagcctgctgctgcccctgatcaagctgcccaccaccggcaacagcctggccaagatccagaccgtgggccagaacagacagagagtgaagagagtgctgatgggccccagaagcatccagaagagacacttcaaggaggtgggcagacagagcatcagaagagagcagggcgcccaggccagcgtggagaacgccgccgaggagaagagactgggcagccccgcccccagagaggtggagcagccccacacccagcagggccccgagaagctggccggcaacgccgtgtacaccaagcccagcttcacccaggagcacaaggccgccgtgagcgtgctgaagcccttcagcaagggcgcccccagcaccagcagccccgccaaggccctgccccaggtgagagacagatggaaggacctgacccacgccatcagcatcctggagagcgccaaggccagagtgaccaacaccaagaccagcaagcccatcgtgcacgccagaaagaagtacagattccacaagaccagaagccacgtgacccacagaacccccaaggtgaagaagagccccaaggtgagaaagaagagctacctgagcagactgatgctggccaacagactgcccttcagcgccgccaagagcctgatcaacagccccagccagggcgccttcagcagcctgggcgacctgagcccccaggagaaccccttcctggaggtgagcgcccccagcgagcacttcatcgagaagaacaacaccaagcacaccaccgccagaaacgccttcgaggagaacgacttcatggagaacaccaacatgcccgagggcaccatcagcgagaacaccaactacaaccacccccccgaggccgacagcgccggcaccgccttcaacctgggccccaccgtgaagcagaccgagaccaagtgggagtacaacaacgtgggcaccgaccccagccccgagcccaagagcttcaactaccccctgctgagcagccccggcgaccagttcgagatccagctgacccagcagctgcagagcctgatccccaacaacaacgtgagaagactgatcgcccacgtgatcagaaccctgaagatggactgcagcggcgcccacgtgcaggtgacctgcgccaagctgatcagcagaaccggccacctgatgaagctgctgagcggccagcaggaggtgaaggccagcaagatcgagtgggacaccgaccagtggaagatcgagaactacatcaacgagagcaccgaggcccagagcgagcagaaggagaagagcctggagctgaagaaggaggtgcccggctacggctacaccgacaagctgatcctggccctgatcgtgaccggcatcctgaccatcctgatcatcctgttctgcctgatcgtgatctgctgccacagaagaagcctgcaggaggacgaggagggcttcagcagagacagcgaggcccccaccgaggaggaggagagcgaggccctgccctag

SEQ ID NO: 25783 - DNA, 393 bp, Artificial Sequence
  Description of Artificial Sequence: Synthetic coding sequence
ggcgccagaagccccggcagcacccaccagggcagcctggccagcggcgtgctgcccatcaagtgcagccacgtggagttcggcatgtggaagggcggcagaagccaccccttcctgccccacagcagcagatgcgccggcagcggcggccagctggacagcatcctgccccaccagagccccgcctggggcccctggggctgcaaggacctgagcagcggcttccccagcttcctgaccagcagcatcctgtggaagagcgccgtggtgagagagccccacatcagcccccaccaggcccccccctacaagaccagcgactgcatcagagccatcagcttccccgtgtgcaccatccaccaggagatcatgagaggccactggcacaagtag

SEQ ID NO: 25784 - DNA, 876 bp, Artificial Sequence; identical to SEQ ID NO: 25779
  Description of Artificial Sequence: Synthetic coding sequence

SEQ ID NO: 25785 - DNA, 1593 bp, Artificial Sequence
  Description of Artificial Sequence: Synthetic coding sequence
atgagcctgaagtggaccagcgtgttcctgctgatccagctgagctgctacttcagcagcggcagctgcggcaaggtgctggtgtggcccaccgagtacagccactggatcaacatgaagaccatcctggaggagctggtgcagagaggccacgaggtgaccgtgctgaccagcagcgccagcaccctggtgaacgccagcaagagcagcgccatcaagctggaggtgtaccccaccagcctgaccaagaacgacctggaggacagcctgctgaagatcctggacagatggatctacggcgtgagcaagaacaccttctggagctacttcagccagctgcaggagctgtgctgggagtactacgactacagcaacaagctgtgcaaggacgccgtgctgaacaagaagctgatgatgaagctgcaggagagcaagttcgacgtgatcctggccgacgccctgaacccctgcggcgagctgctggccgagctgttcaacatccccttcctgtacagcctgagattcagcgtgggctacaccttcgagaagaacggcggcggcttcctgttcccccccagctacgtgcccgtggtgatgagcgagctgagcgaccagatgatcttcatggagagaatcaagaacatgatccacatgctgtacttcgacttctggttccagatctacgacctgaagaagtgggaccagttctacagcgaggtgctgggcagacccaccaccctgttcgagaccatgggcaaggccgagatgtggctgatcagaacctactgggacttcgagttccccagacccttcctgcccaacgtggacttcgtgggcggcctgcactgcaagcccgccaagcccctgcccaaggagatggaggagttcgtgcagagcagcggcgagaacggcatcgtggtgttcagcctgggcagcatgatcagcaacatgagcgaggagagcgccaacatgatcgccagcgccctggcccagatcccccagaaggtgctgtggagattcgacggcaagaagcccaacaccctgggcagcaacaccagactgtacaagtggctgccccagaacgacctgctgggccaccccaagaccaaggccttcatcacccacggcggcaccaacggcatctacgaggccatctaccacggcatccccatggtgggcatccccctgttcgccgaccagcacgacaacatcgcccacatgaaggccaagggcgccgccctgagcgtggacatcagaaccatgagcagcagagacctgctgaacgccctgaagagcgtgatcaacgaccccgtgtacaaggagaacgtgatgaagctgagcagaatccaccacgaccagcccatgaagcccctggacagagccgtgttctggatcgagttcgtgatgagacacaagggcgccaagcacctgagagtggccgcccacaacctgacctggatccagtaccacagcctggacgtgatcgccttcctgctggcctgcgtggccaccgtgatcttcatcatcaccaagttctgcctgttctgcttcagaaagctggccaagaagggcaagaagaagaagagagactag

SEQ ID NO: 25786 - DNA, 102 bp, Artificial Sequence; identical to SEQ ID NO: 25773
  Description of Artificial Sequence: Synthetic coding sequence

SEQ ID NO: 25787 - DNA, 375 bp, Artificial Sequence
  Description of Artificial Sequence: Synthetic coding sequence
atgaccctgaacgagcacgccgccttcaagcacctgttcaacaaggcccacctggccccccccctgatccacctgaccctgagcggccacagcacctgcttcagagagcacagagtgggcggcaaggtgaccgaccagcaggaccccaaggccgaggagttcttcctggtgcagaacaagatgaagagcctgccctgcctgctgctgagcacccagaccggccagcccagcgacttcagcatcttcagcccccccttcccccccttctacagcaccaagccccccctgagcagctggcccatccccaacgagcccctgggcaccccccccagaagaggcagaggcagagccgagggcctgctgaccagccagtag

SEQ ID NO: 25788 - DNA, 474 bp, Artificial Sequence
  Description of Artificial Sequence: Synthetic coding sequence
atgcacccctggctgggcagcgccctgggcttccccaagtgcagaggcatccacctgtgcgcctgcggcaacggctggacccccggcgagaccctgagccagaacaagaccgagatcaccaagaacaaggtgacctgctggagaccccacggctgcgagcccaacaccggcctgggctaccagggcagccacaccagcaagtacaccctgctgccctggaacctgctgaagaccaagcccctgccccccagccacggcaaggagggcggcaaggaggccaaggtgcccagcggcgacaacagcggcagaggcgaggtgcccagagcccaggagggccaggccgcctgcggcagagccgccagcggcgacagccaggagggcatgagaagaggctgcgaggagagagccaccgcccagagacccgccgtgagaagcgccgagaccaccgcccacggcacctggatctacccctag

SEQ ID NO: 25789 - DNA, 612 bp, Artificial Sequence
  Description of Artificial Sequence: Synthetic coding sequence
atgggcaacatcttcgagaagctgttcaagagcctgctgggcaagaagaagatgagaatcctgatcctgagcctggacaccgccggcaagaccaccatcctgtacaagctgaagctgggcgagaccgtgcccgccgtgcccaccgtgggcttctgcgtggagaccgtggagtacaagaacaacaccttcggcgtgtgggacgtgggcagccacttcaagatcagacccctgtggcagcacttcttccagaacaccaagggcgccagaagccccggcagcacccaccagggcagcctggccagcggcgtgctgcccatcaagtgcagccacgtggagttcggcatgtggaagggcggcagaagccaccccttcctgccccacagcagcagatgcgccggcagcggcggccagctggacagcatcctgccccaccagagccccgcctggggcccctggggctgcaaggacctgagcagcggcttccccagcttcctgaccagcagcatcctgtggaagagcgccgtgagctaccagctgcccagcctgcacaacagcagcagaaactacgccggcagcctggcccagatgatgagacacctgctggaggcctag

SEQ ID NO: 25790 - DNA, 1701 bp, Artificial Sequence
  Description of Artificial Sequence: Synthetic coding sequence
atgaagatgcagaagggcaacgtgctgctgatgttcggcctgctgctgcacctggaggccgccaccaacagcaacgagaccagcaccagcgccaacaccggcagcagcgtgatcagcagcggcgccagcaccgccaccaacagcggcagcagcgtgaccagcagcggcgtgagcaccgccaccatcagcggcagcagcgtgaccagcaacggcgtgagcatcgtgaccaacagcgagttccacaccaccagcagcggcatcagcaccgccaccaacagcgagttcagcaccgccagcagcggcatcagcatcgccaccaacagcgagagcagcaccaccagcagcggcgccagcaccgccaccaacagcgagagcagcacccccagcagcggcgccagcaccgccaccaacagcgagagcagcaccctgagcagcggcgccagcaccgccaccaacagcgacagcagcaccaccagcagcggcgccagcaccgccaccaacagcgagagcagcaccaccagcagcggcgccagcaccgccaccaacagcgagagcagcaccgtgagcagcagagccagcaccgccaccaacagcgagagcagcaccaccagcagcggcgccagcaccgccaccaacagcgagagcagaaccaccagcaacggcgccggcaccgccaccaacagcgagagcagcaccaccagcagcggcgccagcaccgccaccaacagcgacagcagcaccaccagcagcggcgccggcaccgccaccaacagcgagagcagcaccaccagcagcggcgccagcaccgccaccaacagcgagagcagcaccaccagcagcggcgccagcaccgccaccaacagcgacagcagcaccaccagcagcggcgccggcaccgccaccaacagcgagagcagcaccgtgagcagcggcatcagcaccgtgaccaacagcgagagcagcacccccagcagcggcgccaacaccgccaccaacagcgagagcagcaccaccagcagcggcgccaacaccgccaccaacagcgagagcagcaccgtgagcagcggcgccagcaccgccaccaacagcgagagcagcaccaccagcagcggcgtgagcaccgccaccaacagcgagagcagcaccaccagcagcggcgccagcaccgccaccaacagcgacagcagcaccaccagcagcgaggccagcaccgccaccaacagcgagagcagcaccgtgagcagcggcatcagcaccgtgaccaacagcgagagcagcaccaccagcagcggcgccaacaccgccaccaacagcggcagcagcgtgaccagcgccggcagcggcaccgccgccctgaccggcatgcacaccaccagccacagcgccagcaccgccgtgagcgaggccaagcccggcggcagcctggtgccctgggagatcttcctgatcaccctggtgagcgtggtggccgccgtgggcctgttcgccggcctgttcttctgcgtgagaaacagcctgagcctgagaaacaccttcaacaccgccgtgtaccacccccacggcctgaaccacggcctgggccccggccccggcggcaaccacggcgccccccacagacccagatggagccccaactggttctggagaagacccgtgagcagcatcgccatggagatgagcggcagaaacagcggcccctag

SEQ ID NO: 25791 - DNA, 4908 bp, Artificial Sequence
  Description of Artificial Sequence: Synthetic coding sequence
atgaccagcgcccagtgccccgccctggcctgcgtgatgagccccctgagattctggggcccctggcccctgctgatgtggcagctgctgtggctgctggtgaaggaggcccagcccctggagtgggtgaaggaccccctgcagctgaccagcaaccccctgggcccccccgagccctggagcagccacagcagccacttccccagagagagcccccacgcccccaccctgcccgccgacccctgggacttcgaccacctgggccccagcgccagcagcgagatgcccgcccccccccaggagagcaccgagaacctggtgcccttcctggacacctgggacagcgccggcgagctgcccctggagcccgagcagttcctggccagccagcaggacctgaaggacaagctgagcccccaggagagactgcccgtgagccccaagaagctgaagaaggaccccgcccagagatggagcctggccgagatcatcggcatcatcagacagctgagcaccccccagagccagaagcagaccctgcagaacgagtacagcagcaccgacaccccctaccccggcagcctgccccccgagctgagagtgaagagcgacgagccccccggccccagcgagcaggtgggccccagccagttccacctggagcccgagacccagaaccccgagaccctggaggacatccagagcagcagcctgcagcaggaggcccccgcccagctgccccagctgctggaggaggagcccagcagcatgcagcaggaggcccccgccctgccccccgagagcagcatggagagcctgaccctgcccaaccacgaggtgagcgtgcagccccccggcgaggaccaggcctactaccacctgcccaacatcaccgtgaagcccgccgacgtggaggtgaccatcaccagcgagcccaccaacgagaccgagagcagccaggcccagcaggagacccccatccagttccccgaggaggtggagcccagcgccacccagcaggaggcccccatcgagccccccgtgccccccatggagcacgagctgagcatcagcgagcagcagcagcccgtgcagcccagcgagagccccagagaggtggagagcagccccacccagcaggagacccccggccagccccccgagcaccacgaggtgaccgtgagcccccccggccaccaccagacccaccacctggccagccccagcgtgagcgtgaagccccccgacgtgcagctgaccatcgccgccgagcccagcgccgaggtgggcaccagcctggtgcaccaggaggccaccaccagactgagcggcagcggcaacgacgtggagccccccgccatccagcacggcggcccccccctgctgcccgagagcagcgaggaggccggccccctggccgtgcagcaggagaccagcttccagagccccgagcccatcaacaacgagaaccccagccccacccagcaggaggccgccgccgagcacccccagaccgccgaggagggcgagagcagcctgacccaccaggaggcccccgcccagacccccgagttccccaacgtggtggtggcccagccccccgagcacagccacctgacccaggccaccgtgcagcccctggacctgggcttcaccatcacccccgagagcaagaccgaggtggagctgagccccaccatgaaggagacccccacccagccccccaagaaggtggtgccccagctgagagtgtaccagggcgtgaccaaccccacccccggccaggaccaggcccagcaccccgtgagccccagcgtgaccgtgcagctgctggacctgggcctgaccatcacccccgagcccaccaccgaggtgggccacagcaccccccccaagagaaccatcgtgagccccaagcaccccgaggtgaccctgccccaccccgaccaggtgcagacccagcacagccacctgaccagagccaccgtgcagcccctggacctgggcttcaccatcacccccaagagcatgaccgaggtggagcccagcaccgccctgatgaccaccgcccccccccccggccaccccgaggtgaccctgccccccagcgacaagggccaggcccagcacagccacctgacccaggccaccgtgcagcccctggacctggagctgaccatcaccaccaagcccaccaccgaggtgaagcccagccccaccaccgaggagaccagcacccagccccccgacctgggcctggccatcatccccgagcccaccaccgagaccggccacagcaccgccctggagaagaccaccgcccccagacccgacagagtgcagaccctgcacagaagcctgaccgaggtgaccggcccccccaccgagctggagcccgcccaggacagcctggtgcagagcgagagctacacccagaacaaggccctgaccgcccccgaggagcacaaggccagcaccagcaccaacatctgcgagctgtgcacctgcggcgacgagatgctgagctgcatcgacctgaaccccgagcagagactgagacaggtgcccgtgcccgagcccaacacccacaacggcaccttcaccatcctgaacttccagggcaactacatcagctacatcgacggcaacgtgtggaaggcctacagctggaccgagaagctgatcctgagagagaacaacctgaccgagctgcacaaggacagcttcgagggcctgctgagcctgcagtacctggacctgagctgcaacaagatccagagcatcgagagacacaccttcgagcccctgcccttcctgaagttcatcaacctgagctgcaacgtgatcaccgagctgagcttcggcaccttccaggcctggcacggcatgcagttcctgcacaagctgatcctgaaccacaaccccctgaccaccgtggaggacccctacctgttcaagctgcccgccctgaagtacctggacatgggcaccaccctggtgcccctgaccaccctgaagaacatcctgatgatgaccgtggagctggagaagctgatcctgcccagccacatggcctgctgcctgtgccagttcaagaacagcatcgaggccgtgtgcaagaccgtgaagctgcactgcaacagcgcctgcctgaccaacaccatccactgccccgaggaggccagcgtgggcaaccccgagggcgccttcatgaaggtgctgcaggccagaaagaactacaccagcaccgagctgatcgtggagcccgaggagcccagcgacagcagcggcatcaacctgagcggcttcggcagcgagcagctggacaccaacgacgagagcgacttcatcagcaccctgagatacatcctgccctacttcagcgccgtgaacctggacgtgaagagcctgctgctgcccctgatcaagctgcccaccaccggcaacagcctggccaagatccagaccgtgggccagaacagacagagagtgaagagagtgctgatgggccccagaagcatccagaagagacacttcaaggaggtgggcagacagagcatcagaagagagcagggcgcccaggccagcgtggagaacgccgccgaggagaagagactgggcagccccgcccccagagaggtggagcagccccacacccagcagggccccgagaagctggccggcaacgccgtgtacaccaagcccagcttcacccaggagcacaaggccgccgtgagcgtgctgaagcccttcagcaagggcgcccccagcaccagcagccccgccaaggccctgccccaggtgagagacagatggaaggacctgacccacgccatcagcatcctggagagcgccaaggccagagtgaccaacaccaagaccagcaagcccatcgtgcacgccagaaagaagtacagattccacaagaccagaagccacgtgacccacagaacccccaaggtgaagaagagccccaaggtgagaaagaagagctacctgagcagactgatgctggccaacagactgcccttcagcgccgccaagagcctgatcaacagccccagccagggcgccttcagcagcctgggcgacctgagcccccaggagaaccccttcctggaggtgagcgcccccagcgagcacttcatcgagaagaacaacaccaagcacaccaccgccagaaacgccttcgaggagaacgacttcatggagaacaccaacatgcccgagggcaccatcagcgagaacaccaactacaaccacccccccgaggccgacagcgccggcaccgccttcaacctgggccccaccgtgaagcagaccgagaccaagtgggagtacaacaacgtgggcaccgaccccagccccgagcccaagagcttcaactaccccctgctgagcagccccggcgaccagttcgagatccagctgacccagcagctgcagagcctgatccccaacaacaacgtgagaagactgatcgcccacgtgatcagaaccctgaagatggactgcagcggcgcccacgtgcaggtgacctgcgccaagctgatcagcagaaccggccacctgatgaagctgctgagcggccagcaggaggtgaaggccagcaagatcgagtgggacaccgaccagtggaagatcgagaactacatcaacgagagcaccgaggcccagagcgagcagaaggagaagagcctggagctgaagaaggaggtgcccggctacggctacaccgacaagctgatcctggccctgatcgtgaccggcatcctgaccatcctgatcatcctgttctgcctgatcgtgatctgctgccacagaagaagcctgcaggaggacgaggagggcttcagcagagacagcgaggcccccaccgaggaggaggagagcgaggccctgccctag

SEQ ID NO: 25792 - DNA, 372 bp, Artificial Sequence; identical to SEQ ID NO: 25772
  Description of Artificial Sequence: Synthetic coding sequence

SEQ ID NO: 25793 - DNA, 2262 bp, Artificial Sequence
  Description of Artificial Sequence: Synthetic coding sequence
atggagttccacagagtggcccaggccggcgtggagctgctgagcagcggcgacccccccgccagcgccagccagagcgtgggcatcatcggcgtgagccactgcacctggcacatcaacttccagggcaactacatcagctacatcgacggcaacgtgtggaaggcctacagctggaccgagaagctgatcctgagagagaacaacctgaccgagctgcacaaggacagcttcgagggcctgctgagcctgcagtacctgatcctgaaccacaaccccctgaccaccgtggaggacccctacctgttcaagctgcccgccctgaagtacctggacatgggcaccaccctggtgcccctgaccaccctgaagaacatcctgatgatgaccgtggagctggagaagctgatcctgcccagccacatggcctgctgcctgtgccagttcaagaacagcatcgaggccgtgtgcaagaccgtgaagctgcactgcaacagcgcctgcctgaccaacaccacccactgccccgaggaggccagcgtgggcaaccccgagggcgccttcatgaaggtgctgcaggccagaaagaactacaccagcaccgagctgatcgtggagcccgaggagcccagcgacagcagcggcatcaacctgagcggcttcggcagcgagcagctggacaccaacgacgagagcgacttcatcagcaccctgagatacatcctgccctacttcagcgccgtgaacctggacgtgaagagcctgctgctgcccctgatcaagctgcccaccaccggcaacagcctggccaagatccagaccgtgggccagaacagacagagagtgaagagagtgctgatgggccccagaagcatccagaagagacacttcaaggaggtgggcagacagagcatcagaagagagcagggcgcccaggccagcgtggagaacgccgccgaggagaagagactgggcagccccgcccccagagaggtggagcagccccacacccagcagggccccgagaagctggccggcaacgccgtgtacaccaagcccagcttcacccaggagcacaaggccgccgtgagcgtgctgaagcccttcagcaagggcgcccccagcaccagcagccccgccaaggccctgccccaggtgagagacagatggaaggacctgacccacgccatcagcaccctggagagcgccaaggccagagtgaccaacaccaagaccagcaagcccatcgtgcacgccagaaagaagtacagattccacaagaccagaagccacgtgacccacagaacccccaaggtgaagaagagccccaaggtgagaaagaagagctacctgagcagactgatgctggccaacagactgcccttcagcgccgccaagagcctgatcaacagccccagccagggcgccttcagcagcctgggcgacctgagcccccaggagaaccccttcctggaggtgagcgcccccagcgagcacttcatcgagaagaacaacaccaagcacaccaccgccagaaacgccttcgaggagaacgacttcatggagaacaccaacatgcccgagggcaccatcagcgagaacaccaactacaaccacccccccgaggccgacagcgccggcaccgccttcaacctgggccccaccgtgaagcagaccgagaccaagtgggagtacaacaacgtgggcaccgacctgagccccgagcccaagagcttcaactaccccctgctgagcagccccggcgaccagttcgagatccagctgacccagcagctgcagagcctgatccccaacaacaacgtgagaagactgatcgcccacgtgatcagaaccctgaagatggactgcagcggcacccacgtgcaggtgacctgcgccaagctgatcagcagaaccggccacctgatgaagctgctgagcggccagcaggaggtgaaggccagcaagatcgagtgggacaccgaccagtggaagatcgagaactacatcaacgagagcaccgaggcccagagcgagcagaaggagaagagcctggagctgaagaaggaggtgcccggctacggctacaccgacaagctgatcctggccctgatcgtgaccggcatcctgaccatcctgatcatcctgttctgcctgatcgtgatctgctgccacagaagaagcctgcaggaggacgaggagggcttcagcagagacagcgaggcccccaccgaggaggaggagagcgaggccctgccctag

SEQ ID NO: 25794 - DNA, 378 bp, Artificial Sequence
  Description of Artificial Sequence: Synthetic coding sequence
atgggcaacatcttcgagaagctgttcaagagcctgctgggcaagaagaagatgagaatcctgatcctgagcctggacaccgccggcaagaccaccatcctgtacaagctgaagctgggcgagaccgtgcccgccgtgcccaccgtgggcttctgcgtggagaccgtggagtacaagaacaacaccttcggcgtgtgggacgtgggcagccacttcaagatcagacccctgtggcagcacttcttccagaacaccaaggagctgagcgccagccagttcgcccagttcatcaagaagctgtgcggcgtgaccggcaccaacgacgaggccagccccggcagcctgaccagctaccccagccacctgctggacagatag

SEQ ID NO: 25795 - DNA, 102 bp, Artificial Sequence; identical to SEQ ID NO: 25773
  Description of Artificial Sequence: Synthetic coding sequence

SEQ ID NO: 25796 - DNA, 522 bp, Artificial Sequence
  Description of Artificial Sequence: Synthetic coding sequence
atgcccgccatgcccagccccctgtgcgcccccgccagagtgagccccagccccctgaccgccgccccccccttctgcagcctgagccccatcctgtgggtgagcctgatcctgctgctgaccagcatcagcaagtgctgcgagagcatcttcaagttcatccagaaccccttcaccagccactacttcccctgcagccaccccagccagggcaagagaagactgcaccccggcatcctgcacagcttccccaccgtgttccccaccgccagcctggtgccccacctgagcatcctgttcagcgcccagcagcccgagagaagcttccagagaatgagccccaccatgagccacttcagcaagctgagcagcccctgccacagcgagcagagaagcacccccttcccccaccccagcggcctgcccgccctggccacccccctgaccagcctgcagttcctgtgcgtgcagcccttctggctgctgccccccagcagaaacaccgacaacttcctgccctag

SEQ ID NO: 25797 - DNA, 876 bp, Artificial Sequence; identical to SEQ ID NO: 25779
  Description of Artificial Sequence: Synthetic coding sequence

SEQ ID NO: 25798 - DNA, 1272 bp, Artificial Sequence
  Description of Artificial Sequence: Synthetic coding sequence
atgatgtacagacccgacgtggtgagagccagaaagagagtgtgctgggagccctgggtgatcggcctggtgatcttcatcagcctgatcgtgctggccgtgtgcatcggcctgaccgtgcactacgtgagatacaaccagaagaagacctacaactactacagcaccctgagcttcaccaccgacaagctgtacgccgagttcggcagagaggccagcaacaacttcaccgagatgagccagagactggagagcatggtgaagaacgccttctacaagagccccctgagagaggagttcgtgaagagccaggtgatcaagttcagccagcagaagcacggcgtgctggcccacatgctgctgatctgcagattccacagcaccgaggaccccgagaccgtggacaagatcgtgcagctggtgctgcacgagaagctgcaggacgccgtgggcccccccaaggtggacccccagagcgtgaagatcaagaagatcaacaagaccgagaccgacagctacctgaaccactgctgcggcaccagaagaagcaagaccctgggccagagcctgagaatcgtgggcggcaccgaggtggaggagggcgagtggccctggcaggccagcctgcagtgggacggcagccacagatgcggcgccaccctgatcaacgccacctggctggtgagcgccgcccactgcttcaccacctacaagaaccccgccagatggaccgccagcttcggcgtgaccatcaagcccagcaagatgaagagaggcctgagaagaatcatcgtgcacgagaagtacaagcaccccagccacgactacgacatcagcctggccgagctgagcagccccgtgccctacaccaacgccgtgcacagagtgtgcctgcccgacgccagctacgagttccagcccggcgacgtgatgttcgtgaccggcttcggcgccctgaagaacgacggctacagccagaaccacctgagacaggcccaggtgaccctgatcgacgccaccacctgcaacgagccccaggcctacaacgacgccatcacccccagaatgctgtgcgccggcagcctggagggcaagaccgacgcctgccagggcgacagcggcggccccctggtgagcagcgacgccagagacatctggtacctggccggcatcgtgagctggggcgacgagtgcgccaagcccaacaagcccggcgtgtacaccagagtgaccgccctgagagactggatcaccagcaagaccggcatctag

SEQ ID NO: 25799 - DNA, 375 bp, Artificial Sequence; identical to SEQ ID NO: 25730
  Description of Artificial Sequence: Synthetic coding sequence

SEQ ID NO: 25800 - DNA, 339 bp, Artificial Sequence
  Description of Artificial Sequence: Synthetic coding sequence
tgcgacatccagatgacccagagccccagcagcctgagcgccagcgtgggcgacagagtgaccatcacctgcagagccagccagagcatcagcagctacctgaactggtaccagcagaagcccggcaaggcccccaagctgctgatctacgccgccagcagcctgcagagcggcgtgcccagcagattcagcggcagcggcagcggcaccgacttcaccctgaccatcagcagcctgcagcccgaggacttcgccacctactactgccagcagagctacagcaccccccccaccgtgctgcagggcaccagactgaagatcagcagagtggaggcctag

SEQ ID NO: 25801 - DNA, 384 bp, Artificial Sequence
  Description of Artificial Sequence: Synthetic coding sequence
atggagttcggcctgaactgggtgttcctggtggccatcatcaagggcgcccagtgcgaggtgcagctggtggagagcggcggcggcctggtgcagcccggcggcagcctgagactgagctgccccgacagcggcttcaccttcagcaaccactacatgagctgggtgagacaggcccccggcaagggcctggagtggatcagctacatcagcggcgacagcggctacaccaactacgccgacagcgtgaagggcagattcaccatcagcagagacaacgccaacaacagcccctacctgcagatgaacagcctgagagccgaggacaccgccgtgtactactgcgtgaagcacaccgccagaggcaacctgcagttctactag

SEQ ID NO: 25802 - DNA, 315 bp, Artificial Sequence
  Description of Artificial Sequence: Synthetic coding sequence
atgacccagagccccagcagcctgagcgccagcgtgggcgacagagtgaccatcacctgcagagccagccagagcatcagcagctacctgaactggtaccagcagaagcccggcaaggcccccaagctgctgatctacgccgccagcagcctgcagagcggcgtgcccagcagattcagcggcagcggcagcggcaccgacttcaccctgaccatcagcagcctgcagcccgaggacttcgccacctactactgccagcagagctacagcaccccccccaccgtgggcagcggcacctacttcaagctgaagtag

SEQ ID NO: 25803 - DNA, 348 bp, Artificial Sequence
  Description of Artificial Sequence: Synthetic coding sequence
atgctgtgggtgcccggcagcagcggcgacgtggtgatgacccagagccccctgagcctgcccgtgaccctgggccagcccgccagcatcagctgcagaagcagccagagcctggtgtacagcgacggcaacacctacctgaactggttccagcagagacccggccagagccccagaagactgatctacaaggtgagcaactgggacagcggcgtgcccgacagattcagcggcagcggcagcggcaccgacttcaccctgaagatcagcagagtggaggccgaggacgtgggcgtgtactactgcatgcagggcacccactggccccccaccgtggtgcagccctag

SEQ ID NO: 25804 - DNA, 348 bp, Artificial Sequence
  Description of Artificial Sequence: Synthetic coding sequence
atgagagtgcccgcccagctgctgggcctgctgctgctgtggctgagaggcgccagatgcgacatccagatgacccagagccccagcagcctgagcgccagcgtgggcgacagagtgaccatcacctgcagagccagccagagcatcagcagctacctgaactggtaccagcagaagcccggcaaggcccccaagctgctgatctacgccgccagcagcctgcagagcggcgtgcccagcagattcagcggcagcggcagcggcaccgacttcaccctgaccatcagcagcctgcagcccgaggacttcgccacctactactgccagcagagctacagcaccccctag

SEQ ID NO: 25805 - DNA, 432 bp, Artificial Sequence
  Description of Artificial Sequence: Synthetic coding sequence
atgtgggtgcagacccaccccagcagcgccagctacaagagctggggccccggcaccgccgacacccacaccatgagactgagcagaagacccgagaccttcctgctggccttcgtgctgctgtgcaccctgctgggcctgggctgccccctgcactgcgagatctgcaccgccgccggcagcagatgccacggccagatgaagacctgcagcagcgacaaggacacctgcgtgctgctggtgggcaaggccaccagcagcaagagaatgtggcccggcacctggtggggcggcggcgtgtacctgcagggcggcagagactaccacgccgagggcggcagcagctggttcagcagaagagagagaggcaagaagagcgtggagagcagaaaggagggcaagaccatcatgagatggagagagcagaagtag

SEQ ID NO: 25806 - DNA, 939 bp, Artificial Sequence
  Description of Artificial Sequence: Synthetic coding sequence
ctggccctgagacccagaagaatggccagcaacagacagagaagcctgagaggccccagccaccccagccacatggaggagcccttcctgcagatggtgcaggccagcgagagcctgccccccagccagacctgggcccagagagagttcttcctgcccagcgagagctgggagttccccggcttcaccagacaggcctaccaccagctggccctgaagctgcccccctgcaccgacatgaagagcaaggtgagacagagactgatccacccctggaagggcggcgcccagcacacctggggcttccacacctggctggacgtgtgcagactgcccgccaccttccccacccagcccgacagaccctacgacagcaacgtgtggagatggctgaccgacagcaacgcccacagatgcccccccaccgagcaccccatccccccccccagctggatgggccagaacagcttcctgaccttcatccactgctaccccaccttcgtggacatgaagagaaagaagcaggtgatcttcagaaccgtgaaggagctgaaggaggtggagaagctgaagctgagaagcgaggccagagccccccccctggacgcccagggcaacatccagccccccgccagcttcaagaagtacagacacatcagcgccggcggcagattcgagccccagggcctgcagctgatgcccaaccccttccccaacaacttcgccagaagctggccctgccccaaccccctgccccactaccaggagaaggtgctgaagctggccctgctgcccagcgcccccctgagccaggacctgatcagagacttccagaccctgatcaaggacagaaccgccctgcccctgcaccacctgagcaaggcccaggccagcaagagccccgccagaaagagaaagagaagacccggccacttctag

SEQ ID NO: 25807 - DNA, 456 bp, Artificial Sequence
  Description of Artificial Sequence: Synthetic coding sequence
atggccgtgagccagatgagcaagtggagactgagcagagtgggcggcagcagaagcctgcccgccgagatggaggtgctgggcgaggtgtggtgcgtgagagccgaggagcagcccatgaccggcctgggcatcgtgtggcacagccccctgctggacaaggccctggagacctggagcctgcagcagcagcccgacttcagcctgggcctgggccacctgggcctgggcaccgacgccacctggatgcagagcttccccggcagcggcggcgacgcccaggccggcaccggcgtgagcggcctgctgagactgtaccccaacctgctgtgcgacttcggccccagacagggccccctgtgggccctgctgctggagaagagacagatggccggcaccggcggcagccccgccctgctggcctggagaagcgccagctggagagccctgggctag

SEQ ID NO: 25808 - DNA, 345 bp, Artificial Sequence
  Description of Artificial Sequence: Synthetic coding sequence
atggccgtgagccagatgagcaagtggagactgagcagagtgggcggcagcagaagcctgcccgccgagatggaggtgctgggcgaggtgtggtgcgtgagagccgaggagcagcccatgaccggcctgggcatcgtgtggcacagccccctgctggacaaggccctggagacctggagcctgcagcagcagcccgacttcagcctgggcctgggccacctgggcctgggcctgtacatcctggccagctacctgctgtgccccagacagccccccagccagcccgacggcccctgcggcagccccaaccccgtgagcggcgccaagaagaccaccgtggcctag

SEQ ID NO: 25809 - DNA, 504 bp, Artificial Sequence
  Description of Artificial Sequence: Synthetic coding sequence
atgctgtgcccctgcatccaggagagcaccttcgagacctgcctgttcatggccgtgagccagatgagcaagtggagactgagcagagtgggcggcagcagaagcctgcccgccgagatggaggtgctgggcgaggtgtggtgcgtgagagccgaggagcagcccatgaccggcctgggcatcgtgtggcacagccccctgctggacaaggccctggagacctggagcctgcagcagcagcccgacttcagcctgggcctgggccacctgggcctgggcaccgacgccacctggatgcagagcttccccggcagcggcggcgacgcccaggccggcaccggcgtgagcggcctgctgagactgtaccccaacctgctgtgcgacttcggccccagacagggccccctgtgggccctgctgctggagaagagacagatggccggcaccggcggcagccccgccctgctggcctggagaagcgccagctggagagccctgggctag

SEQ ID NO: 25810 - DNA, 393 bp, Artificial Sequence
  Description of Artificial Sequence: Synthetic coding sequence
atgctgtgcccctgcatccaggagagcaccttcgagacctgcctgttcatggccgtgagccagatgagcaagtggagactgagcagagtgggcggcagcagaagcctgcccgccgagatggaggtgctgggcgaggtgtggtgcgtgagagccgaggagcagcccatgaccggcctgggcatcgtgtggcacagccccctgctggacaaggccctggagacctggagcctgcagcagcagcccgacttcagcctgggcctgggccacctgggcctgggcctgtacatcctggccagctacctgctgtgccccagacagccccccagccagcccgacggcccctgcggcagccccaaccccgtgagcggcgccaagaagaccaccgtggcctag

SEQ ID NO: 25811 - DNA, 2124 bp, Artificial Sequence
  Description of Artificial Sequence: Synthetic coding sequence
atggtggaccccgtgcccgaggaggagaaggccggcgccgagcccggcgacagcggcggcgacgaggccgtggccagcgtgccccccgacagccagggcgcccaggagcccgccgccagcagcgccagcgccagcgccagcgccgccgtgcccagaaaggccgaggtgccctgcgccgccgccgagggcggcagaagagagcagagccccctgctgcacctggacctgttcaacttcgactgccccgaggccgagggcagcagatacgtgctgaccagccccagaagcctggaggcctgcgccagatgcgccgtgaagcccgtggagctgctgcccagagccctggccgacctggtgagagaggcccccggcagaagcatgagagtggccaccggcctgtacgaggcctacgaggccgagagaagagccaagctgcagcagtgcagagccgagagagagagaatcatgagagaggagaagagaagactgttcacccccctgagccccgccgccgccgccgccgccgccgccgccgccgccagcgcccccagcgccggcagcagcagcagctgcagcagcgccagcctgcccgccagccccgcccccagagccgccagaaaggccagccccagccccagcagcgccagaacccagcccccccccgccggcagcagaaccggcagaaagagccacagcctggacagcctgagcagaagaagagagggcgccctgagcagcgagagcggcgccagcagcagcagctacagcggcgagagcctgagagagctgagatggccccccagagccagcgccagaaacagctgccccgccggcagcgccagcagcaccaccaacgcccccggcagacccagcgccctgaccctggtgcccatcaccggcagaagcttcagcctgggcgacctgagccacagcccccagaccgcccagcacgtggagagaatcgtgagacaggtgagagccgagagaggcctgagaggcgtgcccgagagagacagaaagatcgccgccctgatgctggccagacaccaggaggagctgctgctgctggagcagagagccgccgcccacggccagtgggagctgcagagagtgcacgccaagcagagaagagagagagaggagagagagaagcagagagccctggagcagggcagaagagcctgggccgcccaggtggaggagagaagaggcagaagaggcagagaggagagagaggccgccagaagaagacagagacagtacgagagaagcgaggagagaagaagagagctggccgagagacagggcctgctgagaagagagagagccgagagagccgccagagaggacagactgagaaagctgcagcaggagcagaacctgaagcagagagaggagggcctgcaggagggcagagagagagccgagcagatcagaagagagagagcccagagagccgccagagccaagcagagacaggagggccagctgcagagagagaagagagagctgagcagagccgagagagccagacacgaggccctgctgcagggcagaaccagacagcagagacaggagagagagggcctgagaagcagcctggaggccagcctgggcagagcccaggagaactacgagcacctggtggagcagagaaccagagagctgagagagagagccagaagagaggagctgcagggcagaagagccaaggaggccgccgagagaaaggagagagagcaccaggcccacctggaggccctggccagagccggcgagagaagactgcagcacgccacccaggtggccgaggaggccgtgcagcagaaggccagaagagtgggccagagcagactggagaaggagagagcccagagagccaacaaggagaaggtggagagagacgaggactgcagaagaagagagctgctgcaggccatcggcagaaagctggagagaagcgagcagctgaccagagagagaagaagcgccctggagagcgccagaagcaccgccagagccagcttccacgtgagagagaaggtgagagaggagaccaacaccagaagcttcgacagaatggtgagagaggcccagctgcacgccagcctggacagaaagtag

SEQ ID NO: 25812 - DNA, 198 bp, Artificial Sequence
  Description of Artificial Sequence: Synthetic coding sequence
atgagcgagcagaacatctgcaaccagaaggacaagagcaccctgcccttctgccaggcccacctgtgcgaggagaccaccaacagactgtgcgtgagcaacaaggccgtgtacagcctggagtgcaagtgggccgagagcgagaacagagtgagcgagggcagatggggcagaggctgcttcatcggcgtgggctag

SEQ ID NO: 25813 - DNA, 477 bp, Artificial Sequence
  Description of Artificial Sequence: Synthetic coding sequence
atgagagccagcagaagcccccccagccccagaagatgccaccaccaccacgaggccaccggcgccgccagcggcgccgccgccggcggccccggcgccggctgcgtgggcctgtgcagactggccctgacccccagcgcccaggacggcagaaacagcaccttccagacctacaagaaggaggtgtgcctgcccagacacagcatgcaccccggcccctgggccatctgctgcgagtgccagaccagattcggcggcagactgcccgtgagcagagtggaggccgccctgccctactgggtgcccctgagcctgagacccagaaagcagcacccctgctggatgcacgccgccggcaccaccgccggcggcagcgccgtgatgagcgcctgctgccccagcagcagcagcagcagaccccccaccagaaccagctacagactgctgcagagagtgtgctgccccagcgccagctag

SEQ ID NO: 25814 - DNA, 1668 bp, Artificial Sequence
  Description of Artificial Sequence: Synthetic coding sequence
atgagaagacccagcaccgccagcctgaccagaaccccccccagagccagccccaccagaatgcccagcagagccagcctgaagatgacccccttcagagccagcctgaccaagatggagagcaccgccctgctgagaaccctgcccagagccagcctgatgagaacccccaccagagccagcctgatgagaaccccccccagagccagccccaccagaaagccccccagagccagccccagaacccccagcagagccagccccaccagaagactgcccagagccagccccatgggcagcccccacagagccagccccatgagaaccccccccagagccagccccaccggcacccccagcaccgccagccccaccggcacccccagcagcgccagccccaccggcaccccccccagagccagccccaccggcaccccccccagagcctgggccaccagaagccccagcaccgccagcctgaccagaacccccagcagagccagcctgaccagatggccccccagagccagccccaccagaaccccccccagagagagccccagaatgagccacagagccagccccaccagaaccccccccagagccagccccaccagaagaccccccagagccagccccaccagaaccccccccagagagagcctgagaaccagccacagagccagccccaccagaatgccccccagagccagccccaccagaagaccccccagagccagccccaccggcagcccccccagagccagccccatgaccccccccagagccagccccagaaccccccccagagccagccccaccaccacccccagcagagccagcctgaccagaacccccagctgggccagccccaccaccacccccagcagagccagcctgatgaagatggagagcaccgtgagcatcaccagaaccccccccagagccagccccaccggcacccccagcagagccagccccaccggcacccccagcagagccagcctgaccggcagccccagcagagccagcctgaccggcacccccagcagagccagcctgatcggcacccccagcagagccagcctgaccggcaccccccccagagccagcctgaccggcaccagcagcaccgccagcctgaccagaacccccagcagagccagcctgaccagaacccagagcagcagcagcctgaccagaacccccagcatggccagcctgaccagaaccccccccagagccagcctgaccagaaccccccccagagccagcctgaccagaaccctgcccagagccagcctgaccagaaccccccccagagccagcctgaccagaacccccagcatggtgagcctgaagagaagccccagcagagccagcctgaccagaacccccagcagagccagcctgaccatgacccccagcagagccagcctgaccagaacccccagcaccgccagcctgaccggcaccccccccaccgccagcctgaccagaaccccccccaccgccagcctgaccagaagcccccccaccgccagcctgaccagaacccccagcaccgccagcctgaccagaatgcccagcaccgccagcctgaccagaaagagcaacgtgaaccagcagtgccccgccagcacccccagcagcgaggtgatcagctag

SEQ ID NO: 25815 - DNA, 1719 bp, Artificial Sequence
  Description of Artificial Sequence: Synthetic coding sequence
atgcccgtgtactgcaagtaccagttccacaagacccccgtgcacaagaccaagggcgagccccacggcacccacgtgtacttccaggacatcaacgtgatcttcctgggcgccctgcaccccagcgacctgagagagtacctggagggcccccccatggtggtggaggtgcacgacagagacagaaagagcgaggagtgcagccagaagcccgtgctgttcggcgaggaccccctggacagctacctgaacttccaggccctgatcagccccagagagaccgagaacaaccccttcgagagccagaacaagatgtggtacccctacggcatcgcccaggtgagcttcgccgacctgctgctgggccacaagtacctgaacctggccgtgcccatccacagctgcgaggtgcagcccacccactgcggccaggacagcagaagaagaaaggtggtgggcctgggcgtgcccagagacggccaccagcacggccccatgcccagaggcaactacctggaggccgacagccagctgaagctgagagtggacatcgccgtgcccctgagagccggcgccagagccgccgaccccgacctgggcggcagccagttcggcagaatcatcttcgtgttcgacttcaagaaggtgagcctgctgcacagcctgctgcaggacatcaccatgatcaacgccaaggccctgggcctggacagctaccccgtgagaaccctgcagcagatcctgagcgccttcaaggtgagagtgagagtgcaggagcagcagcacctggacgtgctgaccggcttccacctgctggacggcaagacccacctgttcatcctggagggcctggccgaccagggcctgagacagctgtgggagaaccaccagagctggatccccagaagcgagcacagaaagtacaaggtgctgtacaacagccagctgctgttcagaagcagactgtacggcgacctggaggccatcctgtaccacgtgcacctgttccagcccaccgagctgctgctgcagcaggccgtgttcttcctgagagacaccgagagaagaagagtgttccaggccctggccagaatccacgacatctgctacaacagcaccaccctgtgggacgtgaccgtgagagacctgctgcccagcagcgccatgatcaaggacctgagccaggagttcggcatgcccctgagccaggaggagctgaccgacgagaagctgttcgccctgcccccccagcccgcccccaacctggaggactaccacagcagaaacagcaccctgaccctggagatccacgcccaccaggagcccagaaagagattcacctacagccaggactacctgagcgccatggtggagcccctggacctgaaggaggaggagaagaaggcccagaagaagagcagacaggcctggctgaccgccagaggcttccaggtgaccggcctgcagagcgacaccgagagcagcttccaggacctgaagctgccccccatcaaggagctgaacgaggagtggaaggagaacagcctgttcgccaacgtgctggagcccgtgctggacagagacagatggagctgggacagacaccacgtggacttcgacctgtacaagaagcccccccccttcctggagctgctgcccagccccgcccccaagcccgtgaccgtgagaaagaagaagggcaacagccccatcagctag

SEQ ID NO: 25816 - DNA, 1719 bp, Artificial Sequence; identical to SEQ ID NO: 25815
  Description of Artificial Sequence: Synthetic coding sequence

SEQ ID NO: 25817 - DNA, 390 bp, Artificial Sequence
  Description of Artificial Sequence: Synthetic coding sequence
atgcccgtgtactgcaagtaccagttccacaagacccccgtgcacaagaccaagggcgagccccacggcacccacgtgtacttccaggacatcaacgtgatcttcctgggcgccctgcaccccagcgacctgagagagtacctggagggcccccccatggtggtggaggtgcacgacagagacagaaagagcgaggagtgcagccagaagcccgtgctgttcggcgaggaccccctggacagctacctgaacttccaggccctgatcagccccagagagaccgagaacaaccccttcgagagccagaacaagatgtggtacccctacggcatcgcccaggtgagcttcgccgacctgctgctgggccacaagtacctgaacctggcctag

SEQ ID NO: 25818 - DNA, 1068 bp, Artificial Sequence
  Description of Artificial Sequence: Synthetic coding sequence
ctgggcgtgaagggcctgcccctgtaccccgaccccagcagagtgcccggcaccaagacccagaacaacctggagagcgactacctggccagagacggccccagcagcaacagcagcttccacagcagcgaggaggagggcaccgacctggagggcgacatgctggactgcagcggcagcagacccctgctgatggagagcgaggaggaggacgagagctgcagacccccccccggcaagctgggcggcgccgtgcccttcgccccccccgaggtgagccccgagcaggccaagaccgtgcagggcggcagaaagaaccagttccaggccttcacccagcccgccaccgacggcctgagcgagcccgacgtgttcgccatcgcccccttcagaagcagcagagtgcccaacgacgacatggacatcttcagcaaggcccccttcgtgagcaagagcagcatggcccccagccagcccgaggagagcgacgtgttcctgagagcccccttcaccaagaagaagagcatggaggagctgaccgtgatccagtgcaccagccaggagctgcccgcccagaccggcctgctgagccagaccggcgacgtgcccctgcccgccggcagagagagagccgtgtacaccagcgtgcaggcccagtacagcaccgccggcttcgtgcagcagagcaacctgctgagccacagcgtgcaggccgccgaccacctggacagcatcagccccagaggcagctgcctggagagcggcggccacagcaacgacagaaacaagggcccccagctgcagaaggaggccgtgagcggccccatggccggcaagcccttcagaccccagagcctgagcaagtacagcagacactacagccccgaggacgagcccagccccgaggcccagcccatcgccgcctacaagatcgtgagccagaccaacaagcagagcatcgccggcagcgtgagcatcaccagcctgagcagcagaaccaccgagctgcccgccgccgaccccttcgccctggcccccttccccagcaagagcggcaagaagccctag

SEQ ID NO: 25819 - DNA, 462 bp, Artificial Sequence
  Description of Artificial Sequence: Synthetic coding sequence
atgcactacgtgcacgtgcacagagtgaccacccagcccagaaacaagccccagaccaagtgccccagcggcggccagagccagggccccagaggccagttcctggacaccgtgctggccgccatgtgccccatcgccatgctgctgaccgccgaccccggcatgccccccacctgcctgtggcacaccccccacgccaagcacaaggagcacctgagcatccacctgaacatggtgcccaagtgcgtgcacatgcacgtgacccacacccacaccaacagcggcagcagatacgtgggcaagtacatcctgctgatcaagtggagcctggccatgtacttcgtgcagggcagcaccctgagcaccgtgaccaagatgagccacggcaaggccctgcccgacagcgacacctacatccagttccccaaccagcagggcccccacacccccagcatcccctag

SEQ ID NO: 25820 - DNA, 366 bp, Artificial Sequence
  Description of Artificial Sequence: Synthetic coding sequence
atgcagaagcagctgctgcccctggccgccggccagagatgcgactacagccagagagagagctgctgccagagcccccacagagccgagagcgccggcgacagaagcaccgacaacggcctgcacagaggcgccgagagaagcttctgctgcgccctggaccccctgcccagaagaccccccgccggcagaagaggcagagacagaagcagcagcgcctgccccggcgccagagccagagtgtggccccccggcgcctgcgccagcttcagagacagccacaagagattcatcatgagaagaaccgccctgttccacttcacccccaccagcttccacctgagatacaccctgagaaagctgtag

SEQ ID NO: 25821 - DNA, 384 bp, Artificial Sequence
  Description of Artificial Sequence: Synthetic coding sequence
atgctgcccagcagcacccccggccccggccacgccaccgagacctgccccgccccccccggccccgagagaagccccgccgccagagcccccgccgccgccagcagcctgggccccgtgagcaccgccggcagagcccccagaggcctggacatgagcgcccaggagcccccccagggcagaagattccccatcgaggccggcgacagcagaggcctggccgccgcccccgagagccaggacagccccgaggccgtggccaccgagcacaaccccgtgagacccctgagaagatgccccggctgccactgcctgaccctgctgcacgtgcccatcgacgtgtacctggccatgggcggcagccccagagccagagccacctag

SEQ ID NO: 25822 - DNA, 408 bp, Artificial Sequence
  Description of Artificial Sequence: Synthetic coding sequence
atggtgcccgccccccccttcctgggcgtgctggagaaccccgtgccccagtgggacctgagcatcctgggcagcatcagaatcagagtgagccacaccgaggtgcagggcagcggcagcagcagaagccccgaggccctgagaaaggagagcctggaggtggagtggaccctggtgctgctggccatcccccccagaatccagcccagccagcaggacggcggcccccccaagtgctgcgacctgctgagagccgccctgctgggcagacactgccccctgtgcgtgcccgccggcgaggtgttcagccagaagagagacaacgagcaggacagaagcgagttcatcggccagaccctgaagctgctggtgaagagaaacgtgagcctggagctgagctgcagatag

SEQ ID NO: 25823 - DNA, 717 bp, Artificial Sequence
  Description of Artificial Sequence: Synthetic coding sequence
atgcccggcagaaccggcctggccggcgagatgcccgtgggctggggccccggcagagccggcgccagcgagcccaacgagagcacctgcgcccccgaggccctggacggccacctgggcgtggccagaagagagggccccatcctgggcaccctgctgggcagaggcaagggccactgccaggccctgagccagctgggccactgccccagccccgcctggaacaactacagcggcatgatggacatcggcgtggcccccagcagagtgggccccagcggccactgcggcgtgctgagaagccacagcagacccggcgagctggccgtggtgatgaaccacaaggtgcccagacacagacccgtgagcagcgtgggcaccgagctgctgtgggtgagatgcgcccccaagatggtgcagctgcccatctgctgcctgctgctgacccccgcccccggcatcggccccagagcccacggccacctgcacaccaacctggagaccagaggcctgcccagaggcaccagagagagccagcaggccgagggcgagggcgaggccatccaggagggcagaggcgcctgcaagagagcccagagaaaggagggcgagggccccagaggcccctgcgtggtgagagccggcggcgtgggctggggcaccagacaggtggccggcgagccccccctggtggactgcagcaccgccggcacctag

SEQ ID NO: 25824 - DNA, 315 bp, Artificial Sequence
  Description of Artificial Sequence: Synthetic coding sequence
atgggcctgggcgacagaagaggcagaagaagagccagcgccagcgccgccttcagaaccgccagcagcagcagctgcaactgcagcagatgcagcagcgccgacaccagaagcagcaccagcatccccctggtgcccgacaagctgagcagcggcagaagaggcagcgccggctgcagagccacccaggagctgcagtgccccagaggccccagcagactgcccggcagcaagagaggcgccagccacgcccccttcctgagcagatacctgggcctgggccacctggacatgagccagggcagaggcctgtag

SEQ ID NO: 25825 - DNA, 198 bp, Artificial Sequence
  Description of Artificial Sequence: Synthetic coding sequence
atgcccgccaagggcaagaagggcaagggccagggcaagagccacggcaagaagcagaagaagcccgaggtggacatcctgagccccgccgccatgctgaacctgtactacatcgcccacaacgtggccgactgcctgcacctgagaggcttccactggcccggcgcccccaagggcaagaagggcagaagcaagtag

SEQ ID NO: 25826 - DNA, 645 bp, Artificial Sequence
  Description of Artificial Sequence: Synthetic coding sequence
gccaccatggtgtggttctgcaacagcgccgactgccagttcagcgtgttcgccctgaccaccatcggctggatcctgagcagcaccagcaccggcctggtggagtggagaatctggtacatgaaggacaccagcctgtacccccccggcatcgcctgcgtgggcatcttcagagtgtgcatctacagaagaagaaccaacagcaccaccaccaagttctgctacagatacagctaccaggacaccttcctgcccttcgagatcagcatggcccagagattcctgctgaccgccagcatcttcggcttcttcggcagagccttcaacatgttcgccctgagaaacatgagcatgagaatgttcgaggaggacacctacaacagcttcgtggtgagcggcatcctgaacatcgccgccggcgtgttcaacctgatcgccgtgctgcagaactacgacgccgtgatcaacagccagggcatcaccttcctgcccagcctgcagatgcccttcaagcccgacgtgcaggaggtgggcaccgccatccaggtggccggcatcggcgtgctgcccatgctgctgaccggcatgttcagcctgttctacaagtgcccccccatgctgtaccagatcttccccaccacctag

SEQ ID NO: 25827 - DNA, 345 bp, Artificial Sequence
  Description of Artificial Sequence: Synthetic coding sequence
atgtacaccagcctgaagagcaccttcgtggccttcgccgacggcagaggcaccaccgagagcatgcccagcccccccctggccaacagcaaccacgagagccccgtgaaccagctgggcaacatgcagaacatgagactgggccccagcttcatcctgaccggcatcttcctgggcaacggcagaaccgaggccagccccttcttcaccgacgagttcgccctgagcaagatcttccccgagtacaagagaaacctgttcggcaagttccagaccaacatggccttcagcctggagctggacccccccagcctgctgctgagcgtggtgctgttcatgttctag

SEQ ID NO: 25828 - DNA, 1086 bp, Artificial Sequence
  Description of Artificial Sequence: Synthetic coding sequence
atggccccccagagagccggccccggcctgggcaagcccagcagcaagaagagcagagccctgagaggcggccccggcgtgcccagagccagacagagaagccccagagccgccgccgagctgaacaccgaggtgcccaagcccagcgccaaggacgtggagatcctggagcaggagagcgaggtgctggagcccagcgtggagcaggacgccgagagccccggcctgagcaccgccgccggcttcgagagccccgagcccggcagagacgaccccggccccagcgaggcccagagagccgaggtgcagggccagcaccccccccccggccccaagaccagcagcagcagaagcggcagcgaggccccccacctgagattccccccctgccccgaggccccccagagaccccccgaggagagattcatggagacccccatcgagagagagatcagaagaagctgcgagagagaggagagcctgagaagaagcagaggcctgagccccggcagagccggcagagagctggtggagctgagagtgagacccgtgctgaacctgcccggccccggccccgccctgcccagagccctggagagagccagagccggcgcccagatgcagagagacatcgagagagaggcccacagacaggccgccctggccagacccgccgtgcccgagcccagagccagaagccccccccagcccctgggcgagctgaagagattcttcgaggccgccgccggcagcggcagcagcgccggcgccggcgacggcgccggcccccagagactgcccgagcccggcggcagacccagaagcgccgtgcagggcggctgcagagtgctgggcagcgcccccccccccttcacccccagcctgctggagcaggaggtgagagccgtgagagagagagagcaggagctgcagagacagagaagaagcgtgtacggcaccgccgagttcaaggagcccacccccagcctgaccgccagcagaggcgacggcaagctggtggtgatctggccccccagaagaaaggtgagcgagaacggcctggagcaggaggagagaaagccctag

SEQ ID NO: 25829 - DNA, 366 bp, Artificial Sequence
  Description of Artificial Sequence: Synthetic coding sequence
atgaccgacagaaacagagacaagaagagcaccagccccagcaacagcgacaccgagatgaagagcgagcagctgcccccctgcgtgaaccccggcaaccccgtgttcagctgcatgctggaccccaagaccctgcagaccgccaccagcctgagcaagccccagatgatcatgtacaagaccaacagcagccactacggcgagttcctgcccatcccccagttcttcccctgcaactacacccccaaggagcaggtgttcagcagccacatcagagccaccggcttctaccagaacaacaccctgaacaccgcccccgacagaaccagaaccctggacttccccaacatccagcacaccctgtag

SEQ ID NO: 25830 - DNA, 561 bp, Artificial Sequence
  Description of Artificial Sequence: Synthetic coding sequence
atggagcagcccaaggacggcgccggccccgagggcaacaacctgagcctgcccagcagcggcaccgagccctggccccccgcccccctgcccgcccccccccccctgctgctgaacagcaccgaccccacccacctgggcctgcccgagagcgtggccagcgtgaccgtgcccatcagactggacaccctgagctgcctgctgcacagcgccctgctgggcgcctacaccttccagcaggccctgcccagctgcccctgctgcagccaggccggccacagccagcccggcgccgtgagaagaccccccagaggcagaggcggctgggaggtgagacacagacccggctggggcagaggcctgcacagaagaggcctgggcagagccgagcagcccgagagaggcagagccggcggccccggcgccggccccagaaccccccccatgaccctgcccagcccccccaccctgcccgcccaggacggcaagaaggaggccagaggccccgagccccccctggagacccccctggccgccgaggactgggagaccgagtactag

SEQ ID NO: 25831 - DNA, 357 bp, Artificial Sequence
  Description of Artificial Sequence: Synthetic coding sequence
atgcagagcctgagacccgagcagaccagaggcctgctggagcccgagagaaccaagaccctgctgcccagagagagcagagcctgggagaagcccccccaccccgcctgcaccaaggactgggaggccgtggaggtgggcgccagcagccacgacagcgacgagaaggacctgagcagccaggagaccggcctgagccaggagtggagcagcgtggaggaggacgacgagagcgagggcagccagggcttcgtggagtggagcaaggccccccagcagaccaccatcgtgctggtggtgtgcgtgctgttcctgttcctggtgctgaccggcatgcccatgatgttccacatctag

SEQ ID NO: 25832 - DNA, 315 bp, Artificial Sequence
  Description of Artificial Sequence: Synthetic coding sequence
atgggcagaatccccggcggctgcagcagcaaggccttcatcggcagagcccagtggctgacccccgtgatccccgccctgtgggaggccaagggcctgaccctgctgagcagactggagtgcagcgacgtgatcatggaccactgcagcccccagctgaccggcctgagaatgaagggcttcctggcccagaccccccccctggagttccccgtgcaccagtaccagcccggcgaccacgtgctgatcaagagctggaagagagagagcctgaaccagctgagaagaaccagcagcggcaccctggacgagtag

SEQ ID NO: 25833 - DNA, 381 bp, Artificial Sequence
  Description of Artificial Sequence: Synthetic coding sequence
atgaagaagtggaagagcagactgttccccagaccccccaactggctgagcggcaagtacctgagactgcccagcagcgccatgttcctgatcgacttctgcctgtgcgtgccctggaccacccccttccagtgcaagatcctgatggtggagttcatcgtgggcttctacgacttctgcctggccctggaggtgcagtacagaaccagcaagctgttcctgtgcggccagcccagccccagaagaagcctgggcatccagcagcaggccctgaagctggcctgcctgagccccaccctgctggagagcagcagctgcgtggacccccccggcaacaccgccggcagcagaatgcccagcagcagcaactgcatcaagtag

SEQ ID NO: 25834 - DNA, 663 bp, Artificial Sequence
  Description of Artificial Sequence: Synthetic coding sequence
gtggagggcgaggcccccggcctgttcctgagcagccaggagcagagagccagagacaccgagggccccagacagggcgacctggaggccggcctgggctggggctggcccctgcaccccggcagcaaccagggcgcccccagacagggcggcagcatcggcagcggcaccagaccctgcccctgcccccccctgagcagagagggcggcgccctggccagccccagagtggccctgagccagctgcagtgcggcctgctgggcagcgccgagcagagcttcctgcagctggagcaggagaaccacagcctgaagagacagaaccaggagctgagagagcagctgggcgccctgctgggccccggccagcagttcctgcccctgtgccccgagcacagcagctgcaccgccctggcctggccccccgaccccgccggcacccagcccctgggcaacagagcccccctgcagctgctgagaagagagctgtgccagggccaggaggccttcgtgcagcagagccagaacgagctgcagcagatcagactgtgcttcgagagaaagaagatggtgatcaccgaggtgtgggacaacgtggccgagatgcacatggccctgaacaaccaggccaccggcctgctggtgggcccccacagagcctag

SEQ ID NO: 25835 - DNA, 363 bp, Artificial Sequence
  Description of Artificial Sequence: Synthetic coding sequence
atgtacagcttccccaccaccgtggtggaggagatcctgagcctgagcctgcagctgatcgccttccccaccgtgagctgcgagatcctgctggagatcaccagccagaccaacaagaagcagacctgggagacctgctacgcccacagcgccgaggagatcggcatcatcgccggcaagagaatccacaagacccaggccgtgccctacatctgcttcctgctgagacaccagttcatcagccagagcagccacgtgagagtggaggccctgtacagcctgctgttcctgggcaccctgctgcaggtgggcaagggccaggaggtgctgctgaaggacgccctgagagccagagccccctag

SEQ ID NO: 25836 - DNA, 2568 bp, Artificial Sequence
  Description of Artificial Sequence: Synthetic coding sequence
atgtggagcaccggccccgaggccagagacggcgacagcagcgtgagcagcggcagactgagctgcagcagcggcggccacgacgtgtgcgtgagctggaaggagagacccccccaggtgctgggcccccagcagagacccagaaagagcgacgccagactggagcagctgagagacaagatcagagcccaggcctggcagcagggcagctgcgccagcctgggcaccagcgcccccagcagcgccagcagactgcacaaggccagcaccctgatgctgagaagaaagggccaggaggccaagaaccccccccccgcccccgagtgcagcggcttcagcatcctgagcgccgccgagagaagagtggaggccaaggccagccacggccagggcagagagctgagcagagtgagccagcaccaggtgcccgtgctgagagagaagcccaagagagtgaagagcagcagctgcaagagagagaagacccccaagctgcccagccccagaagagccgccaaggacaagcacaaggacgaggacagcgagctggtgggcgtgtacgcctggagaaagggccaggccctggtgagaagcctgctgggccccccccccgtgctgagaagacaccacagcaaggaccccagcagagaccccgccctgaccgtggacctgggcgacagcgagaaggtgatcgccgccaagtgcagccccgtgtgcgcccagctgcccgacgccaccagcgcctacagcgaccagcaggtgagcggcaacacccccagcctggccagcttcgaccagcccgccaccatccagaccgccatggccatcctgcaggacctgagacagcagatccaggccggcctggagctggcccaggccagaaagggcggccaggagctgggccccagcaagagaagactgcaggacgtggccggcagaggctgctgcagagaccccaacgcccagagcagcttcagcaagagcccctgggccatgaccgagagaaagcacagcagcctggagagagccagaagcgtgcacacctgggagccctggagcagcagcaccgccagagagagctgcccccagagagcctggggcgcccagggccaggacagaagcttccagagacccgagagcccccacgagagactgggccacttcagccagagaccctggagcgccctggccggccaggcctgcagcccccagagagcctggggcgcccagagacagggccccagcagccagagacccggcagcccccccgagaagagaagccccttcccccagcagccctggagcgccgtggccacccagccctgccccagaagagcctggaccgcctgcgagacctgggaggaccccggccccagactgagaaaccccctggagagacccagcccccccgcccagagaccctggagcagcagcggcgtgcagagagccggcccccagggcaagggcagaggcatcggcagccccgtgagcgccgccaagcacgccctgcccagacccaccggcagcttcccccagaaccccctgggcaaggagaaggacaccctgagaccctgccccagaagcagaggcctgctgggccccagccacagcagcgagagcctgagagagttcatgagacagaaggcccaggccagaagaagacaggccctggaggagaaggccagcgccctgagaaccagagagctgagaagcagaagactgcaggaggtgtacagacagcagagagaggccgtgctgggcagagccgtgcccgtggtgagcagaaccacccccggcatcgtgaccttcgtgcccagcagcgcccagagcggcggcctggaggccagcggcagcctggagagccccgtgctggagtggagcaaggtgaccagcggcatggtgctgggcggccaggaggcccccggcagcttctgcctgtgcctgaacagagcctggaaccacgccgagaccctggacccccccggcatgggcggcccccaggacggcagagacgcccccgtgctgctgagcgccagccccagcctgggcagcctggagctgcaggacctgaccaccagatacctgcccagaggcatgtgcatctacctggaccccaaggaggccgagcacctgggcaccagcagcagcctgcacctgagacacaagcaggcccagctgcaggccctggagaccaccgccaaggtgctgaagcagagagtggacagcctgaccgccaagctgcagggcgccgaggccctggacaccgtgagagaccccgccgtgggcctgctgagaagctgcccccacagcctgcccgccgcccccaccctggccacccccaccctggccacccccgcctgccccggcgccctgggccccaactggggcagaggcgcccccggcgagtgggtgagcatgcagccccagcccctgctgccccccacctacttcctggacggcgagaccctgagctggggccccagctgggagcagcagcagagcgtgagccccagagcccactgcgagagcaagcccagaggcgtgagccaggcccccctgctgctgtag

SEQ ID NO: 25837 - DNA, 2829 bp, Artificial Sequence
  Description of Artificial Sequence: Synthetic coding sequence
atggtggtgagcgccggcccctggagcagcgagaaggccgagatgaacatcctggagatcaacgagaccctgagaccccagctggccgagaagaagcagcagttcagaaacctgaaggagaagtgcttcctgacccagctggccggcttcctggccaaccagcagaagaagtacaagtacgaggagtgcaaggacctgatcaagttcatgctgagaaacgagagacagttcaaggaggagaagctggccgagcagctgaagcaggccgaggagctgagacagtacaaggtgctggtgcacagccaggagagagagctgacccagctgagagagaagctgagagagggcagagacgccagcagaagcctgtacgagcacctgcaggccctgctgaccccctacgagcccgacaagagccagggccaggacctgcaggagcagctggccgagggctgcagactggcccagcacctggtgcagaagctgagccccgagaacgacgaggacgaggacgaggacgtgcaggtggaggaggccgagaaggtgctggagagcagcgcccccagagaggtgcagaaggccgaggagagcaaggtgcccgaggacagcctggaggagtgcgccatcacctgcagcaacagccacggcccctgcgacagcaaccagccccacaagaacatcaagatcaccttcgaggaggacgaggtgaacagcaccctggtggtggacagagagagcagccacgacgagtgccaggacgccctgaacatcctgcccgtgcccggccccaccagcagcgccaccaacgtgagcatggtggtgagcgccggccccctgagcagcgagaaggccgagatgaacatcctggagatcaacgagaagctgagaccccagctggccgagaagaagcagcagttcagaaacctgaaggagaagtgcttcctgacccagctgagcggcttcctggccaaccagcagaagaagtacaagtacgaggagtgcaaggacctgatcaagttcatgctgagaaacgagagacagttcaaggaggagaagctggccgagcagctgaagcaggccgaggagctgagacagtacaaggtgctggtgcacgcccaggagagagagctgacccagctgagagagaagctgagagagggcagagacgccagcagaagcctgaacgagcacctgcaggccctgctgacccccgacgagcccgacaagagccagggccaggacctgcaggagcagctggccgagggctgcagactggcccagcacctggtgcagaagctgagccccgagaacgacaacgacgacgacgaggacgtgcaggtggaggtggccgagaaggtgcagaagagcagcgcccccagagagatgcagaaggccgaggagaaggaggtgcccgaggacagcctggaggagtgcgccatcacctacagcaacagccacggcagctacgacagcaaccagccccacagaaagaccaagatcaccttcgaggaggacaaggtggacagcaccctgatcggcagcagcagccacgtggagtgggaggacgccgtgcacatcatccccgagaacgagagcgacgacgaggaggaggaggagaagggccccgtgagccccagaaacctgcaggagagcgaggaggaggaggtgccccaggagagctgggacgagggctacagcaccctgagcatcccccccgagatgctggccagctaccagagctacagcagcaccttccacagcctggaggagcagcaggtgtgcatggccgtggacatcggcagacacagatgggaccaggtgaagaaggaggaccaggaggccaccggccccagactgagcagagagctgctggacgagaagggccccgaggtgctgcaggacagcctggacagatgctacagcacccccagcggctgcctggagctgaccgacagctgccagccctacagaagcgccttctacgtgctggagcagcagagagtgggcctggccgtggacatggacgagatcgagaagtaccaggaggtggaggaggaccaggaccccagctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaatcaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgaacggcgtgctgatggaggtggaggagagagaggtgctgcaggacagcctggacagatgctacagcacccccagcatgtacttcgagctgcccgacagcttccagcactacagaagcgtgttctacagcttcgaggagcagcacatcagcttcgccctgtacgtggacaacagattcttcaccctgaccgtgaccagcctgcacctggtgttccagatgggcgtgatcttcccccagtag

SEQ ID NO: 25838 - DNA, 267 bp, Artificial Sequence
  Description of Artificial Sequence: Synthetic coding sequence
atggccgtgagcaccgaggagctggaggccaccgtgcaggaggtgctgggcagactgaagagccaccagttcttccagagcacctgggacaccgtggccttcatcgtgttcctgaccttcatgggcaccgtgctgctgctgctgctgctggtggtggcccactgctgctgctgcagcagccccggccccagaagagagagccccagaaaggtgagcccctggaaggagagacccaagggcgtggacaacctggccctggagccctag

SEQ ID NO: 25839 - DNA, 267 bp, Artificial Sequence; identical to SEQ ID NO: 25838
  Description of Artificial Sequence: Synthetic coding sequence

SEQ ID NO: 25840 - DNA, 252 bp, Artificial Sequence
  Description of Artificial Sequence: Synthetic coding sequence
atggccgtgagcaccgaggagctggaggccaccgtgcaggaggtgctgggcagactgaagagccaccagttcttccagagcacctgggacaccgtggccttcatcgtgttcctgaccttcatgggcaccgtgctgctgctgctgctgctggtggtggcccactgctgctgctgcagcagccccggccccagaagagagagccccagaaaggagagacccaagggcgtggacaacctggccctggagccctag

SEQ ID NO: 25841 - DNA, 615 bp, Artificial Sequence
  Description of Artificial Sequence: Synthetic coding sequence
atgcagagcgccctggtgggcagctggcacaacaacggcttctacggccactacagaagccagttcaagagcgagagcgccagagagtaccacctggccgccaagccccagccccccgccgtgttcctgcagagatgccaggagcccgcccagagacacttcttcagcaagcacgacaacagaaccagcttcgacaagggcccctactgcctgctgcagggcatcggcagaagaaaggacctggagagactgtggcagagacacaccttcctgagatgggccccctgcgagatcgagctgagacagcagggccccctggagagcagctaccaggccgacttcagacccggccccggcctgagcggcctgccccagcacctgatccacttcgtgcaggtgcagcccagccacaccagaaccacctaccagcagaacttctgctgccccagccagggcggccactacggcagctacaaggtgggcccccaggcccccgtgaccgacgtgctgcccgacctgcccggcatccccagacccaagctgctgcagcactacctgcacgccggcgtgagcgagtgcctgaactggagcagagccctgaacaaggacagctag

SEQ ID NO: 25842 - DNA, 1140 bp, Artificial Sequence
  Description of Artificial Sequence: Synthetic coding sequence
atgcagagcttcctgaccctgctgaaggagcacgaggacacctgcgccccccccgccgagctggtgaccctggccggcagactgtgcagagacttccaggacgacctggcccagctgcagcccctggtgaccgccatcctggacagccagctgagactgcacctgctggacaacgccgacgtggccctggcctgcgccagagtgctggaccagcaggagcagcagcaggccgcctgcagactgctggagggctgccaggtgcccggcggcagccaggagctggtgcagctgtggaacgacatccactacagactggtgatgagaagactgggcgtggccgccctgacccccgtgcagaagttcagatgcagaaagagaaacccccccccccccagcctgtgccccgagggcctgaagagcagaaacttccccagagaggtgagagagaagctgcacaacttcgccgtgggcgtgaacaccaaccccagcaaggccgagagagagaacctggccctggagaccagcctgacccccgagcaggtgtacaactggttcgccaactacagaagaagacagagagccctgccccagcacatgaagcccgcccagcaggccaccgccgaggaccccggcgccagagagagaggccccgacctgctgcagcccagcggcaaccccagagtggacagcggcttcgtggacagaccccagtggagcgaggagagagaggagaagggccccccccagagcccccagaccacccagggcccctgggagcccctggccctggcccccgacttccccgccgacgagaccgtgagcaagcccctggacgtgagcggccacccccagagcgtgcagctggaggagggcctgggcaccagcagcggcagaaccgagctgagagtgggcagcttcctggtgacccagccccccctgcaggcccccgagttcatcctgacccagagcccccccgagctggcccccgcccccagcgccttccccggccccgtgagcgccatggagctgagccaggccctgcccagcagccaggtgcagtgcagcgacagccaggccagcggcgacgccttctggggcgccagaatgctgctggagttcagcggcagcagcctgggctag

SEQ ID NO: 25843 - DNA, 366 bp, Artificial Sequence
  Description of Artificial Sequence: Synthetic coding sequence
atgagcctgcacggcatcctggccagcgccggcaccatcggcgccgtggccgcctggctgatgagctacaagcccgccctgttcggcttcctgttcctgctgctgctgctgagcaactggctggtgaagtacgagcacaagctgaccctgcccgagccccagcaggacgagatcctgcagagactgctgttcagcgagatgaagatgaaggtgctggagaaccagatgttcatcatctggaacaagatgaaccaccacggcagaagcagcagacacagaaacttccccatgaagaagcacagaatgagaagacacgagagcatctgccccaccctgagcgactgcaccagcagcagccccagctag

SEQ ID NO: 25844 - DNA, 756 bp, Artificial Sequence
  Description of Artificial Sequence: Synthetic coding sequence
atggacaccaccctgagaatggtgagaaccgcctgccagcacagagccccccagatcagccacaagaccggctgcagccacatcagcatgcacagccccggcggcctgaccaccaccaagatggccggccccctgcccagagtgagcgacagcctgttcagcgccatggagctggccaagatgagcgacatgaccaagctgcaccaggccgtggccgccggcgactacagcctggtgaagaagatcctgaagaagggcctgtgcgaccccaactacaaggacgtggactggaacgacagaacccccctgcactgggccgccatcaagggccagatggaggtgatcagactgctgatcgagtacggcgccagaccctgcctggtgaccagcgtgggctggacccccgcccacttcgccgccgaggccggccacctgaacatcctgaagaccctgcacgccctgcacgccgccatcgacgcccccgacttcttcggcgacacccccaagagaatcgcccagatctacggccagaaggcctgcgtggccttcctggagaaggccgagcccgagtgccaggaccacagatgcgccgcccagcagaagggcctgcccctggacgagagagacgaggactgggacgccaagaagagagagctggagctgagcctgcccagcctgaaccagaacatgaacaagaagaacaagaagagcagaggccccaccagacccagcaacaccaagggcagaagagtgtag

SEQ ID NO: 25845 - DNA, 378 bp, Artificial Sequence
  Description of Artificial Sequence: Synthetic coding sequence
atgcccccccaccccgccatcttcttctactgcctgctgagacagggcctgaccatgctgcccagactggtgctgaacttctgggcccaggccgtgcacctgcccagaccccccagagtgctgggcctgcaggccggcggcaccgcccccggccagaagaagctgttcctgaccagccacttcccccccgccagccccctgcccctgtgcttcagcctgcagcagaacttcaagaagcacagccccagaagcccccccggcatcctgggcagcctgtaccccggcttctgcagccccatcgccaccagccccttcgccaagggcaccagaggcctgagagtggtgggcagcagcggcagactgagcgccagcagctag

SEQ ID NO: 25846 - DNA, 390 bp, Artificial Sequence
  Description of Artificial Sequence: Synthetic coding sequence
atggccgccgccacctgggacaaggagagcaagtgcagactgagcagaggccactgccaccacagaagacaccagagcctgcccgtgggcctgaccctgagatacagcgcccccgccagccaccagcccaagtgcttcaccagcaagcacggcaccagacccagccagagaaagcccagcctgagagtgagcggccactacagcccccacagcctgttccccggccacggcagaagaggcgcctgcgtggccagaagcagaagattcgccggccacatgcagctgacctggaagctgaagagaaagaagcccggcagaaccgccagcagcgaggagcacaagaagcagggcagaggctgcgccggcagaagactgatcaagagcacctag

SEQ ID NO: 25847 - DNA, 711 bp, Artificial Sequence
  Description of Artificial Sequence: Synthetic coding sequence
atgcacacctacgtgtacagctacaccagaatctgcatccacatgtacatccacatccacgcctacgcctacatctgcatcttcatctacacccacatgcacacctacgtgtacagctacaccagaatctgcatccacatgtacatccacatccacgcctacgcctacatctacgtgtacagctacaccagaatctgcatccacatctgcatcttcatctacacccacatgcacacctacatgtacatccacatccacgcctacgcctacatctacgtgtacagctacaccagaatctgcatccacatctgcgtgttcatctgcacccacgcctacatctacgtgtacagctacgtgcagtgcatgcacatgtgcatccacatgtacacctgcatgcacatgtgcatcttcatctgcacccacgcctgcatctgcgtgttcaccagcacccacgcctgcatctgcgtgttcacctgcacccacgtgtacatcagcgtgttcacctgcacccacgtgtacatctgcgtgttcatctacatctgcatccacgtgtacatccacatctacatctgcatccacatctgcgtgtacagctacatccacatgtacacctacatccacacctacacctacacctacacccagctgttcttcaaccacctgagcatcgacgagcacagcctgttcctgtacctgggctactgggagtag

SEQ ID NO: 25848 - DNA, 450 bp, Artificial Sequence
  Description of Artificial Sequence: Synthetic coding sequence
atgagactgctgcccagaaccagcatccccagaagacagcccttcagcagatggagaaagcagaacctgaagacccccgtgagcctgaactgcagcagaagctgcaagctgctggagggcagaggcatgcccgccatcttcatcatcgccctgcccccccccaacaccatcggcggccccgccctgatcatcagcctgcaggtgtaccccgccgcccccgagagacagagacccgccagaagaggccacgacgacggcggcggcttcgtgaagaccaagatgggcatctgcagagagaagaaggagagaagcgactgctactgcgtgtacatcgagagagaggacatcagagacagcatcctgaagaagacctgcaccctgaacaactgcttcgccgagatgctgctgatctgcagcttcgcccccgccaccctgccccagcccctgtag

SEQ ID NO: 25849 - DNA, 444 bp, Artificial Sequence
  Description of Artificial Sequence: Synthetic coding sequence
atgatctacgacggcaacaaccagctgctgaacgccagcaaggtgggcgaggtgctgagaggcggcaccagacagatctactaccaggtggtgaacttcagcagcctgtggcccctgtacaagtacgccgacaagctgcacgtgatcctgctgtacaagaccctgcaccagctggtggtggagcccgtgaaggtggccgcctggtactacgagagcgccagactgctgaacacctacggcctgctgggcatgaacgtggccggcatcagctggcacctgtacatcttccacctggtgtgcaccgacaccagcgtgagcagcagcgcccccctgccctgccccctgcccctgatccaccagatgctgatcatcttcgtgtggagactgctgagagcctgcctgtactgcagcagcctggccctgatcatctggagctacagctag

SEQ ID NO: 25850 - DNA, 1242 bp, Artificial Sequence
  Description of Artificial Sequence: Synthetic coding sequence
atgagaggcggccacagccccgccgccgcccccgcccacaccggcggcagaagaggcggcggcgcccccgccccccagtgcgtgagaagccccgccgccctgagcagaagacaccagcccggcagactgctgctgcacgtgtgcagccccgtgccctggaccggcaccgccaccgagggccagagcgtgggcacctgcctgcccggccagttcaccagacccctggacagacacagacacagaggcagcgagtgctggcacctgagcagcggcagcgtgcaccccagccccggccccgcccccgcccagagagtgagagtgctggcccccgtgttcagaatctgcagccccctgcccagaaccggcaccgccaccgagggccaggagtgctggcacctgagcagcggcagcgtgcaccccagccccggccccgcccccccccagagagtgagaagcgtgggcacctgcctgcccgacctgttcaccagacccctggacagacacagacacagaggcagcgagtgctggcacctgagcagcggcagcgtgcaccccagccccggccccgcccccccccagagagtgagagtgctggcccccgtgttcagaatctgcagccccgtgccctggaccggcaccgccaccgagggccagagcgtgggcacctgcctgcccgacctgttcaccagacccctggacagacacagacacagaggcagcgagtgctggcacctgagcagcggcagcgtgcaccccagccccggcagcgcccccgcccagagagtgagagtgctggcccccgtgttcagaatctgcagccccgtgccctggaccggcaccgccaccgagggccagagcgtgggcacctgcctgcccgacctgttcacccccagactggacagacacagacacagaggcagcgagtgctggcacctgagcagcggcagcgtgcaccccagccccggccccgcccccccccagagagtgagagtgctggcccccgtgttcagaatctgcagccccctgccctggatcggcaccggcaccgagggccagagcgtgggcacctgcctgcccgacctgttcaccagacccctggacagacacagacacagaggcagcgagtgctggcacctgagcagcggcagcgtgcaccccagccccggcctggcccccgcccagagagtggagtgctggcacctgagcagcggcagccccagcctgcccctgttcgtggagtag

SEQ ID NO: 25851 - DNA, 435 bp, Artificial Sequence
  Description of Artificial Sequence: Synthetic coding sequence
atgatcagagccgccctgctggagccccagccccccaagctgaagcagagcagccacctgagcccccagggcgccggcaccaccggcgccggcccccacacccccctgaccttcctgtacttcttcagactggagctgctgcaggccgccctgcccccccagccccccaaggtgctggtgagacagcccggcggcaaggacagcctggccgagagccccttcgacctgagcaccggcagaaacgccccctgcggcggcgccctgggcaacctgagacacctgcagtggggcggcgcctggcccctgctgttcctgggcggcacctgggacagcgtgtaccaggccggcagcaccctggccctgggcagagtgagcgtgagcctgttcttcttcctgcccaacaagttccacagccaccccagcagacacctgtag

SEQ ID NO: 25852 - DNA, 366 bp, Artificial Sequence
  Description of Artificial Sequence: Synthetic coding sequence
atgaagggctacagagacaacgccgtggagagcaccttcaccagcagattctacggcagcgagaagtggctgcagatcacctacctgaagacccagatgcccagcggcagcgccggcaacatcgaggacctgaccagcttcttcatcttcctgagacagagcctggccctgctgcccagactggagtgcagcggcaccatcagcgcccactgcaacctgagcctgcccggcagcagcatcagccacgccagcgccttcagagtggccggcatcaccggcgtgcactgcagaacccagctgatcttcgtgtacctggtggagaccggcttccaccacatgctggccagaatggtgagcatcagctag

SEQ ID NO: 25853 - DNA, 399 bp, Artificial Sequence
  Description of Artificial Sequence: Synthetic coding sequence
atgctgagccccctgtggctgcagatcagcaagagacccagacccgaggtgagcgtgagcaacgcctgcttcagcagcgccctgcccaccagcaaccccaccagcctgaccctgaagcaccacaacatcttcgtgctgagagtggccctggagatcatccagtacagcgtgcacggcggcagaaacagaaagcccctggaggtgaccagcctggcctacagctgccccgagaactggtggcagaagcagatcggcgtgcagccccccgacgtgcacgccagcgccctgagccccaagccctgcgtgagctggagcagacccctgagcctgctgagcagcaccatcctgttctggaagacccacgacgagagagccgacttcagcaagctgcacagctag

SEQ ID NO: 25854 - DNA, 465 bp, Artificial Sequence
  Description of Artificial Sequence: Synthetic coding sequence
atggagatcatgcccatgaacatcgtgagcatcatcagccccctgatcgacgtgagccccggcagaagaggcagactgaagaacgccggcggcggcatcagactggccgagagagtgaacagaagagccgacagaaacgtgctgagaagagagaagggcctggccctgggcagagtgaccttccccagagccggcagaggcagcagagtgagcgcccccgccagaagcgagcccggccccgccgccgtgcccggcggcgtgagaagagccgacgacagaaagttcccccccggcgccagccagcccgccttcagaagcagaagattccaggccgccgccggcggccccagctacgccaacgaccccaccagcagcgccaagcccgtgaagctgctgcccagagagagagccggcctgaaggtgaccaacttcagccagagcagagagagagagggcagcgcctag

SEQ ID NO: 25855 - DNA, 387 bp, Artificial Sequence
  Description of Artificial Sequence: Synthetic coding sequence
atgagctgccaccagagccccctggtgttcgacgtgggccagtgcagacagcacgacctggccggccagatcctgatctaccacagcctgacccccgccggccccctgggcagaccccccgacgtgccccacagcccccacctggccagccccaccggcagcagacagagaaccgtgggcggcacctgcgacaccgccctgttcctgtgcagctgcttcagcagcagcttcttcagcctgctggtgaccctgttcttcttcaccctgagcccccacaagaccagaaacttcgtgatcctgctgatcttcctgtacagcgtgtgcctgcacaccgacggctacctgagagccagcgagctgagcctgccccccagcatcatcagctag

SEQ ID NO: 25856 - DNA, 414 bp, Artificial Sequence
  Description of Artificial Sequence: Synthetic coding sequence
atgctgggcgtggaggacctggtgggcgccggcagatggggcagaggccccgagaacctgcccgacagcggcggcagactggccgagcaggccctgcagggccccagccaccccttcagctgcctgcccccccccgagcagatcctgggcgcctggagagccctgaaggaggagctgctgagcagagcccccagccagttcaccctgtgcaccgaggtgctgcagagcagcaacctgagccccacccccgccgtgagccccttcgtgcagagcagcgtggagatggagaagttcctggtgcccctgagcatgttcctgagcggcgagagaacctggaagctgctgctgcaggtggacttcctgaaccagggcggcgagtactacagaaactggagaaagagaagaagaacctag

SEQ ID NO: 25857 - DNA, 1122 bp, Artificial Sequence
  Description of Artificial Sequence: Synthetic coding sequence
atgttcctggccgacgtgcccaccagcctgcacttccagagcatgctgaagagccagtggcagaacaagcccttcgacaagatcaagccccccaagaagctgagcctgaagcacagagcccccatgcccggcagcctgcccgaccccgccagaaaggacagacacaagctggtgagcagcttcctgaccaccgccatgctgaagcaccacaccgacatgagcagcagcagctacctggccgccacccaccaccccccccacagccccctggtgagacagctgagcaccagcagcgacagccccgcccccgccagcagcagcagccaggtgaccgccagcaccagccagcagcccgtgagaagaagaagaggcgagagcagcttcgacatcaacaacatcgtgatccccatgagcgtggccgccaccaccagagtggagaagctgcagtacaaggagatcctgacccccagctggagagaggtggacctgcagagcctgaagggcagccccgacgaggagaacgaggagatcgaggacctgagcgacgccgccttcgccgccctgcacgccaagtgcgaggagatggagagagccagatggctgtggaccaccagcgtgcccccccagagaagaggcagcagaagctacagaagcagcgacggcagaaccaccccccagctgggcagcgccaaccccagcaccccccagcccgccagccccgacgtgagcagcagccacagcctgagcgagtacagccacggccagagccccagaagccccatcagccccgagctgcacagcgcccccctgacccccgtggccagagacacccccagacacctggccagcgaggacaccagatgcagcacccccgagctgggcctggacgagcagagcgtgcagccctgggagagaagaaccttccccctggcccacagcccccaggccgagtgcgaggaccagctggacgcccaggagagagccgccagatgcaccagaagaaccagcggcagcaagaccggcagagagaccgaggccgcccccaccagcccccccaccgtgcccctgaagagcagacacctggtggccgccgccaccgcccagagacccacccacagatag

SEQ ID NO: 25858 - DNA, 3318 bp, Artificial Sequence
  Description of Artificial Sequence: Synthetic coding sequence
atggccgccatggcccccgccctgaccgacgccgccgccgaggcccaccacatcagattcaagctggccccccccagcagcaccctgagccccggcagcgccgagaacaacggcaacgccaacatcctgatcgccgccaacggcaccaagagaaaggccatcgccgccgaggaccccagcctggacttcagaaacaaccccaccaaggaggacctgggcaagctgcagcccctggtggccagctacctgtgcagcgacgtgaccagcgtgcccagcaaggagagcctgaagctgcagggcgtgttcagcaagcagaccgtgctgaagagccaccccctgctgagccagagctacgagctgagagccgagctgctgggcagacagcccgtgctggagttcagcctggagaacctgagaaccatgaacaccagcggccagaccgccctgccccaggcccccgtgaacggcctggccaagaagctgaccaagagcagcacccacagcgaccacgacaacagcaccagcctgaacggcggcaagagagccctgaccagcagcgccctgcacggcggcgagatgggcggcagcgagagcggcgacctgaagggcggcatgaccaactgcaccctgccccacagaagcctggacgtggagcacaccaccctgtacagcaacaacagcaccgccaacaagagcagcgtgaacagcatggagcagcccgccctgcagggcagcagcagactgagccccggcaccgacagcagcagcaacctgggcggcgtgaagctggagggcaagaagagccccctgagcagcatcctgttcagcgccctggacagcgacaccagaatcaccgccctgctgagaagacaggccgacatcgagagcagagccagaagactgcagaagagactgcaggtggtgcaggccaagcaggtggagagacacatccagcaccagctgggcggcttcctggagaagaccctgagcaagctgcccaacctggagagcctgagacccagaagccagctgatgctgaccagaaaggccgaggccgccctgagaaaggccgccagcgagaccaccaccagcgagggcctgagcaacttcctgaagagcaacagcatcagcgaggagctggagagattcaccgccagcggcatcgccaacctgagatgcagcgagcaggccttcgacagcgacgtgaccgacagcagcagcggcggcgagagcgacatcgaggaggaggagctgaccagagccgaccccgagcagagacacgtgcccctgagaagaagaagcgagtggaagtgggccgccgacagagccgccatcgtgagcagatggaactggctgcaggcccacgtgagcgacctggagtacagaatcagacagcagaccgacatctacaagcagatcagagccaacaagggcctgatcgtgctgggcgaggtgcccccccccgagcacaccaccgacctgttcctgcccctgagcagcgaggtgaagaccgaccacggcaccgacaagctgatcgagagcgtgagccagcccctggagaaccacggcgcccccatcatcggccacatcagcgagagcctgagcaccaagagctgcggcgccctgagacccgtgaacggcgtgatcaacaccctgcagcccgtgctggccgaccacatccccggcgacagcagcgacgccgaggagcagctgcacaagaagcagagactgaacctggtgagcagcagcagcgacggcacctgcgtggccgccagaaccagacccgtgctgagctgcaagaagagaagactggtgagacccaacagcatcgtgcccctgagcaagaaggtgcacagaaacagcaccatcagacccggctgcgacgtgaaccccagctgcgccctgtgcggcagcggcagcatcaacaccatgccccccgagatccactacgaggcccccctgctggagagactgagccagctggacagctgcgtgcaccccgtgctggccttccccgacgacgtgcccaccagcctgcacttccagagcatgctgaagagccagtggcagaacaagcccttcgacaagatcaagccccccaagaagctgagcctgaagcacagagcccccatgcccggcagcctgcccgaccccgccagaaaggacagacacaagctggtgagcagcttcctgaccaccgccaagctgagccaccaccagaccagacccgacagaacccacagacagcacctggacgacgtgggcgccgtgcccatggtggagagagtgaccgcccccaaggccgagagactgctgaacccccccccccccgtgcacgaccccaaccacagcaagatgagactgagagaccacagcagcgagagaagcgaggtgctgaagcaccacaccgacatgagcagcagcagctacctggccgccacccaccaccccccccacagccccctggtgagacagctgagcaccagcagcgacagccccgcccccgccagcagcagcagccaggtgaccgccagcaccagccagcagcccgtgagaagaagaagaggcgagagcagcttcgacatcaacaacatcgtgatccccatgagcgtggccgccaccaccagagtggagaagctgcagtacaaggagatcctgacccccagctggagagaggtggacctgcagagcctgaagggcagccccgacgaggagaacgaggagatcgaggacctgagcgacgccgccttcgccgccctgcacgccaagtgcgaggagatggagagagccagatggctgtggaccaccagcgtgcccccccagagaagaggcagcagaagctacagaagcagcgacggcagaaccaccccccagctgggcagcgccaaccccagcaccccccagcccgccagccccgacgtgagcagcagccacagcctgagcgagtacagccacggccagagccccagaagccccatcagccccgagctgcacagcgcccccctgacccccgtggccagagacacccccagacacctggccagcgaggacaccagatgcagcacccccgagctgggcctggacgagcagagcgtgcagccctgggagagaagaaccttccccctggcccacagcccccaggccgagtgcgaggaccagctggacgcccaggagagagccgccagatgcaccagaagaaccagcggcagcaagaccggcagagagaccgaggccgcccccaccagcccccccaccgtgcccctgaagagcagacacctggtggccgccgccaccgcccagagacccacccacagatag

SEQ ID NO: 25859 - DNA, 486 bp, Artificial Sequence
  Description of Artificial Sequence: Synthetic coding sequence
atgggccacagacccaacctgggccagcccccccaccccaacgccgtggccgccgccctgcacgccagcctgtgccccgccaacagaggcacctgccccctgggcaagcccggctaccccggctgcctgtggttccagcccctgctgctgttccccggctgcctgtgcagccccgacggccccttccccagagccgtgttcaccagcgccggcaagggccccctgcagaccgacctgggcagaggcagagtgccccccagagaccagcagacccccaagagcggcccctgccccagagcccccgtggccagcaacagacagagcggcggcagcgccgtgagcgcccccctgagcggcgccagaagagcctggaagagcgccttcgccgccccccccagaagcagactgagaccccagaagggcgtgccctggaccgagaagagagccagaggcggcggcagagccggcccctgcagaagaacctag

SEQ ID NO: 25860 - DNA, 372 bp, Artificial Sequence
  Description of Artificial Sequence: Synthetic coding sequence
atgagaagcgagaagagcaagggctgctggagagacggcggcgacgcccaccccggcgagaaggccagccagagcagcggcatcaccggcgtgagccacagaaccagactgaccagcgtgctgctgagaaacacccagagaagaagacacagaagaggcgagcaccacgtgatggtggacaccgagatcggcgtgctgcagccccaggccaaggagctgctggagccccccggcgacggcagatgcaaggagctgatcttcagccagagcctgtggagagagtgcggccccggcgacaccctgatcctggacttctggcccaccgagccctgcacccaggaggacttcatcagccaggtgagcctgcagtag

SEQ ID NO: 25861 - DNA, 630 bp, Artificial Sequence
  Description of Artificial Sequence: Synthetic coding sequence
atgctgagcagccagctgtgctgcgtgcacagcctgccccccaccgccaaccccgccgccctgtgcagcctggcccagcagatgttcaccaacatcagaagcccctgcagcggcccccagggcagccccggcctgcccagaagaacccacatccacctgtggccccacagcgcccacatgtacttcctggtgaccagcagcctgctgcccttccccctgatccagcccggctgcagcagaaccagattcaagaccctgtgcagcctgagacacaccagcgcccccaccgaggagggccacggccccgtgagaagaccctgcggcatgcactgcctgagccacctgccccaccccagaggcagaccccagggccaccccacccacatgagacccgccctgcagcaggccctgctgagccaccccagcctgctgctgccctggagaagcagccccgacagcgccgtgcaggtgggccccagcatgatcctgagaagaatccccatggccggccacctgtgcttcccccactggccccagctgctggacagcagagactgctgcacctacacctgcatcaacacccccgtgctgaacagccacatggtgcaggagggcgtgtgcggccagtag

SEQ ID NO: 25862 - DNA, 642 bp, Artificial Sequence
  Description of Artificial Sequence: Synthetic coding sequence
atgagccccaagtgcgccgagaccgcccagcagctgagatgcctgaccgagaacgtgcagagacccctgtgccccaccatgcccgcctggggcagacccagcctgggcctgctgagagtgagccccgcctgccagcccaagggcggcagaagctgcggctgcagccagcccctgctgaaggtgggcctgtgggtggagatgtgggccgccagcggcagacacagctacaagtgcatccccgccctgagaaccaccttcctgctgcccagccccttcctgagaacccccatgcagaagagaggcagacagctgaccaaggacagagagggctactgcagctggcacctgatgggcagcatctgctgcatccccctgggctgctgccccggctggatcggcaaggagctggccggcagactgagcagcgtgctgaccacctggctgggcggcggcagaggcgcctggcaggagcagagcgccggccccggcaactggggcctggtgcacgtgtgcacccacgtgtgcgtgtgcgtgagagcctgctgggtgggcagagaggaggccgtgaagccccaccccctgctgagcgccgccgtgctgctgtgcgtgagcgccgccagaggctgccaccacaccagctag

SEQ ID NO: 25863 - DNA, 612 bp, Artificial Sequence
  Description of Artificial Sequence: Synthetic coding sequence
atggacagcgcccccgccggcagcttcagcgccagcagcttcttcgacctgagcgtgaccgtgaccagagccaagaacagcagaggccccagcagcagccccagcgagctgcagggcgcccactgcctgaccagcagcctggccgccgcctgcagcgtggcctacagcgccctgtggagcagcagccccctgagaagcccctggagcatcagcagcatcaccatgcccagactgagcagcgaggagagcagcgccagcctgctggccggcgccgacggcagaccccccagactgctgttcctgcccttctgggtgaacctgctgagactggtgctgttcctgagacccagaagacccctgctgggcttcctggccgcccccagaagcgagcccgcctgccccgtgaccagccccgagagctgggcctgcgtgagcgaggccggcggcgtgggcgccagccccggcgtgcccgccagcgccgcctgcgtgggccccagcagcagcagcagaagactgatctgcctgagaaccctggtgagctgcgccagaagcttccacagaaccctgcagacccccagcctgcccggcatcagcctgggcatggccgcctag

SEQ ID NO: 25864 - DNA, 666 bp, Artificial Sequence
  Description of Artificial Sequence: Synthetic coding sequence
atggccgccgccggccccctgtgcaccgagagagtgagcgtgctgagccagcccaacagcggcgtggaggaccccacccccgccggcggcagaggccagggcagaagaagaggcagagaggagctggagagcatcggcgccggccccggcgccagcgtgagaatcctgcccgccctgagacccggcctgggcggcgtgtggggcgccggcgccgccagcctggtgttccaggccggccccggcagcagctggctgggctggcccgacctggacctggccctgtacagaggctgggcctgcagaagcgagggcaccgccaacgtggccttccccggcaccgccagccccggcttcagcagagccagacagaccagagacctgagaaagcccgccctgaagacccccagccacaccgccagccagctggccgccgaggccggcaaccccagcggcggctgccccagcatgagatgccagagaagagtgggcgccctggtgcccacctggaagggcggctggagagacggctggagcggcagcggcggcagagccaaggagagaatcctggccttcagcttccccgccggcggcggcatcagaggcgagagagtgcaggccgccagcaacaccagaatctgggaggagcccggcagcacccccaactag

SEQ ID NO: 25865 - DNA, 378 bp, Artificial Sequence
  Description of Artificial Sequence: Synthetic coding sequence
atgcagcccgtgatcagcgccctgaacatccagacccagaccgtgcagacccaccccgcccccagaaacaccagcgagcactgcaccctgcccgcctgcgacgcccaggaggagcacagagacaccgtggacggcagcatcgccagaaccgagagcgccagcggcgagatctggagacagacccacatggacggcgagcaccacgtgaacaccaaggccgagatcagcgtgatgagcgccaaccagggcgcccccagaatcaccagcaagccccccgaggccagaagagaggccagagacagaagcctgcccagcgccttcagcctgagaggcctgaccgacaccctgatcctgggcttctgcccccccgagctgtag

SEQ ID NO: 25866 - DNA, 369 bp, Artificial Sequence
  Description of Artificial Sequence: Synthetic coding sequence
atgaaggtggccctgctgagattcttcagcccccccaacatgagcgtgacccacaaggaggcccacgagagaaagtgccccgagaagcccgagctgtggaaggccggcagcaccgtgcccctgaccgcccccgagaagaccgaccccttccccctgtgcccccccctgagcctgacctgcccccagcagcagagctgcatccccagcagcagccaggacgtgctgaacagcctgtgggtgagcagccactgcctgcagctgaagatcagcaagaccaagacccactgcctgcccacccagaacgtgctgcccttcctgctgcccacccccgtgagcatcgtgtgcagactgcccggcctggacccctag

SEQ ID NO: 25867 - DNA, 459 bp, Artificial Sequence
  Description of Artificial Sequence: Synthetic coding sequence
atggaggccgaggcctggggcagccaggccagagccggcctgggcgccgccgagaactgcctggagggcggcaaccaggccttcctgctggagagagtgaccggcaccaagggcagaggccagggccagcccctggagagagccggcgaggagggcgaggccggcggcgaccccagaagagaccccggcgaggtggtggccaagagcagagtgagagccagaccccacctgagcctgtaccccgccctgcccggcgtggccctggccctgctgtgctgccccctgcaggacagatgcctgagactggtgcccgcctgccccaccgccggcccccagcacccccaggtgctgccctgggccctgcagaagcagggcgtggtgagaagcggcccctgggccaccgaggagatggtgtggggcaccagaaccggcgtgggcggcctgaccgccgtgttctag

SEQ ID NO: 25868 - DNA, 879 bp, Artificial Sequence
  Description of Artificial Sequence: Synthetic coding sequence
atgcagcccagcagagaggccctggagctgagaggcctgcccaagagcgtgagcaccgtgagcagcaccaagccccccctgaccacccccagcagcaccaaccccagcagacagctggccctggaggactgcgtgcagctgagagccgccctggacctgggctacggccccgagtgctgctgccaccacctgcccgaggtggcccacaagagcagcgccagcgccggcgcccccagcgccagactgcccctgcagccccacagcctgggcaccagaaccaagctgccccccagcctgtgcctgcccggccccggcagaaccagactgaccaccgagcccttccccggcgcccccttctgcagcgacagctgcagccccgccctgtgctgcgtgctgctgacccccggcagaggcagaggcagcgtggcccccctgggcagcagccaggacggcagaggcggctgctgccccaccgacaccgtgcccgccgcccagggcatggacgccagctggaccgtggcccccgcccaggagtggctgggccaccccctgcagagctgcccccagagcgccagcagaggccacctgcccctgcccctgcccacccccaccaccccctgcatcagccagccccccggcagaagatgcagaccccactgcggcaaggagctgttcagagcccccggcgccctgcacttcctgcccagaagacaccccgccgccgtgagacacagatggaccagagcctgccccgagggccccagaatgcacatcccccagggctggctgctgagcagccccagcctgctgaccgactggttcagcatggacagcttcaagccccccagcctggccagcggccagatcagcaagacctag

SEQ ID NO: 25869 - DNA, 900 bp, Artificial Sequence
  Description of Artificial Sequence: Synthetic coding sequence
atgcccgagggcagcgtgagcgccatgagaaccagccccaagagcagctggccctggtgctgcagctggagctgcgcctggagcagcagcagccccccctggagaagcccccccagcgccaccggcaccctgtgcagaagctgcagcctggcccccagcggcgacctggaggtgctgaagagccaggagaccggctgcagagaccccctgcagctgcccggcctgctgggcccctgcgccctgagccccatggtgggcagccccagcggcagagtgaagctggtgggcagaagaagcgtggtgcagtgcagcagatgctgcatcgaccccctgatcttcttcgtgttcgtgttcatcctgttctgcttcgtgttcgagatggagagctgcagcgtgacccaggccggcgtgcagtggtgcgacgacctgggcagcctgcagccccccccccccggcttcagctgcctgagcctgcccggcagctgggactacagacacccccccccccaccccgccaacttctgcatcttcagcagagacgaggtgagcacccccacccaggccggcgtgaagctgctgaccgccagcgacctgcccaccctggccagccagagcgtggccatcaccggcgtgagccaccacgcccagcccaaccccctgatcttctgcttcagcagcagcaccgtgagaaaggccttcgacagaggccccagaagatggcagcacggcggcggcctgaccgtgtgggtggtggtgaaggccctggagagccagctgcagagagaggacgtggacctgagagacggccagtgccacctgcacagaagactggaggcccccgcctggggcaacctgctgggcaaggagggcagcaagagaggcaccatgaagcagaactag

SEQ ID NO: 25870 - DNA, 843 bp, Artificial Sequence
  Description of Artificial Sequence: Synthetic coding sequence
atgaccagcctgacccacggcatgcacctgaccagcagcaccagctgcagctgccagagcagcggcaccagcttcaccagctgcagctgcagaagcagcggcaccagcagcaccagcagaagctggtggagcagcggcaccagcagcaccagctgcagctggtggagcagcggcaccagcagcaccttctgcagctgctggagcagcggcaccagcttcaccagctgcagctgctggagcagcggcaccagcagcaccccctgcagctgcagaagcagcggcaccagcagcaccagctgcagctgctggagcagcggcaccagcagcaccagctggagctgcaagagcagcggcaccagcagcacctgctacatgtgcctgagcagcggcaccagcagcaccagctacagcagctggagcagccagaccagcagcaccagcagcatgtgcctgcccagcagaaccagcagcatcttctacagctgcctgcccctgggccaccacctgcccttctgcagcgtgagacccctgggcccccccaccaccagccccctgagcaacctgtggatcctgagccaccccttctacctgggcggcgtgtggcccctgaacaaccacctgcacatgaacctgctgggctacttcaacaacctgcacctgtggagcctgggcctgcagcccctgcccccccccggcagccccctggtgcacctgccccccccccccctgggctggcccctgctgagcgagctgctgcaggacctgaaccagctgccctaccccctgctgcccgtgggccccagacccagacccccccacgtgctgctgggcatcttcatctag

SEQ ID NO: 25871 - DNA, 477 bp, Artificial Sequence
  Description of Artificial Sequence: Synthetic coding sequence
atgctggacggcggcagaaacggcagactgctggagctgagcagcctgctgcccgagagaggcggcggccccagcctgtgcagaagccccgccagcaccgagaaggaggtgggcgcctgcggcaccctggccagcctgagaagaggcctgtggaagtgcagcctgtgccccggccccgccctgctgctgggcggcagctgctgcctgatctgcagcctgagcctgctgctgctgagcacccccaccttcttcagcagaaacttcgagcccagcttcagccccagccccatcgagaagcccagcgcccccagcagcggccagagcagccagctgcagacccaggtgcagccccccgccgagagaggcgccgccagcatgcccggccccgccagcctgcccctgagcaccggccccagccagcccctgagatgcagccccagagtgctgtgcagcagagtgctggccctgagaagatag

SEQ ID NO: 25872 - DNA, 480 bp, Artificial Sequence
  Description of Artificial Sequence: Synthetic coding sequence
atggccaccgtggaccccgccggcctggccctgcaccccgcctgccccagagtgtggggccccagcgaccagcacagacccccccaggagggcagccacctgcccgccagaagaagaggcctggccagaaaccagagctgccagcaccccgacctgggcccccccgccagcagaaccgagaaggagatgagcgccgtggccgcccccggctgcgccgccctgctgcagcccccccagcagaccagcgtgcagagcttcaagggcatgagcctgagcgtggaggccggcctgtgcggcgagcccgccggcaagctgctgggcgagggcggcggccagagagaggccagcctggtgggcaagaagggctgggagtggagaagacacagaggcagaaccctgagcgaggaggaccagggcgccagacccttcagccccggcagctgcgccctgagaggcgacagagagggcggcatcggctag

SEQ ID NO: 25873 - DNA, 618 bp, Artificial Sequence
  Description of Artificial Sequence: Synthetic coding sequence
atgagagagcccctgatccccccctgcaaggccgccagcctgagcgagcaggagcaggtgagaggcgagtgcggcatgatgaccgcccagggcatcctgggccccagaggcaagagcaagctgcccgtgctgcccgaccccagactgatctgcagatacatgtgcagctgcagagagatccccggcgtgatcagcacccccgtgccccacagcgccggcccccaggtgaccagattccacagccccagccccccccacatcagcgagctgagccagaccctgcacgcccccttccagggcagctggcccagaccctgccacgccctgagcggccccagagccatggtgcccaaccagctgcaccccggcaccccctgccccgcccacgtgccccacagctgcaccatgcccgccggcacctgccccctgttcaccggcgcccccgccgccgccgaggccggcctgaaccccggccccgccctgagagcccccaccagctgcagcagcagcacctggcccaagcccttcatgaccgtgtgcctgctgcccaccagcagcatgctgaccagccccggcaccggcggctgcatcagagccagaatcctggagcccgcctag

SEQ ID NO: 25874 - DNA, 453 bp, Artificial Sequence
  Description of Artificial Sequence: Synthetic coding sequence
atggccgtgaccttccagatgctggccgtgcagcagagcaccagccacgccatccagagctggcacagcctgagacccagctgccagagaagacccgacagcagctgcaccagactgagcggcatgaccagcgccgccaccagaaccagcgagaccgccatggacgccaccagactgtggggcaccagatggaaggtgagaaccagaagaatggtggccagcaccagcagattccaggccaacgtggccgccaccagaaagcccagcaaggccgccggctgcagcctgaacagcgtgctgggcaagcccgtgctgggcgagcccgccttctgggacctgcccagcgtgcccgtggcccccgccacccccagcgaggccgccgcccccgagagcgagtgctggagagcccacagagacctgccctaccccagcggcgacctggccctgcagtag

SEQ ID NO: 25875 - DNA, 528 bp, Artificial Sequence
  Description of Artificial Sequence: Synthetic coding sequence
atgaccagacccctgcccgagagcatcagactgctgagacacaccggcctggtgccccccacccccgtgcccctgggctacccccaccagagcttcgtgagccagccccaccccttcagcaagcagcccagcccctgccccagacagagcccccagggcgacttcggctgggtgagccccggcgccagcagaagcatcaccggccccagcagccccgccgcccccagcctgatcagcctgggcagcctgggcagccacctgcagggcgccagaccccaccccagacagagcagcctgggcgacttcggcctggtgacccccggcaccccctgctgcagactgtgcccccccctgctgctgccccagggcagacccccctgggtgctgtgcgccggcgtgagcaaggagctgggccccaaccccgtgctgcccagccccatcgtggagcagagactgggccacggcgccgacatggtgcccccccccgaccaggaggagtggaacgtggtgatgagccagagcacctag

SEQ ID NO: 25876 - DNA, 528 bp, Artificial Sequence; identical to SEQ ID NO: 25875
  Description of Artificial Sequence: Synthetic coding sequence

SEQ ID NO: 25877 - DNA, 591 bp, Artificial Sequence
  Description of Artificial Sequence: Synthetic coding sequence
atggccgccgccagcgtgccccccgagagcagcatcatccaccccgccagcagcgccatcaagagaaccgacggcggcagactggagctggagatcagaatcggcatcttcgcccagttctggagcgcctgcctgctgttccccagatgcagccagcccagacagcccagaagctggggccccagagtgaacgccttcgccctgtggcccgccaccagaagacccgcccacaccggcagaagagtgacccccgccagagcctgcagccacaccagcggcaccggcgccggcagaaagagaaagggcggcgagaccagcttccagagagagtggagcgagaacagaagagagaagggccagggcaagatcagaagccccgcccccgagcccgccggcggcgaggccagcagcagccccgcccccgaggagagaggccccagccactgcagccaggccaacgtgagccccgccagctgcaccctgcccggcaagaccagaatccacagcctgtgcagagagggcaacgccggcagaacccccagccagccccccctgagcggctacaagacccccaacaagagaaacctgtag

SEQ ID NO: 25878 - DNA, 423 bp, Artificial Sequence
  Description of Artificial Sequence: Synthetic coding sequence
atgggcctggaggccaagaacagcccctgctgccaccagcacggcgacttcgtgccctaccccatcctgagcgccagagtgttccagcccgaggtggaggaggccaccctggccgcccacgccatcagccacgactgcgtgtgcagcggcggcggcgtgctgctgccccacgactggagaaacaactacatgatcctgctgaacccccaggtgctggccgacgagagaggccaccagagacccgtggccttcctggcctacaaggtgaacggccagtacatcatggagggcttcgccagcagcttcctgttcaccatgggcggcctgggcttcatcatgctggaccagagcaacgcccccaacatccccaagctgaacagattcttcttcttctacagcctggacagcagcgtgagctactag

SEQ ID NO: 25879 - DNA, 462 bp, Artificial Sequence
  Description of Artificial Sequence: Synthetic coding sequence
atgcacctgaagaacccccccaaccccccccacctgccccccgtggagagcgccagaaacaagaccatcctgctgcagcagctgagcgccctgcccgacagccccctgtggggcctgggcatgaccagagtgttcctggccgacctgaccgaggccagcctggccctgtgcagcctgatcagcctgaagtgcctgcccggcgacagcggcaagagcggcaaggtgagcctgggcctggccggctgcagcggcatccagaccagcgtggcccccagcagccagcagcagaagaccgccagctgcggcaccggcggcagatgctgcggcccccaccccgccagccccagaaagggcgccggcagccacagcaccgccagagcctggcccagcaagggcgaggcccagctgttcagcccccccgccagcgccggctgcagcggcacccagcccggcgtgacctag

SEQ ID NO: 25880 - DNA, 549 bp, Artificial Sequence
  Description of Artificial Sequence: Synthetic coding sequence
atggccgtgaccggcgtgcagtgcagcgagagatgcaagcagaccagaagagtggacagcagcagcggcaagtggctggccacccccctgatctgggagaagctgaactggcccagcagaagccagagccagaacctgcaccccttcagaatcctgcccaacggcctgaccctgcccggcgcccaggagagacccggctacctgctggccgccctgcccaacccctgcgcccccagaccctaccaggtgcactgggtgcacgtggccgtgctgatcgccgtgctgctgcagcagctgccccagagcagatgcctgagactgcccctgcccggcggcggcggcggccagagagccctgcagggcagactgaagacccaggccggcaagagaggcgtgagaaagagaggcggctggagagagagagagagacccagcgccgaccccggcgagagaggcctgagagtgggcgcccaggtgcagaaccccagagcccccagaaagatcttcgccatccccgccaccagcaaggtgcagctgagacccatgtag

SEQ ID NO: 25881 - DNA, 435 bp, Artificial Sequence
  Description of Artificial Sequence: Synthetic coding sequence
atggccgacggcggcggcggcggcagcggcggcgccggccccgccagcaccagagccagcagaggcctgttcgacagcttcagaagagactgcaaggccgacgtggacaccaagcccgcctaccagaacctgagccagaaggccgacaacttcgtgagcacccacctggacaagcaggagtggaacccccccgccaacgacaaccagctgcacgacggcctgagacagagcgtggtgcagagcggcagaagcgaggccggcgtggacagaatcagcagccaggtggtggaccccaagctgaaccacatcttcagaccccagatcgagcagatcatccacgagttcctggtggcccagaaggaggccgccgtgcccgccctgccccccgagcccgagggccaggacccccccgcccccagccaggacaccagctag

SEQ ID NO: 25882 - DNA, 861 bp, Artificial Sequence
  Description of Artificial Sequence: Synthetic coding sequence
cagagatgctgcagatgctgctgcagatgcccctgctgcggccagggccccagaagcggctgcaagatccccgccggcgacgccagagtgagagacggcgccggcggcagcgtgcacctgtgcgccctgttcggcctgctgcccagagtgtggctggagagattctacccctgcctgtggcccctggtgcccggcagaggccagtgcagacccggcgacagcgccaccaacaacagcacccagaaggtgcagaaggagacccagggcagattccacctgctgggcgaccccagcagaaacaactgcagcctgagcatcagagacgccagaagaagagacaacggcagctacttcttctgggtggccagaggcagaaccaagttcagctacaagtacagccccctgagcgtgtacgtgaccgccctgacccacagacccgacatcctgatccccgagttcctgaagagcggccaccccagcaacctgacctgcagcgtgccctgggtgtgcgagcagggcaccccccccatcttcagctggatgagcgccgcccccaccagcctgggccccagaaccctgcacagcagcgtgctgaccatcatccccagaccccaggaccacggcaccaacctgatctgccaggtgaccttccccggcgccggcgtgaccaccgagagaaccatccagctgagcgtgagctggaagagcggcaccgtggaggaggtggtggtgctggccgtgggcgtggtggccgtgaagatcctgctgctgtgcctgtgcctgatcatcctgagcttccacaagaagaaggccgtgagagccgtggaggtggaggagaacgtgtacgccgtgatgggctag

SEQ ID NO: 25883 - DNA, 834 bp, Artificial Sequence
  Description of Artificial Sequence: Synthetic coding sequence
atgcccgagagcgtgaccgtgcaggagggcctgtgcatcttcgtgcactgcagcgtgttctacctggagtacggctggaaggacagcacccccgcctacggccactggttcagagagggcgtgagcgtggaccaggagacccccgtggccaccaacaacagcacccagaaggtgcagaaggagacccagggcagattccacctgctgggcgaccccagcagaaacaactgcagcctgagcatcagagacgccagaagaagagacaacggcagctacttcttctgggtggccagaggcagaaccaagttcagctacaagtacagccccctgagcgtgtacgtgaccgccctgacccacagacccgacatcctgatccccgagttcctgaagagcggccaccccagcaacctgacctgcagcgtgccctgggtgtgcgagcagggcaccccccccatcttcagctggatgagcgccgcccccaccagcctgggccccagaaccctgcacagcagcgtgctgaccatcatccccagaccccaggaccacggcaccaacctgatctgccaggtgaccttccccggcgccggcgtgaccaccgagagaaccatccagctgagcgtgagctaccccctgatgaaccccgtgatcgaggccagcctggaggacggcaccggcaagagcggcaccgtggaggaggtggtggtgctggccgtgggcgtggtggccgtgaagatcctgctgctgtgcctgtgcctgatcatcctgagcttccacaagaagaaggccgtgagagccgtggaggtggaggagaacgtgtacgccgtgatgggctag

SEQ ID NO: 25884 - DNA, 543 bp, Artificial Sequence
  Description of Artificial Sequence: Synthetic coding sequence
atggccgagagcctgcccctggagatgctgacctacatcctgagcttcctgcccctgagcgaccagaaggaggccagcctggtgagctgggcctggtacagagccgcccagaacgccctgagagagagcctgggcctgagaggcatctgctgcatcagcctgaccaacctggacggcagcctggccagccaccaggtgctgcagagcgtggcctaccacctgggcccccacctgcagagcctgagcctgggcggcggcagccccaccgaggccagcagcgtggccctgatcctgggctgccccgccctgtgcgtgctggacctgagcggctgcaacagcctgttcaccagcggcaccctgctggcccagcccgagatggcccagagcgtgcagcaggccctgagcggcctgagagagctgaacctggccggcctgagagacctggccgacctgagcttcaaccagctgagcagctgcgcccccagcctggagagactgagcctggcctactgccacctgaccttcgagctgggccccgcctag

SEQ ID NO: 25885 - DNA, 702 bp, Artificial Sequence
  Description of Artificial Sequence: Synthetic coding sequence
atgagactgctgcccctgctgagaaccgtgctgtgggccgccttcctgggcagccccctgagaggcggcagcagcctgagacacgtggtgtactggaacagcagcaaccccagcctgagaagagagggctacaccgtgcaggtgaacgtgaacgactacctggacatctactgcccccactacaacagcagcggcgtgggccccggcgccggccccggccccggcggcggcgccgagcagtacgtgctgtacatggtgagcagaaacggctacagaacctgcaacgccagccagggcttcaagagatgggagtgcaacagaccccacgccccccacagccccatcaagttcagcgagaagttccagagatacagcgccttcagcctgggctacgagttccacgccggccacgagtactactacatcagcacccccacccacaacctgcactggaagtgcctgagaatgaaggtgttcgtgtgctgcgccagcaccagccacagcggcgagaagcccgtgcccaccctgccccagttcaccatgggccccaacgtgaagatcaacgtgctggaggacttcgagggcgagaacccccaggtgcccaagctggagaagagcatcagcggcaccagccccaagagagagcacctgcccctggccgtgggcatcgccttcttcctgatgaccttcctggccagctag

SEQ ID NO: 25886 - DNA, 495 bp, Artificial Sequence
  Description of Artificial Sequence: Synthetic coding sequence
atggaggacgagagaatcctggacaacctgggcgccgagggcagacacggcagcgagtgggagtggagaagatggcacttcggcggctgggtggaggaggagcacagacacagatggcccagaggcgtgtggagcaccgacaagagccccggcggcgtgcagccccagtgcctgagccaggaggtgagcgccctggtgagcggcacccagagcagcctgagaaacggcctgggcgacaagtggagcgcctgctgcaccagagccctgggccagatggagcagaccaagcagagcaagagaagagccggcagagaggacagattcagcgtggccctgggcagatgcagaggcaacgagcacaagaccctgagccacgtgcccggcgccagcgacgccgcccagaagcccagagccaagccctgcagcagaggcatcggcgccagcgtgctgctgcagaccatgcacctgagcttcatcaccctgggcttcagatag

SEQ ID NO: 25887 - DNA, 1323 bp, Artificial Sequence
  Description of Artificial Sequence: Synthetic coding sequence
atgagcatgctggccgagagaagaagaaagcagaagtgggccgtggacccccagaacaccgcctggagcaacgacgacagcaagttcggccagagaatgctggagaagatgggctggagcaagggcaagggcctgggcgcccaggagcagggcgccaccgaccacatcaaggtgcaggtgaagaacaaccacctgggcctgggcgccaccatcaacaacgaggacaactggatcgcccaccaggacgacttcaaccagctgctggccgagctgaacacctgccacggccaggagaccaccgacagcagcgacaagaaggagaagaagagcttcagcctggaggagaagagcaagatcagcaagaacagagtgcactacatgaagttcaccaagggcaagagctggaaggccctgaccctgagccagaagagaccctacgtggacgaggccgagagactgagactgcagcacatgcaggactaccccaactacaagtacagacccagaagaaagaagcaggccaagagactgtgcaagagagtggaccccggcttcctgctgagcagcctgagcagagaccagaacgccctgcccgagaagagaagcggcagcagaggcgccctgggcgagaaggaggacagaggcgagtacagccccggcaccgccctgcccagcctgagaggctgctaccacgagggccccgccggcggcggcggcggcggcacccccagcagcgtggacacctacccctacggcctgcccaccccccccgagatgagccccctggacgtgctggagcccgagcagaccttcttcagcagcccctgccaggaggagcacggccaccccagaagaatcccccacctgcccggccacccctacagccccgagtacgcccccagccccctgcactgcagccaccccctgggcagcctggccctgggccagagccccggcgtgagcatgatgagccccgtgcccggctgcccccccagccccgcctactacagccccgccacctaccaccccctgcacagcaacctgcaggcccacctgggccagctgagccccccccccgagcaccccggcttcgacgccctggaccagctgagccaggtggagctgctgggcgacatggacagaaacgagttcgaccagtacctgaacacccccggccaccccgacagcgccaccggcgccatggccctgagcggccacgtgcccgtgagccaggtgacccccaccggccccaccgagaccagcctgatcagcgtgctggccgacgccaccgccacctactacaacagctacagcgtgagctag

SEQ ID NO: 25888 - DNA, 888 bp, Artificial Sequence
  Description of Artificial Sequence: Synthetic coding sequence
atgctgcccgacttcaagctgtactacaaggccaccgtgaccaagaccgcctggtacagataccagaacagagacatcgaccagtggaacagaaccgagcccagcgagatcaccccccacatctacaactacctgatcttcgacaagcccgagaagaacaagcagtggggcaaggacagcctgttcaacaagtggtgctgggagaactggctggccatctgcagaaagctgaagctggaccccttcctgaccccctacaccaagatcaacagcagatggatcaagtacctgaacgtgagacccaagaccatcaagaccgtggaggagaacctgggcatcaccatccaggacatcggcatgggcaaggacttcatgagcaagacccccaaggccatggccaccaaggccaagatcgacaagtgggacctgatcaagctgaagagcttctgcaccgccaaggagaccaccatcagagtgaacagacagcccaccaagtgggagaagatcttcgccacctacagcagcgacaagggcctgatcagcagaatctacaacgagttcaagcagatctacaagaagaagaccaacaaccccatcaagaagtgggccaaggacatgaacagacacttcagcaaggaggacatctacgccgccaagaagcacatgaagaagtgcagccccagcctggccatcagagagatgcagatcaagaccaccatgagataccacctgacccccgtgagaatggccgtgatcaagaagagcggcaacaacagatgctggagaggctgcggcgagatcggcaccctgctgcactgctggtgggactgcaagctggtgcagcccctgtggaagagcgtgtggagattcctgagagacctggagtag

SEQ ID NO: 25889 - DNA, 372 bp, Artificial Sequence
  Description of Artificial Sequence: Synthetic coding sequence
atgcagagcgagaagccccagggcctgttcctgcagctgaaccccaacgccagcagcaccgagacccagctgctggtgcccgccctggagagcagagacaccctgccccccacccactgcttcatggccggcaccgagagccccctgggcaacccctggcccctgagcctgccccccccctgctggaccggctgcctgctgcccgcccccagaggccagagaaagcccggccccctgggcctgagcatcttcatcagcctgggcaacaagagacacagaagcggcaaccacgtggtgagagagagcgagcagcccctgagccagggcaacccccaccagggctggggccccgacaccagaaagggcagatag

SEQ ID NO: 25890 - DNA, 372 bp, Artificial Sequence; identical to SEQ ID NO: 25889
  Description of Artificial Sequence: Synthetic coding sequence

SEQ ID NO: 25891 - DNA, 855 bp, Artificial Sequence
  Description of Artificial Sequence: Synthetic coding sequence
atgctgagcgtggtggagaacggcctggacccccaggccgccatccccgtgatcaagaagaagctggtgggcagcgtgaaggccctgcagaagcagtacgtgagcctggacatggtggtgaccagcgaggacggcgacgccaacaccatgtgcagcgccctggaggccgtgttcatccacggcctgcacaccaagcacatcagagccgaggccggcggcaagagaaagaagagcgcccaccagaagcccctgccccagcccgtgttctggcccctgctgaaggccgtgacccccaagcacatcatcagcgagctggagcacctgaccttcgtgaacatggacgtgggcagatgcagagcctggctgagactggccctgaacaacggcctgatggagtgctacctgaagctgctgctgcaggagcaggccagactgcagctgcagagaaaggagagcctggacagcatcagccacagcagcggcagcgaggacatcgaggtgcaccacagcggccacaagatcagaagaaaccagaagcccaccgccagcagcctgagcctggacaccgccagcagcagccagctgagctgcagcctgaacagcgacagctgcctgctgcaggagaacggcagcaagagccccgaccactgcgaggagcccatgagctacgacagcgacctgggcaccgccaacgccgaggacagcgaccagagcctgcaggacatcaagatcttcagctgggcccagtggctgacccccgtgatccccgccctgtgggaggccgaggccggcggcagccagagccaggagatcgagaccttcctggccaacaccgtgaagccccacctgtactag

SEQ ID NO: 25892 - DNA, 516 bp, Artificial Sequence
  Description of Artificial Sequence: Synthetic coding sequence
atggactggacccccagactgcccagcagacacatcatcagcgagctggagcacctgaccttcgtgaacatggacgtgggcagatgcagagcctggctgagactggccctgaacaacggcctgatggagtgctacctgaagctgctgctgcaggagcaggccagactgcagctgcagagaaaggagagcctggacagcatcagccacagcagcggcagcgaggacatcgaggtgcaccacagcggccacaagatcagaagaaaccagaagcccaccgccagcagcctgagcctggacaccgccagcagcagccagctgagctgcagcctgaacagcgacagctgcctgctgcaggagaacggcagcaagagccccgaccactgcgaggagcccatgagctacgacagcgacctgggcaccgccaacgccgaggacagcgaccagagcctgcaggagaagaccagagccggcagccagagaatgaccagcaccggcctgcccggcagcaacccctag

SEQ ID NO: 25893 - DNA, 576 bp, Artificial Sequence
  Description of Artificial Sequence: Synthetic coding sequence
atgcccgccgccatcgcccccaaggacgacctgagcatcagattcctgaagccctggctgggcgagggcatcctgctgagcggcggcgacaagtggagcagacacagaagaatgctgacccccgccttccacttcaacatcctgaagccctacatcaagatcttcaacagaagcgtgaacatcatgcacgacaagtggcagcacctggccagcgagggcagcagcagactggacatgttcgagcacatcagcctgatgaccctggacagcctgcagaagtgcatcttcagcttcgacagccactgccaggagagacccagcgagtacatcgccaccatcctggagctgagcgccctggtggagaagagaaaccagcacatcctgcagcacatggacttcctgtactacctgagccacgacggctggagattcagaagagcctgcagactggtgcacgacttcaccgacgccgtgatccaggagagaagacacaccctgcccacccagggcatcgtgatcagcagcagaaccaagcccagccccagactgtggatcagcctgatgtgcttctgctag

SEQ ID NO: 25894 - DNA, 4098 bp, Artificial Sequence
  Description of Artificial Sequence: Synthetic coding sequence
atgagcagcggcagaagaagaggcagcgccccctggcacagcttcagcagattcttcgcccccagaagccccagcagagacaaggaggaggaggaggaggagagacccggcaccagccccccccccgcccccggcagaagcgccgccagcgtggagaacgagcccatgagcaccagccagaagaaggagaacgtgctgagcagcgaggccgtgaagatcagacagagcgaggacaagagaaaccacgccgagaagcccgtgaccctgcccgtgcaggaggaccccaagaaggcctacgacctgagcagcagcaccagcgacaccaagatcggcgagagcgacagacagcccaaggagagcttcttccagttcctgggcaacctgttcaacatcagcggcaagagcagcctgggcgaggccaagcagagcagcttcaaggacgaccaggacaagaccgagaaggacctgcagaaccccagcgaccaccacgaggacggcatcaagagagagagagagatcttcagcggcagcctgagaacccagacccaccccaccgaggagcaggacagcaacagcagcgagctgagcgacgccttcagcctggacaccacccaggacagcgaccaggagaccaccaacctgctgaagcagatcgacggcaagcccgagaagcccagcgtgacctacgccacctacagaggccccagacacatcggcaagtacctgaagcagcagaccggcctggccaccgtgaacaccctggacagagagaacgagagcagcgacagcagcaccaacagacacatcgaccccggcagcgagatcgaggccggcgtgctgcccctgctgctgagcgccagcaccgacagcagcatgaagggcaacctgctggagggccccctggaggacagcgactgcagcaagaccagcttcaacaaggagaacagcctgaccaacaaccccgagctgcagaacatcgccagcagcaacaacctgctgaacaagaacgcctggggcagcatcgagagaaacagaagcagccccagcagcgtgaccaacagcagctacgacggcgagagcgacagccagcaccacctgagctgcgagcccgtgagccagaccaacagaaacctggtgtgcagcgccctgctgaccggcagcaaccacagaaaggtgccctgcagccccgacttccagagagtgaccaccaccgagaacaccatcaaggagaacagcaccgtgatgagcaacagaaccctggtgcagagagaggagctggtggagccccagggccccgccatcagcgacttcagctgcagcaagagcgacggcagcgacaccaccgagcaggagagcaccaacctgcccagccccaacaagagcatcagacacgagcacctgcagctgcccgagagcgagtgcagcgacaagcagaccatcgacagcagcagcaagcaggccgccacccacaccaacatcatcgccctgcagagacacgccgtgaccgacaccgagttcgtgaacgagggcaagagactgagcgcccaggacagccagaagaacgtggccgtgagagagatcagaagagagaccgagagcgccagcgccggcgagagcatcgccagcagccacgtgaaggcccccgaggacaagatcgagagcctgcccaaggacaccgaccagtacttcgagaccaaggccaagaagctggacttcagaagccacgacaagatcccccacatcagaatgaacaagaaggacctggccagcctgaactacatcagcgagagcgccgtggtggccagcctgggcaacgagaacgcccccgagctgaagttcgagctgaacagaagccacatcagcgagacccccctggacagcgagagcccccagcaggccgaggtgagccccgacgccaagaccagcctgagcctggactgcaagaagctgaacttcagcatcagcccccccaccttcgtgagcggcgtgggcatgctgagcaagctggacatccccgacctgatgaacgagggcagccccgtgcccatcgagaccggcaacgtgaacatcgtgggcatcagctaccagcccagaaagtgcaaggaggagaacgtgaagaaccacgtggaggccgccggcagaaagagccccccccccagcttctgcctggagtacaccagcgccatcttcgagttcaaggaggtgctgagcaacagcgagaagtgccaggtgctgcccggcagcgaggccagcggcccccacctgaccggcctggagctgctgagcttcgacagcggcaacctgagcaaggactgcagcagcatcctgagccaggaccccaacagagtggagctggtgagcagcaacaccaaggccaacatgagcatcatcgagaagagcgacagcctgagcctggaggccaagaccgccaacatcgtgagcaaggccgagatcgacggccagaacaacgtgctggtggagagccacagcggcagaggcaagaccatcagcctgagcaaggtgagcctgagcaaggtggagcccagaaacatcagccaggacaagatgagcagcttccccctgaagatcacccacgtgcccgagaagcccatcctgagcgagctgaccttcctggaggtggagcagggcaagagattccagagcatcaaccacaacgagatcggcgagaagtgcagcgacgccggcctgaaggagaactgccaggccgagctgagccccgccgccagcaagtacgaggacaagcccgagcccgaggtggacgccctgggcagcccccccgccctgctgaagagcaacatcagctggatcctgccccccatccacgacgagaagatcagcagacagatggcccagaactgcgaggcccacacctgcgtgttccaccagagcctggacatctgcggcaccaagaagatcagcggccacagcgagatggccgagctgagcctgaccaacatcagccccaagttccaggagaccggcagcatgaaggtgaacagccccttcctggacagcgacagcagcctggagaagaacagcagcgccagcgaggacagcagcttcctgaaggtgcccagcgtgctgaagctggagaagaagagcagcagctacagaaagaaggagaacatccacttcctgaacggcggcatcgacagcgtgagcagcagcagcagctaccccgaggaggtgagcatgatcgtgaacagccacaagccccagaacaacctggacagcatccaggtgaccaaggacctgacccacgagggcaccagcgtgaccaacctgctgtaccccaccaccagctacctggagttcgagaccagcgtgagcatcggcaccgaggtgacccccttccaggagcacttcggcatctacaccggcaagatcagcatcgacttccccaccgccgcccagttcgacaacctggtggaggccgagaccggcgccgtggccggccccgccgccagcgtgaacagcagcggccagcagtgcagcgaggccagcgccgagcacatcgaggccagaagaagagcccacgaccagctgctggacctgaagagcagcctgctgaagaaggccgacaccctgatcggcgagatcttcaacagcgtgagagaggagctgaagttcaagcacaccgtgagcacctgccaggagcacatcgccatcgagggcatcatgaacctgggcaccctgaaggaggacatcagcgagaagaaccccagcgaggtgaccctgaccgagatccagcagaccgagggcctggaggagcagggcatggagaacatgagcgaggtgaaggagaagccctgcgtgagccccaccgtgggcgagaagaacctgctggtggaccccaacagcatgaacgtgagctgcctgctggaggacaaggccagagagctggtgaacgagatcatctacgtggcccaggagaagctgagaaacgacaccttcgaggacaccgaggacacctgggacagcgagctgcaggccaacaccagcaagatcctgaacagcgacagcgtgaagccccacgacgtggtgagagagttcctggtgagcgagcagcccgtgtag

SEQ ID NO: 25895 - DNA, 372 bp, Artificial Sequence
  Description of Artificial Sequence: Synthetic coding sequence
atggccacccacagaagcaccctggccggctacagcccctgcagcagcccccagagagccgcccccaccagaaaccagaaggccgagaaggccagaaacagacaggccagccccatccccaccagactgcccagaaaccccagcctggccagcaccggcagacagggcacccccatgagcagaaagaagcagggcagcgactgcctggtgtaccccggccacccccccggcctgtggcccgtgatcagctgccacctgggcctgagcgccctgagcagcgagatctggaccagcaactgcctgtgcctggccgccctgccctgcgacaccggcctggagagcctgaccgtggtgtgctggagcggcatctag

SEQ ID NO: 25896 - DNA, 375 bp, Artificial Sequence
  Description of Artificial Sequence: Synthetic coding sequence
atggtgagagccaccagaggctactgggaggccaagggcaagtggcagacctggctgagattcagaaagaagagcagcaagtgcagagaggccagaaccttccccagcttcaagttcctgaagggcagccagagcagcttcagcagcctgctgcagatgcccctgcagagcttcaccgccgcccacacctacagaagaagaaacagccccagccagaaggacgacagagccctgggcgccggcgtgcccctggtgctggccgagagcctggacgcctgcgaggtgaagcccgacctgggcaaggccgccctgtggaccctgctggccgtgccccacacccagctgggcttcctgagaaagcagcacagactgtag

SEQ ID NO: 25897 - DNA, 402 bp, Artificial Sequence
  Description of Artificial Sequence: Synthetic coding sequence
atgggctggcccctgagcctgagccccagcggcttcagagaggtggagtggggcatcctgttcgtgtggcagtggctgctgagcagctggcacctgagccccttccccgtgcccaccagccccagcaccccctgcctgcccttcctgtgccaccccctgcccgtgctgcacggcaactgcaccggcctgagcgtgttcgcctgcatgtgcgcccccgtgtacacctgcatcgagagatacatctgcggcggcagaggcgagagaggcggcggcggcgtgaagctgagagcctgcagccaggacaccgcccactggagcctgagcagcgcccccagcgtgctggtgagactgagagaggagggcggcagagccctggtgaagcccgactgccccagcctgtag

SEQ ID NO: 25898 - DNA, 534 bp, Artificial Sequence
  Description of Artificial Sequence: Synthetic coding sequence
atgaccaccagcatcagacagttcaccagcagcagcagcatcaagggcagcagcggcctgggcggcggcagcagcagaaccagctgccagctgagcggcggcctgggcgccggcagctgcagacccggcagcgccggcggcctgggcagcgccctgggcggcagcagctacagcagctgctacagcttcggcagcggcggcggctacggcagcagcagcttcgagggcgtggacggcctgctggtgggcggcgagaaggccaccatgcagaacctgaacgacagactggccagctacctggacaaggtgagagccctggaggaggccgacaccgagctggaggtgaagatcagagactggtaccagagacaggcccccggccccgccagagactacagccagtactacagaatcatcgaggagctgcagaacaagcccccctggaccatgcccaccagctgctacagaatgaccatgcccatctggctgctgctgaccagcgcccccaagagctggcagaacgagggcagatag

SEQ ID NO: 25899 - DNA, 981 bp, Artificial Sequence
  Description of Artificial Sequence: Synthetic coding sequence
atgccccacctgcccctggccagcttcagaccccccttctggggcctgagacacagcagaggcctgcccagattccacagcgtgagcacccagagcgagccccacggcagccccatcagcagaagaaacagagaggccaagcagaagagactgagagagaagcaggccaccctggaggccgagatcgccggcgagagcaagagccccgccgagagcatcaaggcctggagacccaaggagctggtgctgtacgagatccccaccaagcccggcgagaagaaggacgtgagcggccccctgccccccgcctacagccccagatacgtggaggccgcctggtacccctggtgggtgagagagggcttcttcaagcccgagtaccaggccagactgccccaggccaccggcgagaccttcagcatgtgcatccccccccccaacgtgaccggcagcctgcacatcggccacgccctgaccgtggccatccaggacgccctggtgagatggcacagaatgagaggcgaccaggtgctgtgggtgcccggcagcgaccacgccggcatcgccacccaggccgtggtggagaagcagctgtggaaggagagaggcgtgagaagacacgagctgagcagagaggccttcctgagagaggtgtggcagtggaaggaggccaagggcggcgagatctgcgagcagctgagagccctgggcgccagcctggactgggacagagagtgcttcaccatggacgtgggcagcagcgtggccgtgaccgaggccttcgtgagactgtacaaggccggcctgctgtacagaaaccaccagctggtgaactggagctgcgccctgagaagcgccatcagcgacatcgaggtggagaacagacccctgcccggccacacccagctgagactgcccggctgccccacccccgtgagcttcggcctgctgttcagcgtggccttccccgtggacggctag

SEQ ID NO: 25900 - DNA, 3192 bp, Artificial Sequence
  Description of Artificial Sequence: Synthetic coding sequence
atgccccacctgcccctggccagcttcagaccccccttctggggcctgagacacagcagaggcctgcccagattccacagcgtgagcacccagagcgagccccacggcagccccatcagcagaagaaacagagaggccaagcagaagagactgagagagaagcaggccaccctggaggccgagatcgccggcgagagcaagagccccgccgagagcatcaaggcctggagacccaaggagctggtgctgtacgagatccccaccaagcccggcgagaagaaggacgtgagcggccccctgccccccgcctacagccccagatacgtggaggccgcctggtacccctggtgggtgagagagggcttcttcaagcccgagtaccaggccagactgccccaggccaccggcgagaccttcagcatgtgcatccccccccccaacgtgaccggcagcctgcacatcggccacgccctgaccgtggccatccaggacgccctggtgagatggcacagaatgagaggcgaccaggtgctgtgggtgcccggcagcgaccacgccggcatcgccacccaggccgtggtggagaagcagctgtggaaggagagaggcgtgagaagacacgagctgagcagagaggccttcctgagagaggtgtggcagtggaaggaggccaagggcggcgagatctgcgagcagctgagagccctgggcgccagcctggactgggacagagagtgcttcaccatggacgtgggcagcagcgtggccgtgaccgaggccttcgtgagactgtacaaggccggcctgctgtacagaaaccaccagctggtgaactggagctgcgccctgagaagcgccatcagcgacatcgaggtggagaacagacccctgcccggccacacccagctgagactgcccggctgccccacccccgtgagcttcggcctgctgttcagcgtggccttccccgtggacggcgagcccgacgccgaggtggtggtgggcaccaccagacccgagaccctgcccggcgacgtggccgtggccgtgcaccccgacgacagcagatacacccacctgcacggcagacagctgagacaccccctgatgggccagcccctgcccctgatcaccgactacgccgtgcagccccacgtgggcaccggcgccgtgaaggtgacccccgcccacagccccgccgacgccgagatgggcgccagacacggcctgagccccctgaacgtgatcgccgaggacggcaccatgaccagcctgtgcggcgactggctgcagggcctgcacagattcgtggccagagagaagatcatgagcgtgctgagcgagagaggcctgttcagaggcctgcagaaccaccccatggtgctgcccatctgcagcagaagcggcgacgtgatcgagtacctgctgaagaaccagtggttcgtgagatgccaggagatgggcgccagagccgccaaggccgtggagagcggcgccctggagctgagccccagcttccaccagaagaactggcagcactggttcagccacatcggcgactggtgcgtgagcagacagctgtggtggggccaccagatccccgcctacctggtggtggaggaccacgcccagggcgaggaggactgctgggtggtgggcagaagcgaggccgaggccagagaggtggccgccgagctgaccggcagacccggcgccgagctgaccctggagagagaccccgacgtgctggacacctggttcagcagcgccctgttccccttcagcgccctgggctggccccaggagacccccgacctggccagattctaccccctgagcctgctggagaccggcagcgacctgctgctgttctgggtgggcagaatggtgatgctgggcacccagctgaccggccagctgcccttcagcaaggtgctgctgcaccccatggtgagagacagacagggcagaaagatgagcaagagcctgggcaacgtgctggaccccagagacatcatcagcggcgtggagatgcaggtgctgcaggagaagctgagaagcggcaacctggaccccgccgagctggccatcgtggccgccgcccagaagaaggacttcccccacggcatccccgagtgcggcaccgacgccctgagattcaccctgtgcagccacggcgtgcaggccggcgacctgcacctgagcgtgagcgaggtgcagagctgcagacacttctgcaacaagatctggaacgccctgagattcatcctgaacgccctgggcgagaagttcgtgccccagcccgccgaggagctgagccccagcagccccatggacgcctggatcctgagcagactggccctggccgcccaggagtgcgagagaggcttcctgaccagagagctgagcctggtgacccacgccctgcaccacttctggctgcacaacctgtgcgacgtgtacctggaggccgtgaagcccgtgctgtggcacagccccagacccctgggccccccccaggtgctgttcagctgcgccgacctgggcctgagactgctggcccccctgatgcccttcctggccgaggagctgtggcagagactgccccccagacccggctgcccccccgcccccagcatcagcgtggccccctaccccagcgcctgcagcctggagcactggagacagcccgagctggagagaagattcagcagagtgcaggaggtggtgcaggtgctgagagccctgcaggccacctaccagctgaccaaggccagacccagagtgctgctgcagagcagcgagcccggcgaccagggcctgttcgaggccttcctggagcccctgggcaccctgggctactgcggcgccgtgggcctgctgccccccggcgccgccgcccccagcggctgggcccaggcccccctgagcgacaccgcccaggtgtacatggagctgcagggcctggtggacccccagatccagctgcccctgctggccgccagaagatacaagctgcagaagcagctggacagcctgaccgccagaacccccagcgagggcgaggccggcacccagagacagcagaagctgagcagcctgcagctggagctgagcaagctggacaaggccgccagccacctgagacagctgatggacgagccccccgcccccggcagccccgagctgtag

SEQ ID NO: 25901 - DNA, 348 bp, Artificial Sequence
  Description of Artificial Sequence: Synthetic coding sequence
atgccccacctgcccctggccagcttcagaccccccttctggggcctgagacacagcagaggcctgcccagattccacagcgtgagcacccagagcgagccccacggcagccccatcagcagaagaaacagagaggccaagcagaagagactgagagagaagcaggccaccctggaggccgagatcgccggcgagagcaagagccccgccgagagcatcaaggcctggagacccaaggagctggtgctgtacgagatccccaccaagcccggcgagaagaaggacgtgagcggccccctgccccccgcctacagccccagatacgtggaggccgcctggtacccctag

SEQ ID NO: 25902 - DNA, 2772 bp, Artificial Sequence
  Description of Artificial Sequence: Synthetic coding sequence
atgtgcatccccccccccaacgtgaccggcagcctgcacatcggccacgccctgaccgtggccatccaggacgccctggtgagatggcacagaatgagaggcgaccaggtgctgtgggtgcccggcagcgaccacgccggcatcgccacccaggccgtggtggagaagcagctgtggaaggagagaggcgtgagaagacacgagctgagcagagaggccttcctgagagaggtgtggcagtggaaggaggccaagggcggcgagatctgcgagcagctgagagccctgggcgccagcctggactgggacagagagtgcttcaccatggacgtgggcagcagcgtggccgtgaccgaggccttcgtgagactgtacaaggccggcctgctgtacagaaaccaccagctggtgaactggagctgcgccctgagaagcgccatcagcgacatcgaggtggagaacagacccctgcccggccacacccagctgagactgcccggctgccccacccccgtgagcttcggcctgctgttcagcgtggccttccccgtggacggcgagcccgacgccgaggtggtggtgggcaccaccagacccgagaccctgcccggcgacgtggccgtggccgtgcaccccgacgacagcagatacacccacctgcacggcagacagctgagacaccccctgatgggccagcccctgcccctgatcaccgactacgccgtgcagccccacgtgggcaccggcgccgtgaaggtgacccccgcccacagccccgccgacgccgagatgggcgccagacacggcctgagccccctgaacgtgatcgccgaggacggcaccatgaccagcctgtgcggcgactggctgcagggcctgcacagattcgtggccagagagaagatcatgagcgtgctgagcgagagaggcctgttcagaggcctgcagaaccaccccatggtgctgcccatctgcagcagaagcggcgacgtgatcgagtacctgctgaagaaccagtggttcgtgagatgccaggagatgggcgccagagccgccaaggccgtggagagcggcgccctggagctgagccccagcttccaccagaagaactggcagcactggttcagccacatcggcgactggtgcgtgagcagacagctgtggtggggccaccagatccccgcctacctggtggtggaggaccacgcccagggcgaggaggactgctgggtggtgggcagaagcgaggccgaggccagagaggtggccgccgagctgaccggcagacccggcgccgagctgaccctggagagagaccccgacgtgctggacacctggttcagcagcgccctgttccccttcagcgccctgggctggccccaggagacccccgacctggccagattctaccccctgagcctgctggagaccggcagcgacctgctgctgttctgggtgggcagaatggtgatgctgggcacccagctgaccggccagctgcccttcagcaaggtgctgctgcaccccatggtgagagacagacagggcagaaagatgagcaagagcctgggcaacgtgctggaccccagagacatcatcagcggcgtggagatgcagctgctgcaggagaagctgagaagcggcaacctggaccccgccgagctggccatcgtggccgccgcccagaagaaggacttcccccacggcatccccgagtgcggcaccgacgccctgagattcaccctgtgcagccacggcgtgcaggccggcgacctgcacctgagcgtgagcgaggtgcagagctgcagacacttctgcaacaagatctggaacgccctgagattcatcctgaacgccctgggcgagaagttcgtgccccagcccgccgaggagctgagccccagcagccccatggacgcctggatcctgagcagactggccctggccgcccaggagtgcgagagaggcttcctgaccagagagctgagcctggtgacccacgccctgcaccacttctggctgcacaacctgtgcgacgtgtacctggaggccgtgaagcccgtgctgtggcacagccccagacccctgggccccccccaggtgctgttcagctgcgccgacctgggcctgagactgctggcccccctgatgcccttcctggccgaggagctgtggcagagactgccccccagacccggctgcccccccgcccccagcatcagcgtggccccctaccccagcgcctgcagcctggagcactggagacagcccgagctggagagaagattcagcagagtgcaggaggtggtgcaggtgctgagagccctgagagccacctaccagctgaccaaggccagacccagagtgctgctgcagagcagcgagcccggcgaccagggcctgttcgaggccttcctggagcccctgggcaccctgggctactgcggcgccgtgggcctgctgccccccggcaccgccgcccccagcggctgggcccaggcccccctgagcgacaccgcccaggtgtacatggagctgcagggcctggtggacccccagatccagctgcccctgctggccgccagaagatacaagctgcagaagcagctggacagcctgaccgccagaacccccagcgagggcgaggccggcacccagagacagcagaagctgagcagcctgcagctggagctgagcaagctggacaaggccgccagccacctgagacagctgatggacgagccccccgcccccggcagccccgagctgtag

SEQ ID NO: 25903 - DNA, 3282 bp, Artificial Sequence
  Description of Artificial Sequence: Synthetic coding sequence
atgggcggcaaggcctggcccagaagagccgtgggcaccgccggcggcccctgcgccgagcagatcagcgcccccttccagaccctgctgatgccccacctgcccctggccagcttcagaccccccttctggggcctgagacacagcagaggcctgcccagattccacagcgtgagcacccagagcgagccccacggcagccccatcagcagaagaaacagagaggccaagcagaagagactgagagagaagcaggccaccctggaggccgagatcgccggcgagagcaagagccccgccgagagcatcaaggcctggagacccaaggagctggtgctgtacgagatccccaccaagcccggcgagaagaaggacgtgagcggccccctgccccccgcctacagccccagatacgtggaggccgcctggtacccctggtgggtgagagagggcttcttcaagcccgagtaccaggccagactgccccaggccaccggcgagaccttcagcatgtgcatccccccccccaacgtgaccggcagcctgcacatcggccacgccctgaccgtggccatccaggacgccctggtgagatggcacagaatgagaggcgaccaggtgctgtgggtgcccggcagcgaccacgccggcatcgccacccaggccgtggtggagaagcagctgtggaaggagagaggcgtgagaagacacgagctgagcagagaggccttcctgagagaggtgtggcagtggaaggaggccaagggcggcgagatctgcgagcagctgagagccctgggcgccagcctggactgggacagagagtgcttcaccatggacgtgggcagcagcgtggccgtgaccgaggccttcgtgagactgtacaaggccggcctgctgtacagaaaccaccagctggtgaactggagctgcgccctgagaagcgccatcagcgacatcgaggtggagaacagacccctgcccggccacacccagctgagactgcccggctgccccacccccgtgagcttcggcctgctgttcagcgtggccttccccgtggacggcgagcccgacgccgaggtggtggtgggcaccaccagacccgagaccctgcccggcgacgtggccgtggccgtgcaccccgacgacagcagatacacccacctgcacggcagacagctgagacaccccctgatgggccagcccctgcccctgatcaccgactacgccgtgcagccccacgtgggcaccggcgccgtgaaggtgacccccgcccacagccccgccgacgccgagatgggcgccagacacggcctgagccccctgaacgtgatcgccgaggacggcaccatgaccagcctgtgcggcgactggctgcagggcctgcacagattcgtggccagagagaagatcatgagcgtgctgagcgagagaggcctgttcagaggcctgcagaaccaccccatggtgctgcccatctgcagcagaagcggcgacgtgatcgagtacctgctgaagaaccagtggttcgtgagatgccaggagatgggcgccagagccgccaaggccgtggagagcggcgccctggagctgagccccagcttccaccagaagaactggcagcactggttcagccacatcggcgactggtgcgtgagcagacagctgtggtggggccaccagatccccgcctacctggtggtggaggaccacgcccagggcgaggaggactgctgggtggtgggcagaagcgaggccgaggccagagaggtggccgccgagctgaccggcagacccggcgccgagctgaccctggagagagaccccgacgtgctggacacctggttcagcagcgccctgttccccttcagcgccctgggctggccccaggagacccccgacctggccagattctaccccctgagcctgctggagaccggcagcgacctgctgctgttctgggtgggcagaatggtgatgctgggcacccagctgaccggccagctgcccttcagcaaggtgctgctgcaccccatggtgagagacagacagggcagaaagatgagcaagagcctgggcaacgtgctggaccccagagacatcatcagcggcgtggagatgcaggtgctgcaggagaagctgagaagcggcaacctggaccccgccgagctggccatcgtggccgccgcccagaagaaggacttcccccacggcatccccgagtgcggcaccgacgccctgagattcaccctgtgcagccacggcgtgcaggccggcgacctgcacctgagcgtgagcgaggtgcagagctgcagacacttctgcaacaagatctggaacgccctgagattcatcctgaacgccctgggcgagaagttcgtgccccagcccgccgaggagctgagccccagcagccccatggacgcctggatcctgagcagactggccctggccgcccaggagtgcgagagaggcttcctgaccagagagctgagcctggtgacccacgccctgcaccacttctggctgcacaacctgtgcgacgtgtacctggaggccgtgaagcccgtgctgtggcacagccccagacccctgggccccccccaggtgctgttcagctgcgccgacctgggcctgagactgctggcccccctgatgcccttcctggccgaggagctgtggcagagactgccccccagacccggctgcccccccgcccccagcatcagcgtggccccctaccccagcgcctgcagcctggagcactggagacagcccgagctggagagaagattcagcagagtgcaggaggtggtgcaggtgctgagagccctgcaggccacctaccagctgaccaaggccagacccagagtgctgctgcagagcagcgagcccggcgaccagggcctgttcgaggccttcctggagcccctgggcaccctgggctactgcggcgccgtgggcctgctgccccccggcgccgccgcccccagcggctgggcccaggcccccctgagcgacaccgcccaggtgtacatggagctgcagggcctggtggacccccagatccagctgcccctgctggccgccagaagatacaagctgcagaagcagctggacagcctgaccgccagaacccccagcgagggcgaggccggcacccagagacagcagaagctgagcagcctgcagctggagctgagcaagctggacaaggccgccagccacctgagacagctgatggacgagccccccgcccccggcagccccgagctgtag

SEQ ID NO: 25904 - DNA, 2772 bp, Artificial Sequence
  Description of Artificial Sequence: Synthetic coding sequence
atgtgcatccccccccccaacgtgaccggcagcctgcacatcggccacgccctgaccgtggccatccaggacgccctggtgagatggcacagaatgagaggcgaccaggtgctgtgggtgcccggcagcgaccacgccggcatcgccacccaggccgtggtggagaagcagctgtggaaggagagaggcgtgagaagacacgagctgagcagagaggccttcctgagagaggtgtggcagtggaaggaggccaagggcggcgagatctgcgagcagctgagagccctgggcgccagcctggactgggacagagagtgcttcaccatggacgtgggcagcagcgtggccgtgaccgaggccttcgtgagactgtacaaggccggcctgctgtacagaaaccaccagctggtgaactggagctgcgccctgagaagcgccatcagcgacatcgaggtggagaacagacccctgcccggccacacccagctgagactgcccggctgccccacccccgtgagcttcggcctgctgttcagcgtggccttccccgtggacggcgagcccgacgccgaggtggtggtgggcaccaccagacccgagaccctgcccggcgacgtggccgtggccgtgcaccccgacgacagcagatacacccacctgcacggcagacagctgagacaccccctgatgggccagcccctgcccctgatcaccgactacgccgtgcagccccacgtgggcaccggcgccgtgaaggtgacccccgcccacagccccgccgacgccgagatgggcgccagacacggcctgagccccctgaacgtgatcgccgaggacggcaccatgaccagcctgtgcggcgactggctgcagggcctgcacagattcgtggccagagagaagatcatgagcgtgctgagcgagagaggcctgttcagaggcctgcagaaccaccccatggtgctgcccatctgcagcagaagcggcgacgtgatcgagtacctgctgaagaaccagtggttcgtgagatgccaggagatgggcgccagagccgccaaggccgtggagagcggcgccctggagctgagccccagcttccaccagaagaactggcagcactggttcagccacatcggcgactggtgcgtgagcagacagctgtggtggggccaccagatccccgcctacctggtggtggaggaccacgcccagggcgaggaggactgctgggtggtgggcagaagcgaggccgaggccagagaggtggccgccgagctgaccggcagacccggcgccgagctgaccctggagagagaccccgacgtgctggacacctggttcagcagcgccctgttccccttcagcgccctgggctggccccaggagacccccgacctggccagattctaccccctgagcctgctggagaccggcagcgacctgctgctgttctgggtgggcagaatggtgatgctgggcacccagctgaccggccagctgcccttcagcaaggtgctgctgcaccccatggtgagagacagacagggcagaaagatgagcaagagcctgggcaacgtgctggaccccagagacatcatcagcggcgtggagatgcaggtgctgcaggagaagctgagaagcggcaacctggaccccgccgagctggccatcgtggccgccgcccagaagaaggacttcccccacggcatccccgagtgcggcaccgacgccctgagattcaccctgtgcagccacggcgtgcaggccggcgacctgcacctgagcgtgagcgaggtgcagagctgcagacacttctgcaacaagatctggaacgccctgagattcatcctgaacgccctgggcgagaagttcgtgccccagcccgccgaggagctgagccccagcagccccatggacgcctggatcctgagcagactggccctggccgcccaggagtgcgagagaggcttcctgaccagagagctgagcctggtgacccacgccctgcaccacttctggctgcacaacctgtgcgacgtgtacctggaggccgtgaagcccgtgctgtggcacagccccagacccctgggccccccccaggtgctgttcagctgcgccgacctgggcctgagactgctggcccccctgatgcccttcctggccgaggagctgtggcagagactgccccccagacccggctgcccccccgcccccagcatcagcgtggccccctaccccagcgcctgcagcctggagcactggagacagcccgagctggagagaagattcagcagagtgcaggaggtggtgcaggtgctgagagccctgcaggccacctaccagctgaccaaggccagacccagagtgctgctgcagagcagcgagcccggcgaccagggcctgttcgaggccttcctggagcccctgggcaccctgggctactgcggcgccgtgggcctgctgccccccggcgccgccgcccccagcggctgggcccaggcccccctgagcgacaccgcccaggtgtacatggagctgcagggcctggtggacccccagatccagctgcccctgctggccgccagaagatacaagctgcagaagcagctggacagcctgaccgccagaacccccagcgagggcgaggccggcacccagagacagcagaagctgagcagcctgcagctggagctgagcaagctggacaaggccgccagccacctgagacagctgatggacgagccccccgcccccggcagccccgagctgtag

SEQ ID NO: 25905 - DNA, 774 bp, Artificial Sequence
  Description of Artificial Sequence: Synthetic coding sequence
atgccccacctgcccctggccagcttcagaccccccttctggggcctgagacacagcagaggcctgcccagattccacagcgtgagcacccagagcgagccccacggcagccccatcagcagaagaaacagagaggccaagcagaagagactgagagagaagcaggccaccctggaggccgagatcgccggcgagagcaagagccccgccgagagcatcaaggcctggagacccaaggagctggtgctgtacgagatccccaccaagcccggcgagaagaaggacgtgagcggccccctgccccccgcctacagccccagatacgtggaggccgcctggtacccctggtgggtgagagagggcttcttcaagcccgagtaccaggccagactgccccaggccaccggcgagaccttcagcatgtgcatccccccccccaacgtgaccggcagcctgcacatcggccacgccctgaccgtggccatccaggacgccctggtgagatggcacagaatgagaggcgaccaggtgctgtgggtgcccggcagcgaccacgccggcatcgccacccaggccgtggtggagaagcagctgtggaaggagagaggcgtgagaagacacgagctgagcagagaggccttcctgagagaggtgtggcagtggaaggaggccaagggcggcgagatctgcgagcagctgagagccctgggcgccagcctggactgggacagagtgttctaccacggctgctggctgctgagcggctgcgactag

SEQ ID NO: 25906 - DNA, 639 bp, Artificial Sequence
  Description of Artificial Sequence: Synthetic coding sequence
atgcccaccacctgccactgcgtggccatcaccccccccgacagcggcggcagccccagcagccccgccggcggcagccccagccccgcccccgccgccggcgccgccgagctgagccccgccacccccaccggcagcgccaaccccaccaccagcagctgcgccggcggcacccccgccgccagcctgctgagatgggtgagaagctgcttcctgagactggacgacaccaccaaggacttcccccacgccctgcagtggaagggcagaagccccgagtgcaccagactgtgcttcgtgagactggccagaagcgccaaggccagaccccacagcagccagagaaagggcagatggcccgagtgcaccagcgcctgcagactgagaagccaggacgccaccaacgtgctgagccactgcagacacctgaacggcagaagccccgtgtgcaccagaagatgcatggccagaagcgccggctgcagaaagagcctgccccacttcagccagtggtacggcttcacccccagctgggccagatggtggagaagaaagctggagggcagcgagaacatgagaccccagagaggccacagaaagggcttcagccccgagtgcgtgagaagctggctgtggtag

SEQ ID NO: 25907 - DNA, 1233 bp, Artificial Sequence
  Description of Artificial Sequence: Synthetic coding sequence
atgggcgccgtgagctgcagacagggccagcacacccagcagggcgagcacaccagagtggccgtgccccacaagcagggcggcaacatcagaggcccctgggccagaggctggaagagcctgtggaccggcctgggcaccatcagaagcgacctggaggagctgtgggagctgagaggccaccactacctgcaccaggagagcctgaagcccgcccccgtgctggtggagaagcccctgcccgagtggcccgtgccccagttcatcaacctgttcctgcccgagttccccatcagacccatcagaggccagcagcagctgaagatcctgggcctggtggccaagggcagcttcggcaccgtgctgaaggtgctggactgcacccagaaggccgtgttcgccgtgaaggtggtgcccaaggtgaaggtgctgcagagagacaccgtgagacagtgcaaggaggaggtgagcatccagagacagatcaaccaccccttcgtgcacagcctgggcgacagctggcagggcaagagacacctgttcatcatgtgcagctactgcagcaccgacctgtacagcctgtggagcgccgtgggctgcttccccgaggccagcatcagactgttcgccgccgagctggtgctggtgctgtgctacctgcacgacctgggcatcatgcacagagacgtgaagatggagaacatcctgctggacgagagaggccacctgaagctgaccgacttcggcctgagcagacacgtgccccagggcgcccaggcctacaccatctgcggcaccctgcagtacatggcccccgaggtgctgagcggcggcccctacaaccacgccgccgactggtggagcctgggcgtgctgctgttcagcctggccaccggcaagttccccgtggccgccgagagagaccacgtggccatgctggccagcgtgacccacagcgacagcgagatccccgccagcctgaaccagggcctgagcctgctgctgcacgagctgctgtgccagaaccccctgcacagactgagatacctgcaccacttccaggtgcaccccttcttcagaggcgtggccttcgaccccgagctgctgcagaagcagcccgtgaacttcgtgaccgagacccaggccacccagcccagcagcgccgagaccatgcccttcgacgacttcgactgcgacctggagagcttcctgctgtaccccatccccgcctag

SEQ ID NO: 25908 - DNA, 447 bp, Artificial Sequence
  Description of Artificial Sequence: Synthetic coding sequence
atgggcgccgtgagctgcagacagggccagcacacccagcagggcgagcacaccagagtggccgtgccccacaagcagggcggcaacatcagaggcccctgggccagaggctggaagagcctgtggaccggcctgggcaccatcagaagcgacctggaggagctgtgggagctgagaggccaccactacctgcaccaggagagcctgaagcccgcccccgtgctggtggagaagcccctgcccgagtggcccgtgccccagttcatcaacctgttcctgcccgagttccccatcagacccatcagaggccagcagcagctgaagatcctgggcctggtggccaagggcagcttcggcaccgtgctgaaggtgctggactgcacccagaaggccgtgttcgccgtgaaggtggtgcccaaggtgaaggtgctgcagggcatcccctag

SEQ ID NO: 25909 - DNA, 516 bp, Artificial Sequence
  Description of Artificial Sequence: Synthetic coding sequence
atgggcgccgtgagctgcagacagggccagcacacccagcagggcgagcacaccagagtggccgtgccccacaagcagggcggcaacatcagaggcccctgggccagaggctggaagagcctgtggaccggcctgggcaccatcagaagcgacctggaggagctgtgggagctgagaggccaccactacctgcaccaggagagcctgaagcccgcccccgtgctggtggagaagcccctgcccgagtggcccgtgccccagttcatcaacctgttcctgcccgagttccccatcagacccatcagaggccagcagcagctgaagatcctgggcctggtggccaagggcagcttcggcaccgtgctgaaggtgctggactgcacccagaaggccgtgttcgccgtgaaggtggtgcccaaggtgaaggtgctgcagagagacaccgtgagacagtgcaaggaggaggtgagcatccaggtgatcagcatgacctgggccagctgcatcgagatgtag

SEQ ID NO: 25910 - DNA, 516 bp, Artificial Sequence; identical to SEQ ID NO: 25909
  Description of Artificial Sequence: Synthetic coding sequence

SEQ ID NO: 25911 - DNA, 441 bp, Artificial Sequence
  Description of Artificial Sequence: Synthetic coding sequence
atggccgccagcagactggagctgaacctggtgagactgctgagcagatgcgaggccatggccgccgagaagagagaccccgacgagtggagactggagaagtacgtgggcgccctggaggacatgctgcaggccctgaaggtgcacgccagcaagcccgccagcgaggtgatcaacgagtacagctggaaggtggacttcctgaagggcatgctgcaggccgagaagctgaccagcagcagcgagaaggccctggccaaccagttcctggcccccggcagagtgcccaccaccgccagagagagagtgcccgccaccaagaccgtgcacctgcagagcagagccagatacaccagcgagatgagaagcgagctgctgggcaccgccgaggccgagcccgagatggacgtgagaaagagaaccccctgccacacccactag

SEQ ID NO: 25912 - DNA, 780 bp, Artificial Sequence
  Description of Artificial Sequence: Synthetic coding sequence
atggccgccagcagactggagctgaacctggtgagactgctgagcagatgcgaggccatggccgccgagaagagagaccccgacgagtggagactggagaagtacgtgggcgccctggaggacatgctgcaggccctgaaggtgcacgccagcaagcccgccagcgaggtgatcaacgagtacagctggaaggtggacttcctgaagggcatgctgcaggccgagaagctgaccagcagcagcgagaaggccctggccaaccagttcctggcccccggcagagtgcccaccaccgccagagagagagtgcccgccaccaagaccgtgcacctgcagagcagagccagatacaccagcgagatgagaagcgagctgctgggcaccgccgaggccgagcccgagatggacgtgagaaagagaaccggcgtggccggcagccagcccgtgagcgagaagcagctggccgccgagctggacctggtgctgcagagacaccagaacctgcaggagaagctggccgaggagatgctgggcctggccagaagcctgaagaccaacaccctggccgcccagagcgtgatcaagaaggacaaccagaccctgagccacagcctgaagatggccgaccagaacctggagaagctgaagaccgagagcgagagactggagcagcacacccagaagagcgtgaactggctgctgtgggccatgctgatcatcgtgtgcttcatcttcatcagcatgatcctgttcatcagaatcatgcccaagctgaagtag

SEQ ID NO: 25913 - DNA, 2661 bp, Artificial Sequence
  Description of Artificial Sequence: Synthetic coding sequence
atgagacccgactgcaacagccagaagcccagccaggccctgagcatcagagacaccagcagcaaggacccctggcccgacatcgagccccagctgcccgccacccccgccgccgtgtggggcgtgttcaccttcagctggagaggcgccggcgccctgggccccagaagaggccccagaagactgaacaacaagagaggcgccgccaagagacaggaggacaagaccatgagcaagggccccggccccggcggcagcgccgccagcagcgccccccccgccgccaccgcccaggtgctgcaggcccagcccgagaagccccagcactacacctacctgaaggagttcagaaccgagcagtgccccctgttcgtgcagcacaagtgcacccagcacagaccctacacctgcttccactggcacttcgtgaaccagagaagaagaagaagcatcagaagaagagacggcaccttcaactacagccccgacgtgtactgcaccaagtacgacgaggccaccggcctgtgccccgagggcgacgagtgccccttcctgcacagaaccaccggcgacaccgagagaagataccacctgagatactacaagaccggcatctgcatccacgagaccgacagcaagggcaactgcaccaagaacggcctgcactgcgccttcgcccacggcccccacgacctgagaagccccgtgtacgacatcagagagctgcaggccatggaggccctgcagaacggccagaccaccgtggagggcagcatcgagggccagagcgccggcgccgccagccacgccatgatcgagaagatcctgagcgaggagcccagatggcaggagaccgcctacgtgctgggcaactacaagaccgagccctgcaagaagccccccagactgtgcagacagggctacgcctgcccctactaccacaacagcaaggacagaagaagaagccccagaaagcacaagtacagaagcagcccctgccccaacgtgaagcacggcgacgagtggggcgaccccggcaagtgcgagaacggcgacgcctgccagtactgccacaccagaaccgagcagcagttccaccccgagatctacaagagcaccaagtgcaacgacatgcagcagagcggcagctgccccagaggccccttctgcgccttcgcccacgtggagcagccccccctgagcgacgacctgcagcccagcagcgccgtgagcagccccacccagcccggccccgtgctgtacatgcccagcgccgccggcgacagcgtgcccgtgagccccagcagcccccacgcccccgacctgagcgccctgctgtgcagaaacagcagcctgggcagccccagcaacctgtgcggcagcccccccggcagcatcagaaagccccccaacctggagggcatcgtgttccccggcgagagcggcctggcccccggcagctacaagaaggcccccggcttcgagagagaggaccaggtgggcgccgagtacctgaagaacttcaagtgccaggccaagctgaagccccacagcctggagcccagaagccaggagcagcccctgctgcagcccaagcaggacatgctgggcatcctgcccgccggcagccccctgaccagcagcatcagcagcagcatcaccagcagcctggccgccaccccccccagccccgtgggcaccagcagcgtgcccggcatgaacgccaacgccctgcccttctaccccaccagcgacaccgtggagagcgtgatcgagagcgccctggacgacctggacctgaacgagttcggcgtggccgccctggagaagaccttcgacaacagcaccgtgccccaccccggcagcatcaccatcggcggcagcctgctgcagagcagcgcccccgtgaacatccccggcagcctgggcagcagcgccagcttccacagcgccagccccagcccccccgtgagcctgagcagccacttcctgcagcagccccagggccacctgagccagagcgagaacaccttcctgggcaccagcgccagccacggcagcctgggcctgaacggcatgaacagcagcatctgggagcacttcgccagcggcagcttcagccccggcaccagccccgccttcctgagcggccccggcgccgccgagctggccagactgagacaggagctggacgaggccaacagcaccatcaagcagtgggaggagagctggaagcaggccaagcaggcctgcgacgcctggaagaaggaggccgaggaggccggcgagagagccagcgccgccggcgccgagtgcgagctggccagagagcagagagacgccctggaggtgcaggtgaagaagctgcaggaggagctggagagactgcacgccggccccgagccccaggccctgcccgccttcagcgacctggaggccctgagcctgagcaccctgtacagcctgcagaagcagctgagagcccacctggagcaggtggacaaggccgtgttccacatgcagagcgtgaagtgcctgaagtgccaggagcagaagagagccgtgctgccctgccagcacgccgccctgtgcgagctgtgcgccgagggcagcgagtgccccatctgccagcccggcagagcccacaccctgcagagctag

SEQ ID NO: 25914 - DNA, 510 bp, Artificial Sequence
  Description of Artificial Sequence: Synthetic coding sequence
atggtgagcagcaagggcctgtggaaggagagacccagcgcccacaccagcgagtgcttcagcaccaccgcctgccccgtggccttcatcctgctggtgtggaacagccagacccccgccggcctgcagagcctgtgcaccggcagacaccccagcctgagcgccagagcccagagagccggccccagagccagcagagaggagggcaccttctggaccgagagagtgggccaggagagatggctgatcagaagcggcagcagccagaacgagagccaggaggaccagggcgccggcctgatcagccaggccggcctgaaggccgacaacagaagagagagcagcacctgggccaacgaggtggaggacagaagaccccagtgcacccccgccctgaacctgacccccagccacccccaccccccccacagcctgaccaccttcctgagaagcgtgatcggcatccagatcccccccggcctggtggccgccggcggcaccgtggcctag

SEQ ID NO: 25915 - DNA, 510 bp, Artificial Sequence
  Description of Artificial Sequence: Synthetic coding sequence
atgggcagcagcaagggcctgtggaaggagaagcccagcgcccacaccagcgagtgcttcagcaccaccgcctgccccgtggcctgcatcctgctggtgtggaacagccagacccccgccggcctgcagagcctgtgcaccggcagacaccccagcctgagcgccagagcccagtgggccggccccagagccagcagagaggagggcaccttctggaccgagcccgtgggccaggagagaagactgatcagaagcggcagcagccagaacgagagccaggaggaccagggcgccgacctgatcagccacgagggcctgaaggccgacaaccagagagagagcagcacctgggccaacgaggtggaggacagaagaccccagtgcaccagcgccctgaacctgacccccagccacctgcaccccccccaccccctgaccaccttcttcagaaacgtgatcggcatcaagatcccccccggcctggtggccatgggcggcaccgtggcctag

SEQ ID NO: 25916 - DNA, 972 bp, Artificial Sequence
  Description of Artificial Sequence: Synthetic coding sequence
atgaagaacgtggacagcgacgacctggtgaccggcaccctgcccaagctgaagagcagcaaggagtggctggagcccaagcccctgtgcttcatggaggtgctggccaaggaggacaccgaggccgccatccagagcatcctgtacaaggagaacagcgtgatcaaggagctggacaagtacctgcagcaccacgccttcctgaacgccagaagaaaggagatgctgtacaagagatgggtggactgcgtggccgaccccctgcagaagaagatcatcgagaaggtgtgcagccacaagaagatcaagaagagaagacagggcgagctggacggcttcctgaagcacgtgaacaagaagggcaacgccttcatcgagcactacgaccccaaggagtacgaccccttctacatgagcaagaaggaccccaacttcctgaaggtgaccatcccccccttccacgaccccctgaagaaggcccagtacgacaaggacaacgagaagagaaccctgctgcagtgcgagaccggcaagatctacagcatcaaggagttcaaggaggtggagaaggtgcagctgcacagcagattcccccagatcagcaacagcagacacttcatcacccccaacgagtggctgaagctgcccaccagatacatcgagagcgagttctgcagaagaagaagactgaaggtgaaggtgaacttcaacgactgcagcttcgacctgaagcccctggccagagccccctacctgctggagagccaggaggaggagaagaccgtgatctacaagaacaagggcagcagcttcctggagagagagcccctgtgctaccaggagggcaacaaccccagcgccaaggaggccatcagcgagggctacttcagcagcctgagcctgcaggagagagaggaggaccaggacggcagccccagccccagactgggcctgctgaagctggagctgtag

SEQ ID NO: 25917 - DNA, 2592 bp, Artificial Sequence
  Description of Artificial Sequence: Synthetic coding sequence
atgctggagagctacgtgacccccatcctgatgagctacgtgaacagatacatcaagaacctgaagcccagcgacctgcagctgagcctgtggggcggcgacgtggtgctgagcaagctggagctgaagctggacgtgctggagcaggagctgaagctgcccttcaccttcctgagcggccacatccacgagctgagaatccacgtgccctggaccaagctgggcagcgagcccgtggtgatcaccatcaacaccatggagtgcatcctgaagctgaaggacggcatccaggacgaccacgagagctgcggcagcaacagcaccaacagaagcaccgccgagagcaccaagagcagcatcaagcccagaagaatgcagcaggccgcccccaccgaccccgacctgccccccggctacgtgcagagcctgatcagaagagtggtgaacaacgtgaacatcgtgatcaacaacctgatcctgaagtacgtggaggacgacatcgtgctgagcgtgaacatcaccagcgccgagtgctacaccgtgggcgagctgtgggacagagccttcatggacatcagcgccaccgacctggtgctgagaaaggtgatcaacttcagcgactgcaccgtgtgcctggacaagagaaacgccagcggcaagatcgagttctaccaggaccccctgctgtacaagtgcagcttcagaaccagactgcacttcacctacgagaacctgaacagcaagatgcccagcgtgatcaagatccacaccctggtggagagcctgaagctgagcatcaccgaccagcagctgcccatgttcatcagaatcatgcagctgggcatcgccctgtactacggcgagatcggcaacttcaaggagggcgagatcgaggacctgacctgccacaacaaggacatgctgggcaacatcaccggcagcgaggacgagaccagaatcgacatgcagtaccccgcccagcacaagggccaggagctgtacagccagcaggacgaggagcagccccagggctgggtgagctgggcctggagcttcgtgcccgccatcgtgagctacgacgacggcgaggaggacttcgtgggcaacgaccccgccagcaccatgcaccagcagaaggcccagaccctgaaggaccccatcgtgagcatcggcttctactgcaccaaggccaccgtgaccttcaagctgaccgagatgcaggtggagagcagctactacagcccccagaaggtgaagagcaaggaggtgctgtgctgggagcaggagggcaccaccgtggaggccctgatgatgggcgagcccttcttcgactgccagatcggcttcgtgggctgcagagccatgtgcctgaagggcatcatgggcgtgaaggacttcgaggagaacatgaacagaagcgagaccgaggcctgcttcttcatctgcggcgacaacctgagcaccaagggcttcacctacctgaccaacagcctgttcgactacagaagccccgagaacaacggcaccagagccgagttcatcctggacagcacccaccacaaggagacctacaccgagatcgccggcatgcagagattcggcgccttctacatggactacctgtacaccatggagaacaccagcggcaagggcagcaccaaccagcaggacttcagcagcggcaagagcgaggacctgggcaccgtgcaggagaagagcaccaagagcctggtgatcggccccctggacttcagactggacagcagcgccgtgcacagaatcctgaagatgatcgtgtgcgccctggagcacgagtacgagccctacagcagactgaagagcgacatcaaggacgagaacgagaccatcctgaaccccgaggaggtggccctgctggaggagtacatccccaccagacacaccagcgtgaccctgctgaagtgcacctgcaccatcagcatggccgagttcaacctgctggaccacctgctgcccgtgatcatgggcgagaagaacagcagcaacttcatgaacaccaccaacttccagagcctgagacccctgcccagcatcagaatcctggtggacaagatcaacctggagcacagcgtgcccatgtacgccgagcagctggtgcacgtggtgagcagcctgacccagcccagcgacaacctgctgcactactgctacgtgcactgctacctgaagatcttcggcttccaggccggcctgaccagcctggactgcagcggcagctactgcctgcccgtgcccgtgatccccagcttcagcaccgccctgtacggcaagctgctgaagctgcccacctgctggaccaagagaagccagatcgccatcaccgagggcatcttcgagctgcccaacctgaccatccaggccaccagagcccagaccctgctgctgcaggccatctaccagagctggagccacctgggcaacgtgagcagcagcgccgtgatcgaggccctgatcaacgagatcttcctgagcatcgagatcggcagctgctacgtggcccaggtggacctggagctgctggccagcaacgacccccccaccagcaccagctag

SEQ ID NO: 25918 - DNA, 11994 bp, Artificial Sequence
  Description of Artificial Sequence: Synthetic coding sequence
atgctggagagctacgtgacccccatcctgatgagctacgtgaacagatacatcaagaacctgaagcccagcgacctgcagctgagcctgtggggcggcgacgtggtgctgagcaagctggagctgaagctggacgtgctggagcaggagctgaagctgcccttcaccttcctgagcggccacatccacgagctgagaatccacgtgccctggaccaagctgggcagcgagcccgtggtgatcaccatcaacaccatggagtgcatcctgaagctgaaggacggcatccaggacgaccacgagagctgcggcagcaacagcaccaacagaagcaccgccgagagcaccaagagcagcatcaagcccagaagaatgcagcaggccgcccccaccgaccccgacctgccccccggctacgtgcagagcctgatcagaagagtggtgaacaacgtgaacatcgtgatcaacaacctgatcctgaagtacgtggaggacgacatcgtgctgagcgtgaacatcaccagcgccgagtgctacaccgtgggcgagctgtgggacagagccttcatggacatcagcgccaccgacctggtgctgagaaaggtgatcaacttcagcgactgcaccgtgtgcctggacaagagaaacgccagcggcaagatcgagttctaccaggaccccctgctgtacaagtgcagcttcagaaccagactgcacttcacctacgagaacctgaacagcaagatgcccagcgtgatcaagatccacaccctggtggagagcctgaagctgagcatcaccgaccagcagctgcccatgttcatcagaatcatgcagctgggcatcgccctgtactacggcgagatcggcaacttcaaggagggcgagatcgaggacctgacctgccacaacaaggacatgctgggcaacatcaccggcagcgaggacgagaccagaatcgacatgcagtaccccgcccagcacaagggccaggagctgtacagccagcaggacgaggagcagccccagggctgggtgagctgggcctggagcttcgtgcccgccatcgtgagctacgacgacggcgaggaggacttcgtgggcaacgaccccgccagcaccatgcaccagcagaaggcccagaccctgaaggaccccatcgtgagcatcggcttctactgcaccaaggccaccgtgaccttcaagctgaccgagatgcaggtggagagcagctactacagcccccagaaggtgaagagcaaggaggtgctgtgctgggagcaggagggcaccaccgtggaggccctgatgatgggcgagcccttcttcgactgccagatcggcttcgtgggctgcagagccatgtgcctgaagggcatcatgggcgtgaaggacttcgaggagaacatgaacagaagcgagaccgaggcctgcttcttcatctgcggcgacaacctgagcaccaagggcttcacctacctgaccaacagcctgttcgactacagaagccccgagaacaacggcaccagagccgagttcatcctggacagcacccaccacaaggagacctacaccgagatcgccggcatgcagagattcggcgccttctacatggactacctgtacaccatggagaacaccagcggcaagggcagcaccaaccagcaggacttcagcagcggcaagagcgaggacctgggcaccgtgcaggagaagagcaccaagagcctggtgatcggccccctggacttcagactggacagcagcgccgtgcacagaatcctgaagatgatcgtgtgcgccctggagcacgagtacgagccctacagcagactgaagagcgacatcaaggacgagaacgagaccatcctgaaccccgaggaggtggccctgctggaggagtacatccccaccagacacaccagcgtgaccctgctgaagtgcacctgcaccatcagcatggccgagttcaacctgctggaccacctgctgcccgtgatcatgggcgagaagaacagcagcaacttcatgaacaccaccaacttccagagcctgagacccctgcccagcatcagaatcctggtggacaagatcaacctggagcacagcgtgcccatgtacgccgagcagctggtgcacgtggtgagcagcctgacccagcccagcgacaacctgctgcactactgctacgtgcactgctacctgaagatcttcggcttccaggccggcctgaccagcctggactgcagcggcagctactgcctgcccgtgcccgtgatccccagcttcagcaccgccctgtacggcaagctgctgaagctgcccacctgctggaccaagagaagccagatcgccatcaccgagggcatcttcgagctgcccaacctgaccatccaggccaccagagcccagaccctgctgctgcaggccatctaccagagctggagccacctgggcaacgtgagcagcagcgccgtgatcgaggccctgatcaacgagatcttcctgagcatcggcgtgaagagcaagaaccccctgcccaccctggagggcagcatccagaacgtggagctgaagtactgcagcaccagcctggtgaagtgcgccagcggcaccatgggcagcatcaagatctgcgccaaggcccccgtggacagcggcaaggagaagctgatccccctgctgcagggccccagcgacaccaaggacctgcacagcaccaagtggctgaacgagagcagaaagcccgagagcctgctggcccccgacctgatggccttcaccatccaggtgccccagtacatcgactactgccacaacagcggcgccgtgctgctgtgcagcatccagggcctggccgtgaacatcgaccccatcctgtacacctggctgatctaccagccccagaagagaaccagcagacacatgcagcagcagcccgtggtggccgtgcccctggtgatgcccgtgtgcagaagaaaggaggacgaggtgagcatcggcagcgcccccctggccaagcagcagagctaccaggccagcgagtacgccagcagccccgtgaagaccaagaccgtgaccgagagcagacccctgagcgtgcccgtgaaggccatgctgaacatcagcgagagctgcagaagccccgaggagagaatgaaggagttcatcggcatcgtgtggaacgccgtgaagcacctgaccctgcagctggaggtgcagagctgctgcgtgttcatccccaacgacagcctgcccagccccagcaccatcgtgagcggcgacatccccggcaccgtgagaagctggtaccacggccagaccagcatgcccggcaccctggtgctgtgcctgccccagatcaagatcatcagcgccggccacaagtacatggagcccctgcaggagatccccttcgtgatccccagacccatcctggaggagggcgacgccttcccctggaccatcagcctgcacaacttcagcatctacaccctgctgggcaagcaggtgaccctgtgcctggtggagcccatgggctgcaccagcaccctggccgtgaccagccagaagctgctggccaccggccccgacaccagacacagcttcgtggtgtgcctgcacgtggacctggagagcctggagatcaagtgcagcaacccccaggtgcagctgttctacgagctgaccgacatcatgaacaaggtgtggaacaagatccagaagagaggcaacctgaacctgagccccaccagccccgagaccatggccggccccgtgcccaccagccccgtgagaagcagcatcggcaccgccccccccgacaccagcacctgcagccccagcgccgacatcggcaccaccaccgagggcgacagcatccaggccggcgaggagagccccttcagcgacagcgtgaccctggagcagaccaccagcaacatcggcggcaccagcggcagagtgagcctgtggatgcagtgggtgctgcccaagatcaccatcaagctgttcgcccccgaccccgagaacaagggcaccgaggtgtgcatggtgagcgagctggaggacctgagcgccagcatcgacgtgcaggacgtgtacaccaaggtgaagtgcaagatcgagagcttcaacatcgaccactacagaagcagacccggcgagggctggcagagcggccacttcgagggcgtgttcctgcagtgcaaggagaagagcgtgaccaccaccaagctgctggacggcacccaccagcagcacggcttcctgagcctgacctacaccaaggccgtgaccaagaacgtgagacacaagctgaccagcagaaacgagagaagaagcttccacaagctgagcgagggcctgatggacggcagcccccacttcctgcacgagatcctgctgagcgcccaggccttcgacatcgtgctgtacttccccctgctgaacgccatcgccagcatcttccaggccaagctgcccaagacccagaaggagaagagaaagagccccggccagcccatgagaacccacaccctgaccagcagaaacctgcccctgatctacgtgaacaccagcgtgatcagaatcttcatccccaagaccgaggagatgcagcccaccgtggaggccaaccaggccgccaaggaggacaccgtggtgctgaagatcggcagcgtggccatggccccccaggccgacaaccccctgggcagaagcgtgctgagaaaggacatctaccagagagccctgaacctgggcatcctgagagaccccggcagcgagatcgaggacagacagtaccagatcgacctgcagagcatcaacatcggcaccgcccagtggcaccagctgaagcccgagaaggagagcgtgagcggcggcgtggtgaccgagaccgagagaaacagccagaaccccgccctggagtggaacatggccagcagcatcagaagacaccaggagagaagagccatcctgacccccgtgctgaccgacttcagcgtgagaatcaccggcgcccccgccgtgatcttcaccaaggtggtgagccccgagaacctgcacaccgaggagatcctggtgtgcggccacagcctggaggtgaacatcaccaccaacctggacttcttcctgagcgtggcccaggtgcagctgctgcaccagctgatcgtggccaacatgaccggcctggagcccagcaacaaggccgccgagatcagcaagcaggagcagaagaaggtggacatcttcgacggcggcatggccgagaccagcagcagatacagcggcgcccaggacagcggcatcggcagcgacagcgtgaagatcagaatcgtgcagatcgagcagcacagcggcgccagccagcacagaatcgccagacccagcagacagagcagcatcgtgaagaacctgaacttcatccccttcgacatcttcatcaccgccagcagaatcagcctgatgacctacagctgcatggccctgagcaagagcaagagccaggagcagaagaacaacgagaagaccgacaagagcagcctgaacctgcccgaggtggacagcgacgtggccaagcccaaccaggcctgcatcagcaccgtgaccgccgaggacctgctgagaagcagcatcagcttccccagcggcaagaagatcggcgtgctgagcctggagagcctgcacgccagcaccagaagcagcgccagacaggccctgggcatcaccatcgtgagacagcccggcagaagaggcaccggcgacctgcagctggagcccttcctgtacttcatcgtgagccagcccagcctgctgctgagctgccaccacagaaagcagagagtggaggtgagcatcttcgacgccgtgctgaagggcgtggccagcgactacaagtgcatcgaccccggcaagaccctgcccgaggccctggactactgcaccgtgtggctgcagaccgtgcccggcgagatcgacagcaagagcggcatcccccccagcttcatcaccctgcagatcaaggacttcctgaacggccccgccgacgtgaacctggacatcagcaagcccctgaaggccaacctgagcttcaccaagctggaccagatcaacctgttcctgaagaagatcaagaacgcccacagcctggcccacagcgaggagaccagcgccatgagcaacaccatggtgaacaaggacgacctgcccgtgagcaagtactacagaggcaagctgagcaagcccaagatccacggcgacggcgtgcagaagatcagcgcccaggagaacatgtggagagccgtgagctgcttccagaagatcagcgtgcagaccacccagatcgtgatcagcatggagaccgtgccccacaccagcaagccctgcctgctggccagcctgagcaacctgaacggcagcctgagcgtgaaggccacccagaaggtgcccggcatcatcctgggcagcagcttcctgctgagcatcaacgacttcctgctgaagaccagcctgaaggagagaagcagaatcctgatcggcccctgctgcgccaccgccaacctggaggccaagtggtgcaagcacagcggcaaccccggccccgagcagagcatccccaagatcagcatcgacctgagaggcggcctgctgcaggtgttctggggccaggagcacctgaactgcctggtgctgctgcacgagctgctgaacggctacctgaacgaggagggcaacttcgaggtgcaggtgagcgagcccgtgccccagatgagcagccccgtggagaagaaccagaccttcaagagcgagcagagcagcgacgacctgagaaccggcctgttccagtacgtgcaggacgccgagagcctgaagctgcccggcgtgtacgaggtgctgttctacaacgagaccgaggactgccccggcatgatgctgtggagataccccgagcccagagtgctgaccctggtgagaatcacccccgtgcccttcaacaccaccgaggaccccgacatcagcaccgccgacctgggcgacgtgctgcaggtgccctgcagcctggagtactgggacgagctgcagaaggtgttcgtggccttcagagagttcaacctgagcgagagcaaggtgtgcgagctgcagctgcccgacatcaacctggtgaacgaccagaagaagctggtgagcagcgacctgtggagaatcgtgctgaacagcagccagaacggcgccgacgaccagagcagcgccagcgagagcggcagccagagcacctgcgaccccctggtgacccccaccgccctggccgcctgcaccagagtggacagctgcttcaccccctggttcgtgcccagcctgtgcgtgagcttccagttcgcccacctggagttccacctgtgccaccacctggaccagctgggcaccgccgccccccagtacctgcagcccttcgtgagcgacagaaacatgcccagcgagctggagtacatgatcgtgagcttcagagagccccacatgtacctgagacagtggaacaacggcagcgtgtgccaggagatccagttcctggcccaggccgactgcaagctgctggagtgcagaaacgtgaccatgcagagcgtggtgaagcccttcagcatcttcggccagatggccgtgagcagcgacgtggtggagaagctgctggactgcaccgtgatcgtggacagcgtgttcgtgaacctgggccagcacgtggtgcacagcctgaacaccgccatccaggcctggcagcagaacaagtgccccgaggtggaggagctggtgttcagccacttcgtgatctgcaacgacacccaggagaccctgagattcggccaggtggacaccgacgagaacatcctgctggccagcctgcacagccaccagtacagctggagaagccacaagagcccccagctgctgcacatctgcatcgagggctggggcaactggagatggagcgagcccttcagcgtggaccacgccggcaccttcatcagaaccatccagtacagaggcagaaccgccagcctgatcatcaaggtgcagcagctgaacggcgtgcagaagcagatcatcatctgcggcagacagatcatctgcagctacctgagccagagcatcgagctgaaggtggtgcagcactacatcggccaggacggccaggccgtggtgagagagcacttcgactgcctgaccgccaagcagaagctgcccagctacatcctggagaacaacgagctgaccgagctgtgcgtgaaggccaagggcgacgaggactggagcagagacgtgtgcctggagagcaaggcccccgagtacagcatcgtgatccaggtgcccagcagcaacagcagcatcatctacgtgtggtgcaccgtgctgaccctggagcccaacagccaggtgcagcagagaatgatcgtgttcagccccctgttcatcatgagaagccacctgcccgaccccatcatcatccacctggagaagagaagcctgggcctgagcgagacccagatcatccccggcaagggccaggagaagcccctgcagaacatcgagcccgacctggtgcaccacctgaccttccaggccagagaggagtacgaccccagcgactgcgccgtgcccatcagcaccagcctgatcaagcagatcgccaccaaggtgcaccccggcggcaccgtgaaccagatcctggacgagttctacggccccgagaagagcctgcagcccatctggccctacaacaagaaggacagcgacagaaacgagcagctgagccagtgggacagccccatgagagtgaagctgagcatctggaagccctacgtgagaaccctgctgatcgagctgctgccctgggccctgctgatcaacgagagcaagtgggacctgtggctgttcgagggcgagaagatcgtgctgcaggtgcccgccggcaagatcatcatcccccccaacttccaggaggccttccagatcggcatctactgggccaacaccaacaccgtgcacaagagcgtggccatcaagctggtgcacaacctgaccagccccaagtggaaggacggcggcaacggcgaggtggtgaccctggacgaggaggccttcgtggacaccgagatcagactgggcgccttccccggccaccagaagctgtgccagttctgcatcagcagcatggtgcagcagggcatccagatcatccagatcgaggacaagaccaccatcatcaacaacaccccctaccagatcttctacaagccccagctgagcgtgtgcaacccccacagcggcaaggagtacttcagagtgcccgacagcgccaccttcagcatctgccccggcggcgagcagcccgccatgaagagcagcagcctgccctgctgggacctgatgcccgacatcagccagagcgtgctggacgccagcctgctgcagaagcagatcatgctgggcttcagccccgcccccggcgccgacagcagccagtgctggagcctgcccgccatcgtgagacccgagttccccagacagagcgtggccgtgcccctgggcaacttcagagagaacggcttctgcaccagagccatcgtgctgacctaccaggagcacctgggcgtgacctacctgaccctgagcgaggaccccagccccagagtgatcatccacaacagatgccccgtgaagatgctgatcaaggagaacatcaaggacatccccaagttcgaggtgtactgcaagaagatccccagcgagtgcagcatccaccacgagctgtaccaccagatcagcagctaccccgactgcaagaccaaggacctgctgcccagcctgctgctgagagtggagcccctggacgaggtgaccaccgagtggagcgacgccatcgacatcaacagccagggcacccaggtggtgttcctgaccggcttcggctacgtgtacgtggacgtggtgcaccagtgcggcaccgtgttcatcaccgtggcccccgagggcaaggccggccccatcctgaccaacaccaacagagcccccgagaagatcgtgaccttcaagatgttcatcacccagctgagcctggccgtgttcgacgacctgacccaccacaaggccagcgccgagctgctgagactgaccctggacaacatcttcctgtgcgtggcccccggcgccggccccctgcccggcgaggagcccgtggccgccctgttcgagctgtactgcgtggagatctgctgcggcgacctgcagctggacaaccagctgtacaacaagagcaacttccacttcgccgtgctggtgtgccagggcgagaaggccgagcccatccagtgcagcaagatgcagagcctgctgatcagcaacaaggagctggaggagtacaaggagaagtgcttcatcaagctgtgcatcaccctgaacgagggcaagagcatcctgtgcgacatcaacgagttcagcttcgagctgaagcccgccagactgtacgtggaggacaccttcgtgtactacatcaagaccctgttcgacacctacctgcccaacagcagactggccggccacagcacccacctgagcggcggcaagcaggtgctgcccatgcaggtgacccagcacgccagagccctggtgaaccccgtgaagctgagaaagctggtgatccagcccgtgaacctgctggtgagcatccacgccagcctgaagctgtacatcgccagcgaccacacccccctgagcttcagcgtgttcgagagaggccccatcttcaccaccgccagacagctggtgcacgccctggccatgcactacgccgccggcgccctgttcagagccggctgggtggtgggcagcctggacatcctgggcagccccgccagcctggtgagaagcatcggcaacggcgtggccgacttcttcagactgccctacgagggcctgaccagaggccccggcgccttcgtgagcggcgtgagcagaggcaccaccagcttcgtgaagcacatcagcaagggcaccctgaccagcatcaccaacctggccaccagcctggccagaaacatggacagactgagcctggacgaggagcactacaacagacaggaggagtggagaagacagctgcccgagagcctgggcgagggcctgagacagggcctgagcagactgggcatcagcctgctgggcgccatcgccggcatcgtggaccagcccatgcagaacttccagaagaccagcgaggcccaggccagcgccggccacaaggccaagggcgtgatcagcggcgtgggcaagggcatcatgggcgtgttcaccaagcccatcggcggcgccgccgagctggtgagccagaccggctacggcatcctgcacggcgccggcctgagccagctgcccaagcagagacaccagcccagcgacctgcacgccgaccaggcccccaacagccacgtgaagtacgtgtggaagatgctgcagagcctgggcagacccgaggtgcacatggccctggacgtggtgctggtgagaggcagcggccaggagcacgagggctgcctgctgctgaccagcgaggtgctgttcgtggtgagcgtgagcgaggacacccagcagcaggccttccccgtgaccgagatcgactgcgcccaggacagcaagcagaacaacctgctgaccgtgcagctgaagcagcccagagtggcctgcgacgtggaggtggacggcgtgagagagagactgagcgagcagcagtacaacagactggtggactacatcaccaagaccagctgccacctggcccccagctgcagcagcatgcagatcccctgccccgtggtggccgccgagcccccccccagcaccgtgaagacctaccactacctggtggacccccacttcgcccaggtgttcctgagcaagttcaccatggtgaagaacaaggccctgagaaagggcttcccctag

SEQ ID NO: 25919 - DNA, 12069 bp, Artificial Sequence
  Description of Artificial Sequence: Synthetic coding sequence
atgctggagagctacgtgacccccatcctgatgagctacgtgaacagatacatcaagaacctgaagcccagcgacctgcagctgagcctgtggggcggcgacgtggtgctgagcaagctggagctgaagctggacgtgctggagcaggagctgaagctgcccttcaccttcctgagcggccacatccacgagctgagaatccacgtgccctggaccaagctgggcagcgagcccgtggtgatcaccatcaacaccatggagtgcatcctgaagctgaaggacggcatccaggacgaccacgagagctgcggcagcaacagcaccaacagaagcaccgccgagagcaccaagagcagcatcaagcccagaagaatgcagcaggccgcccccaccgaccccgacctgccccccggctacgtgcagagcctgatcagaagagtggtgaacaacgtgaacatcgtgatcaacaacctgatcctgaagtacgtggaggacgacatcgtgctgagcgtgaacatcaccagcgccgagtgctacaccgtgggcgagctgtgggacagagccttcatggacatcagcgccaccgacctggtgctgagaaaggtgatcaacttcagcgactgcaccgtgtgcctggacaagagaaacgccagcggcaagatcgagttctaccaggaccccctgctgtacaagtgcagcttcagaaccagactgcacttcacctacgagaacctgaacagcaagatgcccagcgtgatcaagatccacaccctggtggagagcctgaagctgagcatcaccgaccagcagctgcccatgttcatcagaatcatgcagctgggcatcgccctgtactacggcgagatcggcaacttcaaggagggcgagatcgaggacctgacctgccacaacaaggacatgctgggcaacatcaccggcagcgaggacgagaccagaatcgacatgcagtaccccgcccagcacaagggccaggagctgtacagccagcaggacgaggagcagccccagggctgggtgagctgggcctggagcttcgtgcccgccatcgtgagctacgacgacggcgaggaggacttcgtgggcaacgaccccgccagcaccatgcaccagcagaaggcccagaccctgaaggaccccatcgtgagcatcggcttctactgcaccaaggccaccgtgaccttcaagctgaccgagatgcaggtggagagcagctactacagcccccagaaggtgaagagcaaggaggtgctgtgctgggagcaggagggcaccaccgtggaggccctgatgatgggcgagcccttcttcgactgccagatcggcttcgtgggctgcagagccatgtgcctgaagggcatcatgggcgtgaaggacttcgaggagaacatgaacagaagcgagaccgaggcctgcttcttcatctgcggcgacaacctgagcaccaagggcttcacctacctgaccaacagcctgttcgactacagaagccccgagaacaacggcaccagagccgagttcatcctggacagcacccaccacaaggagacctacaccgagatcgccggcatgcagagattcggcgccttctacatggactacctgtacaccatggagaacaccagcggcaagggcagcaccaaccagcaggacttcagcagcggcaagagcgaggacctgggcaccgtgcaggagaagagcaccaagagcctggtgatcggccccctggacttcagactggacagcagcgccgtgcacagaatcctgaagatgatcgtgtgcgccctggagcacgagtacgagccctacagcagactgaagagcgacatcaaggacgagaacgagaccatcctgaaccccgaggaggtggccctgctggaggagtacatccccaccagacacaccagcgtgaccctgctgaagtgcacctgcaccatcagcatggccgagttcaacctgctggaccacctgctgcccgtgatcatgggcgagaagaacagcagcaacttcatgaacaccaccaacttccagagcctgagacccctgcccagcatcagaatcctggtggacaagatcaacctggagcacagcgtgcccatgtacgccgagcagctggtgcacgtggtgagcagcctgacccagcccagcgacaacctgctgcactactgctacgtgcactgctacctgaagatcttcggcttccaggccggcctgaccagcctggactgcagcggcagctactgcctgcccgtgcccgtgatccccagcttcagcaccgccctgtacggcaagctgctgaagctgcccacctgctggaccaagagaagccagatcgccatcaccgagggcatcttcgagctgcccaacctgaccatccaggccaccagagcccagaccctgctgctgcaggccatctaccagagctggagccacctgggcaacgtgagcagcagcgccgtgatcgaggccctgatcaacgagatcttcctgagcatcggcgtgaagagcaagaaccccctgcccaccctggagggcagcatccagaacgtggagctgaagtactgcagcaccagcctggtgaagtgcgccagcggcaccatgggcagcatcaagatctgcgccaaggcccccgtggacagcggcaaggagaagctgatccccctgctgcagggccccagcgacaccaaggacctgcacagcaccaagtggctgaacgagagcagaaagcccgagagcctgctggcccccgacctgatggccttcaccatccaggtgccccagtacatcgactactgccacaacagcggcgccgtgctgctgtgcagcatccagggcctggccgtgaacatcgaccccatcctgtacacctggctgatctaccagccccagaagagaaccagcagacacatgcagcagcagcccgtggtggccgtgcccctggtgatgcccgtgtgcagaagaaaggaggacgaggtgagcatcggcagcgcccccctggccaagcagcagagctaccaggccagcgagtacgccagcagccccgtgaagaccaagaccgtgaccgagagcagacccctgagcgtgcccgtgaaggccatgctgaacatcagcgagagctgcagaagccccgaggagagaatgaaggagttcatcggcatcgtgtggaacgccgtgaagcacctgaccctgcagctggaggtgcagagctgctgcgtgttcatccccaacgacagcctgcccagccccagcaccatcgtgagcggcgacatccccggcaccgtgagaagctggtaccacggccagaccagcatgcccggcaccctggtgctgtgcctgccccagatcaagatcatcagcgccggccacaagtacatggagcccctgcaggagatccccttcgtgatccccagacccatcctggaggagggcgacgccttcccctggaccatcagcctgcacaacttcagcatctacaccctgctgggcaagcaggtgaccctgtgcctggtggagcccatgggctgcaccagcaccctggccgtgaccagccagaagctgctggccaccggccccgacaccagacacagcttcgtggtgtgcctgcacgtggacctggagagcctggagatcaagtgcagcaacccccaggtgcagctgttctacgagctgaccgacatcatgaacaaggtgtggaacaagatccagaagagaggcaacctgaacctgagccccaccagccccgagaccatggccggccccgtgcccaccagccccgtgagaagcagcatcggcaccgccccccccgacaccagcacctgcagccccagcgccgacatcggcaccaccaccgagggcgacagcatccaggccggcgaggagagccccttcagcgacagcgtgaccctggagcagaccaccagcaacatcggcggcaccagcggcagagtgagcctgtggatgcagtgggtgctgcccaagatcaccatcaagctgttcgcccccgaccccgagaacaagggcaccgaggtgtgcatggtgagcgagctggaggacctgagcgccagcatcgacgtgcaggacgtgtacaccaaggtgaagtgcaagatcgagagcttcaacatcgaccactacagaagcagcctgggcgaggagtgctggagcctgggccagtgcggcggcgtgttcctgagctgcaccgacaagctgaacagaagaaccctgctggtgagacccatcagcaagcaggaccccttcagcaactgcagcggcttcttccccagcaccaccaccaagctgctggacggcacccaccagcagcacggcttcctgagcctgacctacaccaaggccgtgaccaagaacgtgagacacaagctgaccagcagaaacgagagaagaagcttccacaagctgagcgagggcctgatggacggcagcccccacttcctgcacgagatcctgctgagcgcccaggccttcgacatcgtgctgtacttccccctgctgaacgccatcgccagcatcttccaggccaagctgcccaagacccagaaggagaagagaaagagccccggccagcccatgagaacccacaccctgaccagcagaaacctgcccctgatctacgtgaacaccagcgtgatcagaatcttcatccccaagaccgaggagatgcagcccaccgtggaggccaaccaggccgccaaggaggacaccgtggtgctgaagatcggcagcgtggccatggccccccaggccgacaaccccctgggcagaagcgtgctgagaaaggacatctaccagagagccctgaacctgggcatcctgagagaccccggcagcgagatcgaggacagacagtaccagatcgacctgcagagcatcaacatcggcaccgcccagtggcaccagctgaagcccgagaaggagagcgtgagcggcggcgtggtgaccgagaccgagagaaacagccagaaccccgccctggagtggaacatggccagcagcatcagaagacaccaggagagaagagccatcctgacccccgtgctgaccgacttcagcgtgagaatcaccggcgcccccgccgtgatcttcaccaaggtggtgagccccgagaacctgcacaccgaggagatcctggtgtgcggccacagcctggaggtgaacatcaccaccaacctggacttcttcctgagcgtggcccaggtgcagctgctgcaccagctgatcgtggccaacatgaccggcctggagcccagcaacaaggccgccgagatcagcaagcaggagcagaagaaggtggacatcttcgacggcggcatggccgagaccagcagcagatacagcggcgcccaggacagcggcatcggcagcgacagcgtgaagatcagaatcgtgcagatcgagcagcacagcggcgccagccagcacagaatcgccagacccagcagacagagcagcatcgtgaagaacctgaacttcatccccttcgacatcttcatcaccgccagcagaatcagcctgatgacctacagctgcatggccctgagcaagagcaagagccaggagcagaagaacaacgagaagaccgacaagagcagcctgaacctgcccgaggtggacagcgacgtggccaagcccaaccaggcctgcatcagcaccgtgaccgccgaggacctgctgagaagcagcatcagcttccccagcggcaagaagatcggcgtgctgagcctggagagcctgcacgccagcaccagaagcagcgccagacaggccctgggcatcaccatcgtgagacagcccggcagaagaggcaccggcgacctgcagctggagcccttcctgtacttcatcgtgagccagcccagcctgctgctgagctgccaccacagaaagcagagagtggaggtgagcatcttcgacgccgtgctgaagggcgtggccagcgactacaagtgcatcgaccccggcaagaccctgcccgaggccctggactactgcaccgtgtggctgcagaccgtgcccggcgagatcgacagcaagagcggcatcccccccagcttcatcaccctgcagatcaaggacttcctgaacggccccgccgacgtgaacctggacatcagcaagcccctgaaggccaacctgagcttcaccaagctggaccagatcaacctgttcctgaagaagatcaagaacgcccacagcctggcccacagcgaggagaccagcgccatgagcaacaccatggtgaacaaggacgacctgcccgtgagcaagtactacagaggcaagctgagcaagcccaagatccacggcgacggcgtgcagaagatcagcgcccaggagaacatgtggagagccgtgagctgcttccagaagatcagcgtgcagaccacccagatcgtgatcagcatggagaccgtgccccacaccagcaagccctgcctgctggccagcctgagcaacctgaacggcagcctgagcgtgaaggccacccagaaggtgcccggcatcatcctgggcagcagcttcctgctgagcatcaacgacttcctgctgaagaccagcctgaaggagagaagcagaatcctgatcggcccctgctgcgccaccgccaacctggaggccaagtggtgcaagcacagcggcaaccccggccccgagcagagcatccccaagatcagcatcgacctgagaggcggcctgctgcaggtgttctggggccaggagcacctgaactgcctggtgctgctgcacgagctgctgaacggctacctgaacgaggagggcaacttcgaggtgcaggtgagcgagcccgtgccccagatgagcagccccgtggagaagaaccagaccttcaagagcgagcagagcagcgacgacctgagaaccggcctgttccagtacgtgcaggacgccgagagcctgaagctgcccggcgtgtacgaggtgctgttctacaacgagaccgaggactgccccggcatgatgctgtggagataccccgagcccagagtgctgaccctggtgagaatcacccccgtgcccttcaacaccaccgaggaccccgacatcagcaccgccgacctgggcgacgtgctgcaggtgccctgcagcctggagtactgggacgagctgcagaaggtgttcgtggccttcagagagttcaacctgagcgagagcaaggtgtgcgagctgcagctgcccgacatcaacctggtgaacgaccagaagaagctggtgagcagcgacctgtggagaatcgtgctgaacagcagccagaacggcgccgacgaccagagcagcgccagcgagagcggcagccagagcacctgcgaccccctggtgacccccaccgccctggccgcctgcaccagagtggacagctgcttcaccccctggttcgtgcccagcctgtgcgtgagcttccagttcgcccacctggagttccacctgtgccaccacctggaccagctgggcaccgccgccccccagtacctgcagcccttcgtgagcgacagaaacatgcccagcgagctggagtacatgatcgtgagcttcagagagccccacatgtacctgagacagtggaacaacggcagcgtgtgccaggagatccagttcctggcccaggccgactgcaagctgctggagtgcagaaacgtgaccatgcagagcgtggtgaagcccttcagcatcttcggccagatggccgtgagcagcgacgtggtggagaagctgctggactgcaccgtgatcgtggacagcgtgttcgtgaacctgggccagcacgtggtgcacagcctgaacaccgccatccaggcctggcagcagaacaagtgccccgaggtggaggagctggtgttcagccacttcgtgatctgcaacgacacccaggagaccctgagattcggccaggtggacaccgacgagaacatcctgctggccagcctgcacagccaccagtacagctggagaagccacaagagcccccagctgctgcacatctgcatcgagggctggggcaactggagatggagcgagcccttcagcgtggaccacgccggcaccttcatcagaaccatccagtacagaggcagaaccgccagcctgatcatcaaggtgcagcagctgaacggcgtgcagaagcagatcatcatctgcggcagacagatcatctgcagctacctgagccagagcatcgagctgaaggtggtgcagcactacatcggccaggacggccaggccgtggtgagagagcacttcgactgcctgaccgccaagcagaagctgcccagctacatcctggagaacaacgagctgaccgagctgtgcgtgaaggccaagggcgacgaggactggagcagagacgtgtgcctggagagcaaggcccccgagtacagcatcgtgatccaggtgcccagcagcaacagcagcatcatctacgtgtggtgcaccgtgctgaccctggagcccaacagccaggtgcagcagagaatgatcgtgttcagccccctgttcatcatgagaagccacctgcccgaccccatcatcatccacctggagaagagaagcctgggcctgagcgagacccagatcatccccggcaagggccaggagaagcccctgcagaacatcgagcccgacctggtgcaccacctgaccttccaggccagagaggagtacgaccccagcgactgcgccgtgcccatcagcaccagcctgatcaagcagatcgccaccaaggtgcaccccggcggcaccgtgaaccagatcctggacgagttctacggccccgagaagagcctgcagcccatctggccctacaacaagaaggacagcgacagaaacgagcagctgagccagtgggacagccccatgagagtgaagctgagcatctggaagccctacgtgagaaccctgctgatcgagctgctgccctgggccctgctgatcaacgagagcaagtgggacctgtggctgttcgagggcgagaagatcgtgctgcaggtgcccgccggcaagatcatcatcccccccaacttccaggaggccttccagatcggcatctactgggccaacaccaacaccgtgcacaagagcgtggccatcaagctggtgcacaacctgaccagccccaagtggaaggacggcggcaacggcgaggtggtgaccctggacgaggaggccttcgtggacaccgagatcagactgggcgccttccccggccaccagaagctgtgccagttctgcatcagcagcatggtgcagcagggcatccagatcatccagatcgaggacaagaccaccatcatcaacaacaccccctaccagatcttctacaagccccagctgagcgtgtgcaacccccacagcggcaaggagtacttcagagtgcccgacagcgccaccttcagcatctgccccggcggcgagcagcccgccatgaagagcagcagcctgccctgctgggacctgatgcccgacatcagccagagcgtgctggacgccagcctgctgcagaagcagatcatgctgggcttcagccccgcccccggcgccgacagcagccagtgctggagcctgcccgccatcgtgagacccgagttccccagacagagcgtggccgtgcccctgggcaacttcagagagaacggcttctgcaccagagccatcgtgctgacctaccaggagcacctgggcgtgacctacctgaccctgagcgaggaccccagccccagagtgatcatccacaacagatgccccgtgaagatgctgatcaaggagaacatcaaggacatccccaagttcgaggtgtactgcaagaagatccccagcgagtgcagcatccaccacgagctgtaccaccagatcagcagctaccccgactgcaagaccaaggacctgctgcccagcctgctgctgagagtggagcccctggacgaggtgaccaccgagtggagcgacgccatcgacatcaacagccagggcacccaggtggtgttcctgaccggcttcggctacgtgtacgtggacgtggtgcaccagtgcggcaccgtgttcatcaccgtggcccccgagggcaaggccggccccatcctgaccaacaccaacagagcccccgagaagatcgtgaccttcaagatgttcatcacccagctgagcctggccgtgttcgacgacctgacccaccacaaggccagcgccgagctgctgagactgaccctggacaacatcttcctgtgcgtggcccccggcgccggccccctgcccggcgaggagcccgtggccgccctgttcgagctgtactgcgtggagatctgctgcggcgacctgcagctggacaaccagctgtacaacaagagcaacttccacttcgccgtgctggtgtgccagggcgagaaggccgagcccatccagtgcagcaagatgcagagcctgctgatcagcaacaaggagctggaggagtacaaggagaagtgcttcatcaagctgtgcatcaccctgaacgagggcaagagcatcctgtgcgacatcaacgagttcagcttcgagctgaagcccgccagactgtacgtggaggacaccttcgtgtactacatcaagaccctgttcgacacctacctgcccaacagcagactggccggccacagcacccacctgagcggcggcaagcaggtgctgcccatgcaggtgacccagcacgccagagccctggtgaaccccgtgaagctgagaaagctggtgatccagcccgtgaacctgctggtgagcatccacgccagcctgaagctgtacatcgccagcgaccacacccccctgagcttcagcgtgttcgagagaggccccatcttcaccaccgccagacagctggtgcacgccctggccatgcactacgccgccggcgccctgttcagagccggctgggtggtgggcagcctggacatcctgggcagccccgccagcctggtgagaagcatcggcaacggcgtggccgacttcttcagactgccctacgagggcctgaccagaggccccggcgccttcgtgagcggcgtgagcagaggcaccaccagcttcgtgaagcacatcagcaagggcaccctgaccagcatcaccaacctggccaccagcctggccagaaacatggacagactgagcctggacgaggagcactacaacagacaggaggagtggagaagacagctgcccgagagcctgggcgagggcctgagacagggcctgagcagactgggcatcagcctgctgggcgccatcgccggcatcgtggaccagcccatgcagaacttccagaagaccagcgaggcccaggccagcgccggccacaaggccaagggcgtgatcagcggcgtgggcaagggcatcatgggcgtgttcaccaagcccatcggcggcgccgccgagctggtgagccagaccggctacggcatcctgcacggcgccggcctgagccagctgcccaagcagagacaccagcccagcgacctgcacgccgaccaggcccccaacagccacgtgaagtacgtgtggaagatgctgcagagcctgggcagacccgaggtgcacatggccctggacgtggtgctggtgagaggcagcggccaggagcacgagggctgcctgctgctgaccagcgaggtgctgttcgtggtgagcgtgagcgaggacacccagcagcaggccttccccgtgaccgagatcgactgcgcccaggacagcaagcagaacaacctgctgaccgtgcagctgaagcagcccagagtggcctgcgacgtggaggtggacggcgtgagagagagactgagcgagcagcagtacaacagactggtggactacatcaccaagaccagctgccacctggcccccagctgcagcagcatgcagatcccctgccccgtggtggccgccgagcccccccccagcaccgtgaagacctaccactacctggtggacccccacttcgcccaggtgttcctgagcaagttcaccatggtgaagaacaaggccctgagaaagggcttcccctag

SEQ ID NO: 25920 - DNA, 4284 bp, Artificial Sequence
  Description of Artificial Sequence: Synthetic coding sequence
atgctggagagctacgtgacccccatcctgatgagctacgtgaacagatacatcaagaacctgaagcccagcgacctgcagctgagcctgtggggcggcgacgtggtgctgagcaagctggagctgaagctggacgtgctggagcaggagctgaagctgcccttcaccttcctgagcggccacatccacgagctgagaatccacgtgccctggaccaagctgggcagcgagcccgtggtgatcaccatcaacaccatggagtgcatcctgaagctgaaggacggcatccaggacgaccacgagagctgcggcagcaacagcaccaacagaagcaccgccgagagcaccaagagcagcatcaagcccagaagaatgcagcaggccgcccccaccgaccccgacctgccccccggctacgtgcagagcctgatcagaagagtggtgaacaacgtgaacatcgtgatcaacaacctgatcctgaagtacgtggaggacgacatcgtgctgagcgtgaacatcaccagcgccgagtgctacaccgtgggcgagctgtgggacagagccttcatggacatcagcgccaccgacctggtgctgagaaaggtgatcaacttcagcgactgcaccgtgtgcctggacaagagaaacgccagcggcaagatcgagttctaccaggaccccctgctgtacaagtgcagcttcagaaccagactgcacttcacctacgagaacctgaacagcaagatgcccagcgtgatcaagatccacaccctggtggagagcctgaagctgagcatcaccgaccagcagctgcccatgttcatcagaatcatgcagctgggcatcgccctgtactacggcgagatcggcaacttcaaggagggcgagatcgaggacctgacctgccacaacaaggacatgctgggcaacatcaccggcagcgaggacgagaccagaatcgacatgcagtaccccgcccagcacaagggccaggagctgtacagccagcaggacgaggagcagccccagggctgggtgagctgggcctggagcttcgtgcccgccatcgtgagctacgacgacggcgaggaggacttcgtgggcaacgaccccgccagcaccatgcaccagcagaaggcccagaccctgaaggaccccatcgtgagcatcggcttctactgcaccaaggccaccgtgaccttcaagctgaccgagatgcaggtggagagcagctactacagcccccagaaggtgaagagcaaggaggtgctgtgctgggagcaggagggcaccaccgtggaggccctgatgatgggcgagcccttcttcgactgccagatcggcttcgtgggctgcagagccatgtgcctgaagggcatcatgggcgtgaaggacttcgaggagaacatgaacagaagcgagaccgaggcctgcttcttcatctgcggcgacaacctgagcaccaagggcttcacctacctgaccaacagcctgttcgactacagaagccccgagaacaacggcaccagagccgagttcatcctggacagcacccaccacaaggagacctacaccgagatcgccggcatgcagagattcggcgccttctacatggactacctgtacaccatggagaacaccagcggcaagggcagcaccaaccagcaggacttcagcagcggcaagagcgaggacctgggcaccgtgcaggagaagagcaccaagagcctggtgatcggccccctggacttcagactggacagcagcgccgtgcacagaatcctgaagatgatcgtgtgcgccctggagcacgagtacgagccctacagcagactgaagagcgacatcaaggacgagaacgagaccatcctgaaccccgaggaggtggccctgctggaggagtacatccccaccagacacaccagcgtgaccctgctgaagtgcacctgcaccatcagcatggccgagttcaacctgctggaccacctgctgcccgtgatcatgggcgagaagaacagcagcaacttcatgaacaccaccaacttccagagcctgagacccctgcccagcatcagaatcctggtggacaagatcaacctggagcacagcgtgcccatgtacgccgagcagctggtgcacgtggtgagcagcctgacccagcccagcgacaacctgctgcactactgctacgtgcactgctacctgaagatcttcggcttccaggccggcctgaccagcctggactgcagcggcagctactgcctgcccgtgcccgtgatccccagcttcagcaccgccctgtacggcaagctgctgaagctgcccacctgctggaccaagagaagccagatcgccatcaccgagggcatcttcgagctgcccaacctgaccatccaggccaccagagcccagaccctgctgctgcaggccatctaccagagctggagccacctgggcaacgtgagcagcagcgccgtgatcgaggccctgatcaacgagatcttcctgagcatcggcgtgaagagcaagaaccccctgcccaccctggagggcagcatccagaacgtggagctgaagtactgcagcaccagcctggtgaagtgcgccagcggcaccatgggcagcatcaagatctgcgccaaggcccccgtggacagcggcaaggagaagctgatccccctgctgcagggccccagcgacaccaaggacctgcacagcaccaagtggctgaacgagagcagaaagcccgagagcctgctggcccccgacctgatggccttcaccatccaggtgccccagtacatcgactactgccacaacagcggcgccgtgctgctgtgcagcatccagggcctggccgtgaacatcgaccccatcctgtacacctggctgatctaccagccccagaagagaaccagcagacacatgcagcagcagcccgtggtggccgtgcccctggtgatgcccgtgtgcagaagaaaggaggacgaggtgagcatcggcagcgcccccctggccaagcagcagagctaccaggccagcgagtacgccagcagccccgtgaagaccaagaccgtgaccgagagcagacccctgagcgtgcccgtgaaggccatgctgaacatcagcgagagctgcagaagccccgaggagagaatgaaggagttcatcggcatcgtgtggaacgccgtgaagcacctgaccctgcagctggaggtgcagagctgctgcgtgttcatccccaacgacagcctgcccagccccagcaccatcgtgagcggcgacatccccggcaccgtgagaagctggtaccacggccagaccagcatgcccggcaccctggtgctgtgcctgccccagatcaagatcatcagcgccggccacaagtacatggagcccctgcaggagatccccttcgtgatccccagacccatcctggaggagggcgacgccttcccctggaccatcagcctgcacaacttcagcatctacaccctgctgggcaagcaggtgaccctgtgcctggtggagcccatgggctgcaccagcaccctggccgtgaccagccagaagctgctggccaccggccccgacaccagacacagcttcgtggtgtgcctgcacgtggacctggagagcctggagatcaagtgcagcaacccccaggtgcagctgttctacgagctgaccgacatcatgaacaaggtgtggaacaagatccagaagagaggcaacctgaacctgagccccaccagccccgagaccatggccggccccgtgcccaccagccccgtgagaagcagcatcggcaccgccccccccgacaccagcacctgcagccccagcgccgacatcggcaccaccaccgagggcgacagcatccaggccggcgaggagagccccttcagcgacagcgtgaccctggagcagaccaccagcaacatcggcggcaccagcggcagagtgagcctgtggatgcagtgggtgctgcccaagatcaccatcaagctgttcgcccccgaccccgagaacaagggcaccgaggtgtgcatggtgagcgagctggaggacctgagcgccagcatcgacgtgcaggacgtgtacaccaaggtgaagtgcaagatcgagagcttcaacatcgaccactacagaagcagacccggcgagggctggcagagcggccacttcgagggcgtgttcctgcagtgcaaggagaagagcgtgccctggggcagagtgctggtgttcggcgccatgtggagatgcctgcccttcctgtactag

SEQ ID NO: 25921 - DNA, 1248 bp, Artificial Sequence
  Description of Artificial Sequence: Synthetic coding sequence
atgctggagagctacgtgacccccatcctgatgagctacgtgaacagatacatcaagaacctgaagcccagcgacctgcagctgagcctgtggggcggcgacgtggtgctgagcaagctggagctgaagctggacgtgctggagcaggagctgaagctgcccttcaccttcctgagcggccacatccacgagctgagaatccacgtgccctggaccaagctgggcagcgagcccgtggtgatcaccatcaacaccatggagtgcatcctgaagctgaaggacggcatccaggacgaccacgagagctgcggcagcaacagcaccaacagaagcaccgccgagagcaccaagagcagcatcaagcccagaagaatgcagcaggccgcccccaccgaccccgacctgccccccggctacgtgcagagcctgatcagaagagtggtgaacaacgtgaacatcgtgatcaacaacctgatcctgaagtacgtggaggacgacatcgtgctgagcgtgaacatcaccagcgccgagtgctacaccgtgggcgagctgtgggacagagccttcatggacatcagcgccaccgacctggtgctgagaaaggtgatcaacttcagcgactgcaccgtgtgcctggacaagagaaacgccagcggcaagatcgagttctaccaggaccccctgctgtacaagtgcagcttcagaaccagactgcacttcacctacgagaacctgaacagcaagatgcccagcgtgatcaagatccacaccctggtggagagcctgaagctgagcatcaccgaccagcagctgcccatgttcatcagaatcatgcagctgggcatcgccctgtactacggcgagatcggcaacttcaaggagggcgagatcgaggacctgacctgccacaacaaggacatgctgggcaacatcaccggcagcgaggacgagaccagaatcgacatgcagtaccccgcccagcacaagggccaggagctgtacagccagcaggacgaggagcagccccagggctgggtgagctgggcctggagcttcgtgcccgccatcgtgagctacgacgacggcgaggaggacttcgtgggcaacgaccccgccagcaccatgcaccagcagaaggcccagaccctgaaggaccccatcgtgagcatcggcttctactgcaccaaggccaccgtgaccttcaaggtgggcctgttcagctgctgcctgtacctgtaccagctgtag

SEQ ID NO: 25922 - DNA, 11133 bp, Artificial Sequence
  Description of Artificial Sequence: Synthetic coding sequence
atggtgctggagagcgtggtggccgacctgctgaacagattcctgggcgactacgtggagaacctgaacaagagccagctgaagctgggcatctggggcggcaacgtggccctggacaacctgcagatcaaggagaacgccctgagcgagctggacgtgcccttcaaggtgaaggccggccagatcgacaagctgaccctgaagatcccctggaagaacctgtacggcgaggccgtggtggccaccctggagggcctgtacctgctggtggtgcccggcgccagcatcaagtacgacgccgtgaaggaggagaagagcctgcaggacgtgaagcagaaggagctgagcagaatcgaggaggccctgcagaaggccgccgagaaggacaagcccaaggaggccaagaaggacaccttcgtggagaagctggccacccaggtgatcaagaacgtgcaggtgaagatcaccgacatccacatcaagtacgaggacgacgtgaccgaccccaagagacccctgagcttcggcgtgaccctgggcgagctgagcctgctgaccgccaacgagcactggaccccctgcatcctgaacgaggccgacaagatcatctacaagctgatcagactggacagcctgagcgcctactggaacgtgaactgcagcatgagctaccagagaagcagagagcagatcctggaccagctgaagaacgagatcctgaccagcggcaacatcccccccaactaccagtacatcttccagcccatcagcgccagcgccaagctgtacatgaacccctacgccgagagcgagctgaagacccccaagctggactgcaacatcgagatccagaacatcgccatcgagctgaccaagccccagtacctgagcatgatcgacctgctggagagcgtggactacatggtgagaaacgccccctacagaaagtacaagccctacctgcccctgcacaccaacggcagaagatggtggaagtacgccatcgacagcgtgctggaggtgcacatcagaagatacacccagatgtggagctggagcaacatcaagaagcacagacagctgctgaagagctacaagatcgcctacaagaacaagctgacccagagcaaggtgagcgaggagatccagaaggagatccaggacctggagaagaccctggacgtgttcaacatcatcctggccagacagcaggcccaggtggaggtgatcagaagcggccagaagctgagaaagaagagcgccgacaccggcgagaagagaggcggctggttcagcggcctgtggggcaagaaggagagcaagaagaaggacgaggagagcctgatccccgagaccatcgacgacctgatgacccccgaggagaaggacaagctgttcaccgccatcggctacagcgagagcacccacaacctgaccctgcccaagcagtacgtggcccacatcatgaccctgaagctggtgagcaccagcgtgaccatcagagagaacaagaacatccccgagatcctgaagatccagatcatcggcctgggcacccaggtgagccagagacccggcgcccaggccctgaaggtggaggccaagctggagcactggtacatcaccggcctgagacagcaggacatcgtgcccagcctggtggccagcatcggcgacaccaccagcagcctgctgaagatcaagttcgagaccaaccccgaggacagccccgccgaccagaccctgatcgtgcagagccagcccgtggaggtgatctacgacgccaagaccgtgaacgccgtggtggagttcttccagagcaacaagggcctggacctggagcagatcaccagcgccaccctgatgaagctggaggagatcaaggagagaaccgccaccggcctgacccacatcatcgagaccagaaaggtgctggacctgagaatcaacctgaagcccagctacctggtggtgccccagaccggcttccaccacgagaagagcgacctgctgatcctggacttcggcaccttccagctgaacagcaaggaccagggcctgcagaagaccaccaacagcagcctggaggagatcatggacaaggcctacgacaagttcgacgtggagatcaagaacgtgcagctgctgttcgccagagccgaggagacctggaagaagtgcagattccagcaccccagcaccatgcacatcctgcagcccatggacatccacgtggagctggccaaggccatggtggagaaggacatcagaatggccagattcaaggtgagcggcggcctgcccctgatgcacgtgagaatcagcgaccagaagatgaaggacgtgctgtacctgatgaacagcatccccctgccccagaagagcagcgcccagagccccgagagacaggtgagcagcatccccatcatcagcggcggcaccaagggcctgctgggcaccagcctgctgctggacaccgtggagagcgagagcgacgacgagtacttcgacgccgaggacggcgagccccagacctgcaagagcatgaagggcagcgagctgaagaaggccgccgaggtgcccaacgaggagctgatcaacctgctgctgaagttcgagatcaaggaggtgatcctggagttcaccaagcagcagaaggaggaggacaccatcctggtgttcaacgtgacccagctgggcaccgaggccaccatgagaaccttcgacctgaccgtggtgagctacctgaagaagatcagcctggactaccacgagatcgagggcagcaagagaaagcccctgcacctgatcagcagcagcgacaagcccggcctggacctgctgaaggtggagtacatcaaggccgacaagaacggccccagcttccagaccgccttcggcaagaccgagcagaccgtgaaggtggccttcagcagcctgaacctgctgctgcagacccaggccctggtggccagcatcaactacctgaccaccatcatccccagcgacgaccagagcatcagcgtggccaaggaggtgcagatcagcaccgagaagcagcagaagaacagcaccctgcccaaggccatcgtgagcagcagagacagcgacatcatcgacttcagactgttcgccaagctgaacgccttctgcgtgatcgtgtgcaacgagaagaacaacatcgccgagatcaagatccagggcctggacagcagcctgagcctgcagagcagaaagcagagcctgttcgccagactggagaacatcatcgtgaccgacgtggaccccaagaccgtgcacaagaaggccgtgagcatcatgggcaacgaggtgttcagattcaacctggacctgtaccccgacgccaccgagggcgacctgtacaccgacatgagcaaggtggacggcgtgctgagcctgaacgtgggctgcatccagatcgtgtacctgcacaagttcctgatgagcctgctgaacttcctgaacaacttccagaccgccaaggagagcctgagcgccgccaccgcccaggccgccgagagagccgccaccagcgtgaaggacctggcccagagaagcttcagagtgagcatcaacatcgacctgaaggcccccgtgatcgtgatcccccagagcagcatcagcaccaacgccgtggtggtggacctgggcctgatcagagtgcacaaccagttcagcctggtgagcgacgaggactacctgaacccccccgtgatcgacagaatggacgtgcagctgaccaagctgaccctgtacagaaccgtgatccagcccggcatctaccaccccgacatccagctgctgcaccccatcaacctggagttcctggtgaacagaaacctggccgccagctggtaccacaaggtgcccgtggtggagatcaagggccacctggacagcatgaacgtgagcctgaaccaggaggacctgaacctgctgttcagaatcctgaccgagaacctgtgcgagggcaccgaggacctggacaaggtgaagcccagagtgcaggagaccggcgagatcaaggagcccctggagatcagcatcagccaggacgtgcacgacagcaagaacaccctgaccaccggcgtggaggagatcagaagcgtggacatcatcaacatgctgctgaacttcgagatcaaggaggtggtggtgaccctgatgaagaagagcgagaagaagggcagacccctgcacgagctgaacgtgctgcagctgggcatggaggccaaggtgaagacctacgacatgaccgccaaggcctacctgaagaagatcagcatgcagtgcttcgacttcaccgacagcaagggcgagcccctgcacatcatcaacagcagcaacgtgaccgacgagcccctgctgaagatgctgctgaccaaggccgacagcgacggccccgagttcaagaccatccacgacagcaccaagcagagactgaaggtgagcttcgccagcctggacctggtgctgcacctggaggccctgctgagcttcatggacttcctgagcagcgccgcccccttcagcgagcccagcagcagcgagaaggagagcgagctgaagcccctggtgggcgagagcagaagcatcgccgtgaaggccgtgagcagcaacatcagccagaaggacgtgttcgacctgaagatcaccgccgagctgaacgccttcaacgtgttcgtgtgcgaccagaagtgcaacatcgccgacatcaagatccacggcatggacgccagcatcagcgtgaagcccaagcagaccgacgtgttcgccagactgaaggacatcatcgtgatgaacgtggacctgcagagcatccacaagaaggccgtgagcatcctgggcgacgaggtgttcagattccagctgaccctgtaccccgacgccaccgagggcgaggcctacgccgacatgagcaaggtggacggcaagctgagcttcaaggtgggctgcatccagatcgtgtacgtgcacaagttcttcatgagcctgctgaacttcctgaacaacttccagaccgccaaggaggccctgagcaccgccaccgtgcaggccgccgagagagccgccagcagcatgaaggacctggcccagaagagcttcagactgctgatggacatcaacctgaaggcccccgtgatcatcatcccccagagcagcgtgagccccaacgccgtgatcgccgacctgggcctgatcagagtggagaacaagttcagcctggtgcccatggagcactacagcctgccccccgtgatcgacaagatgaacatcgagctgacccagctgaagctgagcagaaccatcctgcaggccagcctgccccagaacgacatcgagatcctgaagcccgtgaacatgctgctgagcatccagagaaacctggccgccgcctggtacgtgcagatccccggcatggagatcaagggcaagctgaagcccatgcaggtggccctgagcgaggacgacctgaccgtgctgatgaagatcctgctggagaacctgggcgaggccagcagccagcccagccccacccagagcgtgcaggagaccgtgagagtgagaaaggtggacgtgagcagcgtgcccgaccacctgaaggagcaggaggactggaccgacagcaagctgagcatgaaccagatcgtgagcctgcagttcgacttccacttcgagagcctgagcatcatcctgtacaacaacgacatcaaccaggagagcggcgtggccttccacaacgacagcttccagctgggcgagctgagactgcacctgatggccagcagcggcaagatgttcaaggacggcagcatgaacgtgagcgtgaagctgaagacctgcaccctggacgacctgagagagggcatcgagagagccaccagcagaatgatcgacagaaagaacgaccaggacaacaacagcagcatgatcgacatcagctacaagcaggacaagaacggcagccagatcgacgccgtgctggacaagctgtacgtgtgcgccagcgtggagttcctgatgaccgtggccgacttcttcatcaaggccgtgccccagagccccgagaacgtggccaaggagacccagatcctgcccagacagaccgccaccggcaaggtgaagatcgagaaggacgacagcgtgagacccaacatgaccctgaaggccatgatcaccgaccccgaggtggtgttcgtggccagcctgaccaaggccgacgcccccgccctgaccgccagcttccagtgcaacctgagcctgagcaccagcaagctggagcagatgatggaggccagcgtgagagacctgaaggtgctggcctgccccttcctgagagagaagagaggcaagaacatcaccaccgtgctgcagccctgcagcctgttcatggagaagtgcacctgggccagcggcaagcagaacatcaacatcatggtgaaggagttcatcatcaagatcagccccatcatcctgaacaccgtgctgaccatcatggccgccctgagccccaagaccaaggaggacggcagcaaggacaccagcaaggagatggagaacctgtggggcatcaagagcatcaacgactacaacacctggttcctgggcgtggacaccgccaccgagatcaccgagagcttcaagggcatcgagcacagcctgatcgaggagaactgcggcgtggtggtggagagcatccaggtgaccctggagtgcggcctgggccacagaaccgtgcccctgctgctggccgagagcaagttcagcggcaacatcaagaactggaccagcctgatggccgccgtggccgacgtgaccctgcaggtgcactactacaacgagatccacgccgtgtgggagcccctgatcgagagagtggagggcaagagacagtggaacctgagactggacgtgaagaagaaccccgtgcaggacaagagcctgctgcccggcgacgacttcatccccgagccccagatggccatccacatcagcagcggcaacaccatgaacatcaccatcagcaagagctgcctgaacgtgttcaacaacctggccaagggcttcagcgagggcaccgccagcaccttcgactacagcctgaaggacagagcccccttcaccgtgaagaacgccgtgggcgtgcccatcaaggtgaagcccaactgcaacctgagagtgatgggcttccccgagaagagcgacatcttcgacgtggacgccggccagaacctggagctggagtacgccagcatggtgcccagcagccagggcaacctgagcatcctgagcagacaggagagcagcttcttcaccctgaccatcgtgccccacggctacaccgaggtggccaacatccccgtggccagacccggcagaagactgtacaacgtgagaaaccccaacgccagccacagcgacagcgtgctggtgcagatcgacgccaccgagggcaacaaggtgatcaccctgagaagccccctgcagatcaagaaccacttcagcatcgccttcatcatctacaagttcgtgaagaacgtgaagctgctggagagaatcggcatcgccagacccgaggaggagttccacgtgcccctggacagctacagatgccagctgttcatccagcccgccggcatcctggagcaccagtacaaggagagcaccacctacatcagctggaaggaggagctgcacagaagcagagaggtgagatgcatgctgcagtgccccagcgtggaggtgagcttcctgcccctgatcgtgaacaccgtggccctgcccgacgagctgagctacatctgcacccacggcgaggactgggacgtggcctacatcatccacctgtaccccagcctgaccctgagaaacctgctgccctacagcctgagatacctgctggagggcaccgccgagacccacgagctggccgagggcagcaccgccgacgtgctgcacagcagaatcagcggcgagatcatggagctggtgctggtgaagtaccagggcaagaactggaacggccacttcagaatcagagacaccctgcccgagttcttccccgtgtgcttcagcagcgacagcaccgaggtgaccaccgtggacctgagcgtgcacgtgagaagaatcggcagcagaatggtgctgagcgtgttcagcccctactggctgatcaacaagaccaccagagtgctgcagtacagaagcgaggacatccacgtgaagcaccccgccgacttcagagacatcatcctgttcagcttcaagaagaagaacatcttcaccaagaacaaggtgcagctgaagatcagcaccagcgcctggagcagcagcttcagcctggacaccgtgggcagctacggctgcgtgaagtgccccgccaacaacatggagtacctggtgggcgtgagcatcaagatgagcagcttcaacctgagcagaatcgtgaccctgacccccttctgcaccatcgccaacaagagcagcctggagctggaggtgggcgagatcgccagcgacggcagcatgcccaccaacaagtggaactacatcgccagcagcgagtgcctgcccttctggcccgagagcctgagcggcaagctgtgcgtgagagtggtgggctgcgagggcagcagcaagcccttcttctacaacagacaggacaacggcaccctgctgagcctggaggacctgaacggcggcatcctggtggacgtgaacaccgccgagcacagcaccgtgatcaccttcagcgactaccacgagggcagcgcccccgccctgatcatgaaccacaccccctgggacatcctgacctacaagcagagcggcagccccgaggagatggtgctgctgcccagacaggccagactgttcgcctgggccgaccccaccggcaccagaaagctgacctggacctacgccgccaacgtgggcgagcacgacctgctgaaggacggctgcggccagttcccctacgacgccaacatccagatccactgggtgagcttcctggacggcagacagagagtgctgctgttcaccgacgacgtggccctggtgagcaaggccctgcaggccgaggagatggagcaggccgactacgagatcaccctgagcctgcacagcctgggcctgagcctggtgaacaacgagagcaagcaggaggtgagctacatcggcatcaccagcagcggcgtggtgtgggaggtgaagcccaagcagaagtggaagcccttcagccagaagcagatcatcctgctggagcagagctaccagaagcaccagatcagcagagaccacggctggatcaagctggacaacaacttcgaggtgaacttcgacaaggaccccatggagatgagactgcccatcagaagccccatcaagagagacttcctgagcggcatccagatcgagttcaagcagagcagccaccagagaagcctgagagccagactgtactggctgcaggtggacaaccagctgcccggcgccatgttccccgtggtgttccaccccgtggccccccccaagagcatcgccctggacagcgagcccaagcccttcatcgacgtgagcgtgatcaccagattcaacgagtacagcaaggtgctgcagttcaagtacttcatggtgctgatccaggagatggccctgaagatcgaccagggcttcctgggcgccatcatcgccctgttcacccccaccaccgaccccgaggccgagagaagaagaaccaagctgatccagcaggacatcgacgccctgaacgccgagctgatggagaccagcatgaccgacatgagcatcctgagcttcttcgagcacttccacatcagccccgtgaagctgcacctgagcctgagcctgggcagcggcggcgaggagagcgacaaggagaagcaggagatgttcgccgtgcacagcgtgaacctgctgctgaagagcatcggcgccaccctgaccgacgtggacgacctgatcttcaagctggcctactacgagatcagataccagttctacaagagagaccagctgatctggagcgtggtgagacactacagcgagcagttcctgaagcagatgtacgtgctggtgctgggcctggacgtgctgggcaaccccttcggcctgatcagaggcctgagcgagggcgtggaggccctgttctacgagcccttccagggcgccgtgcagggccccgaggagttcgccgagggcctggtgatcggcgtgagaagcctgttcggccacaccgtgggcggcgccgccggcgtggtgagcagaatcaccggcagcgtgggcaagggcctggccgccatcaccatggacaaggagtaccagcagaagagaagagaggagctgagcagacagcccagagacttcggcgacagcctggccagaggcggcaagggcttcctgagaggcgtggtgggcggcgtgaccggcatcatcaccaagcccgtggagggcgccaagaaggagggcgccgccggcttcttcaagggcatcggcaagggcctggtgggcgccgtggccagacccaccggcggcatcgtggacatggccagcagcaccttccagggcatccagagagccgccgagagcaccgaggaggtgagcagcctgagaccccccagactgatccacgaggacggcatcatcagaccctacgacagacaggagagcgagggcagcgacctgctggagaaccacatcaagaagctggagggcgagacctacagataccactgcgccatccccggcagcaagaagaccatcctgatggtgaccaacagaagagtgctgtgcatcaaggaggtggagatcctgggcctgatgtgcgtggactggcagtgccccttcgaggacttcgtgttcccccccagcgtgagcgagaacgtgctgaagatcagcgtgaaggagcagggcctgttccacaagaaggacagcgccaaccagggctgcgtgagaaaggtgtacctgaaggacaccgccaccgccgagagagcctgcaacgccatcgaggacgcccagagcaccagacagcagcagaagctgatgaagcagagcagcgtgagactgctgagaccccagctgcccagctag

SEQ ID NO: 25923 - DNA, 11262 bp, Artificial Sequence
  Description of Artificial Sequence: Synthetic coding sequence
atggtgctggagagcgtggtggccgacctgctgaacagattcctgggcgactacgtggagaacctgaacaagagccagctgaagctgggcatctggggcggcaacgtggccctggacaacctgcagatcaaggagaacgccctgagcgagctggacgtgcccttcaaggtgaaggccggccagatcgacaagctgaccctgaagatcccctggaagaacctgtacggcgaggccgtggtggccaccctggagggcctgtacctgctggtggtgcccggcgccagcatcaagtacgacgccgtgaaggaggagaagagcctgcaggacgtgaagcagaaggagctgagcagaatcgaggaggccctgcagaaggccgccgagaagggcacccacagcggcgagttcatctacggcctggagaacttcgtgtacaaggacatcaagcccggcagaaagagaaagaagcacaagaagcacttcaagaagcccttcaagggcctggacagaagcaaggacaagcccaaggaggccaagaaggacaccttcgtggagaagctggccacccaggtgatcaagaacgtgcaggtgaagatcaccgacatccacatcaagtacgaggacgacgtgaccgaccccaagagacccctgagcttcggcgtgaccctgggcgagctgagcctgctgaccgccaacgagcactggaccccctgcatcctgaacgaggccgacaagatcatctacaagctgatcagactggacagcctgagcgcctactggaacgtgaactgcagcatgagctaccagagaagcagagagcagatcctggaccagctgaagaacgagatcctgaccagcggcaacatcccccccaactaccagtacatcttccagcccatcagcgccagcgccaagctgtacatgaacccctacgccgagagcgagctgaagacccccaagctggactgcaacatcgagatccagaacatcgccatcgagctgaccaagccccagtacctgagcatgatcgacctgctggagagcgtggactacatggtgagaaacgccccctacagaaagtacaagccctacctgcccctgcacaccaacggcagaagatggtggaagtacgccatcgacagcgtgctggaggtgcacatcagaagatacacccagatgtggagctggagcaacatcaagaagcacagacagctgctgaagagctacaagatcgcctacaagaacaagctgacccagagcaaggtgagcgaggagatccagaaggagatccaggacctggagaagaccctggacgtgttcaacatcatcctggccagacagcaggcccaggtggaggtgatcagaagcggccagaagctgagaaagaagagcgccgacaccggcgagaagagaggcggctggttcagcggcctgtggggcaagaaggagagcaagaagaaggacgaggagagcctgatccccgagaccatcgacgacctgatgacccccgaggagaaggacaagctgttcaccgccatcggctacagcgagagcacccacaacctgaccctgcccaagcagtacgtggcccacatcatgaccctgaagctggtgagcaccagcgtgaccatcagagagaacaagaacatccccgagatcctgaagatccagatcatcggcctgggcacccaggtgagccagagacccggcgcccaggccctgaaggtggaggccaagctggagcactggtacatcaccggcctgagacagcaggacatcgtgcccagcctggtggccagcatcggcgacaccaccagcagcctgctgaagatcaagttcgagaccaaccccgaggacagccccgccgaccagaccctgatcgtgcagagccagcccgtggaggtgatctacgacgccaagaccgtgaacgccgtggtggagttcttccagagcaacaagggcctggacctggagcagatcaccagcgccaccctgatgaagctggaggagatcaaggagagaaccgccaccggcctgacccacatcatcgagaccagaaaggtgctggacctgagaatcaacctgaagcccagctacctggtggtgccccagaccggcttccaccacgagaagagcgacctgctgatcctggacttcggcaccttccagctgaacagcaaggaccagggcctgcagaagaccaccaacagcagcctggaggagatcatggacaaggcctacgacaagttcgacgtggagatcaagaacgtgcagctgctgttcgccagagccgaggagacctggaagaagtgcagattccagcaccccagcaccatgcacatcctgcagcccatggacatccacgtggagctggccaaggccatggtggagaaggacatcagaatggccagattcaaggtgagcggcggcctgcccctgatgcacgtgagaatcagcgaccagaagatgaaggacgtgctgtacctgatgaacagcatccccctgccccagaagagcagcgcccagagccccgagagacaggtgagcagcatccccatcatcagcggcggcaccaagggcctgctgggcaccagcctgctgctggacaccgtggagagcgagagcgacgacgagtacttcgacgccgaggacggcgagccccagacctgcaagagcatgaagggcagcgagctgaagaaggccgccgaggtgcccaacgaggagctgatcaacctgctgctgaagttcgagatcaaggaggtgatcctggagttcaccaagcagcagaaggaggaggacaccatcctggtgttcaacgtgacccagctgggcaccgaggccaccatgagaaccttcgacctgaccgtggtgagctacctgaagaagatcagcctggactaccacgagatcgagggcagcaagagaaagcccctgcacctgatcagcagcagcgacaagcccggcctggacctgctgaaggtggagtacatcaaggccgacaagaacggccccagcttccagaccgccttcggcaagaccgagcagaccgtgaaggtggccttcagcagcctgaacctgctgctgcagacccaggccctggtggccagcatcaactacctgaccaccatcatccccagcgacgaccagagcatcagcgtggccaaggaggtgcagatcagcaccgagaagcagcagaagaacagcaccctgcccaaggccatcgtgagcagcagagacagcgacatcatcgacttcagactgttcgccaagctgaacgccttctgcgtgatcgtgtgcaacgagaagaacaacatcgccgagatcaagatccagggcctggacagcagcctgagcctgcagagcagaaagcagagcctgttcgccagactggagaacatcatcgtgaccgacgtggaccccaagaccgtgcacaagaaggccgtgagcatcatgggcaacgaggtgttcagattcaacctggacctgtaccccgacgccaccgagggcgacctgtacaccgacatgagcaaggtggacggcgtgctgagcctgaacgtgggctgcatccagatcgtgtacctgcacaagttcctgatgagcctgctgaacttcctgaacaacttccagaccgccaaggagagcctgagcgccgccaccgcccaggccgccgagagagccgccaccagcgtgaaggacctggcccagagaagcttcagagtgagcatcaacatcgacctgaaggcccccgtgatcgtgatcccccagagcagcatcagcaccaacgccgtggtggtggacctgggcctgatcagagtgcacaaccagttcagcctggtgagcgacgaggactacctgaacccccccgtgatcgacagaatggacgtgcagctgaccaagctgaccctgtacagaaccgtgatccagcccggcatctaccaccccgacatccagctgctgcaccccatcaacctggagttcctggtgaacagaaacctggccgccagctggtaccacaaggtgcccgtggtggagatcaagggccacctggacagcatgaacgtgagcctgaaccaggaggacctgaacctgctgttcagaatcctgaccgagaacctgtgcgagggcaccgaggacctggacaaggtgaagcccagagtgcaggagaccggcgagatcaaggagcccctggagatcagcatcagccaggacgtgcacgacagcaagaacaccctgaccaccggcgtggaggagatcagaagcgtggacatcatcaacatgctgctgaacttcgagatcaaggaggtggtggtgaccctgatgaagaagagcgagaagaagggcagacccctgcacgagctgaacgtgctgcagctgggcatggaggccaaggtgaagacctacgacatgaccgccaaggcctacctgaagaagatcagcatgcagtgcttcgacttcaccgacagcaagggcgagcccctgcacatcatcaacagcagcaacgtgaccgacgagcccctgctgaagatgctgctgaccaaggccgacagcgacggccccgagttcaagaccatccacgacagcaccaagcagagactgaaggtgagcttcgccagcctggacctggtgctgcacctggaggccctgctgagcttcatggacttcctgagcagcgccgcccccttcagcgagcccagcagcagcgagaaggagagcgagctgaagcccctggtgggcgagagcagaagcatcgccgtgaaggccgtgagcagcaacatcagccagaaggacgtgttcgacctgaagatcaccgccgagctgaacgccttcaacgtgttcgtgtgcgaccagaagtgcaacatcgccgacatcaagatccacggcatggacgccagcatcagcgtgaagcccaagcagaccgacgtgttcgccagactgaaggacatcatcgtgatgaacgtggacctgcagagcatccacaagaaggccgtgagcatcctgggcgacgaggtgttcagattccagctgaccctgtaccccgacgccaccgagggcgaggcctacgccgacatgagcaaggtggacggcaagctgagcttcaaggtgggctgcatccagatcgtgtacgtgcacaagttcttcatgagcctgctgaacttcctgaacaacttccagaccgccaaggaggccctgagcaccgccaccgtgcaggccgccgagagagccgccagcagcatgaaggacctggcccagaagagcttcagactgctgatggacatcaacctgaaggcccccgtgatcatcatcccccagagcagcgtgagccccaacgccgtgatcgccgacctgggcctgatcagagtggagaacaagttcagcctggtgcccatggagcactacagcctgccccccgtgatcgacaagatgaacatcgagctgacccagctgaagctgagcagaaccatcctgcaggccagcctgccccagaacgacatcgagatcctgaagcccgtgaacatgctgctgagcatccagagaaacctggccgccgcctggtacgtgcagatccccggcatggagatcaagggcaagctgaagcccatgcaggtggccctgagcgaggacgacctgaccgtgctgatgaagatcctgctggagaacctgggcgaggccagcagccagcccagccccacccagagcgtgcaggagaccgtgagagtgagaaaggtggacgtgagcagcgtgcccgaccacctgaaggagcaggaggactggaccgacagcaagctgagcatgaaccagatcgtgagcctgcagttcgacttccacttcgagagcctgagcatcatcctgtacaacaacgacatcaaccaggagagcggcgtggccttccacaacgacagcttccagctgggcgagctgagactgcacctgatggccagcagcggcaagatgttcaaggacggcagcatgaacgtgagcgtgaagctgaagacctgcaccctggacgacctgagagagggcatcgagagagccaccagcagaatgatcgacagaaagaacgaccaggacaacaacagcagcatgatcgacatcagctacaagcaggacaagaacggcagccagatcgacgccgtgctggacaagctgtacgtgtgcgccagcgtggagttcctgatgaccgtggccgacttcttcatcaaggccgtgccccagagccccgagaacgtggccaaggagacccagatcctgcccagacagaccgccaccggcaaggtgaagatcgagaaggacgacagcgtgagacccaacatgaccctgaaggccatgatcaccgaccccgaggtggtgttcgtggccagcctgaccaaggccgacgcccccgccctgaccgccagcttccagtgcaacctgagcctgagcaccagcaagctggagcagatgatggaggccagcgtgagagacctgaaggtgctggcctgccccttcctgagagagaagagaggcaagaacatcaccaccgtgctgcagccctgcagcctgttcatggagaagtgcacctgggccagcggcaagcagaacatcaacatcatggtgaaggagttcatcatcaagatcagccccatcatcctgaacaccgtgctgaccatcatggccgccctgagccccaagaccaaggaggacggcagcaaggacaccagcaaggagatggagaacctgtggggcatcaagagcatcaacgactacaacacctggttcctgggcgtggacaccgccaccgagatcaccgagagcttcaagggcatcgagcacagcctgatcgaggagaactgcggcgtggtggtggagagcatccaggtgaccctggagtgcggcctgggccacagaaccgtgcccctgctgctggccgagagcaagttcagcggcaacatcaagaactggaccagcctgatggccgccgtggccgacgtgaccctgcaggtgcactactacaacgagatccacgccgtgtgggagcccctgatcgagagagtggagggcaagagacagtggaacctgagactggacgtgaagaagaaccccgtgcaggacaagagcctgctgcccggcgacgacttcatccccgagccccagatggccatccacatcagcagcggcaacaccatgaacatcaccatcagcaagagctgcctgaacgtgttcaacaacctggccaagggcttcagcgagggcaccgccagcaccttcgactacagcctgaaggacagagcccccttcaccgtgaagaacgccgtgggcgtgcccatcaaggtgaagcccaactgcaacctgagagtgatgggcttccccgagaagagcgacatcttcgacgtggacgccggccagaacctggagctggagtacgccagcatggtgcccagcagccagggcaacctgagcatcctgagcagacaggagagcagcttcttcaccctgaccatcgtgccccacggctacaccgaggtggccaacatccccgtggccagacccggcagaagactgtacaacgtgagaaaccccaacgccagccacagcgacagcgtgctggtgcagatcgacgccaccgagggcaacaaggtgatcaccctgagaagccccctgcagatcaagaaccacttcagcatcgccttcatcatctacaagttcgtgaagaacgtgaagctgctggagagaatcggcatcgccagacccgaggaggagttccacgtgcccctggacagctacagatgccagctgttcatccagcccgccggcatcctggagcaccagtacaaggagagcaccacctacatcagctggaaggaggagctgcacagaagcagagaggtgagatgcatgctgcagtgccccagcgtggaggtgagcttcctgcccctgatcgtgaacaccgtggccctgcccgacgagctgagctacatctgcacccacggcgaggactgggacgtggcctacatcatccacctgtaccccagcctgaccctgagaaacctgctgccctacagcctgagatacctgctggagggcaccgccgagacccacgagctggccgagggcagcaccgccgacgtgctgcacagcagaatcagcggcgagatcatggagctggtgctggtgaagtaccagggcaagaactggaacggccacttcagaatcagagacaccctgcccgagttcttccccgtgtgcttcagcagcgacagcaccgaggtgaccaccgtggacctgagcgtgcacgtgagaagaatcggcagcagaatggtgctgagcgtgttcagcccctactggctgatcaacaagaccaccagagtgctgcagtacagaagcgaggacatccacgtgaagcaccccgccgacttcagagacatcatcctgttcagcttcaagaagaagaacatcttcaccaagaacaaggtgcagctgaagatcagcaccagcgcctggagcagcagcttcagcctggacaccgtgggcagctacggctgcgtgaagtgccccgccaacaacatggagtacctggtgggcgtgagcatcaagatgagcagcttcaacctgagcagaatcgtgaccctgacccccttctgcaccatcgccaacaagagcagcctggagctggaggtgggcgagatcgccagcgacggcagcatgcccaccaacaagtggaactacatcgccagcagcgagtgcctgcccttctggcccgagagcctgagcggcaagctgtgcgtgagagtggtgggctgcgagggcagcagcaagcccttcttctacaacagacaggacaacggcaccctgctgagcctggaggacctgaacggcggcatcctggtggacgtgaacaccgccgagcacagcaccgtgatcaccttcagcgactaccacgagggcagcgcccccgccctgatcatgaaccacaccccctgggacatcctgacctacaagcagagcggcagccccgaggagatggtgctgctgcccagacaggccagactgttcgcctgggccgaccccaccggcaccagaaagctgacctggacctacgccgccaacgtgggcgagcacgacctgctgaaggacggctgcggccagttcccctacgacgccaacatccagatccactgggtgagcttcctggacggcagacagagagtgctgctgttcaccgacgacgtggccctggtgagcaaggccctgcaggccgaggagatggagcaggccgactacgagatcaccctgagcctgcacagcctgggcctgagcctggtgaacaacgagagcaagcaggaggtgagctacatcggcatcaccagcagcggcgtggtgtgggaggtgaagcccaagcagaagtggaagcccttcagccagaagcagatcatcctgctggagcagagctaccagaagcaccagatcagcagagaccacggctggatcaagctggacaacaacttcgaggtgaacttcgacaaggaccccatggagatgagactgcccatcagaagccccatcaagagagacttcctgagcggcatccagatcgagttcaagcagagcagccaccagagaagcctgagagccagactgtactggctgcaggtggacaaccagctgcccggcgccatgttccccgtggtgttccaccccgtggccccccccaagagcatcgccctggacagcgagcccaagcccttcatcgacgtgagcgtgatcaccagattcaacgagtacagcaaggtgctgcagttcaagtacttcatggtgctgatccaggagatggccctgaagatcgaccagggcttcctgggcgccatcatcgccctgttcacccccaccaccgaccccgaggccgagagaagaagaaccaagctgatccagcaggacatcgacgccctgaacgccgagctgatggagaccagcatgaccgacatgagcatcctgagcttcttcgagcacttccacatcagccccgtgaagctgcacctgagcctgagcctgggcagcggcggcgaggagagcgacaaggagaagcaggagatgttcgccgtgcacagcgtgaacctgctgctgaagagcatcggcgccaccctgaccgacgtggacgacctgatcttcaagctggcctactacgagatcagataccagttctacaagagagaccagctgatctggagcgtggtgagacactacagcgagcagttcctgaagcagatgtacgtgctggtgctgggcctggacgtgctgggcaaccccttcggcctgatcagaggcctgagcgagggcgtggaggccctgttctacgagcccttccagggcgccgtgcagggccccgaggagttcgccgagggcctggtgatcggcgtgagaagcctgttcggccacaccgtgggcggcgccgccggcgtggtgagcagaatcaccggcagcgtgggcaagggcctggccgccatcaccatggacaaggagtaccagcagaagagaagagaggagctgagcagacagcccagagacttcggcgacagcctggccagaggcggcaagggcttcctgagaggcgtggtgggcggcgtgaccggcatcatcaccaagcccgtggagggcgccaagaaggagggcgccgccggcttcttcaagggcatcggcaagggcctggtgggcgccgtggccagacccaccggcggcatcgtggacatggccagcagcaccttccagggcatccagagagccgccgagagcaccgaggaggtgagcagcctgagaccccccagactgatccacgaggacggcatcatcagaccctacgacagacaggagagcgagggcagcgacctgctggagaaccacatcaagaagctggagggcgagacctacagataccactgcgccatccccggcagcaagaagaccatcctgatggtgaccaacagaagagtgctgtgcatcaaggaggtggagatcctgggcctgatgtgcgtggactggcagtgccccttcgaggacttcgtgttcccccccagcgtgagcgagaacgtgctgaagatcagcgtgaaggagcagggcctgttccacaagaaggacagcgccaaccagggctgcgtgagaaaggtgtacctgaaggacaccgccaccgccgagagagcctgcaacgccatcgaggacgcccagagcaccagacagcagcagaagctgatgaagcagagcagcgtgagactgctgagaccccagctgcccagctag

SEQ ID NO: 25924 - DNA, 10887 bp, Artificial Sequence
  Description of Artificial Sequence: Synthetic coding sequence
atggtgctggagagcgtggtggccgacctgctgaacagattcctgggcgactacgtggagaacctgaacaagagccagctgaagctgggcatctggggcggcaacgtggccctggacaacctgcagatcaaggagaacgccctgagcgagctggacgtgcccttcaaggtgaaggccggccagatcgacaagctgaccctgaagatcccctggaagaacctgtacggcgaggccgtggtggccaccctggagggcctgtacctgctggtggtgcccggcgccagcatcaagtacgacgccgtgaaggaggagaagagcctgcaggacgtgaagcagaaggagctgagcagaatcgaggaggccctgcagaaggccgccgagaagggcacccacagcggcgagttcatctacggcctggagaacttcgtgtacaaggacatcaagcccggcagaaagagaaagaagcacaagaagcacttcaagaagcccttcaagggcctggacagaagcaaggacaagcccaaggaggccaagaaggacaccttcgtggagaagctggccacccaggtgatcaagaacgtgcaggtgaagatcaccgacatccacatcaagtacgaggacgacgtgaccgaccccaagagacccctgagcttcggcgtgaccctgggcgagctgagcctgctgaccgccaacgagcactggaccccctgcatcctgaacgaggccgacaagatcatctacaagctgatcagactggacagcctgagcgcctactggaacgtgaactgcagcatgagctaccagagaagcagagagcagatcctggaccagctgaagaacgagatcctgaccagcggcaacatcccccccaactaccagtacatcttccagcccatcagcgccagcgccaagctgtacatgaacccctacgccgagagcgagctgaagacccccaagctggactgcaacatcgagatccagaacatcgccatcgagctgaccaagccccagtacctgagcatgatcgacctgctggagagcgtggactacatggtgagaaacgccccctacagaaagtacaagccctacctgcccctgcacaccaacggcagaagatggtggaagtacgccatcgacagcgtgctggaggtgcacatcagaagatacacccagatgtggagctggagcaacatcaagaagcacagacagctgctgaagagctacaagatcgcctacaagaacaagctgacccagagcaaggtgagcgaggagatccagaaggagatccaggacctggagaagaccctggacgtgttcaacatcatcctggccagacagcaggcccaggtggaggtgatcagaagcggccagaagctgagaaagaagagcgccgacaccggcgagaagagaggcggctggttcagcggcctgtggggcaagaaggagagcaagaagaaggacgaggagagcctgatccccgagaccatcgacgacctgatgacccccgaggagaaggacaagctgttcaccgccatcggctacagcgagagcacccacaacctgaccctgcccaagcagtacgtggcccacatcatgaccctgaagctggtgagcaccagcgtgaccatcagagagaacaagaacatccccgagatcctgaagatccagatcatcggcctgggcacccaggtgagccagagacccggcgcccaggccctgaaggtggaggccaagctggagcactggtacatcaccggcctgagacagcaggacatcgtgcccagcctggtggccagcatcggcgacaccaccagcagcctgctgaagatcaagttcgagaccaaccccgaggacagccccgccgaccagaccctgatcgtgcagagccagcccgtggaggtgatctacgacgccaagaccgtgaacgccgtggtggagttcttccagagcaacaagggcctggacctggagcagatcaccagcgccaccctgatgaagctggaggagatcaaggagagaaccgccaccggcctgacccacatcatcgagaccagaaaggtgctggacctgagaatcaacctgaagcccagctacctggtggtgccccagaccggcttccaccacgagaagagcgacctgctgatcctggacttcggcaccttccagctgaacagcaaggaccagggcctgcagaagaccaccaacagcagcctggaggagatcatggacaaggcctacgacaagttcgacgtggagatcaagaacgtgcagctgctgttcgccagagccgaggagacctggaagaagtgcagattccagcaccccagcaccatgcacatcctgcagcccatggacatccacgtggagctggccaaggccatggtggagaaggacatcagaatggccagattcaaggtgagcggcggcctgcccctgatgcacgtgagaatcagcgaccagaagatgaaggacgtgctgtacctgatgaacagcatccccctgccccagaagagcagcgcccagagccccgagagacaggtgagcagcatccccatcatcagcggcggcaccaagggcctgctgggcaccagcctgctgctggacaccgtggagagcgagagcgacgacgagtacttcgacgccgaggacggcgagccccagacctgcaagagcatgaagggcagcgagctgaagaaggccgccgaggtgcccaacgaggagctgatcaacctgctgctgaagttcgagatcaaggaggtgatcctggagttcaccaagcagcagaaggaggaggacaccatcctggtgttcaacgtgacccagctgggcaccgaggccaccatgagaaccttcgacctgaccgtggtgagctacctgaagaagatcagcctggactaccacgagatcgagggcagcaagagaaagcccctgcacctgatcagcagcagcgacaagcccggcctggacctgctgaaggtggagtacatcaaggccgacaagaacggccccagcttccagaccgccttcggcaagaccgagcagaccgtgaaggtggccttcagcagcctgaacctgctgctgcagacccaggccctggtggccagcatcaactacctgaccaccatcatccccagcgacgaccagagcatcagcgtggccaaggaggtgcagatcagcaccgagaagcagcagaagaacagcaccctgcccaaggccatcgtgagcagcagagacagcgacatcatcgacttcagactgttcgccaagctgaacgccttctgcgtgatcgtgtgcaacgagaagaacaacatcgccgagatcaagatccagggcctggacagcagcctgagcctgcagagcagaaagcagagcctgttcgccagactggagaacatcatcgtgaccgacgtggaccccaagaccgtgcacaagaaggccgtgagcatcatgggcaacgaggtgttcagattcaacctggacctgtaccccgacgccaccgagggcgacctgtacaccgacatgagcaaggtggacggcgtgctgagcctgaacgtgggctgcatccagatcgtgtacctgcacaagttcctgatgagcctgctgaacttcctgaacaacttccagaccgccaaggagagcctgagcgccgccaccgcccaggccgccgagagagccgccaccagcgtgaaggacctggcccagagaagcttcagagtgagcatcaacatcgacctgaaggcccccgtgatcgtgatcccccagagcagcatcagcaccaacgccgtggtggtggacctgggcctgatcagagtgcacaaccagttcagcctggtgagcgacgaggactacctgaacccccccgtgatcgacagaatggacgtgcagctgaccaagctgaccctgtacagaaccgtgatccagcccggcatctaccaccccgacatccagctgctgcaccccatcaacctggagttcctggtgaacagaaacctggccgccagctggtaccacaaggtgcccgtggtggagatcaagggccacctggacagcatgaacgtgagcctgaaccaggaggacctgaacctgctgttcagaatcctgaccgagaacctgtgcgagggcaccgaggacctggacaaggtgaagcccagagtgcaggagaccggcgagatcaaggagcccctggagatcagcatcagccaggacgtgcacgacagcaagaacaccctgaccaccggcgtggaggagatcagaagcgtggacatcatcaacatgctgctgaacttcgagatcaaggaggtggtggtgaccctgatgaagaagagcgagaagaagggcagacccctgcacgagctgaacgtgctgcagctgggcatggaggccaaggtgaagacctacgacatgaccgccaaggcctacctgaagaagatcagcatgcagtgcttcgacttcaccgacagcaagggcgagcccctgcacatcatcaacagcagcaacgtgaccgacgagcccctgctgaagatgctgctgaccaaggccgacagcgacggccccgagttcaagaccatccacgacagcaccaagcagagactgaaggtgagcttcgccagcctggacctggtgctgcacctggaggccctgctgagcttcatggacttcctgagcagcgccgcccccttcagcgagcccagcagcagcgagaaggagagcgagctgaagcccctggtgggcgagagcagaagcatcgccgtgaaggccgtgagcagcaacatcagccagaaggacgtgttcgacctgaagatcaccgccgagctgaacgccttcaacgtgttcgtgtgcgaccagaagtgcaacatcgccgacatcaagatccacggcatggacgccagcatcagcgtgaagcccaagcagaccgacgtgttcgccagactgaaggacatcatcgtgatgaacgtggacctgcagagcatccacaagaaggccgtgagcatcctgggcgacgaggtgttcagattccagctgaccctgtaccccgacgccaccgagggcgaggcctacgccgacatgagcaaggtggacggcaagctgagcttcaaggtgggctgcatccagatcgtgtacgtgcacaagttcttcatgagcctgctgaacttcctgaacaacttccagaccgccaaggaggccctgagcaccgccaccgtgcaggccgccgagagagccgccagcagcatgaaggacctggcccagaagagcttcagactgctgatggacatcaacctgaaggcccccgtgatcatcatcccccagagcagcgtgagccccaacgccgtgatcgccgacctgggcctgatcagagtggagaacaagttcagcctggtgcccatggagcactacagcctgccccccgtgatcgacaagatgaacatcgagctgacccagctgaagctgagcagaaccatcctgcaggccagcctgccccagaacgacatcgagatcctgaagcccgtgaacatgctgctgagcatccagagaaacctggccgccgcctggtacgtgcagatccccggcatggagatcaagggcaagctgaagcccatgcaggtggccctgagcgaggacgacctgaccgtgctgatgaagatcctgctggagaacctgggcgaggccagcagccagcccagccccacccagagcgtgcaggagaccgtgagagtgagaaaggtggacgtgagcagcgtgcccgaccacctgaaggagcaggaggactggaccgacagcaagctgagcatgaaccagatcgtgagcctgcagttcgacttccacttcgagagcctgagcatcatcctgtacaacaacgacatcaaccaggagagcggcgtggccttccacaacgacagcttccagctgggcgagctgagactgcacctgatggccagcagcggcaagatgttcaaggacggcagcatgaacgtgagcgtgaagctgaagacctgcaccctggacgacctgagagagggcatcgagagagccaccagcagaatgatcgacagaaagaacgaccaggacaacaacagcagcatgatcgacatcagctacaagcaggacaagaacggcagccagatcgacgccgtgctggacaagctgtacgtgtgcgccagcgtggagttcctgatgaccgtggccgacttcttcatcaaggccgtgccccagagccccgagaacgtggccaaggagacccagatcctgcccagacagaccgccaccggcaaggtgaagatcgagaaggacgacagcgtgagacccaacatgaccctgaaggccatgatcaccgaccccgaggtggtgttcgtggccagcctgaccaaggccgacgcccccgccctgaccgccagcttccagtgcaacctgagcctgagcaccagcaagctggagcagatgatggaggccagcgtgagagacctgaaggtgctggcctgccccttcctgagagagaagagaggcaagaacatcaccaccgtgctgcagccctgcagcctgttcatggagaagtgcacctgggccagcggcaagcagaacatcaacatcatggtgaaggagttcatcatcaagatcagccccatcatcctgaacaccgtgctgaccatcatggccgccctgagccccaagaccaaggaggacggcagcaaggacaccagcaaggagatggagaacctgtggggcatcaagagcatcaacgactacaacacctggttcctgggcgtggacaccgccaccgagatcaccgagagcttcaagggcatcgagcacagcctgatcgaggagaactgcggcgtggtggtggagagcatccaggtgaccctggagtgcggcctgggccacagaaccgtgcccctgctgctggccgagagcaagttcagcggcaacatcaagaactggaccagcctgatggccgccgtggccgacgtgaccctgcaggtgcactactacaacgagatccacgccgtgtgggagcccctgatcgagagagtggagggcaagagacagtggaacctgagactggacgtgaagaagaaccccgtgcaggacaagagcctgctgcccggcgacgacttcatccccgagccccagatggccatccacatcagcagcggcaacaccatgaacatcaccatcagcaagagctgcctgaacgtgttcaacaacctggccaagggcttcagcgagggcaccgccagcaccttcgactacagcctgaaggacagagcccccttcaccgtgaagaacgccgtgggcgtgcccatcaaggtgaagcccaactgcaacctgagagtgatgggcttccccgagaagagcgacatcttcgacgtggacgccggccagaacctggagctggagtacgccagcatggtgcccagcagccagggcaacctgagcatcctgagcagacaggagagcagcttcttcaccctgaccatcgtgccccacggctacaccgaggtggccaacatccccgtggccagacccggcagaagactgtacaacgtgagaaaccccaacgccagccacagcgacagcgtgctggtgcagatcgacgccaccgagggcaacaaggtgatcaccctgagaagccccctgcagatcaagaaccacttcagcatcgccttcatcatctacaagttcgtgaagaacgtgaagctgctggagagaatcggcatcgccagacccgaggaggagttccacgtgcccctggacagctacagatgccagctgttcatccagcccgccggcatcctggagcaccagtacaaggagagcaccacctacatcagctggaaggaggagctgcacagaagcagagaggtgagatgcatgctgcagtgccccagcgtggaggtgagcttcctgcccctgatcgtgaacaccgtggccctgcccgacgagctgagctacatctgcacccacggcgaggactgggacgtggcctacatcatccacctgtaccccagcctgaccctgagaaacctgctgccctacagcctgagatacctgctggagggcaccgccgagacccacgagctggccgagggcagcaccgccgacgtgctgcacagcagaatcagcggcgagatcatggagctggtgctggtgaagtaccagggcaagaactggaacggccacttcagaatcagagacaccctgcccgagttcttccccgtgtgcttcagcagcgacagcaccgaggtgaccaccgtggacctgagcgtgcacgtgagaagaatcggcagcagaatggtgctgagcgtgttcagcccctactggctgatcaacaagaccaccagagtgctgcagtacagaagcgaggacatccacgtgaagcaccccgccgacttcagagacatcatcctgttcagcttcaagaagaagaacatcttcaccaagaacaaggtgcagctgaagatcagcaccagcgcctggagcagcagcttcagcctggacaccgtgggcagctacggctgcgtgaagtgccccgccaacaacatggagtacctggtgggcgtgagcatcaagatgagcagcttcaacctgagcagaatcgtgaccctgacccccttctgcaccatcgccaacaagagcagcctggagctggaggtgggcgagatcgccagcgacggcagcatgcccaccaacaagtggaactacatcgccagcagcgagtgcctgcccttctggcccgagagcctgagcggcaagctgtgcgtgagagtggtgggctgcgagggcagcagcaagcccttcttctacaacagacaggacaacggcaccctgctgagcctggaggacctgaacggcggcatcctggtggacgtgaacaccgccgagcacagcaccgtgatcaccttcagcgactaccacgagggcagcgcccccgccctgatcatgaaccacaccccctgggacatcctgacctacaagcagagcggcagccccgaggagatggtgctgctgcccagacaggccagactgttcgcctgggccgaccccaccggcaccagaaagctgacctggacctacgccgccaacgtgggcgagcacgacctgctgaaggacggctgcggccagttcccctacgacgccaacatccagatccactgggtgagcttcctggacggcagacagagagtgctgctgttcaccgacgacgtggccctggtgagcaaggccctgcaggccgaggagatggagcaggccgactacgagatcaccctgagcctgcacagcctgggcctgagcctggtgaacaacgagagcaagcaggaggtgagctacatcggcatcaccagcagcggcgtggtgtgggaggtgaagcccaagcagaagtggaagcccttcagccagaagcagatcatcctgctggagcagagctaccagaagcaccagatcagcagagaccacggctggatcaagctggacaacaacttcgaggtgaacttcgacaaggaccccatggagatgagactgcccatcagaagccccatcaagagagacttcctgagcggcatccagatcgagttcaagcagagcagccaccagagaagcctgagagccagactgtactggctgcaggtggacaaccagctgcccggcgccatgttccccgtggtgttccaccccgtggccccccccaagagcatcgccctggacagcgagcccaagcccttcatcgacgtgagcgtgatcaccagattcaacgagtacagcaaggtgctgcagttcaagtacttcatggtgctgatccaggagatggccctgaagatcgaccagggcttcctgggcgccatcatcgccctgttcacccccaccaccgaccccgaggccgagagaagaagaaccaagctgatccagcaggacatcgacgccctgaacgccgagctgatggagaccagcatgaccgacatgagcatcctgagcttcttcgagcacttccacatcagccccgtgaagctgcacctgagcctgagcctgggcagcggcggcgaggagagcgacaaggagaagcaggagatgttcgccgtgcacagcgtgaacctgctgctgaagagcatcggcgccaccctgaccgacgtggacgacctgatcttcaagctggcctactacgagatcagataccagttctacaagagagaccagctgatctggagcgtggtgagacactacagcgagcagttcctgaagcagatgtacgtgctggtgctgggcctggacgtgctgggcaaccccttcggcctgatcagaggcctgagcgagggcgtggaggccctgttctacgagcccttccagggcgccgtgcagggccccgaggagttcgccgagggcctggtgatcggcgtgagaagcctgttcggccacaccgtgggcggcgccgccggcgtggtgagcagaatcaccggcagcgtgggcaagggcctggccgccatcaccatggacaaggagtaccagcagaagagaagagaggagctgagcagacagcccagagacttcggcgacagcctggccagaggcggcaagggcttcctgagaggcgtggtgggcggcgtgaccggcatcatcaccaagcccgtggagggcgccaagaaggagggcgccgccggcttcttcaagggcatcggcaagggcctggtgggcgccgtggccagacccaccggcggcatcgtggacatggccagcagcaccttccagggcatccagagagccgccgagagcaccgaggaggtgagcagcctgagaccccccagactgatccacgaggacggcatcatcagaccctacgacagacaggagagcgagggcagcgacctgctggagcaggagctggagatccaggagtag

SEQ ID NO: 25925 - DNA, 10758 bp, Artificial Sequence
  Description of Artificial Sequence: Synthetic coding sequence
atggtgctggagagcgtggtggccgacctgctgaacagattcctgggcgactacgtggagaacctgaacaagagccagctgaagctgggcatctggggcggcaacgtggccctggacaacctgcagatcaaggagaacgccctgagcgagctggacgtgcccttcaaggtgaaggccggccagatcgacaagctgaccctgaagatcccctggaagaacctgtacggcgaggccgtggtggccaccctggagggcctgtacctgctggtggtgcccggcgccagcatcaagtacgacgccgtgaaggaggagaagagcctgcaggacgtgaagcagaaggagctgagcagaatcgaggaggccctgcagaaggccgccgagaaggacaagcccaaggaggccaagaaggacaccttcgtggagaagctggccacccaggtgatcaagaacgtgcaggtgaagatcaccgacatccacatcaagtacgaggacgacgtgaccgaccccaagagacccctgagcttcggcgtgaccctgggcgagctgagcctgctgaccgccaacgagcactggaccccctgcatcctgaacgaggccgacaagatcatctacaagctgatcagactggacagcctgagcgcctactggaacgtgaactgcagcatgagctaccagagaagcagagagcagatcctggaccagctgaagaacgagatcctgaccagcggcaacatcccccccaactaccagtacatcttccagcccatcagcgccagcgccaagctgtacatgaacccctacgccgagagcgagctgaagacccccaagctggactgcaacatcgagatccagaacatcgccatcgagctgaccaagccccagtacctgagcatgatcgacctgctggagagcgtggactacatggtgagaaacgccccctacagaaagtacaagccctacctgcccctgcacaccaacggcagaagatggtggaagtacgccatcgacagcgtgctggaggtgcacatcagaagatacacccagatgtggagctggagcaacatcaagaagcacagacagctgctgaagagctacaagatcgcctacaagaacaagctgacccagagcaaggtgagcgaggagatccagaaggagatccaggacctggagaagaccctggacgtgttcaacatcatcctggccagacagcaggcccaggtggaggtgatcagaagcggccagaagctgagaaagaagagcgccgacaccggcgagaagagaggcggctggttcagcggcctgtggggcaagaaggagagcaagaagaaggacgaggagagcctgatccccgagaccatcgacgacctgatgacccccgaggagaaggacaagctgttcaccgccatcggctacagcgagagcacccacaacctgaccctgcccaagcagtacgtggcccacatcatgaccctgaagctggtgagcaccagcgtgaccatcagagagaacaagaacatccccgagatcctgaagatccagatcatcggcctgggcacccaggtgagccagagacccggcgcccaggccctgaaggtggaggccaagctggagcactggtacatcaccggcctgagacagcaggacatcgtgcccagcctggtggccagcatcggcgacaccaccagcagcctgctgaagatcaagttcgagaccaaccccgaggacagccccgccgaccagaccctgatcgtgcagagccagcccgtggaggtgatctacgacgccaagaccgtgaacgccgtggtggagttcttccagagcaacaagggcctggacctggagcagatcaccagcgccaccctgatgaagctggaggagatcaaggagagaaccgccaccggcctgacccacatcatcgagaccagaaaggtgctggacctgagaatcaacctgaagcccagctacctggtggtgccccagaccggcttccaccacgagaagagcgacctgctgatcctggacttcggcaccttccagctgaacagcaaggaccagggcctgcagaagaccaccaacagcagcctggaggagatcatggacaaggcctacgacaagttcgacgtggagatcaagaacgtgcagctgctgttcgccagagccgaggagacctggaagaagtgcagattccagcaccccagcaccatgcacatcctgcagcccatggacatccacgtggagctggccaaggccatggtggagaaggacatcagaatggccagattcaaggtgagcggcggcctgcccctgatgcacgtgagaatcagcgaccagaagatgaaggacgtgctgtacctgatgaacagcatccccctgccccagaagagcagcgcccagagccccgagagacaggtgagcagcatccccatcatcagcggcggcaccaagggcctgctgggcaccagcctgctgctggacaccgtggagagcgagagcgacgacgagtacttcgacgccgaggacggcgagccccagacctgcaagagcatgaagggcagcgagctgaagaaggccgccgaggtgcccaacgaggagctgatcaacctgctgctgaagttcgagatcaaggaggtgatcctggagttcaccaagcagcagaaggaggaggacaccatcctggtgttcaacgtgacccagctgggcaccgaggccaccatgagaaccttcgacctgaccgtggtgagctacctgaagaagatcagcctggactaccacgagatcgagggcagcaagagaaagcccctgcacctgatcagcagcagcgacaagcccggcctggacctgctgaaggtggagtacatcaaggccgacaagaacggccccagcttccagaccgccttcggcaagaccgagcagaccgtgaaggtggccttcagcagcctgaacctgctgctgcagacccaggccctggtggccagcatcaactacctgaccaccatcatccccagcgacgaccagagcatcagcgtggccaaggaggtgcagatcagcaccgagaagcagcagaagaacagcaccctgcccaaggccatcgtgagcagcagagacagcgacatcatcgacttcagactgttcgccaagctgaacgccttctgcgtgatcgtgtgcaacgagaagaacaacatcgccgagatcaagatccagggcctggacagcagcctgagcctgcagagcagaaagcagagcctgttcgccagactggagaacatcatcgtgaccgacgtggaccccaagaccgtgcacaagaaggccgtgagcatcatgggcaacgaggtgttcagattcaacctggacctgtaccccgacgccaccgagggcgacctgtacaccgacatgagcaaggtggacggcgtgctgagcctgaacgtgggctgcatccagatcgtgtacctgcacaagttcctgatgagcctgctgaacttcctgaacaacttccagaccgccaaggagagcctgagcgccgccaccgcccaggccgccgagagagccgccaccagcgtgaaggacctggcccagagaagcttcagagtgagcatcaacatcgacctgaaggcccccgtgatcgtgatcccccagagcagcatcagcaccaacgccgtggtggtggacctgggcctgatcagagtgcacaaccagttcagcctggtgagcgacgaggactacctgaacccccccgtgatcgacagaatggacgtgcagctgaccaagctgaccctgtacagaaccgtgatccagcccggcatctaccaccccgacatccagctgctgcaccccatcaacctggagttcctggtgaacagaaacctggccgccagctggtaccacaaggtgcccgtggtggagatcaagggccacctggacagcatgaacgtgagcctgaaccaggaggacctgaacctgctgttcagaatcctgaccgagaacctgtgcgagggcaccgaggacctggacaaggtgaagcccagagtgcaggagaccggcgagatcaaggagcccctggagatcagcatcagccaggacgtgcacgacagcaagaacaccctgaccaccggcgtggaggagatcagaagcgtggacatcatcaacatgctgctgaacttcgagatcaaggaggtggtggtgaccctgatgaagaagagcgagaagaagggcagacccctgcacgagctgaacgtgctgcagctgggcatggaggccaaggtgaagacctacgacatgaccgccaaggcctacctgaagaagatcagcatgcagtgcttcgacttcaccgacagcaagggcgagcccctgcacatcatcaacagcagcaacgtgaccgacgagcccctgctgaagatgctgctgaccaaggccgacagcgacggccccgagttcaagaccatccacgacagcaccaagcagagactgaaggtgagcttcgccagcctggacctggtgctgcacctggaggccctgctgagcttcatggacttcctgagcagcgccgcccccttcagcgagcccagcagcagcgagaaggagagcgagctgaagcccctggtgggcgagagcagaagcatcgccgtgaaggccgtgagcagcaacatcagccagaaggacgtgttcgacctgaagatcaccgccgagctgaacgccttcaacgtgttcgtgtgcgaccagaagtgcaacatcgccgacatcaagatccacggcatggacgccagcatcagcgtgaagcccaagcagaccgacgtgttcgccagactgaaggacatcatcgtgatgaacgtggacctgcagagcatccacaagaaggccgtgagcatcctgggcgacgaggtgttcagattccagctgaccctgtaccccgacgccaccgagggcgaggcctacgccgacatgagcaaggtggacggcaagctgagcttcaaggtgggctgcatccagatcgtgtacgtgcacaagttcttcatgagcctgctgaacttcctgaacaacttccagaccgccaaggaggccctgagcaccgccaccgtgcaggccgccgagagagccgccagcagcatgaaggacctggcccagaagagcttcagactgctgatggacatcaacctgaaggcccccgtgatcatcatcccccagagcagcgtgagccccaacgccgtgatcgccgacctgggcctgatcagagtggagaacaagttcagcctggtgcccatggagcactacagcctgccccccgtgatcgacaagatgaacatcgagctgacccagctgaagctgagcagaaccatcctgcaggccagcctgccccagaacgacatcgagatcctgaagcccgtgaacatgctgctgagcatccagagaaacctggccgccgcctggtacgtgcagatccccggcatggagatcaagggcaagctgaagcccatgcaggtggccctgagcgaggacgacctgaccgtgctgatgaagatcctgctggagaacctgggcgaggccagcagccagcccagccccacccagagcgtgcaggagaccgtgagagtgagaaaggtggacgtgagcagcgtgcccgaccacctgaaggagcaggaggactggaccgacagcaagctgagcatgaaccagatcgtgagcctgcagttcgacttccacttcgagagcctgagcatcatcctgtacaacaacgacatcaaccaggagagcggcgtggccttccacaacgacagcttccagctgggcgagctgagactgcacctgatggccagcagcggcaagatgttcaaggacggcagcatgaacgtgagcgtgaagctgaagacctgcaccctggacgacctgagagagggcatcgagagagccaccagcagaatgatcgacagaaagaacgaccaggacaacaacagcagcatgatcgacatcagctacaagcaggacaagaacggcagccagatcgacgccgtgctggacaagctgtacgtgtgcgccagcgtggagttcctgatgaccgtggccgacttcttcatcaaggccgtgccccagagccccgagaacgtggccaaggagacccagatcctgcccagacagaccgccaccggcaaggtgaagatcgagaaggacgacagcgtgagacccaacatgaccctgaaggccatgatcaccgaccccgaggtggtgttcgtggccagcctgaccaaggccgacgcccccgccctgaccgccagcttccagtgcaacctgagcctgagcaccagcaagctggagcagatgatggaggccagcgtgagagacctgaaggtgctggcctgccccttcctgagagagaagagaggcaagaacatcaccaccgtgctgcagccctgcagcctgttcatggagaagtgcacctgggccagcggcaagcagaacatcaacatcatggtgaaggagttcatcatcaagatcagccccatcatcctgaacaccgtgctgaccatcatggccgccctgagccccaagaccaaggaggacggcagcaaggacaccagcaaggagatggagaacctgtggggcatcaagagcatcaacgactacaacacctggttcctgggcgtggacaccgccaccgagatcaccgagagcttcaagggcatcgagcacagcctgatcgaggagaactgcggcgtggtggtggagagcatccaggtgaccctggagtgcggcctgggccacagaaccgtgcccctgctgctggccgagagcaagttcagcggcaacatcaagaactggaccagcctgatggccgccgtggccgacgtgaccctgcaggtgcactactacaacgagatccacgccgtgtgggagcccctgatcgagagagtggagggcaagagacagtggaacctgagactggacgtgaagaagaaccccgtgcaggacaagagcctgctgcccggcgacgacttcatccccgagccccagatggccatccacatcagcagcggcaacaccatgaacatcaccatcagcaagagctgcctgaacgtgttcaacaacctggccaagggcttcagcgagggcaccgccagcaccttcgactacagcctgaaggacagagcccccttcaccgtgaagaacgccgtgggcgtgcccatcaaggtgaagcccaactgcaacctgagagtgatgggcttccccgagaagagcgacatcttcgacgtggacgccggccagaacctggagctggagtacgccagcatggtgcccagcagccagggcaacctgagcatcctgagcagacaggagagcagcttcttcaccctgaccatcgtgccccacggctacaccgaggtggccaacatccccgtggccagacccggcagaagactgtacaacgtgagaaaccccaacgccagccacagcgacagcgtgctggtgcagatcgacgccaccgagggcaacaaggtgatcaccctgagaagccccctgcagatcaagaaccacttcagcatcgccttcatcatctacaagttcgtgaagaacgtgaagctgctggagagaatcggcatcgccagacccgaggaggagttccacgtgcccctggacagctacagatgccagctgttcatccagcccgccggcatcctggagcaccagtacaaggagagcaccacctacatcagctggaaggaggagctgcacagaagcagagaggtgagatgcatgctgcagtgccccagcgtggaggtgagcttcctgcccctgatcgtgaacaccgtggccctgcccgacgagctgagctacatctgcacccacggcgaggactgggacgtggcctacatcatccacctgtaccccagcctgaccctgagaaacctgctgccctacagcctgagatacctgctggagggcaccgccgagacccacgagctggccgagggcagcaccgccgacgtgctgcacagcagaatcagcggcgagatcatggagctggtgctggtgaagtaccagggcaagaactggaacggccacttcagaatcagagacaccctgcccgagttcttccccgtgtgcttcagcagcgacagcaccgaggtgaccaccgtggacctgagcgtgcacgtgagaagaatcggcagcagaatggtgctgagcgtgttcagcccctactggctgatcaacaagaccaccagagtgctgcagtacagaagcgaggacatccacgtgaagcaccccgccgacttcagagacatcatcctgttcagcttcaagaagaagaacatcttcaccaagaacaaggtgcagctgaagatcagcaccagcgcctggagcagcagcttcagcctggacaccgtgggcagctacggctgcgtgaagtgccccgccaacaacatggagtacctggtgggcgtgagcatcaagatgagcagcttcaacctgagcagaatcgtgaccctgacccccttctgcaccatcgccaacaagagcagcctggagctggaggtgggcgagatcgccagcgacggcagcatgcccaccaacaagtggaactacatcgccagcagcgagtgcctgcccttctggcccgagagcctgagcggcaagctgtgcgtgagagtggtgggctgcgagggcagcagcaagcccttcttctacaacagacaggacaacggcaccctgctgagcctggaggacctgaacggcggcatcctggtggacgtgaacaccgccgagcacagcaccgtgatcaccttcagcgactaccacgagggcagcgcccccgccctgatcatgaaccacaccccctgggacatcctgacctacaagcagagcggcagccccgaggagatggtgctgctgcccagacaggccagactgttcgcctgggccgaccccaccggcaccagaaagctgacctggacctacgccgccaacgtgggcgagcacgacctgctgaaggacggctgcggccagttcccctacgacgccaacatccagatccactgggtgagcttcctggacggcagacagagagtgctgctgttcaccgacgacgtggccctggtgagcaaggccctgcaggccgaggagatggagcaggccgactacgagatcaccctgagcctgcacagcctgggcctgagcctggtgaacaacgagagcaagcaggaggtgagctacatcggcatcaccagcagcggcgtggtgtgggaggtgaagcccaagcagaagtggaagcccttcagccagaagcagatcatcctgctggagcagagctaccagaagcaccagatcagcagagaccacggctggatcaagctggacaacaacttcgaggtgaacttcgacaaggaccccatggagatgagactgcccatcagaagccccatcaagagagacttcctgagcggcatccagatcgagttcaagcagagcagccaccagagaagcctgagagccagactgtactggctgcaggtggacaaccagctgcccggcgccatgttccccgtggtgttccaccccgtggccccccccaagagcatcgccctggacagcgagcccaagcccttcatcgacgtgagcgtgatcaccagattcaacgagtacagcaaggtgctgcagttcaagtacttcatggtgctgatccaggagatggccctgaagatcgaccagggcttcctgggcgccatcatcgccctgttcacccccaccaccgaccccgaggccgagagaagaagaaccaagctgatccagcaggacatcgacgccctgaacgccgagctgatggagaccagcatgaccgacatgagcatcctgagcttcttcgagcacttccacatcagccccgtgaagctgcacctgagcctgagcctgggcagcggcggcgaggagagcgacaaggagaagcaggagatgttcgccgtgcacagcgtgaacctgctgctgaagagcatcggcgccaccctgaccgacgtggacgacctgatcttcaagctggcctactacgagatcagataccagttctacaagagagaccagctgatctggagcgtggtgagacactacagcgagcagttcctgaagcagatgtacgtgctggtgctgggcctggacgtgctgggcaaccccttcggcctgatcagaggcctgagcgagggcgtggaggccctgttctacgagcccttccagggcgccgtgcagggccccgaggagttcgccgagggcctggtgatcggcgtgagaagcctgttcggccacaccgtgggcggcgccgccggcgtggtgagcagaatcaccggcagcgtgggcaagggcctggccgccatcaccatggacaaggagtaccagcagaagagaagagaggagctgagcagacagcccagagacttcggcgacagcctggccagaggcggcaagggcttcctgagaggcgtggtgggcggcgtgaccggcatcatcaccaagcccgtggagggcgccaagaaggagggcgccgccggcttcttcaagggcatcggcaagggcctggtgggcgccgtggccagacccaccggcggcatcgtggacatggccagcagcaccttccagggcatccagagagccgccgagagcaccgaggaggtgagcagcctgagaccccccagactgatccacgaggacggcatcatcagaccctacgacagacaggagagcgagggcagcgacctgctggagcaggagctggagatccaggagtag

SEQ ID NO: 25926 - DNA, 13092 bp, Artificial Sequence
  Description of Artificial Sequence: Synthetic coding sequence
atgctggagggcctggtggcctgggtgctgaacacctacctgggcaagtacgtgaacaacctgaacaccgaccagctgagcgtggccctgctgaagggcgccgtggagctggagaacctgcccctgaagaaggacgccctgaaggagctggagctgcccttcgaggtgaaggccggcttcatcggcaaggtgaccctgcagatccccttctacagaccccacgtggacccctgggtgatcagcatcagcagcctgcacctgatcggcgcccccgagaagatccaggacttcaacgacgagaaggagaagctgctggagagagagagaaagaaggccctgctgcaggccctggaggagaagtggaagaacgacagacagcagaagggcgagagctactggtacagcgtgaccgccagcgtggtgaccagaatcgtggagaacatcgagctgaagatccaggacgtgcacctgagattcgaggacggcgtgaccaaccccagccaccccttcgccttcggcatctgcatcaagaacgtgagcatgcagaacgccgtgaacgagcccgtgcagaagctgatgagaaagaagcagctggacgtggccgagttcagcatctactgggacgtggactgcaccctgctgggcgacctgccccagatggagctgcaggaggccatggccagaagcatggagagcagaagccaccactacgtgctggagcccgtgttcgccagcgccctgctgaagagaaactgcagcaagaagcccctgagaagcagacacagccccagaatcgactgcgacatccagctggagaccatccccctgaagctgagccagctgcagtacagacagatcatggagttcctgaaggagctggagagaaaggagagacaggtgaagttcagaagatggaagcccaaggtggccatcagcaagaactgcagagagtggtggtacttcgccctgaacgccaacctgtacgagatcagagagcagagaaagagatgcacctgggacttcatgctgcacagagccagagacgccgtgagctacaccgacaagtacttcaacaagctgaagggcggcctgctgagcaccgacgacaaggaggagatgtgcagaatcgaggaggagcagagcttcgaggagctgaagatcctgagagagctggtgcacgacagattccacaagcaggaggagctggccgagagcctgagagagccccagttcgacagccccggcgcctgccccggcgcccccgagcccggcggcggcagcggcatgctgcagtacctgcagagctggttccccggctggggcggctggtacggccagcagacccccgagggcaacgtggtggagggcctgagcgccgagcagcaggagcagtggatccccgaggagatcctgggcaccgaggagttcttcgaccccaccgccgacgccagctgcatgaacacctacaccaagagagaccacgtgttcgccaagctgaacctgcagctgcagagaggcaccgtgaccctgctgcacaaggagcagggcaccccccagatgaacgagagcgccttcatgcagctggagttcagcgacgtgaagctgctggccgagagcctgcccagaagaaacagcagcctgctgagcgtgagactgggcggcctgttcctgagagacctggccaccgagggcaccatgttccccctgctggtgttccccaacccccagaaggaggtgggcagagtgagccagagcttcggcctgcagaccaccagcgccgacagaagcgaccactaccccgccgccgaccccgacggccccgtgttcgagatgctgtacgagagaaaccccgcccacagccacttcgagagaagactgaacgtgagcaccagacccctgaacatcatctacaacccccaggccatcaagaaggtggccgacttcttctacaagggcaaggtgcacaccagcggcttcggctaccagagcgagctggagctgagagtggccgaggccgccagaagacagtacaacaagctgaagatgcagaccaaggccgagatcagacagaccctggacagactgctggtgggcgacttcatcgaggagagcaagagatggaccgtgagactggacatcagcgccccccaggtgatcttccccgacgacttcaagttcaagaaccccgtgctggtggtggtggacctgggcagaatgctgctgaccaacacccaggacaacagcagaagaaagagcagagacggcagcgccagcgaggagacccagttcagcgacgacgagtacaagacccccctggccaccccccccaacacccccccccccgagagcagcagcagcaacggcgagaagaccccccccttcagcggcgtggagttcagcgaggagcagctgcaggcccacctgatgagcaccaagatgtacgagagatacagcctgagcttcatggacctgcagatcatggtgggcagagtgaaggacaactggaagcacgtgcaggacatcgacgtgggccccacccacgtggtggagaagttcaacgtgcacctgcagctggagagaagactgatctacaccagcgaccccaagtaccccggcgccgtgctgagcggcaacctgcccgacctgaagatccacatcaacgaggacaagatcagcgccctgaagaactgcttcgccctgctgaccacccccgagatgaagaccagcgacacccagatcaaggagaagatcttcccccaggaggagcagagaggcagcctgcaggacagcgtgatgaacctgacccagagcatcgtgctgctggagcagcacaccagagaggtgctggtggagagccagctgctgctggccgagttcaaggtgaactgcatgcagctgggcgtggagagcaacggcagatacatcagcgtgctgaaggtgttcggcaccaacgcccacttcgtgaagagaccctacgacgccgaggtgagcctgaccgtgcacggcctgctgctggtggacaccatgcagacctacggcgccgacttcgacctgctgatggccagccacaagaacctgagcttcgacatccccaccggcagcctgagagacagcagagcccagagccccgtgagcggccccaacgtggcccacctgaccgacggcgccaccctgaacgacagaagcgccaccagcgtgagcctggacaagatcctgaccaaggagcaggagagcctgatcaagctggagtaccagttcgtgagcagcgagtgccccagcatgaacctggacagcaccctgcaggtgatcagcctgcaggtgaacaacctggacatcatcctgaaccccgagaccatcgtggagctgatcggcttcctgcagaagagcttccccaaggagaaggacgacctgagcccccagcccctgatgaccgacttcgagagaagcttcagagagcagggcacctaccagagcacctacgagcagaacaccgaggtggccgtggagatccacagactgaacctgctgctgctgagaaccgtgggcatggccaacagagagaagtacggcagaaagatcgccaccgccagcatcggcggcaccaaggtgaacgtgagcatgggcagcaccttcgacatgaacggcagcctgggctgcctgcagctgatggacctgacccaggacaacgtgaagaaccagtacgtggtgagcatcggcaacagcgtgggctacgagaacatcatcagcgacatcggctacttcgagagcgtgttcgtgagaatggaggacgccgccctgaccgaggccctgagcttcaccttcgtggagagaagcaagcaggagtgcttcctgaacctgaagatggccagcctgcactacaaccacagcgccaagttcctgaaggagctgaccctgagcatggacgagctggaggagaacttcagaggcatgctgaagagcgccgccaccaaggtgaccaccgtgctggccaccaagaccgccgagtacagcgagatggtgagcctgttcgagacccccagaaagaccagagagcccttcatcctggaggagaacgagatctacggcttcgacctggccagcagccacctggacaccgtgaagctgatcctgaacatcaacatcgagagccccgtggtgagcatccccagaaagcccggcagccccgagctgctggtgggccacctgggccagatcttcatccagaacttcgtggccggcgacgacgagagcagaagcgacagactgcaggtggagatcaaggacatcaagctgtacagcctgaactgcacccagctggccggcagagaggccgtgggcagcgagggcagcagaatgttctgcccccccagcggcagcggcagcgccaacagccaggaggaggcccacttcaccagacacgacttcttcgagagcctgcacagaggccaggccttccacatcctgaacaacaccaccatccagttcaagctggagaagatccccatcgagagagagagcgagctgaccttcagcctgagccccgacgacctgggcaccagcagcatcatgaagatcgagggcaagttcgtgaaccccgtgcaggtggtgctggccaagcacgtgtacgagcaggtgctgcagaccctggacaacctggtgtacagcgaggacctgaacaagtaccccgccagcgccaccagcagcccctgccccgacagccccctgccccccctgagcacctgcggcgagagcagcgtggagagaaaggagaacggcctgttcagccacagcagcctgagcaacaccagccagaagagcctgagcgtgaaggaggtgaagagcttcacccagatccaggccaccttctgcatcagcgagctgcaggtgcagctgagcggcgacctgaccctgggcgcccagggcctggtgagcctgaagttccaggacttcgaggtggagttcagcaaggaccacccccagaccctgagcatccagatcgccctgcacagcctgctgatggaggacctgctggagaagaaccccgacagcaagtacaagaacctgatggtgagcagaggcgcccccaagcccagcagcctggcccagaaggagtacctgagccagagctgccccagcgtgagcaacgtggagtaccccgacatgcccagaagcctgcccagccacatggaggaggcccccaacgtgttccagctgtaccagagacccaccagcgccagcagaaagaagcagaaggaggtgcaggacaaggactaccccctgacccccccccccagccccaccgtggacgagcccaagatcctggtgggcaagagcaagttcgacgacagcctggtgcacatcaacatcttcctggtggacaagaagcaccccgagttcagcagcagctacaacagagtgaacagaagcatcgacgtggacttcaactgcctggacgtgctgatcaccctgcagacctgggtggtgatcctggacttcttcggcatcggcagcaccgccgacaaccacgccatgagactgccccccgagggcatcctgcacaacgtgaagctggagccccacgccagcatggagagcggcctgcaggaccccgtgaacaccaagctggacctgaaggtgcacagcctgagcctggtgctgaacaagaccaccagcgagctggccaaggccaacgtgagcaagctggtggcccacctggagatgatcgagggcgacctggccctgcagggcagcatcggcagcctgagcctgagcgacctgacctgccacggcgagttctacagagagagattcaccaccagcggcgaggaggccctgatcttccagaccttcaagtacggcagacccgaccccctgctgagaagagagcacgacatcagagtgagcctgagaatggccagcgtgcagtacgtgcacacccagagattccaggccgaggtggtggccttcatccagcacttcacccagctgcaggacgtgctgggcagacagagagccgccatcgagggccagaccgtgagagaccaggcccagagatgcagcagagtgctgctggacatcgaggccggcgcccccgtgctgctgatccccgagagcagcagaagcaacaacctgatcgtggccaacctgggcaagctgaaggtgaagaacaagttcctgttcgccggcttccccggcaccttcagcctgcaggacaaggagagcgtgcccagcgccagccccaccggcatccccaagcacagcctgagaaagaccaccagcaccgaggagcccagaggcacccacagccagggccagttcaccatgcccctggccggcatgagcctgggcagcctgaagagcgagttcgtgcccagcaccagcaccaagcagcagggcccccagcccaccctgagcgtgggccaggagagcagcagccccgaggaccacgtgtgcctgctggactgcgtggtggtggacctgcaggacatggacatcttcgccgccgagagacaccccagagagtacagcaaggcccccgaggacagcagcggcgacctgatcttccccagctacttcgtgagacagaccggcggcagcctgctgaccgagccctgcagactgaagctgcaggtggagagaaacctggacaaggagatcagccacaccgtgcccgacatcagcatccacggcaacctgagcagcgtgcactgcagcctggacctgtacaagtacaagctgatcagaggcctgctggagaacaacctgggcgagcccatcgaggagttcatgagaccctacgacctgcaggaccccagaatccacaccgtgctgagcggcgaggtgtacacctgcatgtgcttcctgatcgacatggtgaacgtgagcctggagctgaaggaccccaagagaaaggagggcgccggcagcctggccagattcgacttcaagaagtgcaagctgctgtacgagagcttcagcaaccagaccaagagcatcaacctggtgagccacagcatgatggccttcgacaccagatacgccggccagaagaccagccccggcatgaccaacgtgttcagctgcatcttccagcccgccaagaacagcagcaccacccagggcagcatccagatcgagctgcacttcagaagcaccaaggacagcagctgcttcaccgtggtgctgaacaacctgagagtgttcctgatcttcgactggctgctgctggtgcacgacttcctgcacacccccagcgacatcaagaagcagaaccacgtgacccccagcagacacagaaacagcagcagcgagagcgccatcgtgcccaagaccgtgaagagcggcgtggtgaccaagagaagcagcctgcccgtgagcaacgagagacacctggaggtgaaggtgaacgtgaccggcaccgagttcgtggtgatcgaggacgtgagctgcttcgacaccaacgccatcatcctgaagggcaccaccgtgctgacctacaagcccagattcgtggacagacccttcagcggcagcctgttcggcatcgaggtgttcagctgcagactgggcaacgagcacgacaccgccctgagcatcgtggaccccgtgcagatccagatggagctggtgggcaacagcagctaccagaacagcagcggcctgatggacgccttcaacagcgaggacttcccccccgtgctggagatccagctgcaggccctggacatcagactgagctacaacgacgtgcagctgttcctggccatcgccaagagcatccccgagcaggccaacgccgccgtgcccgacagcgtggccctggagagcgacagcgtgggcacctacctgcccggcgccagcagagtgggcgaggagatcagagagggcaccagacacaccctggaccccgtgctggagctgcagctggccagactgcaggagctgggcttcagcatggacgactgcagaaaggccctgctggcctgccagggccagctgaagaaggccgccagctggctgttcaagaacgccgagcccctgaagagcctgagcctggccagcaccagcagagacagccccggcgccgtggccgcccccctgatcagcggcgtggagatcaaggccgagagcgtgtgcatctgcttcatcgacgactgcatggactgcgacgtgcccctggccgagctgaccttcagcagactgaacttcctgcagagagtgagaaccagccccgagggctacgcccacttcaccctgagcggcgactactacaacagagccctgagcggctgggagcccttcatcgagccctggccctgcagcgtgagctggcagcagcaggccgccagcagactgcacccccccagactgaagctggaggccaaggccaagcccagactggacatcaacatcaccagcgtgctgatcgaccagtacgtgagcaccaaggagagctggatggccgactactgcaaggacgacaaggacatcgagagcgccaagagcgaggactggatgggcagcagcgtggaccccccctgcttcggccagaccgaggtgaagacccccaagagaagacagcccttcgtgcccttcgccctgagaaaccacaccggctgcaccctgtggttcgccaccctgaccaccacccccaccagagccgccctgagccacagcggcagccccggcgtggtgcccgagggcaacggcaccttcctggacgacacccacaacgtgagcgagtggagagaggtgctgaccggcgaggagatccccttcgagttcgaggccagaggcaagctgagacacagacacacccacgacctgagaatccaccagctgcaggtgagagtgaacggctgggagcaggtgagccccgtgagcgtggacaaggtgggcaccttcttcagatacgccgcccccgacaagaacagcagcagcagcaccatcggcagccccagcagcagaaccaacatcatccacccccaggtgtacttcagcagcctgccccccgtgagagtggtgttcgccgtgaccatggagggcagcgccagaaaggtgatcaccgtgagaagcgccctgatcgtgagaaacagactggagacccccatggagctgagactggacagccccagcgcccccgacaagcccgtggtgctgcccgccatcatgcccggcgacagcttcgccgtgcccctgcacctgaccagctggagactgcaggccagacccaagggcctgggcgtgttcttctgcaaggcccccatccactggaccaacgtggtgaagaccgccgagatcagcagcagcaagagagagtgccacagcatggacaccgagaagagcagattcttcagattctgcgtggccatcaagaaggagaactaccccgactacatgcccagcaacatcttcagcgacagcgccaagcagatcttcagacagcccggccacaccatctacctgctgcccaccgtggtgatctgcaacctgctgccctgcgagctggacttctacgtgaagggcatgcccatcaacggcaccctgaagcccggcaaggaggccgccctgcacaccgccgacaccagccagaacatcgagctgggcgtgagcctggagaacttccccctgtgcaaggagctgctgatcccccccggcacccagaactacatggtgagaatgagactgtacgacgtgaacagaagacagctgaacctgaccatcagaatcgtgtgcagagccgagggcagcctgaagatcttcatcagcgccccctactggctgatcaacaagaccggcctgcccctgatcttcagacaggacaacgccaagaccgacgccgccggccagttcgaggagcacgagctggccagaagcctgagccccctgctgttctgctacgccgacaaggagcagcccaacctgtgcaccatgagaatcggcagaggcatccaccccgagggcatgcccggctggtgccagggcttcagcctggacggcggcagcggcgtgagagccctgaaggtgatccagcagggcaacagacccggcctgatctacaacatcggcatcgacgtgaagaagggcagaggcagatacatcgacacctgcatggtgatcttcgcccccagatacctgctggacaacaagagcagccacaagctggccttcgcccagagagagttcgccagaggccagggcaccgccaaccccgagggctacatcagcaccctgcccggcagcagcgtggtgttccactggcccagaaacgactacgaccagctgctgtgcgtgagactgatggacgtgcccaactgcatctggagcggcggcttcgaggtgaacaagaacaacagcttccacatcaacatgagagacaccctgggcaagtgcttcttcctgagagtggagatcaccctgagaggcgccacctacagaatcagcttcagcgacaccgaccagctgcccccccccttcagaatcgacaacttcagcaaggtgcccgtggtgttcacccagcacggcgtggccgagcccagactgagaaccgaggtgaagcccatgaccagcctggactacgcctgggacgagcccaccctgccccccttcatcaccctgaccgtgaagggcgccggcagcagcgagatcaactgcaacatgaacgacttccaggacaacagacagctgtactacgagaacttcatctacatcgccgccacctacaccttcagcggcctgcaggagggcaccggcagacccgtggccagcaacaaggccatcacctgcgccgagctggtgctggacgtgagccccaagacccagagagtgatcctgaagaagaaggagcccggcaagagaagccagctgtggagaatgaccggcaccggcatgctggcccacgagggcagcagcgtgccccacaaccccaacaagcccagcgccgccagaagcaccgagggcagcgccatcctggacatcgccggcctggccgccgtgaccgacaacagatacgagcccctgatgctgagaaagcccgacagaagaagaagcaccacccagacctggagcttcagagagggcaagctgacctgcggcctgcacggcctggtggtgcaggccaagggcggcctgagcggcctgttcgacggcgccgaggtggtgctgggccccgacaccagcatggagctgctgggccccgtgccccccgagcagcagttcatcaaccagaagatgagacccggcagcggcatgctgagcatcagagtgatccccgacggccccaccagagccctgcagatcaccgacttctgccacagaaagagcagcagaagctacgaggtggacgagctgcccgtgaccgagcaggagctgcagaagctgaagaaccccgacaccgagcaggagctggaggtgctggtgagactggagggcggcatcggcctgagcctgatcaacaaggtgcccgaggagctggtgttcgccagcctgaccggcatcaacgtgcactacacccagctggccaccagccacatgctggagctgagcatccaggacgtgcaggtggacaaccagctgatcggcaccacccagcccttcatgctgtacgtgacccccctgagcaacgagaacgaggtgatcgagaccggccccgccgtgcaggtgaacgccgtgaagttccccagcaagagcgccctgaccaacatctacaagcacctgatgatcaccgcccagagattcaccgtgcagatcgaggagaagctgctgctgaagctgctgagcttcttcggctacgaccaggccgagagcgaggtggagaagtacgacgagaacctgcacgagaagaccgccgagcagggcggcacccccatcagatactacttcgagaacctgaagatcagcatcccccagatcaagctgagcgtgttcaccagcaacaagctgcccctggacctgaaggccctgaagagcaccctgggcttccccctgatcagattcgaggacgccgtgatcaacctggaccccttcaccagagtgcacccctacgagaccaaggagttcatcatcaacgacatcctgaagcacttccaggaggagctgctgagccaggccgccagaatcctgggcagcgtggacttcctgggcaaccccatgggcctgctgaacgacgtgagcgagggcgtgaccggcctgatcaagtacggcaacgtgggcggcctgatcagaaacgtgacccacggcgtgagcaacagcgccgccaagttcgccggcaccctgagcgacggcctgggcaagaccatggacaacagacaccagagcgagagagagtacatcagataccacgccgccaccagcggcgagcacctggtggccggcatccacggcctggcccacggcatcatcggcggcctgaccagcgtgatcaccagcaccgtggagggcgtgaagaccgagggcggcgtgagcggcttcatcagcggcctgggcaagggcctggtgggcaccgtgaccaagcccgtggccggcgccctggacttcgccagcgagaccgcccaggccgtgagagacaccgccaccctgagcggccccagaacccaggcccagagagtgagaaagcccagatgctgcaccggcccccagggcctgctgcccagatacagcgagagccaggccgagggccaggagcagctgttcaagctgaccgacaacatccaggacgagttcttcatcgccgtggagaacatcgacagctactgcgtgctgatcagcagcaaggccgtgtacttcctgaagagcggcgactacgtggacagagaggccatcttcctggaggtgaagtacgacgacctgtaccactgcctggtgagcaaggaccacggcaaggtgtacgtgcaggtgaccaagaaggccgtgagcaccagcagcggcgtgagcatccccggccccagccaccagaagcccatggtgcacgtgaagagcgaggtgctggccgtgaagctgagccaggagatcaactacgccaagagcctgtactacgagcagcagctgatgctgagactgagcgagaacagagagcagctggagctggacagctag

SEQ ID NO: 25927 - DNA, 13167 bp, Artificial Sequence
  Description of Artificial Sequence: Synthetic coding sequence
atgctggagggcctggtggcctgggtgctgaacacctacctgggcaagtacgtgaacaacctgaacaccgaccagctgagcgtggccctgctgaagggcgccgtggagctggagaacctgcccctgaagaaggacgccctgaaggagctggagctgcccttcgaggtgaaggccggcttcatcggcaaggtgaccctgcagatccccttctacagaccccacgtggacccctgggtgatcagcatcagcagcctgcacctgatcggcgcccccgagaagatccaggacttcaacgacgagaaggagaagctgctggagagagagagaaagaaggccctgctgcaggccctggaggagaagtggaagaacgacagacagcagaagggcgagagctactggtacagcgtgaccgccagcgtggtgaccagaatcgtggagaacatcgagctgaagatccaggacgtgcacctgagattcgaggacggcgtgaccaaccccagccaccccttcgccttcggcatctgcatcaagaacgtgagcatgcagaacgccgtgaacgagcccgtgcagaagctgatgagaaagaagcagctggacgtggccgagttcagcatctactgggacgtggactgcaccctgctgggcgacctgccccagatggagctgcaggaggccatggccagaagcatggagagcagaagccaccactacgtgctggagcccgtgttcgccagcgccctgctgaagagaaactgcagcaagaagcccctgagaagcagacacagccccagaatcgactgcgacatccagctggagaccatccccctgaagctgagccagctgcagtacagacagatcatggagttcctgaaggagctggagagaaaggagagacaggtgaagttcagaagatggaagcccaaggtggccatcagcaagaactgcagagagtggtggtacttcgccctgaacgccaacctgtacgagatcagagagcagagaaagagatgcacctgggacttcatgctgcacagagccagagacgccgtgagctacaccgacaagtacttcaacaagctgaagggcggcctgctgagcaccgacgacaaggaggagatgtgcagaatcgaggaggagcagagcttcgaggagctgaagatcctgagagagctggtgcacgacagattccacaagcaggaggagctggccgagagcctgagagagccccagttcgacagccccggcgcctgccccggcgcccccgagcccggcggcggcagcggcatgctgcagtacctgcagagctggttccccggctggggcggctggtacggccagcagacccccgagggcaacgtggtggagggcctgagcgccgagcagcaggagcagtggatccccgaggagatcctgggcaccgaggagttcttcgaccccaccgccgacgccagctgcatgaacacctacaccaagagagaccacgtgttcgccaagctgaacctgcagctgcagagaggcaccgtgaccctgctgcacaaggagcagggcaccccccagatgaacgagagcgccttcatgcagctggagttcagcgacgtgaagctgctggccgagagcctgcccagaagaaacagcagcctgctgagcgtgagactgggcggcctgttcctgagagacctggccaccgagggcaccatgttccccctgctggtgttccccaacccccagaaggaggtgggcagagtgagccagagcttcggcctgcagaccaccagcgccgacagaagcgaccactaccccgccgccgaccccgacggccccgtgttcgagatgctgtacgagagaaaccccgcccacagccacttcgagagaagactgaacgtgagcaccagacccctgaacatcatctacaacccccaggccatcaagaaggtggccgacttcttctacaagggcaaggtgcacaccagcggcttcggctaccagagcgagctggagctgagagtggccgaggccgccagaagacagtacaacaagctgaagatgcagaccaaggccgagatcagacagaccctggacagactgctggtgggcgacttcatcgaggagagcaagagatggaccgtgagactggacatcagcgccccccaggtgatcttccccgacgacttcaagttcaagaaccccgtgctggtggtggtggacctgggcagaatgctgctgaccaacacccaggacaacagcagaagaaagagcagagacggcagcgccagcgaggagacccagttcagcgacgacgagtacaagacccccctggccaccccccccaacacccccccccccgagagcagcagcagcaacggcgagaagaccccccccttcagcggcgtggagttcagcgaggagcagctgcaggcccacctgatgagcaccaagatgtacgagagatacagcctgagcttcatggacctgcagatcatggtgggcagagtgaaggacaactggaagcacgtgcaggacatcgacgtgggccccacccacgtggtggagaagttcaacgtgcacctgcagctggagagaagactgatctacaccagcgaccccaagtaccccggcgccgtgctgagcggcaacctgcccgacctgaagatccacatcaacgaggacaagatcagcgccctgaagaactgcttcgccctgctgaccacccccgagatgaagaccagcgacacccagatcaaggagaagatcttcccccaggaggagcagagaggcagcctgcaggacagcgtgatgaacctgacccagagcatcgtgctgctggagcagcacaccagagaggtgctggtggagagccagctgctgctggccgagttcaaggtgaactgcatgcagctgggcgtggagagcaacggcagatacatcagcgtgctgaaggtgttcggcaccaacgcccacttcgtgaagagaccctacgacgccgaggtgagcctgaccgtgcacggcctgctgctggtggacaccatgcagacctacggcgccgacttcgacctgctgatggccagccacaagaacctgagcttcgacatccccaccggcagcctgagagacagcagagcccagagccccgtgagcggccccaacgtggcccacctgaccgacggcgccaccctgaacgacagaagcgccaccagcgtgagcctggacaagatcctgaccaaggagcaggagagcctgatcaagctggagtaccagttcgtgagcagcgagtgccccagcatgaacctggacagcaccctgcaggtgatcagcctgcaggtgaacaacctggacatcatcctgaaccccgagaccatcgtggagctgatcggcttcctgcagaagagcttccccaaggagaaggacgacctgagcccccagcccctgatgaccgacttcgagagaagcttcagagagcagggcacctaccagagcacctacgagcagaacaccgaggtggccgtggagatccacagactgaacctgctgctgctgagaaccgtgggcatggccaacagagagaagtacggcagaaagatcgccaccgccagcatcggcggcaccaaggtgaacgtgagcatgggcagcaccttcgacatgaacggcagcctgggctgcctgcagctgatggacctgacccaggacaacgtgaagaaccagtacgtggtgagcatcggcaacagcgtgggctacgagaacatcatcagcgacatcggctacttcgagagcgtgttcgtgagaatggaggacgccgccctgaccgaggccctgagcttcaccttcgtggagagaagcaagcaggagtgcttcctgaacctgaagatggccagcctgcactacaaccacagcgccaagttcctgaaggagctgaccctgagcatggacgagctggaggagaacttcagaggcatgctgaagagcgccgccaccaaggtgaccaccgtgctggccaccaagaccgccgagtacagcgagatggtgagcctgttcgagacccccagaaagaccagagagcccttcatcctggaggagaacgagatctacggcttcgacctggccagcagccacctggacaccgtgaagctgatcctgaacatcaacatcgagagccccgtggtgagcatccccagaaagcccggcagccccgagctgctggtgggccacctgggccagatcttcatccagaacttcgtggccggcgacgacgagagcagaagcgacagactgcaggtggagatcaaggacatcaagctgtacagcctgaactgcacccagctggccggcagagaggccgtgggcagcgagggcagcagaatgttctgcccccccagcggcagcggcagcgccaacagccaggaggaggcccacttcaccagacacgacttcttcgagagcctgcacagaggccaggccttccacatcctgaacaacaccaccatccagttcaagctggagaagatccccatcgagagagagagcgagctgaccttcagcctgagccccgacgacctgggcaccagcagcatcatgaagatcgagggcaagttcgtgaaccccgtgcaggtggtgctggccaagcacgtgtacgagcaggtgctgcagaccctggacaacctggtgtacagcgaggacctgaacaagtaccccgccagcgccaccagcagcccctgccccgacagccccctgccccccctgagcacctgcggcgagagcagcgtggagagaaaggagaacggcctgttcagccacagcagcctgagcaacaccagccagaagagcctgagcgtgaaggaggtgaagagcttcacccagatccaggccaccttctgcatcagcgagctgcaggtgcagctgagcggcgacctgaccctgggcgcccagggcctggtgagcctgaagttccaggacttcgaggtggagttcagcaaggaccacccccagaccctgagcatccagatcgccctgcacagcctgctgatggaggacctgctggagaagaaccccgacagcaagtacaagaacctgatggtgagcagaggcgcccccaagcccagcagcctggcccagaaggagtacctgagccagagctgccccagcgtgagcaacgtggagtaccccgacatgcccagaagcctgcccagccacatggaggaggcccccaacgtgttccagctgtaccagagacccaccagcgccagcagaaagaagcagaaggaggtgcaggacaaggactaccccctgacccccccccccagccccaccgtggacgagcccaagatcctggtgggcaagagcaagttcgacgacagcctggtgcacatcaacatcttcctggtggacaagaagcaccccgagttcagcagcagctacaacagagtgaacagaagcatcgacgtggacttcaactgcctggacgtgctgatcaccctgcagacctgggtggtgatcctggacttcttcggcatcggcagcaccgccgacaaccacgccatgagactgccccccgagggcatcctgcacaacgtgaagctggagccccacgccagcatggagagcggcctgcaggaccccgtgaacaccaagctggacctgaaggtgcacagcctgagcctggtgctgaacaagaccaccagcgagctggccaaggccaacgtgagcaagctggtggcccacctggagatgatcgagggcgacctggccctgcagggcagcatcggcagcctgagcctgagcgacctgacctgccacggcgagttctacagagagagattcaccaccagcggcgaggaggccctgatcttccagaccttcaagtacggcagacccgaccccctgctgagaagagagcacgacatcagagtgagcctgagaatggccagcgtgcagtacgtgcacacccagagattccaggccgaggtggtggccttcatccagcacttcacccagctgcaggacgtgctgggcagacagagagccgccatcgagggccagaccgtgagagaccaggcccagagatgcagcagagtgctgctggacatcgaggccggcgcccccgtgctgctgatccccgagagcagcagaagcaacaacctgatcgtggccaacctgggcaagctgaaggtgaagaacaagttcctgttcgccggcttccccggcaccttcagcctgcaggacaaggagagcgtgcccagcgccagccccaccggcatccccaagcacagcctgagaaagaccaccagcaccgaggagcccagaggcacccacagccagggccagttcaccatgcccctggccggcatgagcctgggcagcctgaagagcgagttcgtgcccagcaccagcaccaagcagcagggcccccagcccaccctgagcgtgggccaggagagcagcagccccgaggaccacgtgtgcctgctggactgcgtggtggtggacctgcaggacatggacatcttcgccgccgagagacaccccagagagtacagcaaggcccccgaggacagcagcggcgacctgatcttccccagctacttcgtgagacagaccggcggcagcctgctgaccgagccctgcagactgaagctgcaggtggagagaaacctggacaaggagatcagccacaccgtgcccgacatcagcatccacggcaacctgagcagcgtgcactgcagcctggacctgtacaagtacaagctgatcagaggcctgctggagaacaacctgggcgagcccatcgaggagttcatgagaccctacgacctgcaggaccccagaatccacaccgtgctgagcggcgaggtgtacacctgcatgtgcttcctgatcgacatggtgaacgtgagcctggagctgaaggaccccaagagaaaggagggcgccggcagcctggccagattcgacttcaagaagtgcaagctgctgtacgagagcttcagcaaccagaccaagagcatcaacctggtgagccacagcatgatggccttcgacaccagatacgccggccagaagaccagccccggcatgaccaacgtgttcagctgcatcttccagcccgccaagaacagcagcaccacccagggcagcatccagatcgagctgcacttcagaagcaccaaggacagcagctgcttcaccgtggtgctgaacaacctgagagtgttcctgatcttcgactggctgctgctggtgcacgacttcctgcacacccccagcgacatcaagaagcagaaccacgtgacccccagcagacacagaaacagcagcagcgagagcgccatcgtgcccaagaccgtgaagagcggcgtggtgaccaagagaagcagcctgcccgtgagcaacgagagacacctggaggtgaaggtgaacgtgaccggcaccgagttcgtggtgatcgaggacgtgagctgcttcgacaccaacgccatcatcctgaagggcaccaccgtgctgacctacaagcccagattcgtggacagacccttcagcggcagcctgttcggcatcgaggtgttcagctgcagactgggcaacgagcacgacaccgccctgagcatcgtggaccccgtgcagatccagatggagctggtgggcaacagcagctaccagaacagcagcggcctgatggacgccttcaacagcgaggacttcccccccgtgctggagatccagctgcaggccctggacatcagactgagctacaacgacgtgcagctgttcctggccatcgccaagagcatccccgagcaggccaacgccgccgtgcccgacagcgtggccctggagagcgacagcgtgggcacctacctgcccggcgccagcagagtgggcgaggagatcagagagggcaccagacacaccctggaccccgtgctggagctgcagctggccagactgcaggagctgggcttcagcatggacgactgcagaaaggccctgctggcctgccagggccagctgaagaaggccgccagctggctgttcaagaacgccgagcccctgaagagcctgagcctggccagcaccagcagagacagccccggcgccgtggccgcccccctgatcagcggcgtggagatcaaggccgagagcgtgtgcatctgcttcatcgacgactgcatggactgcgacgtgcccctggccgagctgaccttcagcagactgaacttcctgcagagagtgagaaccagccccgagggctacgcccacttcaccctgagcggcgactactacaacagagccctgagcggctgggagcccttcatcgagccctggccctgcagcgtgagctggcagcagcaggccgccagcagactgcacccccccagactgaagctggaggccaaggccaagcccagactggacatcaacatcaccagcgtgctgatcgaccagtacgtgagcaccaaggagagctggatggccgactactgcaaggacgacaaggacatcgagagcgccaagagcgaggactggatgggcagcagcgtggaccccccctgcttcggccagagcctgcccctggtgtacctgagaaccagaagcaccgccagcctgaccaacctggagcaccagatctacgccagagccgaggtgaagacccccaagagaagacagcccttcgtgcccttcgccctgagaaaccacaccggctgcaccctgtggttcgccaccctgaccaccacccccaccagagccgccctgagccacagcggcagccccggcgtggtgcccgagggcaacggcaccttcctggacgacacccacaacgtgagcgagtggagagaggtgctgaccggcgaggagatccccttcgagttcgaggccagaggcaagctgagacacagacacacccacgacctgagaatccaccagctgcaggtgagagtgaacggctgggagcaggtgagccccgtgagcgtggacaaggtgggcaccttcttcagatacgccgcccccgacaagaacagcagcagcagcaccatcggcagccccagcagcagaaccaacatcatccacccccaggtgtacttcagcagcctgccccccgtgagagtggtgttcgccgtgaccatggagggcagcgccagaaaggtgatcaccgtgagaagcgccctgatcgtgagaaacagactggagacccccatggagctgagactggacagccccagcgcccccgacaagcccgtggtgctgcccgccatcatgcccggcgacagcttcgccgtgcccctgcacctgaccagctggagactgcaggccagacccaagggcctgggcgtgttcttctgcaaggcccccatccactggaccaacgtggtgaagaccgccgagatcagcagcagcaagagagagtgccacagcatggacaccgagaagagcagattcttcagattctgcgtggccatcaagaaggagaactaccccgactacatgcccagcaacatcttcagcgacagcgccaagcagatcttcagacagcccggccacaccatctacctgctgcccaccgtggtgatctgcaacctgctgccctgcgagctggacttctacgtgaagggcatgcccatcaacggcaccctgaagcccggcaaggaggccgccctgcacaccgccgacaccagccagaacatcgagctgggcgtgagcctggagaacttccccctgtgcaaggagctgctgatcccccccggcacccagaactacatggtgagaatgagactgtacgacgtgaacagaagacagctgaacctgaccatcagaatcgtgtgcagagccgagggcagcctgaagatcttcatcagcgccccctactggctgatcaacaagaccggcctgcccctgatcttcagacaggacaacgccaagaccgacgccgccggccagttcgaggagcacgagctggccagaagcctgagccccctgctgttctgctacgccgacaaggagcagcccaacctgtgcaccatgagaatcggcagaggcatccaccccgagggcatgcccggctggtgccagggcttcagcctggacggcggcagcggcgtgagagccctgaaggtgatccagcagggcaacagacccggcctgatctacaacatcggcatcgacgtgaagaagggcagaggcagatacatcgacacctgcatggtgatcttcgcccccagatacctgctggacaacaagagcagccacaagctggccttcgcccagagagagttcgccagaggccagggcaccgccaaccccgagggctacatcagcaccctgcccggcagcagcgtggtgttccactggcccagaaacgactacgaccagctgctgtgcgtgagactgatggacgtgcccaactgcatctggagcggcggcttcgaggtgaacaagaacaacagcttccacatcaacatgagagacaccctgggcaagtgcttcttcctgagagtggagatcaccctgagaggcgccacctacagaatcagcttcagcgacaccgaccagctgcccccccccttcagaatcgacaacttcagcaaggtgcccgtggtgttcacccagcacggcgtggccgagcccagactgagaaccgaggtgaagcccatgaccagcctggactacgcctgggacgagcccaccctgccccccttcatcaccctgaccgtgaagggcgccggcagcagcgagatcaactgcaacatgaacgacttccaggacaacagacagctgtactacgagaacttcatctacatcgccgccacctacaccttcagcggcctgcaggagggcaccggcagacccgtggccagcaacaaggccatcacctgcgccgagctggtgctggacgtgagccccaagacccagagagtgatcctgaagaagaaggagcccggcaagagaagccagctgtggagaatgaccggcaccggcatgctggcccacgagggcagcagcgtgccccacaaccccaacaagcccagcgccgccagaagcaccgagggcagcgccatcctggacatcgccggcctggccgccgtgaccgacaacagatacgagcccctgatgctgagaaagcccgacagaagaagaagcaccacccagacctggagcttcagagagggcaagctgacctgcggcctgcacggcctggtggtgcaggccaagggcggcctgagcggcctgttcgacggcgccgaggtggtgctgggccccgacaccagcatggagctgctgggccccgtgccccccgagcagcagttcatcaaccagaagatgagacccggcagcggcatgctgagcatcagagtgatccccgacggccccaccagagccctgcagatcaccgacttctgccacagaaagagcagcagaagctacgaggtggacgagctgcccgtgaccgagcaggagctgcagaagctgaagaaccccgacaccgagcaggagctggaggtgctggtgagactggagggcggcatcggcctgagcctgatcaacaaggtgcccgaggagctggtgttcgccagcctgaccggcatcaacgtgcactacacccagctggccaccagccacatgctggagctgagcatccaggacgtgcaggtggacaaccagctgatcggcaccacccagcccttcatgctgtacgtgacccccctgagcaacgagaacgaggtgatcgagaccggccccgccgtgcaggtgaacgccgtgaagttccccagcaagagcgccctgaccaacatctacaagcacctgatgatcaccgcccagagattcaccgtgcagatcgaggagaagctgctgctgaagctgctgagcttcttcggctacgaccaggccgagagcgaggtggagaagtacgacgagaacctgcacgagaagaccgccgagcagggcggcacccccatcagatactacttcgagaacctgaagatcagcatcccccagatcaagctgagcgtgttcaccagcaacaagctgcccctggacctgaaggccctgaagagcaccctgggcttccccctgatcagattcgaggacgccgtgatcaacctggaccccttcaccagagtgcacccctacgagaccaaggagttcatcatcaacgacatcctgaagcacttccaggaggagctgctgagccaggccgccagaatcctgggcagcgtggacttcctgggcaaccccatgggcctgctgaacgacgtgagcgagggcgtgaccggcctgatcaagtacggcaacgtgggcggcctgatcagaaacgtgacccacggcgtgagcaacagcgccgccaagttcgccggcaccctgagcgacggcctgggcaagaccatggacaacagacaccagagcgagagagagtacatcagataccacgccgccaccagcggcgagcacctggtggccggcatccacggcctggcccacggcatcatcggcggcctgaccagcgtgatcaccagcaccgtggagggcgtgaagaccgagggcggcgtgagcggcttcatcagcggcctgggcaagggcctggtgggcaccgtgaccaagcccgtggccggcgccctggacttcgccagcgagaccgcccaggccgtgagagacaccgccaccctgagcggccccagaacccaggcccagagagtgagaaagcccagatgctgcaccggcccccagggcctgctgcccagatacagcgagagccaggccgagggccaggagcagctgttcaagctgaccgacaacatccaggacgagttcttcatcgccgtggagaacatcgacagctactgcgtgctgatcagcagcaaggccgtgtacttcctgaagagcggcgactacgtggacagagaggccatcttcctggaggtgaagtacgacgacctgtaccactgcctggtgagcaaggaccacggcaaggtgtacgtgcaggtgaccaagaaggccgtgagcaccagcagcggcgtgagcatccccggccccagccaccagaagcccatggtgcacgtgaagagcgaggtgctggccgtgaagctgagccaggagatcaactacgccaagagcctgtactacgagcagcagctgatgctgagactgagcgagaacagagagcagctggagctggacagctag

SEQ ID NO: 25928 - DNA, 579 bp, Artificial Sequence
  Description of Artificial Sequence: Synthetic coding sequence
atgctgctggaggagaccggcctgaccccccaggagacctgcctgagccccagaagaccccacagatggcagagaacccaggcccagagagtgagaaagcccagatgctgcaccggcccccagggcctgctgcccagatacagcgagagccaggccgagggccaggagcagctgttcaagctgaccgacaacatccaggacgagttcttcatcgccgtggagaacatcgacagctactgcgtgctgatcagcagcaaggccgtgtacttcctgaagagcggcgactacgtggacagagaggccatcttcctggaggtgaagtacgacgacctgtaccactgcctggtgagcaaggaccacggcaaggtgtacgtgcaggtgaccaagaaggccgtgagcaccagcagcggcgtgagcatccccggccccagccaccagaagcccatggtgcacgtgaagagcgaggtgctggccgtgaagctgagccaggagatcaactacgccaagagcctgtactacgagcagcagctgatgctgagactgagcgagaacagagagcagctggagctggacagctag

SEQ ID NO: 25929 - DNA, 1161 bp, Artificial Sequence
  Description of Artificial Sequence: Synthetic coding sequence
atgagaggcgagaagctgagcaaggccctgaagagcaccctgggcttccccctgatcagattcgaggacgccgtgatcaacctggaccccttcaccagagtgcacccctacgagaccaaggagttcatcatcaacgacatcctgaagcacttccaggaggagctgctgagccaggccgccagaatcctgggcagcgtggacttcctgggcaaccccatgggcctgctgaacgacgtgagcgagggcgtgaccggcctgatcaagtacggcaacgtgggcggcctgatcagaaacgtgacccacggcgtgagcaacagcgccgccaagttcgccggcaccctgagcgacggcctgggcaagaccatggacaacagacaccagagcgagagagagtacatcagataccacgccgccaccagcggcgagcacctggtggccggcatccacggcctggcccacggcatcatcggcggcctgaccagcgtgatcaccagcaccgtggagggcgtgaagaccgagggcggcgtgagcggcttcatcagcggcctgggcaagggcctggtgggcaccgtgaccaagcccgtggccggcgccctggacttcgccagcgagaccgcccaggccgtgagagacaccgccaccctgagcggccccagaacccaggcccagagagtgagaaagcccagatgctgcaccggcccccagggcctgctgcccagatacagcgagagccaggccgagggccaggagcagctgttcaagctgaccgacaacatccaggacgagttcttcatcgccgtggagaacatcgacagctactgcgtgctgatcagcagcaaggccgtgtacttcctgaagagcggcgactacgtggacagagaggccatcttcctggaggtgaagtacgacgacctgtaccactgcctggtgagcaaggaccacggcaaggtgtacgtgcaggtgaccaagaaggccgtgagcaccagcagcggcgtgagcatccccggccccagccaccagaagcccatggtgcacgtgaagagcgaggtgctggccgtgaagctgagccaggagatcaactacgccaagagcctgtactacgagcagcagctgatgctgagactgagcgagaacagagagcagctggagctggacagctag

SEQ ID NO: 25930 - DNA, 378 bp, Artificial Sequence
  Description of Artificial Sequence: Synthetic coding sequence
gagttcatcgaggagctgctgagcccccccttcggcggcctggtggccttcgtgaaggaggccgaggccctgatcgagagaggccaggccgagagactgagaggcgaggaggccagagtgacccagctgatcagaggcttcggcagcagctggaagagcagcgtggagagcctgagccaggacgtgatgagaagcttcaccaacttcagaaacggcaccagcatcatccagggcgccctgacccagctgatccagctgtaccacagattccacagagtgctgagccagccccagctgagagccctgcccgccagagccgagctgatcaacatccaccacctgatggtggagctgaagaagcacaagcccaacttctag

SEQ ID NO: 25931 - DNA, 378 bp, Artificial Sequence; identical to SEQ ID NO: 25930
  Description of Artificial Sequence: Synthetic coding sequence

SEQ ID NO: 25932 - DNA, 1797 bp, Artificial Sequence
  Description of Artificial Sequence: Synthetic coding sequence
atggagcagatgctgggcgccttccagagcgacctgagcagcatcagcagcgagatcagaaccctgcaggagcagagcggcgccatgaacatcagactgagaaacagacaggccgtgagaggcaagctgggcgagctggtggacggcctggtggtgcccagcgccctggtgaccgccatcctggaggcccccgtgaccgagcccagattcctggagcagctgcaggagctggacgccaaggccgccgccgtgagagagcaggaggccagaggcaccgccgcctgcgccgacgtgagaggcgtgctggacagactgagagtgaaggccgtgaccaagatcagagagttcatcctgcagaagatctacagcttcagaaagcccatgaccaactaccagatcccccagaccgccctgctgaagtacagattcttctaccagttcctgctgggcaacgagagagccaccgccaaggagatcagagacgagtacgtggagaccctgagcaagatctacctgagctactacagaagctacctgggcagactgatgaaggtgcagtacgaggaggtggccgagaaggacgacctgatgggcgtggaggacaccgccaagaagggcttcttcagcaagcccagcctgagaagcagaaacaccatcttcaccctgggcaccagaggcagcgtgatcagccccaccgagctggaggcccccatcctggtgccccacaccgcccagagaggcgagcagagataccccttcgaggccctgttcagaagccagcactacgccctgctggacaacagctgcagagagtacctgttcatctgcgagttcttcgtggtgagcggccccgccgcccacgacctgttccacgccgtgatgggcagaaccctgagcatgaccctgaagcacctggacagctacctggccgactgctacgacgccatcgccgtgttcctgtgcatccacatcgtgctgagattcagaaacatcgccgccaagagagacgtgcccgccctggacagatactgggagcaggtgctggccctgctgtggcccagattcgagctgatcctggagatgaacgtgcagagcgtgagaagcaccgacccccagagactgggcggcctggacaccagaccccactacatcaccagaagatacgccgagttcagcagcgccctggtgagcatcaaccagaccatccccaacgagagaaccatgcagctgctgggccagctgcaggtggaggtggagaacttcgtgctgagagtggccgccgagttcagcagcagaaaggagcagctggtgttcctgatcaacaactacgacatgatgctgggcgtgctgatggagagagccgccgacgacagcaaggaggtggagagcttccagcagctgctgaacgccagaacccaggagttcatcgaggagctgctgagcccccccttcggcggcctggtggccttcgtgaaggaggccgaggccctgatcgagagaggccaggccgagagactgagaggcgaggaggccagagtgacccagctgatcagaggcttcggcagcagctggaagagcagcgtggagagcctgagccaggacgtgatgagaagcttcaccaacttcagaaacggcaccagcatcatccagggcgccctgacccagctgatccagctgtaccacagattccacagagtgctgagccagccccagctgagagccctgcccgccagagccgagctgatcaacatccaccacctgatggtggagctgaagaagcacaagcccaacttctag

SEQ ID NO: 25933 - DNA, 1797 bp, Artificial Sequence; identical to SEQ ID NO: 25932
  Description of Artificial Sequence: Synthetic coding sequence

SEQ ID NO: 25934 - DNA, 2106 bp, Artificial Sequence
  Description of Artificial Sequence: Synthetic coding sequence
atggaggaggaggagggccccctggccggcggccccggcctgcaggagcccctgcagctgggcgagctggacatcaccagcgacgagttcatcctggacgaggtggacgtgcacatccaggccaacctggaggacgagctggtgaaggaggccctgaagaccggcgtggacctgagacactacagcaagcaggtggagctggagctgcagcagatcgagcagaagagcatcagagactacatccaggagagcgagaacatcgccagcctgcacaaccagatcaccgcctgcgacgccgtgctggagagaatggagcagatgctgggcgccttccagagcgacctgagcagcatcagcagcgagatcagaaccctgcaggagcagagcggcgccatgaacatcagactgagaaacagacaggccgtgagaggcaagctgggcgagctggtggacggcctggtggtgcccagcgccctggtgaccgccatcctggaggcccccgtgaccgagcccagattcctggagcagctgcaggagctggacgccaaggccgccgccgtgagagagcaggaggccagaggcaccgccgcctgcgccgacgtgagaggcgtgctggacagactgagagtgaaggccgtgaccaagatcagagagttcatcctgcagaagatctacagcttcagaaagcccatgaccaactaccagatcccccagaccgccctgctgaagtacagattcttctaccagttcctgctgggcaacgagagagccaccgccaaggagatcagagacgagtacgtggagaccctgagcaagatctacctgagctactacagaagctacctgggcagactgatgaaggtgcagtacgaggaggtggccgagaaggacgacctgatgggcgtggaggacaccgccaagaagggcttcttcagcaagcccagcctgagaagcagaaacaccatcttcaccctgggcaccagaggcagcgtgatcagccccaccgagctggaggcccccatcctggtgccccacaccgcccagagaggcgagcagagataccccttcgaggccctgttcagaagccagcactacgccctgctggacaacagctgcagagagtacctgttcatctgcgagttcttcgtggtgagcggccccgccgcccacgacctgttccacgccgtgatgggcagaaccctgagcatgaccctgaagcacctggacagctacctggccgactgctacgacgccatcgccgtgttcctgtgcatccacatcgtgctgagattcagaaacatcgccgccaagagagacgtgcccgccctggacagatactgggagcaggtgctggccctgctgtggcccagattcgagctgatcctggagatgaacgtgcagagcgtgagaagcaccgacccccagagactgggcggcctggacaccagaccccactacatcaccagaagatacgccgagttcagcagcgccctggtgagcatcaaccagaccatccccaacgagagaaccatgcagctgctgggccagctgcaggtggaggtggagaacttcgtgctgagagtggccgccgagttcagcagcagaaaggagcagctggtgttcctgatcaacaactacgacatgatgctgggcgtgctgatggagagagccgccgacgacagcaaggaggtggagagcttccagcagctgctgaacgccagaacccaggagttcatcgaggagctgctgagcccccccttcggcggcctggtggccttcgtgaaggaggccgaggccctgatcgagagaggccaggccgagagactgagaggcgaggaggccagagtgacccagctgatcagaggcttcggcagcagctggaagagcagcgtggagagcctgagccaggacgtgatgagaagcttcaccaacttcagaaacggcaccagcatcatccagggcgccctgacccagctgatccagctgtaccacagattccacagagtgctgagccagccccagctgagagccctgcccgccagagccgagctgatcaacatccaccacctgatggtggagctgaagaagcacaagcccaacttctag

SEQ ID NO: 25935 - DNA, 2106 bp, Artificial Sequence; identical to SEQ ID NO: 25934
  Description of Artificial Sequence: Synthetic coding sequence

SEQ ID NO: 25936 - DNA, 1797 bp, Artificial Sequence; identical to SEQ ID NO: 25932
  Description of Artificial Sequence: Synthetic coding sequence

SEQ ID NO: 25937 - DNA, 2106 bp, Artificial Sequence; identical to SEQ ID NO: 25934
  Description of Artificial Sequence: Synthetic coding sequence

SEQ ID NO: 25938 - DNA, 2013 bp, Artificial Sequence
  Description of Artificial Sequence: Synthetic coding sequence
atgatggaggaggaggagctggagttcgtggaggagctggaggccgtgctgcagctgacccccgaggtgcagctggccatcgagcaggtgttccccagccaggaccccctggacagagccgacttcaacgccgtggagtacatcaacaccctgttccccaccgagcagagcctggccaacatcgacgaggtggtgaacaagatcagactgaagatcagaagactggacgacaacatcagaaccgtggtgagaggccagaccaacgtgggccaggacggcagacaggtgaaggagatcaccagagacatcaagcagctggaccacgccaagagacacctgaccaccagcatcaccaccctgaaccacctgcacatgctggccggcggcgtggacagcctggaggccatgaccagaagaagacagtacggcgaggtggccaacctgctgcagggcgtgatgaacgtgctggagcacttccacaagtacatgggcatcccccagatcagacagctgagcgagagagtgaaggccgcccagaccgagctgggccagcagatcctggccgacttcgaggaggccttccccagccagggcaccaagagacccggcggccccagcaacgtgctgagagacgcctgcctggtggccaacatcctggaccccagaatcaagcaggagatcatcaagaagttcatcaagcagcacctgagcgagtacctggtgctgttccaggagaaccaggacgtggcctggctggacaagatcgacagaagatacgcctggatcaagagacagctggtggactacgaggagaagtacggcagaatgttccccagagagtggtgcatggccgagagaatcgccgtggagttctgccacgtgaccagagccgagctggccaagatcatgagaaccagagccaaggagatcgaggtgaagctgctgctgttcgccatccagagaaccaccaacttcgagggcttcctggccaagagattcagcggctgcaccctgaccgacggcaccctgaagaagctggagagccccccccccagcaccaaccccttcctggaggacgagcccacccccgagatggaggagctggccaccgagaagggcgacctggaccagcccaagaagcccaaggcccccgacaaccccttccacggcatcgtgagcaagtgcttcgagccccacctgtacgtgtacatcgagagccaggacaagaacctgggcgagctgatcgacagattcgtggccgacttcaaggcccagggcccccccaagcccaacaccgacgagggcggcgccgtgctgcccagctgcgccgacctgttcgtgtactacaagaagtgcatggtgcagtgcagccagctgagcaccggcgagcccatgatcgccctgaccaccatcttccagaagtacctgagagagtacgcctggaagatcctgagcggcaacctgcccaagaccaccaccagcagcggcggcctgaccatcagcagcctgctgaaggagaaggagggcagcgaggtggccaagttcaccctggaggagctgtgcctgatctgcaacatcctgagcaccgccgagtactgcctggccaccacccagcagctggaggagaagctgaaggagaaggtggacgtgagcctgatcgagagaatcaacctgaccggcgagatggacaccttcagcaccgtgatcagcagcagcatccagctgctggtgcaggacctggacgccgcctgcgaccccgccctgaccgccatgagcaagatgcagtggcagaacgtggagcacgtgggcgaccagagcccctacgtgaccagcgtgatcctgcacatcaagcagaacgtgcccatcatcagagacaacctggccagcaccagaaagtacttcacccagttctgcgtgaagttcgccaacagcttcatccccaagttcatcacccacctgttcaagtgcaagcccatcagcatggtgggcgccgagcaggtgagatggacctag

SEQ ID NO: 25939 - DNA, 1644 bp, Artificial Sequence
  Description of Artificial Sequence: Synthetic coding sequence
atgatggaggaggaggagctggagttcgtggaggagctggaggccgtgctgcagctgacccccgaggtgcagctggccatcgagcaggtgttccccagccaggaccccctggacagagccgacttcaacgccgtggagtacatcaacaccctgttccccaccgagcagagcctggccaacatcgacgaggtggtgaacaagatcagactgaagatcagaagactggacgacaacatcagaaccgtggtgagaggccagaccaacgtgggccaggacggcagacaggccctggaggaggcccagaaggccatccagcagctgttcggcaagatcaaggacatcaaggacaaggccgagaagagcgagcagatggtgaaggagatcaccagagacatcaagcagctggaccacgccaagagacacctgaccaccagcatcaccaccctgaaccacctgcacatgctggccggcggcgtggacagcctggaggccatgaccagaagaagacagtacggcgaggtggccaacctgctgcagggcgtgatgaacgtgctggagcacttccacaagtacatgggcatcccccagatcagacagctgagcgagagagtgaaggccgcccagaccgagctgggccagcagatcctggccgacttcgaggaggccttccccagccagggcaccaaggtggcctggctggacaagatcgacagaagatacgcctggatcaagagacagctggtggactacgaggagaagtacggcagaatgttccccagagagtggtgcatggccgagagaatcgccgtggagttctgccacgtgaccagagccgagctggccaagatcatgagaaccagagccaaggagatcgaggtgaagctgctgctgttcgccatccagagaaccaccaacttcgagggcttcctggccaagagattcagcggctgcaccctgaccgacggcaccctgaagaagctggagagccccccccccagcaccaaccccttcctggaggacgagcccacccccgagatggaggagctggccaccgagaagggcgacctggaccagcccaagaagcccaaggcccccgacaaccccttccacggcatcgtgagcaagtgcttcgagccccacctgtacgtgtacatcgagagccaggacaagaacctgggcgagctgatcgacagattcgtggccgacttcaaggcccagggcccccccaagcccaacaccgacgagggcggcgccgtgctgcccagctgcgccgacctgttcgtgtactacaagaagtgcatggtgcagtgcagccagctgagcaccggcgagcccatgatcgccctgaccaccatcttccagaagtacctgagagagtacgcctggaagatcctgagcggcaacctgcccaagaccaccaccagcagcggcggcctgaccatcagcagcctgctgaaggagaaggagggcagcgaggtggccaagttcaccctggaggagctgtgcctgatctgcaacatcctgagcaccgccgagtactgcctggccaccacccagcagctggaggagaagctgaaggagaaggtggacagacacctgcagcagtacagcgccgccggcagcggcagcggctgctgcctgtag

SEQ ID NO: 25940 - DNA, 1269 bp, Artificial Sequence
  Description of Artificial Sequence: Synthetic coding sequence
atgatggaggaggaggagctggagttcgtggaggagctggaggccgtgctgcagctgacccccgaggtgcagctggccatcgagcaggtgttccccagccaggaccccctggacagagccgacttcaacgccgtggagtacatcaacaccctgttccccaccgagcagagcctggccaacatcgacgaggtggtgaacaagatcagactgaagatcagaagactggacgacaacatcagaaccgtggtgagaggccagaccaacgtgggccaggacggcagacagaagaagctggagagccccccccccagcaccaaccccttcctggaggacgagcccacccccgagatggaggagctggccaccgagaagggcgacctggaccagcccaagaagcccaaggcccccgacaaccccttccacggcatcgtgagcaagtgcttcgagccccacctgtacgtgtacatcgagagccaggacaagaacctgggcgagctgatcgacagattcgtggccgacttcaaggcccagggcccccccaagcccaacaccgacgagggcggcgccgtgctgcccagctgcgccgacctgttcgtgtactacaagaagtgcatggtgcagtgcagccagctgagcaccggcgagcccatgatcgccctgaccaccatcttccagaagtacctgagagagtacgcctggaagatcctgagcggcaacctgcccaagaccaccaccagcagcggcggcctgaccatcagcagcctgctgaaggagaaggagggcagcgaggtggccaagttcaccctggaggagctgtgcctgatctgcaacatcctgagcaccgccgagtactgcctggccaccacccagcagctggaggagaagctgaaggagaaggtggacgtgagcctgatcgagagaatcaacctgaccggcgagatggacaccttcagcaccgtgatcagcagcagcatccagctgctggtgcaggacctggacgccgcctgcgaccccgccctgaccgccatgagcaagatgcagtggcagaacgtggagcacgtgggcgaccagagcccctacgtgaccagcgtgatcctgcacatcaagcagaacgtgcccatcatcagagacaacctggccagcaccagaaagtacttcacccagttctgcgtgaagttcgccaacagcttcatccccaagttcatcacccacctgttcaagtgcaagcccatcagcatggtgggcgccgagcaggtgagatggacctag

SEQ ID NO: 25941 - DNA, 2499 bp, Artificial Sequence
  Description of Artificial Sequence: Synthetic coding sequence
atgatggaggaggaggagctggagttcgtggaggagctggaggccgtgctgcagctgacccccgaggtgcagctggccatcgagcaggtgttccccagccaggaccccctggacagagccgacttcaacgccgtggagtacatcaacaccctgttccccaccgagcagagcctggccaacatcgacgaggtggtgaacaagatcagactgaagatcagaagactggacgacaacatcagaaccgtggtgagaggccagaccaacgtgggccaggacggcagacaggccctggaggaggcccagaaggccatccagcagctgttcggcaagatcaaggacatcaaggacaaggccgagaagagcgagcagatggtgaaggagatcaccagagacatcaagcagctggaccacgccaagagacacctgaccaccagcatcaccaccctgaaccacctgcacatgctggccggcggcgtggacagcctggaggccatgaccagaagaagacagtacggcgaggtggccaacctgctgcagggcgtgatgaacgtgctggagcacttccacaagtacatgggcatcccccagatcagacagctgagcgagagagtgaaggccgcccagaccgagctgggccagcagatcctggccgacttcgaggaggccttccccagccagggcaccaagagacccggcggccccagcaacgtgctgagagacgcctgcctggtggccaacatcctggaccccagaatcaagcaggagatcatcaagaagttcatcaagcagcacctgagcgagtacctggtgctgttccaggagaaccaggacgtggcctggctggacaagatcgacagaagatacgcctggatcaagagacagctggtggactacgaggagaagtacggcagaatgttccccagagagtggtgcatggccgagagaatcgccgtggagttctgccacgtgaccagagccgagctggccaagatcatgagaaccagagccaaggagatcgaggtgaagctgctgctgttcgccatccagagaaccaccaacttcgagggcttcctggccaagagattcagcggctgcaccctgaccgacggcaccctgaagaagctggagagccccccccccagcaccaaccccttcctggaggacgagcccacccccgagatggaggagctggccaccgagaagggcgacctggaccagcccaagaagcccaaggcccccgacaaccccttccacggcatcgtgagcaagtgcttcgagccccacctgtacgtgtacatcgagagccaggacaagaacctgggcgagctgatcgacagattcgtggccgacttcaaggcccagggcccccccaagcccaacaccgacgagggcggcgccgtgctgcccagctgcgccgacctgttcgtgtactacaagaagtgcatggtgcagtgcagccagctgagcaccggcgagcccatgatcgccctgaccaccatcttccagaagtacctgagagagtacgcctggaagatcctgagcggcaacctgcccaagaccaccaccagcagcggcggcctgaccatcagcagcctgctgaaggagaaggagggcagcgaggtggccaagttcaccctggaggagctgtgcctgatctgcaacatcctgagcaccgccgagtactgcctggccaccacccagcagctggaggagaagctgaaggagaaggtggacgtgagcctgatcgagagaatcaacctgaccggcgagatggacaccttcagcaccgtgatcagcagcagcatccagctgctggtgcaggacctggacgccgcctgcgaccccgccctgaccgccatgagcaagatgcagtggcagaacgtggagcacgtgggcgaccagagcccctacgtgaccagcgtgatcctgcacatcaagcagaacgtgcccatcatcagagacaacctggccagcaccagaaagtacttcacccagttctgcgtgaagttcgccaacagcttcatccccaagttcatcacccacctgttcaagtgcaagcccatcagcatggtgggcgccgagcagctgctgctggacacccacagcctgaagatggtgctgctggacctgcccagcatcagcagccaggtggtgagaaaggcccccgccagctacaccaagatcgtggtgaagggcatgaccagagccgagatgatcctgaaggtggtgatggccccccacgagcccctggtggtgttcgtggacaactacatcaagctgctgaccgactgcaacaccgagaccttccagaagatcctggacatgaagggcctgaagagaagcgagcagagcagcatgctggagctgctgagacagagactgcccgccccccccagcggcgccgagagcagcggcagcctgagcctgaccgcccccacccccgagcaggagagcagcagaatcagaaagctggagaagctgatcaagaagagactgtag

SEQ ID NO: 25942 - DNA, 1506 bp, Artificial Sequence
  Description of Artificial Sequence: Synthetic coding sequence
atgttcagcctgatcgtgaaggccgcccagaccgagctgggccagcagatcctggccgacttcgaggaggccttccccagccagggcaccaagagacccggcggccccagcaacgtgctgagagacgcctgcctggtggccaacatcctggaccccagaatcaagcaggagatcatcaagaagttcatcaagcagcacctgagcgagtacctggtgctgttccaggagaaccaggacgtggcctggctggacaagatcgacagaagatacgcctggatcaagagacagctggtggactacgaggagaagtacggcagaatgttccccagagagtggtgcatggccgagagaatcgccgtggagttctgccacgtgaccagagccgagctggccaagatcatgagaaccagagccaaggagatcgaggtgaagctgctgctgttcgccatccagagaaccaccaacttcgagggcttcctggccaagagattcagcggctgcaccctgaccgacggcaccctgaagaagctggagagccccccccccagcaccaaccccttcctggaggacgagcccacccccgagatggaggagctggccaccgagaagggcgacctggaccagcccaagaagcccaaggcccccgacaaccccttccacggcatcgtgagcaagtgcttcgagccccacctgtacgtgtacatcgagagccaggacaagaacctgggcgagctgatcgacagattcgtggccgacttcaaggcccagggcccccccaagcccaacaccgacgagggcggcgccgtgctgcccagctgcgccgacctgttcgtgtactacaagaagtgcatggtgcagtgcagccagctgagcaccggcgagcccatgatcgccctgaccaccatcttccagaagtacctgagagagtacgcctggaagatcctgagcggcaacctgcccaagaccaccaccagcagcggcggcctgaccatcagcagcctgctgaaggagaaggagggcagcgaggtggccaagttcaccctggaggagctgtgcctgatctgcaacatcctgagcaccgccgagtactgcctggccaccacccagcagctggaggagaagctgaaggagaaggtggacgtgagcctgatcgagagaatcaacctgaccggcgagatggacaccttcagcaccgtgatcagcagcagcatccagctgctggtgcaggacctggacgccgcctgcgaccccgccctgaccgccatgagcaagatgcagtggcagaacgtggagcacgtgggcgaccagagcccctacgtgaccagcgtgatcctgcacatcaagcagaacgtgcccatcatcagagacaacctggccagcaccagaaagtacttcacccagttctgcgtgaagttcgccaacagcttcatccccaagttcatcacccacctgttcaagtgcaagcccatcagcatggtgggcgccgagcaggtgagatggacctag

SEQ ID NO: 25943 - DNA, 387 bp, Artificial Sequence
  Description of Artificial Sequence: Synthetic coding sequence
atggtgctgctggacctgcccagcatcagcagccaggtggtgagaaaggcccccgccagctacaccaagatcgtggtgaagggcatgaccagagccgagatgatcctgaaggtggtgatggccccccacgagcccctggtggtgttcgtggacaactacatcaagctgctgaccgactgcaacaccgagaccttccagaagatcctggacatgaagggcctgaagagaagcgagcagagcagcatgctggagctgctgagacagagactgcccgccccccccagcggcgccgagagcagcggcagcctgagcctgaccgcccccacccccgagcaggagagcagcagaatcagaaagctggagaagctgatcaagaagagactgtag

SEQ ID NO: 25944 - DNA, 2934 bp, Artificial Sequence
  Description of Artificial Sequence: Synthetic coding sequence
atggccagcagccacagcagcagccccgtgccccagggcagcagcagcgacgtgttcttcaagatcgaggtggaccccagcaagcacatcagacccgtgcccagcctgcccgacgtgtgccccaaggagcccaccggcgacagccacagcctgtacgtggcccccagcctggtgaccgaccagcacagatggaccgtgtaccacagcaaggtgaacctgcccgccgccctgaacgaccccagactggccaagagagagagcgacttcttcaccaagacctggggcctggacttcgtggacaccgaggtgatccccagcttctacctgccccagatcagcaaggagcacttcaccgtgtaccagcaggagatcagccagagagagaagatccacgagagatgcaagaacatctgcccccccaaggacaccttcgagagaaccctgctgcacacccacgacaagagcagaaccgacctggagcaggtgcccaagatcttcatgaagcccgacttcgccctggacgacagcctgaccttcaacagcgtgctgccctggagccacttcaacaccgccggcggcaagggcaacagagacgccgccagcagcaagctgctgcaggagaagctgagccactacctggacatcgtggaggtgaacatcgcccaccagatcagcctgagaagcgaggccttcttccacgccatgaccagccagcacgagctgcaggactacctgagaaagaccagccaggccgtgaagatgctgagagacaagatcgcccagatcgacaaggtgatgtgcgagggcagcctgcacatcctgagactggccctgaccagaaacaactgcgtgaaggtgtacaacaagctgaagctgatggccaccgtgcaccagacccagcccaccgtgcaggtgctgctgagcaccagcgagttcgtgggcgccctggacctgatcgccaccacccaggaggtgctgcagcaggagctgcagggcatccacagcttcagacacctgggcagccagctgtgcgagctggagaagctgatcgacaagatgatgatcgccgagttcagcacctacagccacagcgacctgaacagacccctggaggacgactgccaggtgctggaggaggagagactgatcagcctggtgttcggcctgctgaagcagagaaagctgaacttcctggagatctacggcgagaagatggtgatcaccgccaagaacatcatcaagcagtgcgtgatcaacaaggtgagccagaccgaggagatcgacaccgacgtggtggtgaagctggccgaccagatgagaatgctgaacttcccccagtggttcgacctgctgaaggacatcttcagcaagttcaccatcttcctgcagagagtgaaggccaccctgaacatcatccacagcgtggtgctgagcgtgctggacaagaaccagagaaccagagagctggaggagatcagccagcagaagaacgccgccaaggacaacagcctggacaccgaggtggcctacctgatccacgagggcatgttcatcagcgacgccttcggcgagggcgagctgacccccatcgccgtggacaccaccagccagagaaacgccagccccaacagcgagccctgcagcagcgacagcgtgagcgagcccgagtgcaccaccgacagcagcagcagcaaggagcacaccagcagcagcgccatccccggcggcgtggacatcatggtgagcgaggacatgaagctgaccgacagcgagctgggcaagctggccaacaacatccaggagctgctgtacagcgccagcgacatctgccacgacagagccgtgaagttcctgatgagcagagccaaggacggcttcctggagaagctgaacagcatggagttcatcaccctgagcagactgatggagaccttcatcctggacaccgagcagatctgcggcagaaagagcaccagcctgctgggcgccctgcagagccaggccatcaagttcgtgaacagattccacgaggagagaaagaccaagctgagcctgctgctggacaacgagagatggaagcaggccgacgtgcccgccgagttccaggacctggtggacagcctgagcgacggcaagatcgccctgcccgagaagaagagcggcgccaccgaggagagaaagcccgccgaggtgctgatcgtggagggccagcagtacgccgtggtgggcaccgtgctgctgctgatcagaatcatcctggagtactgccagtgcgtggacaacatccccagcgtgaccaccgacatgctgaccagactgagcgacctgctgaagtacttcaacagcagaagctgccagctggtgctgggcgccggcgccctgcaggtggtgggcctgaagaccatcaccaccaagaacctggccctgagcagcagatgcctgcagctgatcgtgcactacatccccgtgatcagagcccacttcgaggccagactgccccccaagcagtacagcatgctgagacacttcgaccacatcaccaaggactaccacgaccacatcgccgagatcagcgccaagctggtggccatcatggacagcctgttcgacaagctgctgagcaagtacgaggtgaaggcccccgtgcccagcgcctgcttcagaaacatctgcaagcagatgaccaagatgcacgaggccatcttcgacctgctgcccgaggagcagacccagatgctgttcctgagaatcaacgccagctacaagctgcacctgaagaagcagctgagccacctgaacgtgatcaacgacggcggcccccagaacggcctggtgaccgccgacgtggccttctacaccggcaacctgcaggccctgaagggcctgaaggacctggacctgaacatggccgagatctgggagcagaagagatag

SEQ ID NO: 25945 - DNA, 2901 bp, Artificial Sequence
  Description of Artificial Sequence: Synthetic coding sequence
atggccagcagccacagcagcagccccgtgccccagggcagcagcagcgacgtgttcttcaagatcgaggtggaccccagcaagcacatcagacccgtgcccagcctgcccgacgtgtgccccaaggagcccaccggcgacagccacagcctgtacgtggcccccagcctggtgaccgaccagcacagatggaccgtgtaccacagcaaggtgaacctgcccgccgccctgaacgaccccagactggccaagagagagagcgacttcttcaccaagacctggggcctggacttcgtggacaccgaggtgatccccagcttctacctgccccagatcagcaaggagcacttcaccgtgtaccagcaggagatcagccagagagagaagatccacgagagatgcaagaacatctgcccccccaaggacaccttcgagagaaccctgctgcacacccacgacaagagcagaaccgacctggagcaggtgcccaagatcttcatgaagcccgacttcgccctggacgacagcctgaccttcaacagcgtgctgccctggagccacttcaacaccgccggcggcaagggcaacagagacgccgccagcagcaagctgctgcaggagaagctgagccactacctggacatcgtggaggtgaacatcgcccaccagatcagcctgagaagcgaggccttcttccacgccatgaccagccagcacgagctgcaggactacctgagaaagaccagccaggccgtgaagatgctgagagacaagatcgcccagatcgacaaggtgatgtgcgagggcagcctgcacatcctgagactggccctgaccagaaacaactgcgtgaaggtgtacaacaagctgaagctgatggccaccgtgcaccagacccagcccaccgtgcaggtgctgctgagcaccagcgagttcgtgggcgccctggacctgatcgccaccacccaggaggtgctgcagcaggagctgcagggcatccacagcttcagacacctgggcagccagctgtgcgagctggagaagctgatcgacaagatgatgatcgccgagttcagcacctacagccacagcgacctgaacagacccctggaggacgactgccaggtgctggaggaggagagactgatcagcctggtgttcggcctgctgaagcagagaaagctgaacttcctggagatctacggcgagaagatggtgatcaccgccaagaacatcatcaagcagtgcgtgatcaacaaggtgagccagaccgaggagatcgacaccgacgtggtggtgaagctggccgaccagatgagaatgctgaacttcccccagtggttcgacctgctgaaggacatcttcagcaagttcaccatcttcctgcagagagtgaaggccaccctgaacatcatccacagcgtggtgctgagcgtgctggacaagaaccagagaaccagagagctggaggagatcagccagcagaagaacgccgccaaggacaacagcctggacaccgaggtggcctacctgatccacgagggcatgttcatcagcgacgccttcggcgagggcgagctgacccccatcgccgtggacaccaccagccagagaaacgccagccccaacagcgagccctgcagcagcgacagcgtgagcgagcccgagtgcaccaccgacagcagcagcagcaaggagcacaccagcagcagcgccatccccggcggcgtggacatcatggtgagcgaggacatgaagctgaccgacagcgagctgggcaagctggccaacaacatccaggagctgctgtacagcgccagcgacatctgccacgacagagccgtgaagttcctgatgagcagagccaaggacggcttcctggagaagctgaacagcatggagttcatcaccctgagcagactgatggagaccttcatcctggacaccgagcagatctgcggcagaaagagcaccagcctgctgggcgccctgcagagccaggccatcaagttcgtgaacagattccacgaggagagaaagaccaagctgagcctgctgctggacaacgagagatggaagcaggccgacgtgcccgccgagttccaggacctggtggacagcctgagcgacggcaagatcgccctgcccgagaagaagagcggcgccaccgaggagagaaagcccgccgaggtgctgatcgtggagggccagcagtacgccgtggtgggcaccgtgctgctgctgatcagaatcatcctggagtactgccagtgcgtggacaacatccccagcgtgaccaccgacatgctgaccagactgagcgacctgctgaagtacttcaacagcagaagctgccagctggtgctgggcgccggcgccctgcaggtggtgggcctgaagaccatcaccaccaagaacctggccctgagcagcagatgcctgcagctgatcgtgcactacatccccgtgatcagagcccacttcgaggccagactgccccccaagcagtacagcatgctgagacacttcgaccacatcaccaaggactaccacgaccacatcgccgagatcagcgccaagctggtggccatcatggacagcctgttcgacaagctgctgagcaagtacgaggtgaaggcccccgtgcccagcgcctgcttcagaaacatctgcaagcagatgaccaagatgcacgaggccatcttcgacctgctgcccgaggagcagacccagatgctgttcctgagaatcaacgccagctacaagctgcacctgaagaagcagctgagccacctgaacgtgatcaacgacggcggcccccagaacggcctggtgaccgccgacgtggccttctacaccggcaacctgcaggccctgaagggcctgaagatctggatgtag

SEQ ID NO: 25946 - DNA, 2898 bp, Artificial Sequence
  Description of Artificial Sequence: Synthetic coding sequence
atggccagcagccacagcagcagccccgtgccccagggcagcagcagcgacgtgttcttcaagatcgaggtggaccccagcaagcacatcagacccgtgcccagcctgcccgacgtgtgccccaaggagcccaccgtgaccgaccagcacagatggaccgtgtaccacagcaaggtgaacctgcccgccgccctgaacgaccccagactggccaagagagagagcgacttcttcaccaagacctggggcctggacttcgtggacaccgaggtgatccccagcttctacctgccccagatcagcaaggagcacttcaccgtgtaccagcaggagatcagccagagagagaagatccacgagagatgcaagaacatctgcccccccaaggacaccttcgagagaaccctgctgcacacccacgacaagagcagaaccgacctggagcaggtgcccaagatcttcatgaagcccgacttcgccctggacgacagcctgaccttcaacagcgtgctgccctggagccacttcaacaccgccggcggcaagggcaacagagacgccgccagcagcaagctgctgcaggagaagctgagccactacctggacatcgtggaggtgaacatcgcccaccagatcagcctgagaagcgaggccttcttccacgccatgaccagccagcacgagctgcaggactacctgagaaagaccagccaggccgtgaagatgctgagagacaagatcgcccagatcgacaaggtgatgtgcgagggcagcctgcacatcctgagactggccctgaccagaaacaactgcgtgaaggtgtacaacaagctgaagctgatggccaccgtgcaccagacccagcccaccgtgcaggtgctgctgagcaccagcgagttcgtgggcgccctggacctgatcgccaccacccaggaggtgctgcagcaggagctgcagggcatccacagcttcagacacctgggcagccagctgtgcgagctggagaagctgatcgacaagatgatgatcgccgagttcagcacctacagccacagcgacctgaacagacccctggaggacgactgccaggtgctggaggaggagagactgatcagcctggtgttcggcctgctgaagcagagaaagctgaacttcctggagatctacggcgagaagatggtgatcaccgccaagaacatcatcaagcagtgcgtgatcaacaaggtgagccagaccgaggagatcgacaccgacgtggtggtgaagctggccgaccagatgagaatgctgaacttcccccagtggttcgacctgctgaaggacatcttcagcaagttcaccatcttcctgcagagagtgaaggccaccctgaacatcatccacagcgtggtgctgagcgtgctggacaagaaccagagaaccagagagctggaggagatcagccagcagaagaacgccgccaaggacaacagcctggacaccgaggtggcctacctgatccacgagggcatgttcatcagcgacgccttcggcgagggcgagctgacccccatcgccgtggacaccaccagccagagaaacgccagccccaacagcgagccctgcagcagcgacagcgtgagcgagcccgagtgcaccaccgacagcagcagcagcaaggagcacaccagcagcagcgccatccccggcggcgtggacatcatggtgagcgaggacatgaagctgaccgacagcgagctgggcaagctggccaacaacatccaggagctgctgtacagcgccagcgacatctgccacgacagagccgtgaagttcctgatgagcagagccaaggacggcttcctggagaagctgaacagcatggagttcatcaccctgagcagactgatggagaccttcatcctggacaccgagcagatctgcggcagaaagagcaccagcctgctgggcgccctgcagagccaggccatcaagttcgtgaacagattccacgaggagagaaagaccaagctgagcctgctgctggacaacgagagatggaagcaggccgacgtgcccgccgagttccaggacctggtggacagcctgagcgacggcaagatcgccctgcccgagaagaagagcggcgccaccgaggagagaaagcccgccgaggtgctgatcgtggagggccagcagtacgccgtggtgggcaccgtgctgctgctgatcagaatcatcctggagtactgccagtgcgtggacaacatccccagcgtgaccaccgacatgctgaccagactgagcgacctgctgaagtacttcaacagcagaagctgccagctggtgctgggcgccggcgccctgcaggtggtgggcctgaagaccatcaccaccaagaacctggccctgagcagcagatgcctgcagctgatcgtgcactacatccccgtgatcagagcccacttcgaggccagactgccccccaagcagtacagcatgctgagacacttcgaccacatcaccaaggactaccacgaccacatcgccgagatcagcgccaagctggtggccatcatggacagcctgttcgacaagctgctgagcaagtacgaggtgaaggcccccgtgcccagcgcctgcttcagaaacatctgcaagcagatgaccaagatgcacgaggccatcttcgacctgctgcccgaggagcagacccagatgctgttcctgagaatcaacgccagctacaagctgcacctgaagaagcagctgagccacctgaacgtgatcaacgacggcggcccccagaacggcctggtgaccgccgacgtggccttctacaccggcaacctgcaggccctgaagggcctgaaggacctggacctgaacatggccgagatctgggagcagaagagatag

SEQ ID NO: 25947 - DNA, 2898 bp, Artificial Sequence; identical to SEQ ID NO: 25946
  Description of Artificial Sequence: Synthetic coding sequence

SEQ ID NO: 25948 - DNA, 4287 bp, Artificial Sequence
  Description of Artificial Sequence: Synthetic coding sequence
atggagaacgagcccgaccacgagaacgtggagcagagcctgtgcgccaagaccagcgaggaggagctgaacaagagcttcaacctggaggccagcctgagcaagttcagctacatcgacatggacaaggagctggagttcaagaacgacctgatcgacgacaaggagttcgacatcccccaggtggacaccccccccaccctggagagcatcctgaacgagaccgacgacgaggacgagagcttcatcctggaggaccccaccctgctgaacatcgacaccatcgacagccacagctacgacaccagcagcgtggccagcagcgacagcggcgacagaaccaacctgaagagaaagaagaagctgcccgacagcttcagcctgcacggcagcgtgatgagacacagcctgctgaagggcatcagcgcccagatcgtgagcgccgccgacaaggtggacgccggcctgcccaccgccatcgccgtgagcagcctgatcgccgtgggcaccagccacggcctggccctgatcttcggcaagtaccagaaccaggccctgagactgtgcctgggcagcaccagcgtgggcggccagtacggcgccatcagcgccctgagcatcaacaacgactgcagcagactgctgtgcggcttcgccaagggccagatcaccatgtgggacctggccagcggcaagctgctgagaagcatcaccgacgcccacccccccggcaccgccatcctgcacatcaagttcaccgacgaccccaccctggccatctgcaacgacagcggcggcagcgtgttcgagctgaccttcaagagagtgatgggcgtgagaacctgcgagagcagatgcctgttcagcggcagcaagggcgaggtgtgctgcatcgagcccctgcacagcaagcccgagctgaaggaccaccccatcacccagttcagcctgctggccatggccagcctgaccaagatcctggtgatcggcctgaagcccagcctgaaggtgtggatgaccttcccctacggcagaatggaccccagcagcgtgcccctgctggcctggcacttcgtggccgtgcagaactacgtgaaccccatgctggccttctgcagaggcgacgtggtgcacttcctgctggtgaagagagacgagagcggcgccatccacgtgaccaagcagaagcacctgcacctgtactacgacctgatcaacttcacctggatcaacagcagaaccgtggtgctgctggacagcgtggagaagctgcacgtgatcgacagacagacccaggaggagctggagaccgtggagatcagcgaggtgcagctggtgtacaacagcagccacttcaagagcctggccaccggcggcaacgtgagccaggccctggccctggtgggcgagaaggcctgctaccagagcatcagcagctacggcggccagatcttctacctgggcaccaagagcgtgtacgtgatgatgctgagaagctggagagagagagtggaccacctgctgaagcaggactgcctgaccgaggccctggccctggcctggagcttccacgagggcaaggccaaggccgtggtgggcctgagcggcgacgccagcaagagaaaggccatcgtggccgacagaatggtggagatcctgttccactacgccgacagagccctgaagaagtgccccgaccagggcaagatccaggtgatggagcagcacttccaggacatggtgcccgtgatcgtggactactgcctgctgctgcagagaaaggacctgctgttcagccagatgtacgacaagctgagcgagaacagcgtggccaagggcgtgttcctggagtgcctggagccctacatcctgagcgacaagctggtgggcatcaccccccaggtgatgaaggacctgatcgtgcacttccaggacaagaagctgatggagaacgtggaggccctgatcgtgcacatggacatcaccagcctggacatccagcaggtggtgctgatgtgctgggagaacagactgtacgacgccatgatctacgtgtacaacagaggcatgaacgagttcatcagccccatggagaagctgttcagagtgatcgccccccccctgaacgccggcaagaccctgaccgacgagcaggtggtgatgggcaacaagctgctggtgtacatcagctgctgcctggccggcagagcctaccccctgggcgacatccccgaggacctggtgcccctggtgaagaaccaggtgttcgagttcctgatcagactgcacagcgccgaggccagccccgaggaggagatctacccctacatcagaaccctgctgcacttcgacaccagagagttcctgaacgtgctggccctgaccttcgaggacttcaagaacgacaagcaggccgtggagtaccagcagagaatcgtggacatcctgctgaaggtgatggtggagaacagcgacttcacccccagccaggtgggctgcctgttcaccttcctggccagacagctggccaagcccgacaacaccctgttcgtgaacagaaccctgttcgaccaggtgctggagttcctgtgcagccccgacgacgacagcagacacagcgagagacagcaggtgctgctggagctgctgcaggccggcggcatcgtgcagttcgaggagagcagactgatcagaatggccgagaaggccgagttctaccagatctgcgagttcatgtacgagagagagcaccagtacgacaagatcatcgactgctacctgagagaccccctgagagaggaggaggtgttcaactacatccacaacatcctgagcatccccggccacagcgccgaggagaagcagagcgtgtggcagaaggccatggaccacatcgaggagctggtgagcctgaagccctgcaaggccgccgagctggtggccacccacttcagcggccacatcgagaccgtgatcaagaagctgcagaaccaggtgctgctgttcaagttcctgagaagcctgctggaccccagagagggcatccacgtgaaccaggagctgctgcagatcagcccctgcatcaccgagcagttcatcgagctgctgtgccagttcaaccccacccaggtgatcgagaccctgcaggtgctggagtgctacagactggaggagaccatccagatcacccagaagtaccagctgcacgaggtgaccgcctacctgctggagaagaagggcgacatccacggcgccttcctgatcatgctggagagactgcagagcaagctgcaggaggtgacccaccagggcgagaacaccaaggaggaccccagcctgaaggacgtggaggacaccatggtggagaccatcgccctgtgccagagaaacagccacaacctgaaccagcagcagagagaggccctgtggttccccctgctggaggccatgatggccccccagaagctgagcagcagcgccatcccccacctgcacagcgaggccctgaagagcctgaccatgcaggtgctgaacagcatggccgccttcatcgccctgcccagcatcctgcagagaatcctgcaggaccccgtgtacggcaagggcaagctgggcgagatccagggcctgatcctgggcatgctggacaccttcaactacgagcagaccctgctggagaccaccaccagcctgctgaaccaggacctgcactggagcctgtgcaacctgagagccagcgtgaccagaggcctgaaccccaagcaggactactgcagcatctgcctgcagcagtacaagagaagacaggagatggccgacgagatcatcgtgttcagctgcggccacctgtaccacagcttctgcctgcagaacaaggagtgcaccgtggagttcgagggccagaccagatggacctgctacaagtgcagcagcagcaacaaggtgggcaagctgagcgagaacagcagcgagatcaagaagggcagaatcacccccagccaggtgaagatgagccccagctaccaccagagcaagggcgaccccaccgccaagaagggcaccagcgagcccgtgctggacccccagcagatccaggccttcgaccagctgtgcagactgtacagaggcagcagcagactggccctgctgaccgagctgagccagaacagaagcagcgagagctacagacccttcagcggcagccagagcgcccccgccttcaacagcatcttccagaacgagaacttccagctgcagctgatccccccccccgtgaccgaggactag

SEQ ID NO: 25949 - DNA, 609 bp, Artificial Sequence
  Description of Artificial Sequence: Synthetic coding sequence
atggagaacgagcccgaccacgagaacgtggagcagagcctgtgcgccaagaccagcgaggaggagctgaacaagagcttcaacctggaggccagcctgagcaagttcagctacatcgacatggacaaggagctggagttcaagaacgacctgatcgacgacaaggagttcgacatcccccaggtggacaccccccccaccctggagagcatcctgaacgagaccgacgacgaggacgagagcttcatcctggaggaccccaccctgctgaacatcgacaccatcgacagccacagctacgacaccagcagcgtggccagcagcgacagcggcgacagaaccaacctgaagagaaagaagaagctgcccgacagcttcagcctgcacggcagcgtgatgagacacagcctgctgaagggcatcagcgcccagatcgtgagcgccgccgacaaggtggacgccggcctgcccaccgccatcgccgtgagcagcctgatcgccgtgggcaccagccacggcctggccctgatcttcgaccagaaccaggccctgagactgtgcctgggcagcaccagcgtgggcggccagtacggcgccatcagcgcctag

SEQ ID NO: 25950 - DNA, 4281 bp, Artificial Sequence
  Description of Artificial Sequence: Synthetic coding sequence
atggagaacgagcccgaccacgagaacgtggagcagagcctgtgcgccaagaccagcgaggaggagctgaacaagagcttcaacctggaggccagcctgagcaagttcagctacatcgacatggacaaggagctggagttcaagaacgacctgatcgacgacaaggagttcgacatcccccaggtggacaccccccccaccctggagagcatcctgaacgagaccgacgacgaggacgagagcttcatcctggaggaccccaccctgctgaacatcgacaccatcgacagccacagctacgacaccagcagcgtggccagcagcgacagcggcgacagaaccaacctgaagagaaagaagaagctgcccgacagcttcagcctgcacggcagcgtgatgagacacagcctgctgaagggcatcagcgcccagatcgtgagcgccgccgacaaggtggacgccggcctgcccaccgccatcgccgtgagcagcctgatcgccgtgggcaccagccacggcctggccctgatcttcgaccagaaccaggccctgagactgtgcctgggcagcaccagcgtgggcggccagtacggcgccatcagcgccctgagcatcaacaacgactgcagcagactgctgtgcggcttcgccaagggccagatcaccatgtgggacctggccagcggcaagctgctgagaagcatcaccgacgcccacccccccggcaccgccatcctgcacatcaagttcaccgacgaccccaccctggccatctgcaacgacagcggcggcagcgtgttcgagctgaccttcaagagagtgatgggcgtgagaacctgcgagagcagatgcctgttcagcggcagcaagggcgaggtgtgctgcatcgagcccctgcacagcaagcccgagctgaaggaccaccccatcacccagttcagcctgctggccatggccagcctgaccaagatcctggtgatcggcctgaagcccagcctgaaggtgtggatgaccttcccctacggcagaatggaccccagcagcgtgcccctgctggcctggcacttcgtggccgtgcagaactacgtgaaccccatgctggccttctgcagaggcgacgtggtgcacttcctgctggtgaagagagacgagagcggcgccatccacgtgaccaagcagaagcacctgcacctgtactacgacctgatcaacttcacctggatcaacagcagaaccgtggtgctgctggacagcgtggagaagctgcacgtgatcgacagacagacccaggaggagctggagaccgtggagatcagcgaggtgcagctggtgtacaacagcagccacttcaagagcctggccaccggcggcaacgtgagccaggccctggccctggtgggcgagaaggcctgctaccagagcatcagcagctacggcggccagatcttctacctgggcaccaagagcgtgtacgtgatgatgctgagaagctggagagagagagtggaccacctgctgaagcaggactgcctgaccgaggccctggccctggcctggagcttccacgagggcaaggccaaggccgtggtgggcctgagcggcgacgccagcaagagaaaggccatcgtggccgacagaatggtggagatcctgttccactacgccgacagagccctgaagaagtgccccgaccagggcaagatccaggtgatggagcagcacttccaggacatggtgcccgtgatcgtggactactgcctgctgctgcagagaaaggacctgctgttcagccagatgtacgacaagctgagcgagaacagcgtggccaagggcgtgttcctggagtgcctggagccctacatcctgagcgacaagctggtgggcatcaccccccaggtgatgaaggacctgatcgtgcacttccaggacaagaagctgatggagaacgtggaggccctgatcgtgcacatggacatcaccagcctggacatccagcaggtggtgctgatgtgctgggagaacagactgtacgacgccatgatctacgtgtacaacagaggcatgaacgagttcatcagccccatggagaagctgttcagagtgatcgccccccccctgaacgccggcaagaccctgaccgacgagcaggtggtgatgggcaacaagctgctggtgtacatcagctgctgcctggccggcagagcctaccccctgggcgacatccccgaggacctggtgcccctggtgaagaaccaggtgttcgagttcctgatcagactgcacagcgccgaggccagccccgaggaggagatctacccctacatcagaaccctgctgcacttcgacaccagagagttcctgaacgtgctggccctgaccttcgaggacttcaagaacgacaagcaggccgtggagtaccagcagagaatcgtggacatcctgctgaaggtgatggtggagaacagcgacttcacccccagccaggtgggctgcctgttcaccttcctggccagacagctggccaagcccgacaacaccctgttcgtgaacagaaccctgttcgaccaggtgctggagttcctgtgcagccccgacgacgacagcagacacagcgagagacagcaggtgctgctggagctgctgcaggccggcggcatcgtgcagttcgaggagagcagactgatcagaatggccgagaaggccgagttctaccagatctgcgagttcatgtacgagagagagcaccagtacgacaagatcatcgactgctacctgagagaccccctgagagaggaggaggtgttcaactacatccacaacatcctgagcatccccggccacagcgccgaggagaagcagagcgtgtggcagaaggccatggaccacatcgaggagctggtgagcctgaagccctgcaaggccgccgagctggtggccacccacttcagcggccacatcgagaccgtgatcaagaagctgcagaaccaggtgctgctgttcaagttcctgagaagcctgctggaccccagagagggcatccacgtgaaccaggagctgctgcagatcagcccctgcatcaccgagcagttcatcgagctgctgtgccagttcaaccccacccaggtgatcgagaccctgcaggtgctggagtgctacagactggaggagaccatccagatcacccagaagtaccagctgcacgaggtgaccgcctacctgctggagaagaagggcgacatccacggcgccttcctgatcatgctggagagactgcagagcaagctgcaggaggtgacccaccagggcgagaacaccaaggaggaccccagcctgaaggacgtggaggacaccatggtggagaccatcgccctgtgccagagaaacagccacaacctgaaccagcagcagagagaggccctgtggttccccctgctggaggccatgatggccccccagaagctgagcagcagcgccatcccccacctgcacagcgaggccctgaagagcctgaccatgcaggtgctgaacagcatggccgccttcatcgccctgcccagcatcctgcagagaatcctgcaggaccccgtgtacggcaagggcaagctgggcgagatccagggcctgatcctgggcatgctggacaccttcaactacgagcagaccctgctggagaccaccaccagcctgctgaaccaggacctgcactggagcctgtgcaacctgagagccagcgtgaccagaggcctgaaccccaagcaggactactgcagcatctgcctgcagcagtacaagagaagacaggagatggccgacgagatcatcgtgttcagctgcggccacctgtaccacagcttctgcctgcagaacaaggagtgcaccgtggagttcgagggccagaccagatggacctgctacaagtgcagcagcagcaacaaggtgggcaagctgagcgagaacagcagcgagatcaagaagggcagaatcacccccagccaggtgaagatgagccccagctaccaccagagcaagggcgaccccaccgccaagaagggcaccagcgagcccgtgctggacccccagcagatccaggccttcgaccagctgtgcagactgtacagaggcagcagcagactggccctgctgaccgagctgagccagaacagaagcagcgagagctacagacccttcagcggcagccagagcgcccccgccttcaacagcatcttccagaacgagaacttccagctgcagctgatccccccccccgtgaccgaggactag

SEQ ID NO: 25951 - DNA, 4287 bp, Artificial Sequence
  Description of Artificial Sequence: Synthetic coding sequence
atggagaacgagcccgaccacgagaacgtggagcagagcctgtgcgccaagaccagcgaggaggagctgaacaagagcttcaacctggaggccagcctgagcaagttcagctacatcgacatggacaaggagctggagttcaagaacgacctgatcgacgacaaggagttcgacatcccccaggtggacaccccccccaccctggagagcatcctgaacgagaccgacgacgaggacgagagcttcatcctggaggaccccaccctgctgaacatcgacaccatcgacagccacagctacgacaccagcagcgtggccagcagcgacagcggcgacagaaccaacctgaagagaaagaagaagctgcccgacagcttcagcctgcacggcagcgtgatgagacacagcctgctgaagggcatcagcgcccagatcgtgagcgccgccgacaaggtggacgccggcctgcccaccgccatcgccgtgagcagcctgatcgccgtgggcaccagccacggcctggccctgatcttcggcaaggaccagaaccaggccctgagactgtgcctgggcagcaccagcgtgggcggccagtacggcgccatcagcgccctgagcatcaacaacgactgcagcagactgctgtgcggcttcgccaagggccagatcaccatgtgggacctggccagcggcaagctgctgagaagcatcaccgacgcccacccccccggcaccgccatcctgcacatcaagttcaccgacgaccccaccctggccatctgcaacgacagcggcggcagcgtgttcgagctgaccttcaagagagtgatgggcgtgagaacctgcgagagcagatgcctgttcagcggcagcaagggcgaggtgtgctgcatcgagcccctgcacagcaagcccgagctgaaggaccaccccatcacccagttcagcctgctggccatggccagcctgaccaagatcctggtgatcggcctgaagcccagcctgaaggtgtggatgaccttcccctacggcagaatggaccccagcagcgtgcccctgctggcctggcacttcgtggccgtgcagaactacgtgaaccccatgctggccttctgcagaggcgacgtggtgcacttcctgctggtgaagagagacgagagcggcgccatccacgtgaccaagcagaagcacctgcacctgtactacgacctgatcaacttcacctggatcaacagcagaaccgtggtgctgctggacagcgtggagaagctgcacgtgatcgacagacagacccaggaggagctggagaccgtggagatcagcgaggtgcagctggtgtacaacagcagccacttcaagagcctggccaccggcggcaacgtgagccaggccctggccctggtgggcgagaaggcctgctaccagagcatcagcagctacggcggccagatcttctacctgggcaccaagagcgtgtacgtgatgatgctgagaagctggagagagagagtggaccacctgctgaagcaggactgcctgaccgaggccctggccctggcctggagcttccacgagggcaaggccaaggccgtggtgggcctgagcggcgacgccagcaagagaaaggccatcgtggccgacagaatggtggagatcctgttccactacgccgacagagccctgaagaagtgccccgaccagggcaagatccaggtgatggagcagcacttccaggacatggtgcccgtgatcgtggactactgcctgctgctgcagagaaaggacctgctgttcagccagatgtacgacaagctgagcgagaacagcgtggccaagggcgtgttcctggagtgcctggagccctacatcctgagcgacaagctggtgggcatcaccccccaggtgatgaaggacctgatcgtgcacttccaggacaagaagctgatggagaacgtggaggccctgatcgtgcacatggacatcaccagcctggacatccagcaggtggtgctgatgtgctgggagaacagactgtacgacgccatgatctacgtgtacaacagaggcatgaacgagttcatcagccccatggagaagctgttcagagtgatcgccccccccctgaacgccggcaagaccctgaccgacgagcaggtggtgatgggcaacaagctgctggtgtacatcagctgctgcctggccggcagagcctaccccctgggcgacatccccgaggacctggtgcccctggtgaagaaccaggtgttcgagttcctgatcagactgcacagcgccgaggccagccccgaggaggagatctacccctacatcagaaccctgctgcacttcgacaccagagagttcctgaacgtgctggccctgaccttcgaggacttcaagaacgacaagcaggccgtggagtaccagcagagaatcgtggacatcctgctgaaggtgatggtggagaacagcgacttcacccccagccaggtgggctgcctgttcaccttcctggccagacagctggccaagcccgacaacaccctgttcgtgaacagaaccctgttcgaccaggtgctggagttcctgtgcagccccgacgacgacagcagacacagcgagagacagcaggtgctgctggagctgctgcaggccggcggcatcgtgcagttcgaggagagcagactgatcagaatggccgagaaggccgagttctaccagatctgcgagttcatgtacgagagagagcaccagtacgacaagatcatcgactgctacctgagagaccccctgagagaggaggaggtgttcaactacatccacaacatcctgagcatccccggccacagcgccgaggagaagcagagcgtgtggcagaaggccatggaccacatcgaggagctggtgagcctgaagccctgcaaggccgccgagctggtggccacccacttcagcggccacatcgagaccgtgatcaagaagctgcagaaccaggtgctgctgttcaagttcctgagaagcctgctggaccccagagagggcatccacgtgaaccaggagctgctgcagatcagcccctgcatcaccgagcagttcatcgagctgctgtgccagttcaaccccacccaggtgatcgagaccctgcaggtgctggagtgctacagactggaggagaccatccagatcacccagaagtaccagctgcacgaggtgaccgcctacctgctggagaagaagggcgacatccacggcgccttcctgatcatgctggagagactgcagagcaagctgcaggaggtgacccaccagggcgagaacaccaaggaggaccccagcctgaaggacgtggaggacaccatggtggagaccatcgccctgtgccagagaaacagccacaacctgaaccagcagcagagagaggccctgtggttccccctgctggaggccatgatggccccccagaagctgagcagcagcgccatcccccacctgcacagcgaggccctgaagagcctgaccatgcaggtgctgaacagcatggccgccttcatcgccctgcccagcatcctgcagagaatcctgcaggaccccgtgtacggcaagggcaagctgggcgagatccagggcctgatcctgggcatgctggacaccttcaactacgagcagaccctgctggagaccaccaccagcctgctgaaccaggacctgcactggagcctgtgcaacctgagagccagcgtgaccagaggcctgaaccccaagcaggactactgcagcatctgcctgcagcagtacaagagaagacaggagatggccgacgagatcatcgtgttcagctgcggccacctgtaccacagcttctgcctgcagaacaaggagtgcaccgtggagttcgagggccagaccagatggacctgctacaagtgcagcagcagcaacaaggtgggcaagctgagcgagaacagcagcgagatcaagaagggcagaatcacccccagccaggtgaagatgagccccagctaccaccagagcaagggcgaccccaccgccaagaagggcaccagcgagcccgtgctggacccccagcagatccaggccttcgaccagctgtgcagactgtacagaggcagcagcagactggccctgctgaccgagctgagccagaacagaagcagcgagagctacagacccttcagcggcagccagagcgcccccgccttcaacagcatcttccagaacgagaacttccagctgcagctgatccccccccccgtgaccgaggactag

SEQ ID NO: 25952 - DNA, 423 bp, Artificial Sequence
  Description of Artificial Sequence: Synthetic coding sequence
atggagaacgagcccgaccacgagaacgtggagcagagcctgtgcgccaagaccagcgaggaggagctgaacaagagcttcaacctggaggccagcctgagcaagttcagctacatcgacatggacaaggagctggagttcaagaacgacctgatcgacgacaaggagttcgacatcccccaggtggacaccccccccaccctggagagcatcctgaacgagaccgacgacgaggacgagagcttcatcctggaggaccccaccctgctgaacatcgacaccatcgacagccacagctacgacaccagcagcgtggccagcagcgacagcggcgacagaaccaacctgaagagaaagaagaagctgcccgacagcttcagcctgcacggcagcgtgatgagacacagcctgctgaagggctag

SEQ ID NO: 25953 - DNA, 366 bp, Artificial Sequence
  Description of Artificial Sequence: Synthetic coding sequence
atggagaacgagcccgaccacgagaacgtggagcagagcctgtgcgccaagaccagcgaggaggagctgaacaagagcttcaacctggaggccagcctgagcaagttcagctacatcgacatggacaaggagctggagttcaagaacgacctgatcgacgacaaggagttcgacatcccccaggtggacaccccccccaccctggagagcatcctgaacgagaccgacgacgaggacgagagcttcatcctggaggaccccaccctgctgaacatcgacaccatcgacagccacagctacgacaccagcagcgtggccagcagcgacagcggcgacagaaccaacctgaagagaaagaagaagtag

SEQ ID NO: 25954 - DNA, 4011 bp, Artificial Sequence
  Description of Artificial Sequence: Synthetic coding sequence
atggagaacgagcccgaccacgagaacgtggagcagagcctgtgcgccaagaccagcgaggaggagctgaacaagagcttcaacctggaggccagcctgagcaagttcagctacatcgacatggacaaggagctggagttcaagaacgacctgatcgacgacaaggagttcgacatcccccaggtggacaccccccccaccctggagagcatcctgaacgagaccgacgacgaggacgagagcttcatcctggaggaccccaccctgctgaacatcgacaccatcgacagccacagctacgacaccagcagcgtggccagcagcgacagcggcgacagaaccaacctgaagagaaagaagaagctgcccgacagcttcagcctgcacggcagcgtgatgagacacagcctgctgaagggcatcagcgcccagatcgtgagcgccgccgacaaggtggacgccggcctgcccaccgccatcgccgtgagcagcctgatcgccgtgggcaccagccacggcctggccctgatcttcgaccagaaccaggccctgagactgtgcctgggcagcaccagcgtgggcggccagtacggcgccatcagcgccctgagcatcaacaacgactgcagcagactgctgtgcggcttcgccaagggccagatcaccatgtgggacctggccagcggcaagctgctgagaagcatcaccgacgcccacccccccggcaccgccatcctgcacatcaagttcaccgacgaccccaccctggccatctgcaacgacagcggcggcagcgtgttcgagctgaccttcaagagagtgatgggcgtgagaacctgcgagagcagatgcctgttcagcggcagcaagggcgaggtgtgctgcatcgagcccctgcacagcaagcccgagctgaaggaccaccccatcacccagttcagcctgctggccatggccagcctgaccaagatcctggtgatcggcctgaagcccagcctgaaggtgtggatgaccttcccctacggcagaatggaccccagcagcgtgcccctgctggcctggcacttcgtggccgtgcagaactacgtgaaccccatgctggccttctgcagaggcgacgtggtgcacttcctgctggtgaagagagacgagagcggcgccatccacgtgaccaagcagaagcacctgcacctgtactacgacctgatcaacttcacctggatcaacagcagaaccgtggtgctgctggacagcgtggagaagctgcacgtgatcgacagacagacccaggaggagctggagaccgtggagatcagcgaggtgcagctggtgtacaacagcagccacttcaagagcctggccaccggcggcaacgtgagccaggccctggccctggtgggcgagaaggcctgctaccagagcatcagcagctacggcggccagatcttctacctgggcaccaagagcgtgtacgtgatgatgctgagaagctggagagagagagtggaccacctgctgaagcaggactgcctgaccgaggccctggccctggcctggagcttccacgagggcaaggccaaggccgtggtgggcctgagcggcgacgccagcaagagaaaggccatcgtggccgacagaatggtggagatcctgttccactacgccgacagagccctgaagaagtgccccgaccagggcaagatccaggtgatggagcagcacttccaggtggtgctgatgtgctgggagaacagactgtacgacgccatgatctacgtgtacaacagaggcatgaacgagttcatcagccccatggagaagctgttcagagtgatcgccccccccctgaacgccggcaagaccctgaccgacgagcaggtggtgatgggcaacaagctgctggtgtacatcagctgctgcctggccggcagagcctaccccctgggcgacatccccgaggacctggtgcccctggtgaagaaccaggtgttcgagttcctgatcagactgcacagcgccgaggccagccccgaggaggagatctacccctacatcagaaccctgctgcacttcgacaccagagagttcctgaacgtgctggccctgaccttcgaggacttcaagaacgacaagcaggccgtggagtaccagcagagaatcgtggacatcctgctgaaggtgatggtggagaacagcgacttcacccccagccaggtgggctgcctgttcaccttcctggccagacagctggccaagcccgacaacaccctgttcgtgaacagaaccctgttcgaccaggtgctggagttcctgtgcagccccgacgacgacagcagacacagcgagagacagcaggtgctgctggagctgctgcaggccggcggcatcgtgcagttcgaggagagcagactgatcagaatggccgagaaggccgagttctaccagatctgcgagttcatgtacgagagagagcaccagtacgacaagatcatcgactgctacctgagagaccccctgagagaggaggaggtgttcaactacatccacaacatcctgagcatccccggccacagcgccgaggagaagcagagcgtgtggcagaaggccatggaccacatcgaggagctggtgagcctgaagccctgcaaggccgccgagctggtggccacccacttcagcggccacatcgagaccgtgatcaagaagctgcagaaccaggtgctgctgttcaagttcctgagaagcctgctggaccccagagagggcatccacgtgaaccaggagctgctgcagatcagcccctgcatcaccgagcagttcatcgagctgctgtgccagttcaaccccacccaggtgatcgagaccctgcaggtgctggagtgctacagactggaggagaccatccagatcacccagaagtaccagctgcacgaggtgaccgcctacctgctggagaagaagggcgacatccacggcgccttcctgatcatgctggagagactgcagagcaagctgcaggaggtgacccaccagggcgagaacaccaaggaggaccccagcctgaaggacgtggaggacaccatggtggagaccatcgccctgtgccagagaaacagccacaacctgaaccagcagcagagagaggccctgtggttccccctgctggaggccatgatggccccccagaagctgagcagcagcgccatcccccacctgcacagcgaggccctgaagagcctgaccatgcaggtgctgaacagcatggccgccttcatcgccctgcccagcatcctgcagagaatcctgcaggaccccgtgtacggcaagggcaagctgggcgagatccagggcctgatcctgggcatgctggacaccttcaactacgagcagaccctgctggagaccaccaccagcctgctgaaccaggacctgcactggagcctgtgcaacctgagagccagcgtgaccagaggcctgaaccccaagcaggactactgcagcatctgcctgcagcagtacaagagaagacaggagatggccgacgagatcatcgtgttcagctgcggccacctgtaccacagcttctgcctgcagaacaaggagtgcaccgtggagttcgagggccagaccagatggacctgctacaagtgcagcagcagcaacaaggtgggcaagctgagcgagaacagcagcgagatcaagaagggcagaatcacccccagccaggtgaagatgagccccagctaccaccagagcaagggcgaccccaccgccaagaagggcaccagcgagcccgtgctggacccccagcagatccaggccttcgaccagctgtgcagactgtacagaggcagcagcagactggccctgctgaccgagctgagccagaacagaagcagcgagagctacagacccttcagcggcagccagagcgcccccgccttcaacagcatcttccagaacgagaacttccagctgcagctgatccccccccccgtgaccgaggactag

SEQ ID NO: 25955 - DNA, 225 bp, Artificial Sequence
  Description of Artificial Sequence: Synthetic coding sequence
atggagaacgagcccgaccacgagaacgtggagcagagcctgtgcgccaagaccagcgaggaggagctgaacaagagcttcaacctggaggccagcctgagcaagttcagctacatcgacatggacaaggagctggagttcaagaacgacctgatcgacgacaaggagttcgacatcccccaggtggacaccccccccaccctggagagcatcctgaacgagtag

SEQ ID NO: 25956 - DNA, 741 bp, Artificial Sequence
  Description of Artificial Sequence: Synthetic coding sequence
atgagccccaagcccagagccagcggcccccccgccaaggccaaggaggccggcaagagaaagagcagcagccagcccagccccagcgaccccaagaagaagaccaccaaggtggccaagaagggcaaggccgtgagaagaggcagaagaggcaagaagggcgccgccaccaagatggccgccgtgaccgcccccgaggccgagagcggccccgccgcccccggccccagcgaccagcccagccaggagctgccccagcacgagctgccccccgaggagcccgtgagcgagggcacccagcacgaccccctgagccaggagagcgagctggaggagcccctgagccaggagagcgaggtggaggagcccctgagccaggagagccaggtggaggagcccctgagccaggagagcgaggtggaggagcccctgagccaggagagccaggtggaggagcccctgagccaggagagcgaggtggaggagcccctgagccaggagagcgaggtggaggagcccctgagccaggagagccaggtggaggagcccctgagccaggagagcgaggtggaggagcccctgagccaggagagccaggtggaggagcccctgagccaggagagcgagatggaggagcccctgagccaggagagccaggtggaggagcccctgagccaggagagcgagatggaggagcccctgagccaggagagcgagatggaggagctgcccagcgtgtag

SEQ ID NO: 25957 - DNA, 378 bp, Artificial Sequence
  Description of Artificial Sequence: Synthetic coding sequence
atgagccccaagcccagagccagcggcccccccgccaaggccaaggagaccggcaagagaaagagcagcagccagcccagccccagcggccccaagaagaagaccaccaaggtggccgagaagggcgaggccgtgagaggcggcagaagaggcaagaagggcgccgccaccaagatggccgccgtgaccgcccccgaggccgagagcggccccgccgcccccggccccagcgaccagcccagccaggagctgccccagcacgagctgccccccgaggagcccgtgagcgagggcacccagcacgaccccctgagccaggagagcgagctggaggagcccctgagcaagggcagacccagcacccccctgagcccctag

SEQ ID NO: 25958 - DNA, 2109 bp, Artificial Sequence
  Description of Artificial Sequence: Synthetic coding sequence
atgaccagcagaaaccagctggtgcagaaggtgctgcaggagctgcaggaggccgtggagtgcgagggcctggagggcctgatcggcgccagcctggaggccaagcaggtgctgagcagcttcaccctgcccacctgcagagagggcggccccggcctgcaggtgctggaggtggacagcgtggccctgagcctgtaccccgaggacgcccccagaaacatgctgcccctggtgtgcaagggcgagggcagcctgctgttcgaggccgccagcatgctgctgtggggcgacgccggcctgagcctggagctgagagccagaaccgtggtggagatgctgctgcacagacactactacctgcagggcatgatcgacagcaaggtgatgctgcaggccgtgagatacagcctgtgcagcgaggagagccccgagatgaccagcctgccccccgccaccctggaggccatcttcgacgccgacgtgaaggccagctgcttccccagcagcttcagcaacgtgtggcacctgtacgccctggccagcgtgctgcagagaaacatctacagcatctaccccatgagaaacctgaagatcagaccctacttcaacagagtgatcagacccagaagatgcgaccacgtgcccagcaccctgcacatcatgtgggccggccagcccctgaccagccacttcttcagacaccagtacttcgcccccgtggtgggcctggaggaggtggaggccgagggcgcccccggcgtggcccccgccctgcccgccctggcccccctgagcagccccgccaagaccctggagctgctgaacagagagcccggcctgagctacagccacctgtgcgagagatacagcgtgaccaagagcaccttctacagatggagaagacagagccaggagcacagacagaaggtggccgccagattcagcgccaagcacttcctgcaggacagcttccacagaggcggcgtggtgcccctgcagcagttcctgcagagattccccgagatcagcagaagcacctactacgcctggaagcacgagctgctgggcagcggcacctgccccgccctgccccccagagaggtgctgggcatggaggagctggagaagctgcccgaggagcaggtggccgaggaggagctggagtgcagcgccctggccgtgagcagccccggcatggtgctgatgcagagagccaagctgtacctggagcactgcatcagcctgaacaccctggtgccctacagatgcttcaagagaagattccccggcatcagcagaagcacctactacaactggagaagaaaggccctgagaagaaaccccagcttcaagcccgcccccgccctgagcgccgccggcaccccccagctggccagcgtgggcgagggcgccgtgatcccctggaagagcgaggccgaggagggcgccggcaacgccaccggcgaggacccccccgcccccggcgagctgctgcccctgagaatgcccctgagcagatggcagagaagactgagaagagccgccagaagacaggtgctgagcggccacctgcccttctgcagattcagactgagataccccagcctgagccccagcgccttctgggtgtggaagagcctggccagaggctggcccagaggcctgagcaagctgcaggtgcccgtgcccaccctgggcaagggcggccaggaggccgaggagaagcaggagaaggaggccggcagagacgtgaccgccgtgatggccccccccgtgggcgccagcagcgaggacgtggagggcggccccagcagagagggcgccctgcaggagggcgccaccgcccagggccagccccacagcggccccctgctgagccagcccgtggtggccgccgccggcggcagagacggcagaatgctggtgatggacatgatcgccaccaccaagttcaaggcccaggccaagctgttcctgcagaagagattccagagcaagagcttccccagctacaaggagttcagcgccctgttccccctgaccgccagaagcacctactacatgtggaagagagccctgtacgacggcctgaccctggtggacggctag

SEQ ID NO: 25959 - DNA, 252 bp, Artificial Sequence
  Description of Artificial Sequence: Synthetic coding sequence
atgaccagcagaaaccagctggtgcagaaggtgctgcaggagctgcaggaggccgtggagtgcgagggcctggagggcctgatcggcgccagcctggaggccaagcaggtgctgagcagcttcaccctgcccacctgcagagagggcggccccggcctgcaggtgctggaggtggacagcgtggccctgagcctgtaccccgaggacgcccccagaaacatgctgcccctggtgtgcaagggcgagggctag

SEQ ID NO: 25960 - DNA, 1260 bp, Artificial Sequence
  Description of Artificial Sequence: Synthetic coding sequence
atggccaaggagggcgtggagaaggccgaggagaccgagcagatgatcgagaaggaggccggcaaggagcccgccgagggcggcggcggcgacggcagccacagactgggcgacgcccaggagatgagagccgtggtgctggccggcttcggcggcctgaacaagctgagactgttcagaaaggccatgcccgagccccaggacggcgagctgaagatcagagtgaaggcctgcggcctgaacttcatcgacctgatggtgagacagggcaacatcgacaacccccccaagacccccctggtgcccggcttcgagtgcagcggcatcgtggaggccctgggcgacagcgtgaagggctacgagatcggcgacagagtgatggccttcgtgaactacaacgcctgggccgaggtggtgtgcacccccgtggagttcgtgtacaagatccccgacgacatgagcttcagcgaggccgccgccttccccatgaacttcgtgaccgcctacgtgatgctgttcgaggtggccaacctgagagagggcatgagcgtgctggtgcacagcgccggcggcggcgtgggccaggccgtggcccagctgtgcagcaccgtgcccaacgtgaccgtgttcggcaccgccagcaccttcaagcacgaggccatcaaggacagcgtgacccacctgttcgacagaaacgccgactacgtgcaggaggtgaagagaatcagcgccgagggcgtggacatcgtgctggactgcctgtgcggcgacaacaccggcaagggcctgagcctgctgaagcccctgggcacctacatcctgtacggcagcagcaacatggtgaccggcgagaccaagagcttcttcagcttcgccaagagctggtggcaggtggagaaggtgaaccccatcaagctgtacgaggagaacaaggtgatcgccggcttcagcctgctgaacctgctgttcaagcagggcagagccggcctgatcagaggcgtggtggagaagctgatcggcctgtacaaccagaagaagatcaagcccgtggtggacagcctgtgggccctggaggaggtgaaggaggccatgcagagaatccacgacagaggcaacatcggcaagctgatcctggacgtggagaagacccccacccccctgatggccaacgacagcaccgagaccagcgaggccggcgaggaggaggaggaccacgagggcgacagcgagaacaaggagagaatgcccttcatccagtag

SEQ ID NO: 25961 - DNA, 648 bp, Artificial Sequence
  Description of Artificial Sequence: Synthetic coding sequence
atggtgctgctgaccatgatcgccagagtggccgacggcctgcccctggccgccagcatgcaggaggacgagcagagcggcagagacctgcagcagtaccagagccaggccaagcagctgttcagaaagctgaacgagcagagccccaccagatgcaccctggaggccggcgccatgaccttccactacatcatcgagcagggcgtgtgctacctggtgctgtgcgaggccgccttccccaagaagctggccttcgcctacctggaggacctgcacagcgagttcgacgagcagcacggcaagaaggtgcccaccgtgagcagaccctacagcttcatcgagttcgacaccttcatccagaagaccaagaagctgtacatcgacagcagagccagaagaaacctgggcagcatcaacaccgagctgcaggacgtgcagagaatcatggtggccaacatcgaggaggtgctgcagagaggcgaggccctgagcgccctggacagcaaggccaacaacctgagcagcctgagcaagaagtacagacaggacgccaagtacctgaacatgagaagcacctacgccaagctggccgccgtggccgtgttcttcatcatgctgatcgtgtacgtgagattctggtggctgtag

SEQ ID NO: 25962 - DNA, 873 bp, Artificial Sequence
  Description of Artificial Sequence: Synthetic coding sequence
atggagacccccctggacgtgctgagcagagccgccagcctggtgcacgccgacgacgagaagagagaggccgccctgagaggcgagcccagaatccagaccctgcccgtggccagcgccctgagcagccacagaaccggccccccccccatcagccccagcaagagaaagttcagcatggagcccggcgacgaggacctggactgcgacaacgaccacgtgagcaagatgagcagaatcttcaacccccacctgaacaagaccgccaacggcgactgcagaagagaccccagagagagaagcagaagccccatcgagagagccgtggcccccaccatgagcctgcacggcagccacctgtacaccagcctgcccagcctgggcctggagcagcccctggccctgaccaagaacagcctggacgccagcagacccgccggcctgagccccaccctgacccccggcgagagacagcagaacagacccagcgtgatcacctgcgccagcgccggcgccagaaactgcaacctgagccactgccccatcgcccacagcggctgcgccgcccccggccccgccagctacagaagaccccccagcgccgccaccacctgcgaccccgtggtggaggagcacttcagaagaagcctgggcaagaactacaaggagcccgagcccgcccccaacagcgtgagcatcaccggcagcgtggacgaccacttcgccaaggccctgggcgacacctggctgcagatcaaggccgccaaggacggcgccagcagcagccccgagagcgccagcagaagaggccagcccgccagccccagcgcccacatggtgagccacagccacagccccagcgtggtgagctag

SEQ ID NO: 25963 - DNA, 888 bp, Artificial Sequence
  Description of Artificial Sequence: Synthetic coding sequence
atgaccgagaacacccacttcgacaagatccccgagagctgcgccctgaagagctggagacaccccggcctgcaccacggcgaggccgccctgagaggcgagcccagaatccagaccctgcccgtggccagcgccctgagcagccacagaaccggccccccccccatcagccccagcaagagaaagttcagcatggagcccggcgacgaggacctggactgcgacaacgaccacgtgagcaagatgagcagaatcttcaacccccacctgaacaagaccgccaacggcgactgcagaagagaccccagagagagaagcagaagccccatcgagagagccgtggcccccaccatgagcctgcacggcagccacctgtacaccagcctgcccagcctgggcctggagcagcccctggccctgaccaagaacagcctggacgccagcagacccgccggcctgagccccaccctgacccccggcgagagacagcagaacagacccagcgtgatcacctgcgccagcgccggcgccagaaactgcaacctgagccactgccccatcgcccacagcggctgcgccgcccccggccccgccagctacagaagaccccccagcgccgccaccacctgcgaccccgtggtggaggagcacttcagaagaagcctgggcaagaactacaaggagcccgagcccgcccccaacagcgtgagcatcaccggcagcgtggacgaccacttcgccaaggccctgggcgacacctggctgcagatcaaggccgccaaggacggcgccagcagcagccccgagagcgccagcagaagaggccagcccgccagccccagcgcccacatggtgagccacagccacagccccagcgtggtgagctag

SEQ ID NO: 25964 - DNA, 510 bp, Artificial Sequence
  Description of Artificial Sequence: Synthetic coding sequence
atggagacccccctggacgtgctgagcagagccgccagcctggtgcacgccgacgacgagaagagagaggccgccctgagaggcgagcccagaatccagaccctgcccgtggccagcgccctgagcagccacagaaccggccccccccccatcagccccagcaagagaaagttcagcatggagcccggcgacgaggacctggactgcgacaacgaccacgtgagcaagatgagcagaatcttcaacccccacctgaacaagaccgccaacggcgactgcagaagagaccccagagagagaagcagaagccccatcgagagagccgtggcccccaccatgagcctgcacggcagccacctgtacaccagcctgcccagcctgggcctggagcagcccctggccctgaccaagaacagcctggacgccagcagacccgccggcctgagccccaccctgacccccggcgagagacagcaggtgggcctgtgcctgggcggctggagaggctag

SEQ ID NO: 25965 - DNA, 603 bp, Artificial Sequence
  Description of Artificial Sequence: Synthetic coding sequence
atggagacccccctggacgtgctgagcagagccgccagcctggtgcacgccgacgacgagaagagagaggccgccctgagaggcgagcccagaatccagaccctgcccgtggccagcgccctgagcagccacagaaccggccccccccccatcagccccagcaagagaaagttcagcatggagcccggcgacgaggacctggactgcgacaacgaccacgtgagcaagatgagcagaatcttcaacccccacctgaacaagaccgccaacggcgactgcagaagagaccccagagagagaagcagaagccccatcgagagagccgtggcccccaccatgagcctgcacggcagccacctgtacaccagcctgcccagcctgggcctggagcagcccctggccctgaccaagaacagcctggacgccagcagacccgccggcctgagccccaccctgacccccggcgagagacagcagaacagacccagcgtgatcacctgcgccagcgccggcgccagaaactgcaacctgagccactgccccatcgcccacagcggctgcgccgcccccggccccgccagctacagaagaccccccagctag

SEQ ID NO: 25966 - DNA, 384 bp, Artificial Sequence
  Description of Artificial Sequence: Synthetic coding sequence
atggagacccccctggacgtgctgagcagagccgccagcctggtgcacgccgacgacgagaagagagaggccgccctgagaggcgagcccagaatccagaccctgcccgtggccagcgccctgagcagccacagaaccggccccccccccatcagccccagcaagagaaagttcagcatggagcccggcgacgaggacctggactgcgacaacgaccacgtgagcaagatgagcagaatcttcaacccccacctgaacaagaccgccaacggcgactgcagaagagaccccagagagagaagcagaagccccatcgagagagccgtggcccccaccatgagcctgcacggcagccacctgtacaccagcctgcccagcctgtag

SEQ ID NO: 25967 - DNA, 891 bp, Artificial Sequence
  Description of Artificial Sequence: Synthetic coding sequence
atgctgttcatgaagatggacctgctgaactaccagtacctggacaagatgaacaacaacatcggcatcctgtgctacgagggcgaggccgccctgagaggcgagcccagaatccagaccctgcccgtggccagcgccctgagcagccacagaaccggccccccccccatcagccccagcaagagaaagttcagcatggagcccggcgacgaggacctggactgcgacaacgaccacgtgagcaagatgagcagaatcttcaacccccacctgaacaagaccgccaacggcgactgcagaagagaccccagagagagaagcagaagccccatcgagagagccgtggcccccaccatgagcctgcacggcagccacctgtacaccagcctgcccagcctgggcctggagcagcccctggccctgaccaagaacagcctggacgccagcagacccgccggcctgagccccaccctgacccccggcgagagacagcagaacagacccagcgtgatcacctgcgccagcgccggcgccagaaactgcaacctgagccactgccccatcgcccacagcggctgcgccgcccccggccccgccagctacagaagaccccccagcgccgccaccacctgcgaccccgtggtggaggagcacttcagaagaagcctgggcaagaactacaaggagcccgagcccgcccccaacagcgtgagcatcaccggcagcgtggacgaccacttcgccaaggccctgggcgacacctggctgcagatcaaggccgccaaggacggcgccagcagcagccccgagagcgccagcagaagaggccagcccgccagccccagcgcccacatggtgagccacagccacagccccagcgtggtgagctag

SEQ ID NO: 25968 - DNA, 675 bp, Artificial Sequence
  Description of Artificial Sequence: Synthetic coding sequence
atggagacccccctggacgtgctgagcagagccgccagcctggtgcacgccgacgacgagaagagagaggccgccctgagaggcgagcccagaatccagaccctgcccgtggccagcgccctgagcagccacagaaccggccccccccccatcagccccagcaagagaaagttcagcatggagcccggcgacgaggacctggactgcgacaacgaccacgtgagcaagatgagcagaatcttcaacccccacctgaacaagaccgccaacggcgactgcagaagagaccccagagagagaagcagaagccccatcgagagagccgtggcccccaccatgagcctgcacggcagccacctgtacaccagcctgcccagcctgggcctggagcagcccctggccctgaccaagaacagcctggacgccagcagacccgccggcctgagccccaccctgacccccggcgagagacagcagaacagacccagcgtgatcacctgcgccagcgccggcgccagaaactgcaacctgagccactgccccatcgcccacagcggctgcgccgcccccggccccgccagctacagaagaccccccagcgccgccaccacctgcgaccccgtggtggaggagcacttcagaagaagcctgggcaagaactacaaggagccctag

SEQ ID NO: 25969 - DNA, 621 bp, Artificial Sequence
  Description of Artificial Sequence: Synthetic coding sequence
atgaacaagaccgccaacggcgactgcagaagagaccccagagagagaagcagaagccccatcgagagagccgtggcccccaccatgagcctgcacggcagccacctgtacaccagcctgcccagcctgggcctggagcagcccctggccctgaccaagaacagcctggacgccagcagacccgccggcctgagccccaccctgacccccggcgagagacagcagaacagacccagcgtgatcacctgcgccagcgccggcgccagaaactgcaacctgagccactgccccatcgcccacagcggctgcgccgcccccggccccgccagctacagaagaccccccagcgccgccaccacctgcgaccccgtggtggaggagcacttcagaagaagcctgggcaagaactacaaggagcccgagcccgcccccaacagcgtgagcatcaccggcagcgtggacgaccacttcgccaaggccctgggcgacacctggctgcagatcaaggccgccaaggacggcgccagcagcagccccgagagcgccagcagaagaggccagcccgccagccccagcgcccacatggtgagccacagccacagccccagcgtggtgagctag

SEQ ID NO: 25970 - DNA, 633 bp, Artificial Sequence
  Description of Artificial Sequence: Synthetic coding sequence
atgatcaaggtgagaaacaagaccgccaacggcgactgcagaagagaccccagagagagaagcagaagccccatcgagagagccgtggcccccaccatgagcctgcacggcagccacctgtacaccagcctgcccagcctgggcctggagcagcccctggccctgaccaagaacagcctggacgccagcagacccgccggcctgagccccaccctgacccccggcgagagacagcagaacagacccagcgtgatcacctgcgccagcgccggcgccagaaactgcaacctgagccactgccccatcgcccacagcggctgcgccgcccccggccccgccagctacagaagaccccccagcgccgccaccacctgcgaccccgtggtggaggagcacttcagaagaagcctgggcaagaactacaaggagcccgagcccgcccccaacagcgtgagcatcaccggcagcgtggacgaccacttcgccaaggccctgggcgacacctggctgcagatcaaggccgccaaggacggcgccagcagcagccccgagagcgccagcagaagaggccagcccgccagccccagcgcccacatggtgagccacagccacagccccagcgtggtgagctag

SEQ ID NO: 25971 - DNA, 906 bp, Artificial Sequence
  Description of Artificial Sequence: Synthetic coding sequence
atggccagcagatacgtggccgtgggcatgatcctgagccagaccgtggtgggcgtgctgggcagcttcagcgtgctgctgcactacctgagcttctactgcaccggctgcagactgagaagcaccgacctgatcgtgaagcacctgatcgtggccaacttcctggccctgagatgcaagggcgtgccccagaccatggccgccttcggcgtgagatacttcctgaacgccctgggctgcaagctggtgttctacctgcacagagtgggcagaggcgtgagcatcggcaccacctgcctgctgagcgtgttccaggtgatcaccgtgagcagcagaaagagcagatgggccaagctgaaggagaaggcccccaagcacgtgggcttcagcgtgctgctgtgctggatcgtgtgcatgctggtgaacatcatcttccccatgtacgtgaccggcaagtggaactacaccaacatcaccgtgaacgaggacctgggctactgcagcggcggcggcaacaacaagatcgcccagaccctgagagccatgctgctgagcttccccgacgtgctgtgcctgggcctgatgctgtgggtgagcagcagcatggtgtgcatcctgcacagacacaagcagagagtgcagcacatcgacagaagcaacctgagccccagagccagccccgagaacagagccacccagagcatcctgatcctggtgagcaccttcgtgagcagctacaccctgagctgcctgttccaggtgtgcatggccctgctggacaaccccaacagcctgctggtgaacaccagcgccctgatgagcgtgtgcttccccaccctgagccccttcgtgctgatgagctgcgaccccagcgtgtacagattctgcttcgcctggaagagatag

SEQ ID NO: 25972 - DNA, 2178 bp, Artificial Sequence
  Description of Artificial Sequence: Synthetic coding sequence
atgccccccttcctgctgctggaggccgtgtgcgtgttcctgttcagcagagtgccccccagcctgcccctgcaggaggtgcacgtgagcaaggagaccatcggcaagatcagcgccgccagcaagatgatgtggtgcagcgccgccgtggacatcatgttcctgctggacggcagcaacagcgtgggcaagggcagcttcgagagaagcaagcacttcgccatcaccgtgtgcgacggcctggacatcagccccgagagagtgagagtgggcgccttccagttcagcagcaccccccacctggagttccccctggacagcttcagcacccagcaggaggtgaaggccagaatcaagagaatggtgttcaagggcggcagaaccgagaccgagctggccctgaagtacctgctgcacagaggcctgcccggcggcagaaacgccagcgtgccccagatcctgatcatcgtgaccgacggcaagagccagggcgacgtggccctgcccagcaagcagctgaaggagagaggcgtgaccgtgttcgccgtgggcgtgagattccccagatgggaggagctgcacgccctggccagcgagcccagaggccagcacgtgctgctggccgagcaggtggaggacgccaccaacggcctgttcagcaccctgagcagcagcgccatctgcagcagcgccacccccgactgcagagtggaggcccacccctgcgagcacagaaccctggagatggtgagagagttcgccggcaacgccccctgctggagaggcagcagaagaaccctggccgtgctggccgcccactgccccttctacagctggaagagagtgttcctgacccaccccgccacctgctacagaaccacctgccccggcccctgcgacagccagccctgccagaacggcggcacctgcgtgcccgagggcctggacggctaccagtgcctgtgccccctggccttcggcggcgaggccaactgcgccctgaagctgagcctggagtgcagagtggacctgctgttcctgctggacagcagcgccggcaccaccctggacggcttcctgagagccaaggtgttcgtgaagagattcgtgagagccgtgctgagcgaggacagcagagccagagtgggcgtggccacctacagcagagagctgctggtggccgtgcccgtgggcgagtaccaggacgtgcccgacctggtgtggagcctggacggcatccccttcagaggcggccccaccctgaccggcagcgccctgagacaggccgccgagagaggcttcggcagcgccaccagaaccggccaggacagacccagaagagtggtggtgctgctgaccgagagccacagcgaggacgaggtggccggccccgccagacacgccagagccagagagctgctgctgctgggcgtgggcagcgaggccgtgagagccgagctggaggagatcaccggcagccccaagcacgtgatggtgtacagcgacccccaggacctgttcaaccagatccccgagctgcagggcaagctgtgcagcagacagagacccggctgcagaacccaggccctggacctggtgttcatgctggacaccagcgccagcgtgggccccgagaacttcgcccagatgcagagcttcgtgagaagctgcgccctgcagttcgaggtgaaccccgacgtgacccaggtgggcctggtggtgtacggcagccaggtgcagaccgccttcggcctggacaccaagcccaccagagccgccatgctgagagccatcagccaggccccctacctgggcggcgtgggcagcgccggcaccgccctgctgcacatctacgacaaggtgatgaccgtgcagagaggcgccagacccggcgtgcccaaggccgtggtggtgctgaccggcggcagaggcgccgaggacgccgccgtgcccgcccagaagctgagaaacaacggcatcagcgtgctggtggtgggcgtgggccccgtgctgagcgagggcctgagaagactggccggccccagagacagcctgatccacgtggccgcctacgccgacctgagataccaccaggacgtgctgatcgagtggctgtgcggcggcgagtggggcaacccccacccccagggctgcccccacggcagacccagcgcctag

SEQ ID NO: 25973 - DNA, 1251 bp, Artificial Sequence
  Description of Artificial Sequence: Synthetic coding sequence
atggccaccaagggcatgagactgaagagcaccaaggaggtgttccccctggcccacgtgtgcaacgacaccaacaagatgaccctgatcaacccccagggcgccaagctgaacatctacaagagaaaggtggagcaggccatccagagctacgagaagagactgaacaagatcgtgtggagagccctgagccaggaggagaaggagaagctggacgccaacaagcccatccagtacctggagaacaagaccgtgctgaaccaggccctggagagactgaactggcccatcagcctgaaggagctgagcatgctggagagcgagatcctggccggcaagatgtacatccagcaggccatggagctgcaggaggccgccaagaagaactacgccaacaaggcccccggcgagcagcagaagctgcagggcaaccccaccaagaagaccaagagcaagagacccgaccccctgaagggccagaaggtgatcgccagatgcgacgagaacggcttctacttccccggcgtggtgaagaagtgcgtgagcagaacccaggccctggtgggcttcagctacggcgacaccaaggtggtgagcaccagcttcatcacccccgtgggcggcgccatgccctgccccctgctgcaggtgggcgactacgtgttcgccaagatcgtgatccccaagggcttcgacttctacgtgcccgccatcgtgatcgccctgcccaacaagcacgtggccaccgagaagttctacaccgtgctgaagtgcaacaacagaagagagttctgccccagaagcgccctgatcaagatcagccagaacaagtacgccctgagctgcagccacatcaagagcccccccatccccgaggaccccgaggtggaggacgtggaggccagaaacagcgccttcctgttctggcccctgaaggaggccgacacccaggacagcagagagcccagaagagagaagcccagaagaaagaagagacccgccaagcagcccctgcagcaggccgcccccagcgacagcgacggcagcagccacggcatcagcagccacggcagctgccagggcacccaccccgagcccagaaccgcccacctgcacttccccgccgccggcagactgggcctgagcagccacgccatcatcgccacccccccccccagagccgccctgccctgcaccctgcaggccacccacagcagcaagggcctgagaagcgtgcccgagaccctgtag

SEQ ID NO: 25974 - DNA, 1875 bp, Artificial Sequence
  Description of Artificial Sequence: Synthetic coding sequence
atggagaagagcggccccagcagcaccatcagcgagcagcagctgcagagacaggagggctggatcaacaccaagaccgacctggccgagcagagcctgatcagcagcgagaagtggctgcagctgcacggcctgaagagcaacaagctgaccctgaagcagatcctgagccagatcggcttcccccactgcgaggactacgtggccagcctgggcagacccgtggccagcagatacgccgacggcctgttcccccagctgtacagagccgaggacggcagagtgtacaacctgaccgccaagagcgagctgatctaccagttcgtggagcacctgacccaggccgtggagagctacaagcagagaatggactggctgaccagcaagagcagacagatcttcggcgtgatcctggagcagtgcgtgaccatcgtgctggacttcggcggcatcctggagggcgagctggacctgtgcagagaggccctgaccatggtgctgcaggagcaggtggcccacatcaccgagttcaacatcatcagagtgagccaggagcccgtgaagtggcaggagaacgccacccccgtgaccgagcagagcatcgccaccgccatcagctgggtggagaagctgaccgtggagctgaccgtgagcgaggccggcagactggacgccctgctggaggccggcagagacaagaccatcgagagcatctactacttcgtggtgggcgacgtgcccgaggagagcaaggagctgctgctgcagagagccctggagatcccctgccccgtgtacaccgtgagcttcaacgccagaggcgagggcaccatcgccttcctgaaggacctgagcgccaagacccacagcagattccacgccttcgccgagagaaccgagtgcgtggagttccccgccttcagcaccaaggacggcgacaacgtgatgacctggaacagcagaaagctgaagggcaagctgccccccggcgccggcgtgagagaggacgtgttcctggtgtggcaggagatggaggaggcctgcagcaccctggcccagatccagagactggtggccgagccccccaagcccgacgtggccaccgtggactgcgagagcgagaccaccagcgtggagatcgccagcaaccccgaggacacctgggacagcaagacctggctgcagaagtacggcctgaaggcccagaagctgagcctgtacgacgtgctggccgactgcagcttcagacacgccgacggcgtggtggacatcaaggccaagcccgagaacgagagcgtgcagaccagcgccgagaccaacaagaagaccgtgcacgccaagtactgcagcagattcgtgcacgccccctggaaggacggcagcctggtgcacgtgaacatcaccaaggagaagtgcaagtggtacagcgagagaatccacaccgccctggccagaatcagaagaagaatcaagtggctgcaggacggcagccagagcctgttcggcagactgcacaacgactgcatctacatcctgatcgacaccagccacagcatgaagagcaagctggacctggtgaaggacaagatcatccagttcatccaggagcagctgaagtacaagagcaagttcaacttcgtgaagttcgacggccaggccgtggcctggagagagcagctggccgaggtgaacgaggacaacctggagcaggcccagagctggatcagagacatcaagatcggcagcagcaccaacaccctgagcgccctgaagaccgccttcgccgacaaggagacccaggccatctacctgctgaccgacggcagacccgaccagggcaccagcagccacctgctgctgaccgccgccgtgtag

SEQ ID NO: 25975 - DNA, 1428 bp, Artificial Sequence
  Description of Artificial Sequence: Synthetic coding sequence
atgtggagactgtggggcgacctgtggctgctgggcatgctgatggtgtgcttccacagcagcaccgagcagaagatggccgagtacaccatggtgagccaggagcccgtgaagtggcaggagaacgccacccccgtgaccgagcagagcatcgccaccgccatcagctgggtggagaagctgaccgtggagctgaccgtgagcgaggccggcagactggacgccctgctggaggccggcagagacaagaccatcgagagcatctactacttcgtggtgggcgacgtgcccgaggagagcaaggagctgctgctgcagagagccctggagatcccctgccccgtgtacaccgtgagcttcaacgccagaggcgagggcaccatcgccttcctgaaggacctgagcgccaagacccacagcagattccacgccttcgccgagagaaccgagtgcgtggagttccccgccttcagcaccaaggacggcgacaacgtgatgacctggaacagcagaaagctgaagggcaagctgccccccggcgccggcgtgagagaggacgtgttcctggtgtggcaggagatggaggaggcctgcagcaccctggcccagatccagagactggtggccgagccccccaagcccgacgtggccaccgtggactgcgagagcgagaccaccagcgtggagatcgccagcaaccccgaggacacctgggacagcaagacctggctgcagaagtacggcctgaaggcccagaagctgagcctgtacgacgtgctggccgactgcagcttcagacacgccgacggcgtggtggacatcaaggccaagcccgagaacgagagcgtgcagaccagcgccgagaccaacaagaagaccgtgcacgccaagtactgcagcagattcgtgcacgccccctggaaggacggcagcctggtgcacgtgaacatcaccaaggagaagtgcaagtggtacagcgagagaatccacaccgccctggccagaatcagaagaagaatcaagtggctgcaggacggcagccagagcctgttcggcagactgcacaacgactgcatctacatcctgatcgacaccagccacagcatgaagagcaagctggacctggtgaaggacaagatcatccagttcatccaggagcagctgaagtacaagagcaagttcaacttcgtgaagttcgacggccaggccgtggcctggagagagcagctggccgaggtgaacgaggacaacctggagcaggcccagagctggatcagagacatcaagatcggcagcagcaccaacaccctgagcgccctgaagaccgccttcgccgacaaggagacccaggccatctacctgctgaccgacggcagacccgaccagcagcccttcaaggagggcgtgagcgtgctgagccacagatag

SEQ ID NO: 25976 - DNA, 3885 bp, Artificial Sequence
  Description of Artificial Sequence: Synthetic coding sequence
atggagaagagcggccccagcagcaccatcagcgagcagcagctgcagagacaggagggctggatcaacaccaagaccgacctggccgagcagagcctgatcagcagcgagaagtggctgcagctgcacggcctgaagagcaacaagctgaccctgaagcagatcctgagccagatcggcttcccccactgcgaggactacgtggccagcctgggcagacccgtggccagcagatacgccgacggcctgttcccccagctgtacagagccgaggacggcagagtgtacaacctgaccgccaagagcgagctgatctaccagttcgtggagcacctgacccaggccgtggagagctacaagcagagaatggactggctgaccagcaagagcagacagatcttcggcgtgatcctggagcagtgcgtgaccatcgtgctggacttcggcggcatcctggagggcgagctggacctgtgcagagaggccctgaccatggtgctgcaggagcaggtggcccacatcaccgagttcaacatcatcagagtgagccaggagcccgtgaagtggcaggagaacgccacccccgtgaccgagcagagcatcgccaccgccatcagctgggtggagaagctgaccgtggagctgaccgtgagcgaggccggcagactggacgccctgctggaggccggcagagacaagaccatcgagagcatctactacttcgtggtgggcgacgtgcccgaggagagcaaggagctgctgctgcagagagccctggagatcccctgccccgtgtacaccgtgagcttcaacgccagaggcgagggcaccatcgccttcctgaaggacctgagcgccaagacccacagcagattccacgccttcgccgagagaaccgagtgcgtggagttccccgccttcagcaccaaggacggcgacaacgtgatgacctggaacagcagaaagctgaagggcaagctgccccccggcgccggcgtgagagaggacgtgttcctggtgtggcaggagatggaggaggcctgcagcaccctggcccagatccagagactggtggccgagccccccaagcccgacgtggccaccgtggactgcgagagcgagaccaccagcgtggagatcgccagcaaccccgaggacacctgggacagcaagacctggctgcagaagtacggcctgaaggcccagaagctgagcctgtacgacgtgctggccgactgcagcttcagacacgccgacggcgtggtggacatcaaggccaagcccgagaacgagagcgtgcagaccagcgccgagaccaacaagaagaccgtgcacgccaagtactgcagcagattcgtgcacgccccctggaaggacggcagcctggtgcacgtgaacatcaccaaggagaagtgcaagtggtacagcgagagaatccacaccgccctggccagaatcagaagaagaatcaagtggctgcaggacggcagccagagcctgttcggcagactgcacaacgactgcatctacatcctgatcgacaccagccacagcatgaagagcaagctggacctggtgaaggacaagatcatccagttcatccaggagcagctgaagtacaagagcaagttcaacttcgtgaagttcgacggccaggccgtggcctggagagagcagctggccgaggtgaacgaggacaacctggagcaggcccagagctggatcagagacatcaagatcggcagcagcaccaacaccctgagcgccctgaagaccgccttcgccgacaaggagacccaggccatctacctgctgaccgacggcagacccgaccagccccccgagaccgtgatcgaccaggtgaagagattccaggagatccccatctacaccatcagcttcaactacaacgacgagatcgccaacagattcctgaaggaggtggccgccctgaccggcggcgagttccacttctacaacttcggctgcaaggaccccaccccccccgaggccgtgcagaacgaggacctgaccctgctggtgaaggagatggagcagggccacagcgacctggagaagatgcaggacctgtacagcgagagcctgatcatggactggtggtacaacgccgagaaggacggcgacagcaagcaccagaaggagatctgcagcatgatcagcacccccgagaagtgcgccaagccccagagcgacgtggacagcacccagaccagcagcctgaacatgctgaagggcccctggggcctgagcgaccagaaggtgcagaagaagaaggtgctgcacgccgagagcaccaagaccagcctgctgagaagccagatgagcagcctgagaagcagcgcctgcagcgagagaaaggacggcctgagcaacgccagcagcagaagaaccgccctgagcgacaaggagatgagcatcctgctggccgaggagtggctggacgacaagagcagcgagaaggtgaccagagagggcagccaggtgtacgaccacgacagcagcgacgtgagcagcgagaactggctgaagacctacggcctggtggccaagaagctgaccctgatggacgccctgagcgtggccgccgtgccccacagcagcacctacgtgcccgtgctggacaagcacgtggtgagcaaggtgttcgacgaggtgttccccctggcccacgtgtgcaacgacaccaacaagatgaccctgatcaacccccagggcgccaagctgaacatctacaagagaaaggtggagcaggccatccagagctacgagaagagactgaacaagatcgtgtggagagccctgagccaggaggagaaggagaagctggacgccaacaagcccatccagtacctggagaacaagaccgtgctgaaccaggccctggagagactgaactggcccatcagcctgaaggagctgagcatgctggagagcgagatcctggccggcaagatgtacatccagcaggccatggagctgcaggaggccgccaagaagaactacgccaacaaggcccccggcgagcagcagaagctgcagggcaaccccaccaagaagaccaagagcaagagacccgaccccctgaagggccagaaggtgatcgccagatgcgacgagaacggcttctacttccccggcgtggtgaagaagtgcgtgagcagaacccaggccctggtgggcttcagctacggcgacaccaaggtggtgagcaccagcttcatcacccccgtgggcggcgccatgccctgccccctgctgcaggtgggcgactacgtgttcgccaagatcgtgatccccaagggcttcgacttctacgtgcccgccatcgtgatcgccctgcccaacaagcacgtggccaccgagaagttctacaccgtgctgaagtgcaacaacagaagagagttctgccccagaagcgccctgatcaagatcagccagaacaagtacgccctgagctgcagccacatcaagagcccccccatccccgaggaccccgaggtggaggacgtggaggccagaaacagcgccttcctgttctggcccctgaaggaggccgacacccaggacagcagagagcccagaagagagaagcccagaagaaagaagagacccgccaagcagcccctgcagcaggccgcccccagcgacagcgacggcagcagccacggcatcagcagccacggcagctgccagggcacccaccccgagcccagaaccgcccacctgcacttccccgccgccggcagactgggcctgagcagccacgccatcatcgccacccccccccccagagccgccctgccctgcaccctgcaggccacccacagcagcaagggcctgagaagcgtgcccgagaccctgtag

SEQ ID NO: 25977 - DNA, 3729 bp, Artificial Sequence
  Description of Artificial Sequence: Synthetic coding sequence
atgcccggcctgtactgccccagcagctggacccccctgcccctgaccgacagctgggtgagagcctgcgccaacggcccctgcctgagcgtgagagccagactgacctacagaaacccccagccccagcccgtggacggcgtgttcgtgtaccccctggccgaggccgaggtggtgagcggcttcgaggccgaggccgccggcagaagagtgagcttccagctgcagagcagaagaagaagccaggccgcctgctgcagagccctgggccccggcctgggcacccccacccccagaagatgcgcccagggccacctggtgctggacctggcccaggccagaagcaccctggtgctgcccaccggcatcatcgccgccgccggcaccatgaccgtgaccctgcacagcagcagagagctgcccagcagacccgacggcgtgctgcacgtggccctgcccaccgtgctgacccccctggccccccccggcccccccggcccccccagaccccccggcctgtgcgacgacagccccaccagctgcttcggcgtgggcagcctgcaggaggagggcctggcctgggaggagctggccgcccccagagacgtgttcagcggccccgccagatgccccgccccctacaccttcagcttcgagatgctggtgaccggcccctgcctgctggccggcctggagagccccagccacgccctgagagccgacgcccccccccacgccagcagcgccgccaccatctgcgtgaccctggccgagggccaccactgcgacagagccctggagatcctgctgcaccccagcgagccccaccagccccacctgatgctggagggcggcagcctgagcagcgccgagtacgaggccagagtgagagccagaagagacttccagagactgcagagaagagacagcgacggcgacagacaggtgtggttcctgcagagaagattccacaaggacatcctgctgaaccccgtgctggccctgagcttctgccccgacctgagcagcaagcccggccacctgggcaccgccaccagagagctgctgttcctgctggacagcagcagcgtggcccacaaggacgccatcgtgctggccgtgaagagcctgcccccccagaccctgatcaacctggccgtgttcggcaccctggtgcagcccctgttccccgagagcagaccctgcagcgacgacgccgtgcagctgatctgcgagagcatcgagaccctgcaggtgcccagcggcccccccgacgtgctggccgccctggactgggccgtgggccagccccagcacagagcctaccccagacagctgttcctgctgaccgccgccagccccatggccgccaccacccacagaaccctggagctgatgagatggcacagaggcaccgccagatgcttcagcttcggcctgggccccacctgccaccagctgctgcagggcctgagcgccctgagcagaggccaggcctacttcctgagacccggccagagactgcagcccatgctggtgcaggccctgagaaaggccctggagcccgccctgagcgacatcagcgtggactggttcgtgcccgacaccgtggaggccctgctgacccccagagagatccccgccctgtaccccggcgaccagctgctgggctactgcagcctgttcagagtggacggcttcagaagcagaccccccggcggccaggagcccggctggcagagcagcggcggcagcgtgttccccagccccgaggaggcccccagcgccgccagccccggcaccgagcccaccggcaccagcgagcccctgggcaccggcaccgtgagcgccgagctgagcagcccctgggccgccagagacagcgagcagagcaccgacgccctgaccgaccccgtgaccgaccccggccccaaccccagcgacaccgccatctggagaagaatcttccagagcagctacatcagagagcagtacgtgctgacccactgcagcgccagccccgagcccggccccggcagcaccggcagcagcgagagccccggcagccagggccccggcagccccgagggcagcgcccccctggagccccccagccagcagggctgcagaagcctggcctggggcgagcccgccggcagcagaagctgccccctgcccgcccccacccccgcccccttcaaggtgggcgccctgagcaccgaggtgctgggcagacagcacagagccgccctggccggcagaagcctgagcagcccccccggcagagccaaccaggtgcccggcagacccagaaagcccagcctgggcgccatcctggacggccccagccccgagcccggccagcagctgggccagggcctggacgacagcggcaacctgctgagccccgcccccatggactgggacatgctgatggagccccccttcctgttcaccgccgtgccccccagcggcgagctggccccccccgccgtgcccccccaggcccccagatgccacgtggtgatcagaggcctgtgcggcgagcagcccatgtgctgggaggtgggcgtgggcctggagaccctgtggggccccggcgacggcagccagccccccagcccccccgtgagagaggccgcctgggaccaggccctgcacagactgaccgccgccagcgtggtgagagacaacgagcagctggccctgagaggcggcgccgagaccaccgccgacagaggccacgccagaagatgctggctgagagccctgcagaccagcaaggtgagcagcgcccccagctgcttcacctgccccgtggccgtggacgccaccaccagagaggtgctgcccggcgccctgcaggtgtgcagcagcgagcccgccgagccccccggcaccccccccgccagccacagccacctggacgccgcccccctgcccaccgtggtgtacagcaagggcctgcagagaggcagccccgccggcgcctgggacagcgaccagaacggcaacagcaagagagccctgggcgaccccgccacccccaccgagggccccagaagacccccccccagacccccctgcagactgagcatgggcagaagacacaagctgtgcagccccgaccccggccaggccaacaacagcgagggcagcgaccacgactacctgcccctggtgagactgcaggaggcccccggcagcttcagactggacgcccccttctgcgccgccgtgagaatcagccaggagagactgtgcagagccagccccttcgccgtgcacagagccagcctgagccccaccagcgccagcctgccctgggccctgctgggccccggcgtgggccagggcgacagcgccaccgccagctgcagccccagccccagcagcggcagcgagggccccggccaggtggacagcggcagaggcagcgacaccgaggccagcgagggcgccgagggcctgggcggcaccgacctgagaggcagaacctgggccaccgccgtggccctggcctggctggagcacagatgcgccgccgccttcgacgagtgggagctgaccgccgccaaggccgactgctggctgagagcccagcacctgcccgacggcctggacctggccgccctgaaggccgccgccagaggcctgttcctgctgctgagacactgggaccagaacctgcagctgcacctgctgtgctacagccccgccaacgtgtag

SEQ ID NO: 25978 - DNA, 2676 bp, Artificial Sequence
  Description of Artificial Sequence: Synthetic coding sequence
atgctgcccaccgaggtgccccagagccaccccggccccagcgccctgctgctgctgcagctgctgctgccccccaccagcgccttcttccccaacatctggagcctgctggccgcccccggcagcatcacccaccaggacctgaccgaggaggccgccctgaacgtgaccctgcagctgttcctggagcagcccccccccggcagaccccccctgagactggaggacttcctgggcagaaccctgctggccgacgacctgttcgccgcctacttcggccccggcagcagcagaagattcagagccgccctgggcgaggtgagcagagccaacgccgcccaggacttcctgcccaccagcagaaacgaccccgacctgcacttcgacgccgagagactgggccagggcagagccagactggtgggcgccctgagagagaccgtggtggccgccagagccctggaccacaccctggccagacagagactgggcgccgccctgcacgccctgcaggacttctacagccacagcaactgggtggagctgggcgagcagcagccccacccccacctgctgtggcccagacaggagctgcagaacctggcccaggtggccgaccccacctgcagcgactgcgaggagctgagctgccccagaaactggctgggcttcaccctgctgaccagcggctacttcggcacccacccccccaagccccccggcaagtgcagccacggcggccacttcgacagaagcagcagccagccccccagaggcggcatcaacaaggacagcaccagccccggcttcagcccccaccacatgctgcacctgcaggccgccaagctggccctgctggccagcatccaggccttcagcctgctgagaagcagactgggcgacagagacttcagcagactgctggacatcacccccgccagcagcctgagcttcgtgctggacaccaccggcagcatgggcgaggagatcaacgccgccaagatccaggccagacacctggtggagcagagaagaggcagccccatggagcccgtgcactacgtgctggtgcccttccacgaccccggcttcggccccgtgttcaccaccagcgaccccgacagcttctggcagcagctgaacgagatccacgccctgggcggcggcgacgagcccgagatgtgcctgagcgccctgcagctggccctgctgcacaccccccccctgagcgacatcttcgtgttcaccgacgccagccccaaggacgccttcctgaccaaccaggtggagagcctgacccaggagagaagatgcagagtgaccttcctggtgaccgaggacaccagcagagtgcagggcagagccagaagagagatcctgagccccctgagattcgagccctacaaggccgtggccctggccagcggcggcgaggtgatcttcaccaaggaccagcacatcagagacgtggccgccatcgtgggcgagagcatggccgccctggtgaccctgcccctggacccccccgtggtggtgcccggccagcccctggtgttcagcgtggacggcctgctgcagaagatcaccgtgagaatccacggcgacatcagcagcttctggatcaagaaccccgccggcgtgagccagggccaggaggagggcggcggccccctgggccacaccagaagattcggccagttctggatggtgaccatggacgaccccccccagaccggcacctgggagatccaggtgaccgccgaggacacccccggcgtgagagtgcaggcccagaccagcctggacttcctgttccacttcggcatccccatggaggacggcccccaccccggcctgtaccccctgacccagcccgtggccggcctgcagacccagctgctggtggaggtgaccggcctgggcagcagagccaaccccggcgacccccagccccacttcagccacgtgatcctgagaggcgtgcccgagggcgccgagctgggccaggtgcccctggagcccgtgggcccccccgagagaggcctgctggccgccagcctgagccccaccctgctgagcacccccagacccttcagcctggagctgatcggccaggacgccgccggcagaagactgcacagagccgccccccagcccagcaccgtggtgcccgtgctgctggagctgagcggccccagcggcttcctggcccccggcagcaaggtgcccctgagcctgagaatcgccagcttcagcggcccccaggacctggacctgagaaccttcgtgaaccccagcttcagcctgaccagcaacctgagcagagcccacctggagctgaacgagagcgcctggggcagactgtggctggaggtgcccgacagcgccgcccccgacagcgtggtgatggtgaccgtgaccgccggcggcagagaggccaaccccgtgccccccacccacgccttcctgagactgctggtgagcgcccccgccccccaggacagacacaccacccccaccggcagcagcgaccccatcctgaccaccgccacccccgccttcagccccttcaccctggtggcccagggcagagccggcgccggcctggccgccggcagcccctggtggggcaccgtgggcggcgtgctgctgctgctgggcctggccagctggtag

SEQ ID NO: 25979 - DNA, 2067 bp, Artificial Sequence
  Description of Artificial Sequence: Synthetic coding sequence
atgctgcccaccgaggtgccccagagccaccccggccccagcgccctgctgctgctgcagctgctgctgccccccaccagcgccttcttccccaacatctggagcctgctggccgcccccggcagcatcacccaccaggacctgaccgaggaggccgccctgaacgtgaccctgcagctgttcctggagcagcccccccccggcagaccccccctgagactggaggacttcctgggcagaaccctgctggccgacgacctgttcgccgcctacttcggccccggcagcagcagaagattcagagccgccctgggcgaggtgagcagagccaacgccgcccaggacttcctgcccaccagcagaaacgaccccgacctgcacttcgacgccgagagactgggccagggcagagccagactggtgggcgccctgagagagaccgtggtggccgccagagccctggaccacaccctggccagacagagactgggcgccgccctgcacgccctgcaggacttctacagccacagcaactgggtggagctgggcgagcagcagccccacccccacctgctgtggcccagacaggagctgcagaacctggcccaggtggccgaccccacctgcagcgactgcgaggagctgagctgccccagaaactggctgggcttcaccctgctgaccagcggctacttcggcacccacccccccaagccccccggcaagtgcagccacggcggccacttcgacagaagcagcagccagccccccagaggcggcatcaacaaggacagcaccagccccggcttcagcccccaccacatgctgcacctgcaggccgccaagctggccctgctggccagcatccaggccttcagcctgctgagaagcagactgggcgacagagacttcagcagactgctggacatcacccccgccagcagcctgagcttcgtgctggacaccaccggcagcatgggcgaggagatcaacgccgccaagatccaggccagacacctggtggagcagagaagaggcagccccatggagcccgtgcactacgtgctggtgcccttccacgaccccggcttcggccccgtgttcaccaccagcgaccccgacagcttctggcagcagctgaacgagatccacgccctgggcggcggcgacgagcccgagatgtgcctgagcgccctgcagctggccctgctgcacaccccccccctgagcgacatcttcgtgttcaccgacgccagccccaaggacgccttcctgaccaaccaggtggagagcctgacccaggagagaagatgcagagtgaccttcctggtgaccgaggacaccagcagagtgcagggcagagccagaagagagatcctgagccccctgagattcgagccctacaaggccgtggccctggccagcggcggcgaggtgatcttcaccaaggaccagcacatcagagacgtggccgccatcgtgggcgagagcatggccgccctggtgaccctgcccctggacccccccgtggtggtgcccggccagcccctggtgttcagcgtggacggcctgctgcagaagatcaccgtgagaatccacggcgacatcagcagcttctggatcaagaaccccgccggcgtgagccagggccaggaggagggcggcggccccctgggccacaccagaagattcggccagttctggatggtgaccatggacgaccccccccagaccggcacctgggagatccaggtgaccgccgaggacacccccggcgtgagagtgcaggcccagaccagcctggacttcctgttccacttcggcatccccatggaggacggcccccaccccggcctgtaccccctgacccagcccgtggccggcctgcagacccagctgctggtggagagccagagctggggcagcagcgccgccttcctgcccagacaccccagcagaggccccagaggctgcagaaccagacccggcgccctgggcgccagaggcaccagcggcgccagaagccccagaagcctggccgtggcccacgccgccgtgaacccctag

SEQ ID NO: 25980 - DNA, 2559 bp, Artificial Sequence
  Description of Artificial Sequence: Synthetic coding sequence
atgctgcccaccgaggtgccccagagccaccccggccccagcgccctgctgctgctgcagctgctgctgccccccaccagcgccttcttccccaacatctggagcctgctggccgcccccggcagcatcacccaccaggacctgaccgaggaggccgccctgaacgtgaccctgcagctgttcctggagcagcccccccccggcagaccccccctgagactggaggacttcctgggcagaaccctgctggccgacgacctgttcgccgcctacttcggccccggcagcagcagaagattcagagccgccctgggcgaggtgagcagagccaacgccgcccaggacttcctgcccaccagcagaaacgaccccgacctgcacttcgacgccgagagactgggccagggcagagccagactggtgggcgccctgagagagaccgtggtggccgccagagccctggaccacaccctggccagacagagactgggcgccgccctgcacgccctgcaggacttctacagccacagcaactgggtggagctgggcgagcagcagccccacccccacctgctgtggcccagacaggagctgcagaacctggcccaggtggccgaccccacctgcagcgactgcgaggagctgagctgccccagaaactggctgggcttcaccctgctgaccagcggctacttcggcacccacccccccaagccccccggcaagtgcagccacggcggccacttcgacagaagcagcagccagccccccagaggcggcatcaacaaggacagcaccagccccggcttcagcccccaccacatgctgcacctgcaggccgccaagctggccctgctggccagcatccaggccttcagcctgctgagaagcagactgggcgacagagacttcagcagactgctggacatcacccccgccagcagcctgagcttcgtgctggacaccaccggcagcatgggcgaggagatcaacgccgccaagatccaggccagacacctggtggagcagagaagaggcagccccatggagcccgtgcactacgtgctggtgcccttccacgaccccggcttcggccccgtgttcaccaccagcgaccccgacagcttctggcagcagctgaacgagatccacgccctgggcggcggcgacgagcccgagatgtgcctgagcgccctgcagctggccctgctgcacaccccccccctgagcgacatcttcgtgttcaccgacgccagccccaaggacgccttcctgaccaaccaggtggagagcctgacccaggagagaagatgcagagtgaccttcctggtgaccgaggacaccagcagagtgcagggcagagccagaagagagatcctgagccccctgagattcgagccctacaaggccgtggccctggccagcggcggcgaggtgatcttcaccaaggaccagcacatcagagacgtggccgccatcgtgggcgagagcatggccgccctggtgaccctgcccctggacccccccgtggtggtgcccggccagcccctggtgttcagcgtggacggcctgctgcagaagatcaccgtgagaatccacggcgacatcagcagcttctggatcaagaaccccgccggcgtgagccagggccaggaggagggcggcggccccctgggccacaccagaagattcggccagttctggatggtgaccatggacgaccccccccagaccggcacctgggagatccaggtgaccgccgaggacacccccggcgtgagagtgcaggcccagaccagcctggacttcctgttccacttcggcatccccatggaggacggcccccaccccggcctgtaccccctgacccagcccgtggccggcctgcagacccagctgctggtggaggtgaccggcctgggcagcagagccaaccccggcgacccccagccccacttcagccacgtgatcctgagaggcgtgcccgagggcgccgagctgggccaggtgcccctggagcccgtgggcccccccgagagaggcctgctggccgccagcctgagccccaccctgctgagcacccccagacccttcagcctggagctgatcggccaggacgccgccggcagaagactgcacagagccgccccccagcccagcaccgtggtgcccgtgctgctggagctgagcggccccagcggcttcctggcccccggcagcaaggtgcccctgagcctgagaatcgccagcttcagcggcccccaggacctggacctgagaaccttcgtgaaccccagcttcagcctgaccagcaacctgagcagagcccacctggagctgaacgagagcgcctggggcagactgtggctggaggtgcccgacagcgccgcccccgacagcgtggtgatggtgaccgtgaccgccggcggcagagaggccaaccccgtgccccccacccacgccttcctgagactgctggtgagcgcccccgccccccaggtgagaaaccactacttccccagccagggccccgcccaccacccctacagactgatctag

SEQ ID NO: 25981 - DNA, 2835 bp, Artificial Sequence
  Description of Artificial Sequence: Synthetic coding sequence
atgagcctgaccatcagagcccccagcgtggactacagaaacaccctgggcctgtgcggcaccttcgacgagaaccccgagaacgacttccacgacaagaacggcatgcagatcgaccagaacttcaacaactacgtggccttcatcaacgagtggagaatcctgcccggcaagagcatgagcgacaccctgcccgtgagcatgaccagccccggcaagcccagctactgcagctgcagcctggacaccgccgcctaccccagcagcgaggacctggacagcgtgagcagaagcgagatcgccctgggctgcaaggacctgaaccacgtgagcctgagcagcctgatccccgagctggacgtgaccagcgagtacatcaacagcgacaccctggtgagagagatcaacaagcacaccagccccgaggagtacaacctgaacctgttcctgcaggagaagaagcacatcaacctgaccaagctgggcctgaacgtgcagaagcaccccggcaacgagaaggaggacagcctgcagtacctggccaacaagaagtacacccagggcagaggcagccacagccaggagatgagatacaacagacagaacagatggaagagacagaacttccacgagttcccccccctgttcgccttccccagcctgagccagaccgacctggaggagctgacctacttcttccccgaggaccacgccgaggacgtgcagcaggagttcttccccagctggcccacccccagcggcctgaccgagtacagcaccctgaccctgtgccaggagaccctggccaacagcagcatcggcagactgtgcctggccttcctgggcaagagactggacagcgtgatcgagatgtgcgtgaaggacgtgctgctgaaggacgacctgagctgggccgaggccggcgtggccctgctggagaacgagtgcgagaagagaatcgtggaggagggcaagtacaacaccgaggagtacggcaccagcatcgaggacatcctgagcgtgctgaagtgccccaacctgtgcagcggcaacggccagtgcatggagtggggctgcgcctgcagccccagcttcagcagctacgactgcagcgacagctacgacaaggcccccgagatcaccgagctgggcaacgccggcttctgcgacgtgcagaagtacaactgcatgatggtgagagtgttcggcaagggcttcaaggagctgcccagcatcaagtgcgaggtgaccaagctgcagtacaacagcagcgagtggatgcccggcgagcccatctacacccagaccgtgttccacaacagcagagccgtggactgccagctgcccaccgacgtgcagcagttcgacaccatggacctggtgggcggcaagcccaccggcaagtggcagctgaaggtgagcaacgacggctacaagttcagcaaccccaagatcaccgtgatctacgacggcgcctgccaggtgtgcggcctgtacaagaacgacagctgcaccatcaaggagaacgtgtgcatcatcgacggcctgtgctacgtggagggcgacaagaaccccaccagcccctgcctgatctgcagacccaagatcagcagattcacctggagcttcctggagaacaaccagccccccgtgatccaggccctgcaggacaagctgcagaccttctacggcgagaacttcgagtaccagttcgtggccttcgaccccgagggcagcgacatccacttcaccctggacagcggccccgagggcgccagcgtgagcagcgccggcctgttcatgtggaagaccgacctgctgaccacccagcagatcaccgtgagactgaacgacgactgcgacgccgagaccagagtgaccatcgaggtgaccgtgaagagctgcgactgcctgaacggcggcagctgcgtgagcgacagaaacttcagccccggcagcggcgtgtacctgtgcgtgtgcctgcccggcttccacggcagcctgtgcgaggtggacatcagcggctgccagagcaacccctgcggcctgggcagctacatcagcggcttccacagctacagctgcgactgcccccccgagctgaaggtggagacccagttcgtgaaccagttcaccacccagaccgtggtgctgaccagaagcgacaagagcgtgaacaaggaggaggacgacaagaacgcccagggcagaaagagacacgtgaagcccaccagcggcaacgccttcaccatctgcaagtacccctgcggcaagagcagagagtgcgtggcccccaacatctgcaagtgcaagcccggctacatcggcagcaactgccagaccgccctgtgcgaccccgactgcaagaaccacggcaagtgcatcaagcccaacatctgccagtgcctgcccggccacggcggcgccacctgcgacgaggagcactgcaaccccccctgccagcacggcggcacctgcctggccggcaacctgtgcacctgcccctacggcttcgtgggccccagatgcgagaccatggtgtgcaacagacactgcgagaacggcggccagtgcctgacccccgacatctgccagtgcaagcccggctggtacggccccacctgcagcaccgccctgtgcgaccccgtgtgcctgaacggcggcagctgcaacaagcccaacacctgcctgtgccccaacggcttcttcggcgagcactgccagaacgccttctgccaccccccctgcaagaacggcggccactgcatgagaaacaacgtgtgcgtgtgcagagagggctacaccggcagaagattccagaagagacacctgtag

SEQ ID NO: 25982 - DNA, 513 bp, Artificial Sequence
  Description of Artificial Sequence: Synthetic coding sequence
atgcccggcggcgcctgcgtgctggtgatcgccctgatgttcctggcctggggcgaggcccaggagtgcagccccggcggccaccagttcctgagaagcccctacagaagcgtgagattcgacagctggcacctgcagcagagcgccgtgcaggacctgatctgcgaccacagcctgagccccggctggtacagattcctgatcctggacagacccgccgagatgcccaccaagtgcgtggagatgaaccactgcggcacccaggcccccatctggctgagcctgagagacagcgagaccctgcccagccccggcgagatcaagcagctgaccgcctgcgccacctggcagttcctgttcagcaccaccaaggactgctgcctgttccagatccccgtgagcgtgagaaactgcggcaacttcagcgtgtacctgctgcagcccacccagggctgcatgggctactgcgccgagggcttcttcgccaagatcgtgaagagcccccacacctag

SEQ ID NO: 25983 - DNA, 4524 bp, Artificial Sequence
  Description of Artificial Sequence: Synthetic coding sequence
atgaccaccgtggtggtgcacgtggacagcaaggccgagctgaccaccctgctggagcagtgggagaaggagcacggcagcggccaggacatggtgcccatcctgaccagaatgagccagctgatcgagaaggagaccgaggagtacagaaagggcgaccccgaccccttcgacgacagacaccccggcagagccgaccccgagtgcatgctgggccacctgctgagaatcctgttcaagaacgacgacttcatgaacgccctggtgaacgcctacgtgatgaccagcagagagccccccctgaacaccgccgcctgcagactgctgctggacatcatgcccggcctggagaccgccgtggtgttccaggagaaggagggcatcgtggagaacctgttcaagtgggccagagaggccgaccagcccctgagaacctacagcaccggcctgctgggcggcgccatggagaaccaggacatcgccgccaactacagagacgagaacagccagctggtggccatcgtgctgagaagactgagagagctgcagctgcaggaggtggccctgagacaggagaacaagagacccagccccagaaagctgagcagcgagcccctgctgcccctggacgaggaggccgtggacatggactacggcgacatggccgtggacgtggtggacggcgaccaggaggaggccagcggcgacatggagatcagcttccacctggacagcggccacaagaccagcagcagagtgaacagcaccaccaagcccgaggacggcggcctgaagaagaacaagagcgccaagcagggcgacagagagaacttcagaaaggccaagcagaagctgggcttcagcagcagcgaccccgacagaatgttcgtggagctgagcaacagcagctggagcgagatgagcccctgggtgatcggcaccaactacaccctgtaccccatgacccccgccatcgagcagagactgatcctgcagtacctgacccccctgggcgagtaccaggagctgctgcccatcttcatgcagctgggcagcagagagctgatgatgttctacatcgacctgaagcagaccaacgacgtgctgctgaccttcgaggccctgaagcacctggccagcctgctgctgcacaacaagttcgccaccgagttcgtggcccacggcggcgtgcagaagctgctggagatccccagacccagcatggccgccaccggcgtgagcatgtgcctgtactacctgagctacaaccaggacgccatggagagagtgtgcatgcacccccacaacgtgctgagcgacgtggtgaactacaccctgtggctgatggagtgcagccacgccagcggctgctgccacgccaccatgttcttcagcatctgcttcagcttcagagccgtgctggagctgttcgacagatacgacggcctgagaagactggtgaacctgatcagcaccctggagatcctgaacctggaggaccagggcgccctgctgagcgacgacgagatcttcgccagcagacagaccggcaagcacacctgcatggccctgagaaagtacttcgaggcccacctggccatcaagctggagcaggtgaagcagagcctgcagagaaccgagggcggcatcctggtgcacccccagcccccctacaaggcctgcagctacacccacgagcagatcgtggagatgatggagttcctgatcgagtacggccccgcccagctgtactgggagcccgccgaggtgttcctgaagctgagctgcgtgcagctgctgctgcagctgatcagcatcgcctgcaactggaagacctactacgccagaaacgacaccgtgagattcgccctggacgtgctggccatcctgaccgtggtgcccaagatccagctgcagctggccgagagcgtggacgtgctggacgaggccggcagcaccgtgagcaccgtgggcatcagcatcatcctgggcgtggccgagggcgagttcttcatccacgacgccgagatccagaagagcgccctgcagatcatcatcaactgcgtgtgcggccccgacaacagaatcagcagcatcggcaagttcatcagcggcacccccagaagaaagctgccccagaaccccaagagcagcgagcacaccctggccaagatgtggaacgtggtgcagagcaacaacggcatcaaggtgctgctgagcctgctgagcatcaagatgcccatcaccgacgccgaccagatcagagccctggcctgcaaggccctggtgggcctgagcagaagcagcaccgtgagacagatcatcagcaagctgcccctgttcagcagctgccagatccagcagctgatgaaggagcccgtgctgcaggacaagagaagcgaccacgtgaagttctgcaagtacgccgccgagctgatcgagagagtgagcggcaagcccctgctgatcggcaccgacgtgagcctggccagactgcagaaggccgacgtggtggcccagagcagaatcagcttccccgagaaggagctgctgctgctgatcagaaaccacctgatcagcaagggcctgggcgagaccgccaccgtgctgaccaaggaggccgacctgcccatgaccgccgccagccacagcagcgccttcacccccgtgaccgccgccgccagccccgtgagcctgcccagaacccccagaatcgccaacggcatcgccaccagactgggcagccacgccgccgtgggcgccagcgcccccagcgcccccaccgcccacccccagcccagacccccccagggccccctggccctgcccggccccagctacgccggcaacagccccctgatcggcagaatcagcttcatcagagagagacccagcccctgcaacggcagaaagatcagagtgctgagacagaagagcgaccacggcgcctacagccagagccccgccatcaagaagcagctggacagacacctgcccagcccccccaccctggacagcatcatcaccgagtacctgagagagcagcacgccagatgcaagaaccccgtggccacctgcccccccttcagcctgttcaccccccaccagtgccccgagcccaagcagagaagacaggcccccatcaacttcaccagcagactgaacagaagagccagcttccccaagtacggcggcgtggacggcggctgcttcgacagacacctgatcttcagcagattcagacccatcagcgtgttcagagaggccaacgaggacgagagcggcttcacctgctgcgccttcagcgccagagagagattcctgatgctgggcacctgcaccggccagctgaagctgtacaacgtgttcagcggccaggaggaggccagctacaactgccacaacagcgccatcacccacctggagcccagcagagacggcagcctgctgctgaccagcgccacctggagccagcccctgagcgccctgtggggcatgaagagcgtgttcgacatgaagcacagcttcaccgaggaccactacgtggagttcagcaagcacagccaggacagagtgatcggcaccaagggcgacatcgcccacatctacgacatccagaccggcaacaagctgctgaccctgttcaaccccgacctggccaacaactacaagagaaactgcgccaccttcaaccccaccgacgacctggtgctgaacgacggcgtgctgtgggacgtgagaagcgcccaggccatccacaagttcgacaagttcaacatgaacatcagcggcgtgttccaccccaacggcctggaggtgatcatcaacaccgagatctgggacctgagaaccttccacctgctgcacaccgtgcccgccctggaccagtgcagagtggtgttcaaccacaccggcaccgtgatgtacggcgccatgctgcaggccgacgacgaggacgacctgatggaggagagaatgaagagccccttcggcagcagcttcagaaccttcaacgccaccgactacaagcccatcgccaccatcgacgtgaagagaaacatcttcgacctgtgcaccgacaccaaggactgctacctggccgtgatcgagaaccagggcagcatggacgccctgaacatggacaccgtgtgcagactgtacgaggtgggcagacagagactggccgaggacgaggacgaggaggaggaccaggaggaggaggagcaggaggaggaggacgacgacgaggacgacgacgacaccgacgacctggacgagctggacaccgaccagctgctggaggccgagctggaggaggacgacaacaacgagaacgccggcgaggacggcgacaacgacttcagccccagcgacgaggagctggccaacctgctggaggagggcgaggacggcgaggacgaggacagcgacgccgacgaggaggtggagctgatcctgggcgacaccgacagcagcgacaacagcgacctggaggacgacatcatcctgagcctgaacgagtag

SEQ ID NO: 25984 - DNA, 4524 bp, Artificial Sequence; identical to SEQ ID NO: 25983
  Description of Artificial Sequence: Synthetic coding sequence

SEQ ID NO: 25985 - DNA, 984 bp, Artificial Sequence
  Description of Artificial Sequence: Synthetic coding sequence
atggccgagctgcccggccccttcctgtgcggcgccctgctgggcttcctgtgcctgagcggcctggccgtggaggtgaaggtgcccaccgagcccctgagcacccccctgggcaagaccgccgagctgacctgcacctacagcaccagcgtgggcgacagcttcgccctggagtggagcttcgtgcagcccggcaagcccatcagcgagagccaccccatcctgtacttcaccaacggccacctgtaccccaccggcagcaagagcaagagagtgagcctgctgcagaacccccccaccgtgggcgtggccaccctgaagctgaccgacgtgcaccccagcgacaccggcacctacctgtgccaggtgaacaacccccccgacttctacaccaacggcctgggcctgatcaacctgaccgtgctggtgccccccagcaaccccctgtgcagccagagcggccagaccagcgtgggcggcagcaccgccctgagatgcagcagcagcgagggcgcccccaagcccgtgtacaactgggtgagactgggcaccttccccacccccagccccggcagcatggtgcaggacgaggtgagcggccagctgatcctgaccaacctgagcctgaccagcagcggcacctacagatgcgtggccaccaaccagatgggcagcgccagctgcgagctgaccctgagcgtgaccgagcccagccagggcagagtggccggcgccctgatcggcgtgctgctgggcgtgctgctgctgagcgtggccgccttctgcctggtgagattccagaaggagagaggcaagaagcccaaggagacctacggcggcagcgacctgagagaggacgccatcgcccccggcatcagcgagcacacctgcatgagagccgacagcagcaagggcttcctggagagacccagcagcgccagcaccgtgaccaccaccaagagcaagctgcccatggtggtgtag

SEQ ID NO: 25986 - DNA, 855 bp, Artificial Sequence
  Description of Artificial Sequence: Synthetic coding sequence
atggccgagctgcccggccccttcctgtgcggcgccctgctgggcttcctgtgcctgagcggcctggccgtggaggtgaaggtgcccaccgagcccctgagcacccccctgggcaagaccgccgagctgacctgcacctacagcaccagcgtgggcgacagcttcgccctggagtggagcttcgtgcagcccggcaagcccatcagcgagagccaccccatcctgtacttcaccaacggccacctgtaccccaccggcagcaagagcaagagagtgagcctgctgcagaacccccccaccgtgggcgtggccaccctgaagctgaccgacgtgcaccccagcgacaccggcacctacctgtgccaggtgaacaacccccccgacttctacaccaacggcctgggcctgatcaacctgaccgtgctggtgccccccagcaaccccctgtgcagccagagcggccagaccagcgtgggcggcagcaccgccctgagatgcagcagcagcgagggcgcccccaagcccgtgtacaactgggtgagactgggcaccttccccacccccagccccggcagcatggtgcaggacgaggtgagcggccagctgatcctgaccaacctgagcctgaccagcagcggcacctacagatgcgtggccaccaaccagatgggcagcgccagctgcgagctgaccctgagcgtgaccgagcccagccagggcagagtggccggcgccctgatcggcgtgctgctgggcgtgctgctgctgagcgtggccgccttctgcctggtgagattccagaaggagagaggcaagaagcccaaggagacctacggcggcagcgacctgagatag

SEQ ID NO: 25987 - DNA, 363 bp, Artificial Sequence
  Description of Artificial Sequence: Synthetic coding sequence
atggactggaactggagaatcctgttcctggtggtgatcgccgccggcgcccagagccaggtgcagctggtgcagagcggcgccgaggtgaagaagcccggcgccagcgtgaaggtgagctgcaaggccagcggctacaccatcaccagctactgcatgcactgggtgcaccaggtgcacgcccagggcctggagtggatgggcctggtgtgccccagcgacggcagcaccagctacgcccagaagttccaggccagagtgaccatcaccagagacaccagcatgagcaccgcctacatggagctgagcagcctgagaagcgaggacaccgccatgtactactgcgtgagagacaccatgtag

SEQ ID NO: 25988 - DNA, 564 bp, Artificial Sequence
  Description of Artificial Sequence: Synthetic coding sequence
atgggcgcccccctggccgtggccctgggcgccctgcactacctggccctgttcctgcagctgggcggcgccaccagacccgccggccacgccccctgggacaaccacgtgagcggccacgccctgttcaccgagaccccccacgacatgaccgccagaaccggcgaggacgtggagatggcctgcagcttcagaggcagcggcagccccagctacagcctggagatccagtggtggtacgtgagaagccacagagactggaccgacaagcaggcctgggccagcaaccaggtggtgaaggtggtgggcagcaacatcagccacaagctgagactgagcagagtgaagcccaccgacgagggcacctacgagtgcagagtgatcgacttcagcgacggcaaggccagacaccacaaggtgaaggcctacctgagagtgcagcccggcgagaacagcgtgctgcacctgcccgaggccccccccgccgcccccgccccccccccccccaagcccggcaaggagctgagaaagagaagcgtggaccaggaggcctgcagcctgtag

SEQ ID NO: 25989 - DNA, 615 bp, Artificial Sequence
  Description of Artificial Sequence: Synthetic coding sequence
atgggcgcccccctggccgtggccctgggcgccctgcactacctggccctgttcctgcagctgggcggcgccaccagacccgccggccacgccccctgggacaaccacgtgagcggccacgccctgttcaccgagaccccccacgacatgaccgccagaaccggcgaggacgtggagatggcctgcagcttcagaggcagcggcagccccagctacagcctggagatccagtggtggtacgtgagaagccacagagactggaccgacaagcaggcctgggccagcaaccagctgaaggccagccagcaggaggacgccggcaaggaggccaccaagatcagcgtggtgaaggtggtgggcagcaacatcagccacaagctgagactgagcagagtgaagcccaccgacgagggcacctacgagtgcagagtgatcgacttcagcgacggcaaggccagacaccacaaggtgaaggcctacctgagagtgcagcccggcgagaacagcgtgctgcacctgcccgaggccccccccgccgcccccgccccccccccccccaagcccggcaaggagctgagaaagagaagcgtggaccaggaggcctgcagcctgtag

SEQ ID NO: 25990 - DNA, 450 bp, Artificial Sequence
  Description of Artificial Sequence: Synthetic coding sequence
atgggcgcccccctggccgtggccctgggcgccctgcactacctggccctgttcctgcagctgggcggcgccaccagacccgccggccacgccccctgggacaaccacgtgagcggccacgccctgttcaccgagaccccccacgacatgaccgccagaaccggcgaggacgtggagatggcctgcagcttcagaggcagcggcagccccagctacagcctggagatccagtggtggtacgtgagaagccacagagactggaccgacaagcaggcctgggccagcaaccaggtggtgaaggtggtgggcagcaacatcagccacaagctgagactgagcagagtgaagcccaccgacgagggcacctacgagtgcagagtgatcgacttcagcgacggcaaggccagacaccacaaggtgaaggcctacctgagagtgcagcccggctag

SEQ ID NO: 25991 - DNA, 858 bp, Artificial Sequence
  Description of Artificial Sequence: Synthetic coding sequence
atggagcagagaaacagactgggcgccctgggctacctgccccccctgctgctgcacgccctgctgctgttcgtggccgacgccgccttcaccgaggtgcccaaggacgtgaccgtgagagagggcgacgacatcgagatgccctgcgccttcagagccagcggcgccaccagctacagcctggagatccagtggtggtacctgaaggagccccccagagagctgctgcacgagctggccctgagcgtgcccggcgccagaagcaaggtgaccaacaaggacgccaccaagatcagcaccgtgagagtgcagggcaacgacatcagccacagactgagactgagcgccgtgagactgcaggacgagggcgtgtacgagtgcagagtgagcgactacagcgacgacgacacccaggagcacaaggcccaggccatgctgagagtgctgagcagattcgccccccccaacatgcaggccgccgaggccgtgagccacatccagagcagcggccccagaagacacggccccgccagcgccgccaacgccaacaacgccggcgccgccagcagaaccaccagcgagcccggcagaggcgacaagagccccccccccggcagcccccccgccgccatcgaccccgccgtgcccgaggccgccgccgccagcgccgcccacacccccaccaccaccgtggccgccgccgccgccgccagcagcgccagcccccccagcggccaggccgtgctgctgagacagagacacggcagcggcaccggcagaagctacaccaccgaccccctgctgagcctgctgctgctggccctgcacaagttcctgagactgctgctgggccactag

SEQ ID NO: 25992 - DNA, 2034 bp, Artificial Sequence
  Description of Artificial Sequence: Synthetic coding sequence
atggccaaggtgaacatcaccagagacctgatcagaagacagatcaaggagagaggcgccctgagcttcgagagaagataccacgtgaccgaccccttcatcagaagactgggcctggaggccgagctgcagggccacagcggctgcgtgaactgcctggagtggaacgagaagggcgacctgctggccagcggcagcgacgaccagcacaccatcgtgtgggaccccctgcaccacaagaagctgctgagcatgcacaccggccacaccgccaacatcttcagcgtgaagttcctgccccacgccggcgacagaatcctgatcaccggcgccgccgacagcaaggtgcacgtgcacgacctgaccgtgaaggagaccatccacatgttcggcgaccacaccaacagagtgaagagaatcgccaccgcccccatgtggcccaacaccttctggagcgccgccgaggacggcctgatcagacagtacgacctgagagagaacagcaagcacagcgaggtgctgatcgacctgaccgagtactgcggccagctggtggaggccaagtgcctgaccgtgaacccccaggacaacaactgcctggccgtgggcgccagcggccccttcgtgagactgtacgacatcagaatgatccacaaccacagaaagagcatgaagcagagccccagcgccggcgtgcacaccttctgcgacagacagaagcccctgcccgacggcgccgcccagtactacgtggccggccacctgcccgtgaagctgcccgactacaacaacagactgagagtgctggtggccacctacgtgaccttcagccccaacggcaccgagctgctggtgaacatgggcggcgagcaggtgtacctgttcgacctgacctacaagcagagaccctacaccttcctgctgcccagaaagtgccacagcagcggcgaggtgcagaacggcaagatgagcaccaacggcgtgagcaacggcgtgagcaacggcctgcacctgcacagcaacggcttcagactgcccgagagcagaggccacgtgagcccccaggtggagctgcccccctacctggagagagtgaagcagcaggccaacgaggccttcgcctgccagcagtggacccaggccatccagctgtacagcaaggccgtgcagagagccccccacaacgccatgctgtacggcaacagagccgccgcctacatgaagagaaagtgggacggcgaccactacgacgccctgagagactgcctgaaggccatcagcctgaacccctgccacctgaaggcccacttcagactggccagatgcctgttcgagctgaagtacgtggccgaggccctggagtgcctggacgacttcaagggcaagttccccgagcaggcccacagcagcgcctgcgacgccctgggcagagacatcaccgccgccctgttcagcaagaacgacggcgaggagaagaagggccccggcggcggcgcccccgtgagactgagaagcaccagcagaaaggacagcatcagcgaggacgagatggtgctgagagagagaagctacgactaccagttcagatactgcggccactgcaacaccaccaccgacatcaaggaggccaacttcttcggcagcaacgcccagtacatcgtgagcggcagcgacgacggcagcttcttcatctgggagaaggagaccaccaacctggtgagagtgctgcagggcgacgagagcatcgtgaactgcctgcagccccaccccagctactgcttcctggccaccagcggcatcgaccccgtggtgagactgtggaaccccagacccgagagcgaggacctgaccggcagagtggtggaggacatggagggcgccagccaggccaaccagagaagaatgaacgccgaccccctggaggtgatgctgctgaacatgggctacagaatcaccggcctgagcagcggcggcgccggcgccagcgacgacgaggacagcagcgagggccaggtgcagtgcagacccagctag

SEQ ID NO: 25993 - DNA, 2031 bp, Artificial Sequence
  Description of Artificial Sequence: Synthetic coding sequence
atggccaaggtgaacatcaccagagacctgatcagaagacagatcaaggagagaggcgccctgagcttcgagagaagataccacgtgaccgaccccttcatcagaagactgggcctggaggccgagctgcagggccacagcggctgcgtgaactgcctggagtggaacgagaagggcgacctgctggccagcggcagcgacgaccagcacaccatcgtgtgggaccccctgcaccacaagaagctgctgagcatgcacaccggccacaccgccaacatcttcagcgtgaagttcctgccccacgccggcgacagaatcctgatcaccggcgccgccgacagcaaggtgcacgtgcacgacctgaccgtgaaggagaccatccacatgttcggcgaccacaccaacagagtgaagagaatcgccaccgcccccatgtggcccaacaccttctggagcgccgccgaggacggcctgatcagacagtacgacctgagagagaacagcaagcacagcgaggtgctgatcgacctgaccgagtactgcggccagctggtggaggccaagtgcctgaccgtgaacccccaggacaacaactgcctggccgtgggcgccagcggccccttcgtgagactgtacgacatcagaatgatccacaaccacagaaagagcatgaagcagagccccagcgccggcgtgcacaccttctgcgacagacagaagcccctgcccgacggcgccgcccagtactacgtggccggccacctgcccgtgaagctgcccgactacaacaacagactgagagtgctggtggccacctacgtgaccttcagccccaacggcaccgagctgctggtgaacatgggcggcgagcaggtgtacctgttcgacctgacctacaagcagagaccctacaccttcctgctgcccagaaagtgccacagcagcggcgtgcagaacggcaagatgagcaccaacggcgtgagcaacggcgtgagcaacggcctgcacctgcacagcaacggcttcagactgcccgagagcagaggccacgtgagcccccaggtggagctgcccccctacctggagagagtgaagcagcaggccaacgaggccttcgcctgccagcagtggacccaggccatccagctgtacagcaaggccgtgcagagagccccccacaacgccatgctgtacggcaacagagccgccgcctacatgaagagaaagtgggacggcgaccactacgacgccctgagagactgcctgaaggccatcagcctgaacccctgccacctgaaggcccacttcagactggccagatgcctgttcgagctgaagtacgtggccgaggccctggagtgcctggacgacttcaagggcaagttccccgagcaggcccacagcagcgcctgcgacgccctgggcagagacatcaccgccgccctgttcagcaagaacgacggcgaggagaagaagggccccggcggcggcgcccccgtgagactgagaagcaccagcagaaaggacagcatcagcgaggacgagatggtgctgagagagagaagctacgactaccagttcagatactgcggccactgcaacaccaccaccgacatcaaggaggccaacttcttcggcagcaacgcccagtacatcgtgagcggcagcgacgacggcagcttcttcatctgggagaaggagaccaccaacctggtgagagtgctgcagggcgacgagagcatcgtgaactgcctgcagccccaccccagctactgcttcctggccaccagcggcatcgaccccgtggtgagactgtggaaccccagacccgagagcgaggacctgaccggcagagtggtggaggacatggagggcgccagccaggccaaccagagaagaatgaacgccgaccccctggaggtgatgctgctgaacatgggctacagaatcaccggcctgagcagcggcggcgccggcgccagcgacgacgaggacagcagcgagggccaggtgcagtgcagacccagctag

SEQ ID NO: 25994 - DNA, 1203 bp, Artificial Sequence
  Description of Artificial Sequence: Synthetic coding sequence
atggccgccgagatccagcccaagcccctgaccagaaagcccatcctgctgcagagaatggagggcagccaggaggtggtgaacatggccgtgatcgtgcccaaggaggagggcgtgatcagcgtgagcgaggacagaaccgtgagagtgtggctgaagagagacagcggccagtactggcccagcgtgtaccacgccatgcccagcccctgcagctgcatgagcttcaaccccgagaccagaagactgagcatcggcctggacaacggcaccatcagcgagttcatcctgagcgaggactacaacaagatgacccccgtgaagaactaccaggcccaccagagcagagtgaccatgatcctgttcgtgctggagctggagtgggtgctgagcaccggccaggacaagcagttcgcctggcactgcagcgagagcggccagagactgggcggctacagaaccagcgccgtggccagcggcctgcagttcgacgtggagaccagacacgtgttcatcggcgaccacagcggccaggtgaccatcctgaagctggagcaggagaactgcaccctggtgaccaccttcagaggccacaccggcggcgtgaccgccctgtgctgggaccccgtgcagagagtgctgttcagcggcagcagcgaccacagcgtgatcatgtgggacatcggcggcagaaagggcaccgccatcgagctgcagggccacaacgacagagtgcaggccctgagctacgcccagcacaccagacagctgatcagctgcggcggcgacggcggcatcgtggtgtggaacatggacgtggagagacaggagacccccgagtggctggacagcgacagctgccagaagtgcgaccagcccttcttctggaacttcaagcagatgtgggacagcaagaagatcggcctgagacagcaccactgcagaaagtgcggcaaggccgtgtgcggcaagtgcagcagcaagagaagcagcatccccctgatgggcttcgagttcgaggtgagagtgtgcgacagctgccacgaggccatcaccgacgaggagagagcccccaccgccaccttccacgacagcaagcacaacatcgtgcacgtgcacttcgacgccaccagaggctggctgctgaccagcggcaccgacaaggtgatcaagctgtgggacatgacccccgtggtgagctag

SEQ ID NO: 25995 - DNA, 1266 bp, Artificial Sequence
  Description of Artificial Sequence: Synthetic coding sequence
atggccagcttcccccccagagtgaacgagaaggagatcgtgagactgagaaccatcggcgagctgctggcccccgccgcccccttcgacaagaagtgcggcagagagaactggaccgtggccttcgcccccgacggcagctacttcgcctggagccagggccacagaaccgtgaagctggtgccctggagccagtgcctgcagaacttcctgctgcacggcaccaagaacgtgaccaacagcagcagcctgagactgcccagacagaacagcgacggcggccagaagaacaagcccagagagcacatcatcgactgcggcgacatcgtgtggagcctggccttcggcagcagcgtgcccgagaagcagagcagatgcgtgaacatcgagtggcacagattcagattcggccaggaccagctgctgctggccaccggcctgaacaacggcagaatcaagatctgggacgtgtacaccggcaagctgctgctgaacctggtggaccacaccgaggtggtgagagacctgaccttcgcccccgacggcagcctgatcctggtgagcgccagcagagacaagaccctgagagtgtgggacctgaaggacgacggcaacatgatgaaggtgctgagaggccaccagaactgggtgtacagctgcgccttcagccccgacagcagcatgctgtgcagcgtgggcgccagcaaggccgtgttcctgtggaacatggacaagtacaccatgatcagaaagctggagggccaccaccacgacgtggtggcctgcgacttcagccccgacggcgccctgctggccaccgccagctacgacaccagagtgtacatctgggacccccacaacggcgacatcctgatggagttcggccacctgttccccccccccacccccatcttcgccggcggcgccaacgacagatgggtgagaagcgtgagcttcagccacgacggcctgcacgtggccagcctggccgacgacaagatggtgagattctggagaatcgacgaggactaccccgtgcaggtggcccccctgagcaacggcctgtgctgcgccttcagcaccgacggcagcgtgctggccgccggcacccacgacggcagcgtgtacttctgggccacccccagacaggtgcccagcctgcagcacctgtgcagaatgagcatcagaagagtgatgcccacccaggaggtgcaggagctgcccatccccagcaagctgctggagttcctgagctacagaatctag

SEQ ID NO: 25996 - DNA, 828 bp, Artificial Sequence
  Description of Artificial Sequence: Synthetic coding sequence
atggccagcttcccccccagagtgaacgagaaggagatcggcaagctgctgctgaacctggtggaccacaccgaggtggtgagagacctgaccttcgcccccgacggcagcctgatcctggtgagcgccagcagagacaagaccctgagagtgtgggacctgaaggacgacggcaacatgatgaaggtgctgagaggccaccagaactgggtgtacagctgcgccttcagccccgacagcagcatgctgtgcagcgtgggcgccagcaaggccgtgttcctgtggaacatggacaagtacaccatgatcagaaagctggagggccaccaccacgacgtggtggcctgcgacttcagccccgacggcgccctgctggccaccgccagctacgacaccagagtgtacatctgggacccccacaacggcgacatcctgatggagttcggccacctgttccccccccccacccccatcttcgccggcggcgccaacgacagatgggtgagaagcgtgagcttcagccacgacggcctgcacgtggccagcctggccgacgacaagatggtgagattctggagaatcgacgaggactaccccgtgcaggtggcccccctgagcaacggcctgtgctgcgccttcagcaccgacggcagcgtgctggccgccggcacccacgacggcagcgtgtacttctgggccacccccagacaggtgcccagcctgcagcacctgtgcagaatgagcatcagaagagtgatgcccacccaggaggtgcaggagctgcccatccccagcaagctgctggagttcctgagctacagaatctag

SEQ ID NO: 25997 - DNA, 642 bp, Artificial Sequence
  Description of Artificial Sequence: Synthetic coding sequence
atggccagcttcccccccagagtgaacgagaaggagatcgacggcagctacttcgcctggagccagggccacagaaccgtgaagctggtgccctggagccagtgcctgcagaacttcctgctgcacggcaccaagaacgtgaccaacagcagcagcctgagactgcccagacagaacagcgacggcggccagaagaacaagcccagagagcacatcatcgactgcggcgacatcgtgtggagcctggccttcggcagcagcgtgcccgagaagcagagcagatgcgtgaacatcgagtggcacagattcagattcggccaggaccagctgctgctggccaccggcctgaacaacggcagaatcaagatctgggacgtgtacaccggcaagctgctgctgaacctggtggaccacaccgaggtggtgagagacctgaccttcgcccccgacggcagcctgatcctggtgagcgccagcagagacaagaccctgagagtgtgggacctgaaggacgacggcaacatgatgaaggtgctgagaggccaccagaactgggtgtacagctgcgccttcagccccgacagcagcatgctgtgcagcgtgggcgccagcaaggccgtggtggccgccatcctggtgtag

SEQ ID NO: 25998 - DNA, 1215 bp, Artificial Sequence
  Description of Artificial Sequence: Synthetic coding sequence
atggaggccggcgaggagcccctgctgctggccgagctgaagcccggcagaccccaccagttcgactggaagagcagctgcgagacctggagcgtggccttcagccccgacggcagctggttcgcctggagccagggccactgcatcgtgaagctgatcccctggcccctggaggagcagttcatccccaagggcttcgaggccaagagcagaagcagcaagaacgagaccaagggcagaggcagccccaaggagaagaccctggactgcggccagatcgtgtggggcctggccttcagcccctggcccagcccccccagcagaaagctgtgggccagacaccacccccaggtgcccgacgtgagctgcctggtgctggccaccggcctgaacgacggccagatcaagatctgggaggtgcagaccggcctgctgctgctgaacctgagcggccaccaggacgtggtgagagacctgagcttcacccccagcggcagcctgatcctggtgagcgccagcagagacaagaccctgagaatctgggacctgaacaagcacggcaagcagatccaggtgctgagcggccacctgcagtgggtgtactgctgcagcatcagccccgactgcagcatgctgtgcagcgccgccggcgagaagagcgtgttcctgtggagcatgagaagctacaccctgatcagaaagctggagggccaccagagcagcgtggtgagctgcgacttcagccccgacagcgccctgctggtgaccgccagctacgacaccaacgtgatcatgtgggacccctacaccggcgagagactgagaagcctgcaccacacccaggtggaccccgccatggacgacagcgacgtgcacatcagcagcctgagaagcgtgtgcttcagccccgagggcctgtacctggccaccgtggccgacgacagactgctgagaatctgggccctggagctgaagacccccatcgccttcgcccccatgaccaacggcctgtgctgcaccttcttcccccacggcggcgtgatcgccaccggcaccagagacggccacgtgcagttctggaccgcccccagagtgctgagcagcctgaagcacctgtgcagaaaggccctgagaagcttcctgaccacctaccaggtgctggccctgcccatccccaagaagatgaaggagttcctgacctacagaaccttctag

SEQ ID NO: 25999 - DNA, 540 bp, Artificial Sequence
  Description of Artificial Sequence: Synthetic coding sequence
atgagaagctacaccctgatcagaaagctggagggccaccagagcagcgtggtgagctgcgacttcagccccgacagcgccctgctggtgaccgccagctacgacaccaacgtgatcatgtgggacccctacaccggcgagagactgagaagcctgcaccacacccaggtggaccccgccatggacgacagcgacgtgcacatcagcagcctgagaagcgtgtgcttcagccccgagggcctgtacctggccaccgtggccgacgacagactgctgagaatctgggccctggagctgaagacccccatcgccttcgcccccatgaccaacggcctgtgctgcaccttcttcccccacggcggcgtgatcgccaccggcaccagagacggccacgtgcagttctggaccgcccccagagtgctgagcagcctgaagcacctgtgcagaaaggccctgagaagcttcctgaccacctaccaggtgctggccctgcccatccccaagaagatgaaggagttcctgacctacagaaccttctag

SEQ ID NO: 26000 - DNA, 585 bp, Artificial Sequence
  Description of Artificial Sequence: Synthetic coding sequence
atgctgtgcagcgccgccggcgagaagagcgtgttcctgtggagcatgagaagctacaccctgatcagaaagctggagggccaccagagcagcgtggtgagctgcgacttcagccccgacagcgccctgctggtgaccgccagctacgacaccaacgtgatcatgtgggacccctacaccggcgagagactgagaagcctgcaccacacccaggtggaccccgccatggacgacagcgacgtgcacatcagcagcctgagaagcgtgtgcttcagccccgagggcctgtacctggccaccgtggccgacgacagactgctgagaatctgggccctggagctgaagacccccatcgccttcgcccccatgaccaacggcctgtgctgcaccttcttcccccacggcggcgtgatcgccaccggcaccagagacggccacgtgcagttctggaccgcccccagagtgctgagcagcctgaagcacctgtgcagaaaggccctgagaagcttcctgaccacctaccaggtgctggccctgcccatccccaagaagatgaaggagttcctgacctacagaaccttctag

SEQ ID NO: 26001 - DNA, 1458 bp, Artificial Sequence
  Description of Artificial Sequence: Synthetic coding sequence
atggccgccgtgtggcagcaggtgctggccgtggacgccagatacaacgcctacagaacccccaccttcccccagttcagaacccagtacatcagaagaagaagccagctgctgagagagaacgccaaggccggccacccccccgccctgagaagacagtacctgagactgagaggccagctgctgggccagagatacggccccctgagcgagcccggcagcgccagagcctacagcaacagcatcgtgagaagcagcagaaccaccctggacagaatggaggacttcgaggacgaccccagagccctgggcgccagaggccacagaagaagcgtgagcagaggcagctaccagctgcaggcccagatgaacagagccgtgtacgaggacagaccccccggcagcgtggtgcccaccagcgccgccgaggccagcagagccatggccggcgacaccagcctgagcgagaactacgccttcgccggcatgtaccacgtgttcgaccagcacgtggacgaggccgtgcccagagtgagattcgccaacgacgacagacacagactggcctgctgcagcctggacggcagcatcagcctgtgccagctggtgcccgccccccccaccgtgctgagagtgctgagaggccacaccagaggcgtgagcgacttcgcctggagcctgagcaacgacatcctggtgagcaccagcctggacgccaccatgagaatctgggccagcgaggacggcagatgcatcagagagatccccgaccccgacagcgccgagctgctgtgctgcaccttccagcccgtgaacaacaacctgaccgtggtgggcaacgccaagcacaacgtgcacgtgatgaacatcagcaccggcaagaaggtgaagggcggcagcagcaagctgaccggcagagtgctggccctgagcttcgacgcccccggcagactgctgtgggccggcgacgaccacggcagcgtgttcagcttcctgttcgacatggccaccggcaagctgaccaaggccaagagactggtggtgcacgagggcagccccgtgaccagcatcagcgccagaagctgggtgagcagagaggccagagaccccagcctgctgatcaacgcctgcctgaacaagctgctgctgtacagagtggtggacaacgagggcaccctgcagctgaagagaagcttccccatcgagcagagcagccaccccgtgagaagcatcttctgccccctgatgagcttcagacagggcgcctgcgtggtgaccggcagcgaggacatgtgcgtgcacttcttcgacgtggagagagccgccaaggccgccgtgaacaagctgcagggccacagcgcccccgtgctggacgtgagcttcaactgcgacgagagcctgctggccagcagcgacgccagcggcatggtgatcgtgtggagaagagagcagaagtag

SEQ ID NO: 26002 - DNA, 1299 bp, Artificial Sequence
  Description of Artificial Sequence: Synthetic coding sequence
atggccgcccccatggaggtggccgtgtgcaccgacagcgccgcccccatgtggagctgcatcgtgtgggagctgcacagcggcgccaacctgctgacctacagaggcggccaggccggccccagaggcctggccctgctgaacggcgagtacctgctggccgcccagctgggcaagaactacatcagcgcctgggagctgcagagaaaggaccagctgcagcagaagatcatgtgccccggccccgtgacctgcctgaccgccagccccaacggcctgtacgtgctggccggcgtggccgagagcatccacctgtgggaggtgagcaccggcaacctgctggtgatcctgagcagacactaccaggacgtgagctgcctgcagttcaccggcgacagcagccacttcatcagcggcggcaaggactgcctggtgctggtgtggagcctgtgcagcgtgctgcaggccgaccccagcagaatccccgcccccagacacgtgtggagccaccacgccctgcccatcaccgacctgcactgcggcttcggcggccccctggccagagtggccaccagcagcctggaccagaccgtgaagctgtgggaggtgagcagcggcgagctgctgctgagcgtgctgttcgacgtgagcatcatggccgtgaccatggacctggccgagcaccacatgttctgcggcggcagcgagggcagcatcttccaggtggacctgttcacctggcccggccagagagagagaagcttccaccccgagcaggacgccggcaaggtgttcaagggccacagaaaccaggtgacctgcctgagcgtgagcaccgacggcagcgtgctgctgagcggcagccacgacgagaccgtgagactgtgggacgtgcagagcaagcagtgcatcagaaccgtggccctgaagggccccgtgaccaacgccgccatcctgctggcccccgtgagcatgctgagcagcgacttcagacccagcctgcccctgccccacttcaacaagcacctgctgggcgccgagcacggcgacgagcccagacacggcggcctgaccctgagactgggcctgcaccagcagggcagcgagcccagctacctggacagaaccgagcagctgcaggccgtgctgtgcagcaccatggagaagagcgtgctgggcggccaggaccagctgagagtgagagtgaccgagctggaggacgaggtgagaaacctgagaaagatcaacagagacctgttcgacttcagcaccagattcatcaccagacccgccaagtag

SEQ ID NO: 26003 - DNA, 1746 bp, Artificial Sequence
  Description of Artificial Sequence: Synthetic coding sequence
atggccaccgagggcggcggcaaggagatgaacgagatcaagacccagttcaccaccagagagggcctgtacaagctgctgccccacagcgagtacagcagacccaacagagtgcccttcaacagccagggcagcaaccccgtgagagtgagcttcgtgaacctgaacgaccagagcggcaacggcgacagactgtgcttcaacgtgggcagagagctgtacttctacatctacaagggcgtgagaaaggccgccgacctgagcaagcccatcgacaagagaatctacaagggcacccagcccacctgccacgacttcaaccacctgaccgccaccgccgagagcgtgagcctgctggtgggcttcagcgccggccaggtgcagctgatcgaccccatcaagaaggagaccagcaagctgttcaacgaggagagactgatcgacaagagcagagtgacctgcgtgaagtgggtgcccggcagcgagagcctgttcctggtggcccacagcagcggcaacatgtacctgtacaacgtggagcacacctgcggcaccaccgccccccactaccagctgctgaagcagggcgagagcttcgccgtgcacacctgcaagagcaagagcaccagaaaccccctgctgaagtggaccgtgggcgagggcgccctgaacgagttcgccttcagccccgacggcaagttcctggcctgcgtgagccaggacggcttcctgagagtgttcaacttcgacagcgtggagctgcacggcaccatgaagagctacttcggcggcctgctgtgcgtgtgctggagccccgacggcaagtacatcgtgaccggcggcgaggacgacctggtgaccgtgtggagcttcgtggactgcagagtgatcgccagaggccacggccacaagagctgggtgagcgtggtggccttcgacccctacaccaccagcgtggaggagggcgaccccatggagttcagcggcagcgacgaggacttccaggacctgctgcacttcggcagagacagagccaacagcacccagagcagactgagcaagagaaacagcaccgacagcagacccgtgagcgtgacctacagattcggcagcgtgggccaggacacccagctgtgcctgtgggacctgaccgaggacatcctgttcccccaccagcccctgagcagagccagaacccacaccaacgtgatgaacgccaccagcccccccgccggcagcaacggcaacagcgtgaccacccccggcaacagcgtgcccccccccctgcccagaagcaacagcctgccccacagcgccgtgagcaacgccggcagcaagagcagcgtgatggacggcgccatcgccagcggcgtgagcaagttcgccaccctgagcctgcacgacagaaaggagagacaccacgagaaggaccacaagagaaaccacagcatgggccacatcagcagcaagagcagcgacaagctgaacctggtgaccaagaccaagaccgaccccgccaagaccctgggcacccccctgtgccccagaatggaggacgtgcccctgctggagcccctgatctgcaagaagatcgcccacgagagactgaccgtgctgatcttcctggaggactgcatcgtgaccgcctgccaggagggcttcatctgcacctggggcagacccggcaaggtgggcagcctgagcagccccagccaggccagcagccccggcggcaccgtggtgtag

SEQ ID NO: 26004 - DNA, 1710 bp, Artificial Sequence
  Description of Artificial Sequence: Synthetic coding sequence
atggccaccgagggcggcggcaaggagatgaacgagatcaagacccagttcaccaccagagagggcctgtacaagctgctgccccacagcgagtacagcagacccaacagagtgcccttcaacagccagggcagcaaccccgtgagagtgagcttcgtgaacctgaacgaccagagcggcaacggcgacagactgtgcttcaacgtgggcagagagctgtacttctacatctacaagggcgtgagaaaggccgccgacctgagcaagcccatcgacaagagaatctacaagggcacccagcccacctgccacgacttcaaccacctgaccgccaccgccgagagcgtgagcctgctggtgggcttcagcgccggccaggtgcagctgatcgaccccatcaagaaggagaccagcaagctgttcaacgaggagagactgatcgacaagagcagagtgacctgcgtgaagtgggtgcccggcagcgagagcctgttcctggtggcccacagcagcggcaacatgtacctgtacaacgtggagcacacctgcggcaccaccgccccccactaccagctgctgaagcagggcgagagcttcgccgtgcacacctgcaagagcaagagcaccagaaaccccctgctgaagtggaccgtgggcgagggcgccctgaacgagttcgccttcagccccgacggcaagttcctggcctgcgtgagccaggacggcttcctgagagtgttcaacttcgacagcgtggagctgcacggcaccatgaagagctacttcggcggcctgctgtgcgtgtgctggagccccgacggcaagtacatcgtgaccggcggcgaggacgacctggtgaccgtgtggagcttcgtggactgcagagtgatcgccagaggccacggccacaagagctgggtgagcgtggtggccttcgacccctacaccaccagcgtggaggagggcgaccccatggagttcagcggcagcgacgaggacttccaggacctgctgcacttcggcagagacagagccaacagcacccagagcagactgagcaagagaaacagcaccgacagcagacccgtgagcgtgacctacagattcggcagcgtgggccaggacacccagctgtgcctgtgggacctgaccgaggacatcctgttcccccaccagcccctgagcagagccagaacccacaccaacgtgatgaacgccaccagcccccccgccggcagcaacggcaacagcgtgaccacccccggcaacagcgtgcccccccccctgcccagaagcaacagcctgccccacagcgccgtgagcaacgccggcagcaagagcagcgtgatggacggcgccatcgccagcggcgtgagcaagttcgccaccctgagcctgcacgacagaaaggagagacaccacgagaaggaccacaagagaaaccacagcatgggccacatcagcagcaagagcagcgacaagctgaacctggtgaccaagaccaagaccgaccccgccaagaccctgggcacccccctgtgccccagaatggaggacgtgcccctgctggagcccctgatctgcaagaagatcgcccacgagagactgaccgtgctgatcttcctggaggactgcatcgtgaccgcctgccaggagggcttcatctgcacctggggcagacccggcaaggtggtgagcttcaacccctag

SEQ ID NO: 26005 - DNA, 1536 bp, Artificial Sequence
  Description of Artificial Sequence: Synthetic coding sequence
atgaacgagatcaagacccagttcaccaccagagagggcctgtacaagctgctgccccacagcgagtacagcagacccaacagagtgcccttcaacagccagggcagcaaccccgtgagagtgagcttcgtgaacctgaacgaccagagcggcaacggcgacagactgtgcttcaacgtgggcagagagctgtacttctacatctacaagggcgtgagaaagagactgatcgacaagagcagagtgacctgcgtgaagtgggtgcccggcagcgagagcctgttcctggtggcccacagcagcggcaacatgtacctgtacaacgtggagcacacctgcggcaccaccgccccccactaccagctgctgaagcagggcgagagcttcgccgtgcacacctgcaagagcaagagcaccagaaaccccctgctgaagtggaccgtgggcgagggcgccctgaacgagttcgccttcagccccgacggcaagttcctggcctgcgtgagccaggacggcttcctgagagtgttcaacttcgacagcgtggagctgcacggcaccatgaagagctacttcggcggcctgctgtgcgtgtgctggagccccgacggcaagtacatcgtgaccggcggcgaggacgacctggtgaccgtgtggagcttcgtggactgcagagtgatcgccagaggccacggccacaagagctgggtgagcgtggtggccttcgacccctacaccaccagcgtggaggagggcgaccccatggagttcagcggcagcgacgaggacttccaggacctgctgcacttcggcagagacagagccaacagcacccagagcagactgagcaagagaaacagcaccgacagcagacccgtgagcgtgacctacagattcggcagcgtgggccaggacacccagctgtgcctgtgggacctgaccgaggacatcctgttcccccaccagcccctgagcagagccagaacccacaccaacgtgatgaacgccaccagcccccccgccggcagcaacggcaacagcgtgaccacccccggcaacagcgtgcccccccccctgcccagaagcaacagcctgccccacagcgccgtgagcaacgccggcagcaagagcagcgtgatggacggcgccatcgccagcggcgtgagcaagttcgccaccctgagcctgcacgacagaaaggagagacaccacgagaaggaccacaagagaaaccacagcatgggccacatcagcagcaagagcagcgacaagctgaacctggtgaccaagaccaagaccgaccccgccaagaccctgggcacccccctgtgccccagaatggaggacgtgcccctgctggagcccctgatctgcaagaagatcgcccacgagagactgaccgtgctgatcttcctggaggactgcatcgtgaccgcctgccaggagggcttcatctgcacctggggcagacccggcaaggtgggcagcctgagcagccccagccaggccagcagccccggcggcaccgtggtgtag

SEQ ID NO: 26006 - DNA, 1338 bp, Artificial Sequence
  Description of Artificial Sequence: Synthetic coding sequence
atgtgggccggcagctgcaccagcatcagcaccagaggcagcgccagacagagccacgagagactgatcgacaagagcagagtgacctgcgtgaagtgggtgcccggcagcgagagcctgttcctggtggcccacagcagcggcaacatgtacctgtacaacgtggagcacacctgcggcaccaccgccccccactaccagctgctgaagcagggcgagagcttcgccgtgcacacctgcaagagcaagagcaccagaaaccccctgctgaagtggaccgtgggcgagggcgccctgaacgagttcgccttcagccccgacggcaagttcctggcctgcgtgagccaggacggcttcctgagagtgttcaacttcgacagcgtggagctgcacggcaccatgaagagctacttcggcggcctgctgtgcgtgtgctggagccccgacggcaagtacatcgtgaccggcggcgaggacgacctggtgaccgtgtggagcttcgtggactgcagagtgatcgccagaggccacggccacaagagctgggtgagcgtggtggccttcgacccctacaccaccagcgtggaggagggcgaccccatggagttcagcggcagcgacgaggacttccaggacctgctgcacttcggcagagacagagccaacagcacccagagcagactgagcaagagaaacagcaccgacagcagacccgtgagcgtgacctacagattcggcagcgtgggccaggacacccagctgtgcctgtgggacctgaccgaggacatcctgttcccccaccagcccctgagcagagccagaacccacaccaacgtgatgaacgccaccagcccccccgccggcagcaacggcaacagcgtgaccacccccggcaacagcgtgcccccccccctgcccagaagcaacagcctgccccacagcgccgtgagcaacgccggcagcaagagcagcgtgatggacggcgccatcgccagcggcgtgagcaagttcgccaccctgagcctgcacgacagaaaggagagacaccacgagaaggaccacaagagaaaccacagcatgggccacatcagcagcaagagcagcgacaagctgaacctggtgaccaagaccaagaccgaccccgccaagaccctgggcacccccctgtgccccagaatggaggacgtgcccctgctggagcccctgatctgcaagaagatcgcccacgagagactgaccgtgctgatcttcctggaggactgcatcgtgaccgcctgccaggagggcttcatctgcacctggggcagacccggcaaggtggtgagcttcaacccctag

SEQ ID NO: 26007 - DNA, 1803 bp, Artificial Sequence
  Description of Artificial Sequence: Synthetic coding sequence
atggccaccgagggcggcggcaaggagatgaacgagatcaagacccagttcaccaccagagagggcctgtacaagctgctgccccacagcgagtacagcagacccaacagagtgcccttcaacagccagggcagcaaccccgtgagagtgagcttcgtgaacctgaacgaccagagcggcaacggcgacagactgtgcttcaacgtgggcagagagctgtacttctacatctacaagggcgtgagaaaggccgccgacctgagcaagcccatcgacaagagaatctacaagggcacccagcccacctgccacgacttcaaccacctgaccgccaccgccgagagcgtgagcctgctggtgggcttcagcgccggccaggtgcagctgatcgaccccatcaagaaggagaccagcaagctgttcaacgaggagaacagctgccagcacctgtggaaggtggactggaacgaggagagacagaacgagggcagcaagaccagcgaggaggccctggtgaccgtgcagagactgatcgacaagagcagagtgacctgcgtgaagtgggtgcccggcagcgagagcctgttcctggtggcccacagcagcggcaacatgtacctgtacaacgtggagcacacctgcggcaccaccgccccccactaccagctgctgaagcagggcgagagcttcgccgtgcacacctgcaagagcaagagcaccagaaaccccctgctgaagtggaccgtgggcgagggcgccctgaacgagttcgccttcagccccgacggcaagttcctggcctgcgtgagccaggacggcttcctgagagtgttcaacttcgacagcgtggagctgcacggcaccatgaagagctacttcggcggcctgctgtgcgtgtgctggagccccgacggcaagtacatcgtgaccggcggcgaggacgacctggtgaccgtgtggagcttcgtggactgcagagtgatcgccagaggccacggccacaagagctgggtgagcgtggtggccttcgacccctacaccaccagcgtggaggagggcgaccccatggagttcagcggcagcgacgaggacttccaggacctgctgcacttcggcagagacagagccaacagcacccagagcagactgagcaagagaaacagcaccgacagcagacccgtgagcgtgacctacagattcggcagcgtgggccaggacacccagctgtgcctgtgggacctgaccgaggacatcctgttcccccaccagcccctgagcagagccagaacccacaccaacgtgatgaacgccaccagcccccccgccggcagcaacggcaacagcgtgaccacccccggcaacagcgtgcccccccccctgcccagaagcaacagcctgccccacagcgccgtgagcaacgccggcagcaagagcagcgtgatggacggcgccatcgccagcggcgtgagcaagttcgccaccctgagcctgcacgacagaaaggagagacaccacgagaaggaccacaagagaaaccacagcatgggccacatcagcagcaagagcagcgacaagctgaacctggtgaccaagaccaagaccgaccccgccaagaccctgggcacccccctgtgccccagaatggaggacgtgcccctgctggagcccctgatctgcaagaagatcgcccacgagagactgaccgtgctgatcttcctggaggactgcatcgtgaccgcctgccaggagggcttcatctgcacctggggcagacccggcaaggtggtgagcttcaacccctag

SEQ ID NO: 26008 - DNA, 939 bp, Artificial Sequence
  Description of Artificial Sequence: Synthetic coding sequence
atgaagagctacttcggcggcctgctgtgcgtgtgctggagccccgacggcaagtacatcgtgaccggcggcgaggacgacctggtgaccgtgtggagcttcgtggactgcagagtgatcgccagaggccacggccacaagagctgggtgagcgtggtggccttcgacccctacaccaccagcgtggaggagggcgaccccatggagttcagcggcagcgacgaggacttccaggacctgctgcacttcggcagagacagagccaacagcacccagagcagactgagcaagagaaacagcaccgacagcagacccgtgagcgtgacctacagattcggcagcgtgggccaggacacccagctgtgcctgtgggacctgaccgaggacatcctgttcccccaccagcccctgagcagagccagaacccacaccaacgtgatgaacgccaccagcccccccgccggcagcaacggcaacagcgtgaccacccccggcaacagcgtgcccccccccctgcccagaagcaacagcctgccccacagcgccgtgagcaacgccggcagcaagagcagcgtgatggacggcgccatcgccagcggcgtgagcaagttcgccaccctgagcctgcacgacagaaaggagagacaccacgagaaggaccacaagagaaaccacagcatgggccacatcagcagcaagagcagcgacaagctgaacctggtgaccaagaccaagaccgaccccgccaagaccctgggcacccccctgtgccccagaatggaggacgtgcccctgctggagcccctgatctgcaagaagatcgcccacgagagactgaccgtgctgatcttcctggaggactgcatcgtgaccgcctgccaggagggcttcatctgcacctggggcagacccggcaaggtggtgagcttcaacccctag

SEQ ID NO: 26009 - DNA, 1191 bp, Artificial Sequence
  Description of Artificial Sequence: Synthetic coding sequence
atgtacctgtacaacgtggagcacacctgcggcaccaccgccccccactaccagctgctgaagcagggcgagagcttcgccgtgcacacctgcaagagcaagagcaccagaaaccccctgctgaagtggaccgtgggcgagggcgccctgaacgagttcgccttcagccccgacggcaagttcctggcctgcgtgagccaggacggcttcctgagagtgttcaacttcgacagcgtggagctgcacggcaccatgaagagctacttcggcggcctgctgtgcgtgtgctggagccccgacggcaagtacatcgtgaccggcggcgaggacgacctggtgaccgtgtggagcttcgtggactgcagagtgatcgccagaggccacggccacaagagctgggtgagcgtggtggccttcgacccctacaccaccagcgtggaggagggcgaccccatggagttcagcggcagcgacgaggacttccaggacctgctgcacttcggcagagacagagccaacagcacccagagcagactgagcaagagaaacagcaccgacagcagacccgtgagcgtgacctacagattcggcagcgtgggccaggacacccagctgtgcctgtgggacctgaccgaggacatcctgttcccccaccagcccctgagcagagccagaacccacaccaacgtgatgaacgccaccagcccccccgccggcagcaacggcaacagcgtgaccacccccggcaacagcgtgcccccccccctgcccagaagcaacagcctgccccacagcgccgtgagcaacgccggcagcaagagcagcgtgatggacggcgccatcgccagcggcgtgagcaagttcgccaccctgagcctgcacgacagaaaggagagacaccacgagaaggaccacaagagaaaccacagcatgggccacatcagcagcaagagcagcgacaagctgaacctggtgaccaagaccaagaccgaccccgccaagaccctgggcacccccctgtgccccagaatggaggacgtgcccctgctggagcccctgatctgcaagaagatcgcccacgagagactgaccgtgctgatcttcctggaggactgcatcgtgaccgcctgccaggagggcttcatctgcacctggggcagacccggcaaggtggtgagcttcaacccctag

SEQ ID NO: 26010 - DNA, 1527 bp, Artificial Sequence
  Description of Artificial Sequence: Synthetic coding sequence
atggccaccgagggcggcggcaaggagatgaacgagatcaagacccagttcaccaccagagagggcctgtacaagctgctgccccacagcgagtacagcagacccaacagagtgcccttcaacagccagggcagcaaccccgtgagagtgagcttcgtgaacctgaacgaccagagcggcaacggcgacagactgtgcttcaacgtgggcagagagctgtacttctacatctacaagggcgtgagaaagagactgatcgacaagagcagagtgacctgcgtgaagtgggtgcccggcagcgagagcctgttcctggtggcccacagcagcggcaacatgtacctgtacaacgtggagcacacctgcggcaccaccgccccccactaccagctgctgaagcagggcgagagcttcgccgtgcacacctgcaagagcaagagcaccagaaaccccctgctgaagtggaccgtgggcgagggcgccctgaacgagttcgccttcagccccgacggcaagttcctggcctgcgtgagccaggacggcttcctgagagtgttcaacttcgacagcgtggagctgcacggcaccatgaagagctacttcggcggcctgctgtgcgtgtgctggagccccgacggcaagtacatcgtgaccggcggcgaggacgacctggtgaccgtgtggagcttcgtggactgcagagtgatcgccagaggccacggccacaagagctgggtgagcgtggtggccttcgacccctacaccaccagcgtggaggagggcgaccccatggagttcagcggcagcgacgaggacttccaggacctgctgcacttcggcagagacagagccaacagcacccagagcagactgagcaagagaaacagcaccgacagcagacccgtgagcgtgacctacagattcggcagcgtgggccaggacacccagctgtgcctgtgggacctgaccgaggacatcctgttcccccaccagcccctgagcagagccagaacccacaccaacgtgatgaacgccaccagcccccccgccggcagcaacggcaacagcgtgaccacccccggcaacagcgtgcccccccccctgcccagaagcaacagcctgccccacagcgccgtgagcaacgccggcagcaagagcagcgtgatggacggcgccatcgccagcggcgtgagcaagttcgccaccctgagcctgcacgacagaaaggagagacaccacgagaaggaccacaagagaaaccacagcatgggccacatcagcagcaagagcagcgacaagctgaacctggtgaccaagaccaagaccgaccccgccaagaccctgggcacccccctgtgccccagaatggaggacgtgcccctgctggagcccctgatctgcaagaagatcgcccacgagagactgaccgtgctgatcttcctggaggactgcatcgtgaccgcctgccaggagggcttcatctgcacctggggcagacccggcaaggtggtgagcttcaacccctag

SEQ ID NO: 26011 - DNA, 588 bp, Artificial Sequence
  Description of Artificial Sequence: Synthetic coding sequence
atggccaccgagggcggcggcaaggagatgaacgagatcaagacccagttcaccaccagagagggcctgtacaagctgctgccccacagcgagtacagcagacccaacagagtgcccttcaacagccagggcagcaaccccgtgagagtgagcttcgtgaacctgaacgaccagagcggcaacggcgacagactgtgcttcaacgtgggcagagagctgtacttctacatctacaagggcgtgagaaaggccgccgacctgagcaagcccatcgacaagagaatctacaagggcacccagcccacctgccacgacttcaaccacctgaccgccaccgccgagagcgtgagcctgctggtgggcttcagcgccggccaggtgcagctgatcgaccccatcaagaaggagaccagcaagctgttcaacgaggagaacagctgccagcacctgtggaaggtggactggaacgaggagagacagaacgagggcagcaagaccagcgaggaggccctggtgaccgtgcagcccgccgagcacttctgcagacaggaggacagaatgcagggcgtgctgcaggaccagaactag

SEQ ID NO: 26012 - DNA, 1563 bp, Artificial Sequence
  Description of Artificial Sequence: Synthetic coding sequence
atggccaccgagggcggcggcaaggagatgaacgagatcaagacccagttcaccaccagagagggcctgtacaagctgctgccccacagcgagtacagcagacccaacagagtgcccttcaacagccagggcagcaaccccgtgagagtgagcttcgtgaacctgaacgaccagagcggcaacggcgacagactgtgcttcaacgtgggcagagagctgtacttctacatctacaagggcgtgagaaagagactgatcgacaagagcagagtgacctgcgtgaagtgggtgcccggcagcgagagcctgttcctggtggcccacagcagcggcaacatgtacctgtacaacgtggagcacacctgcggcaccaccgccccccactaccagctgctgaagcagggcgagagcttcgccgtgcacacctgcaagagcaagagcaccagaaaccccctgctgaagtggaccgtgggcgagggcgccctgaacgagttcgccttcagccccgacggcaagttcctggcctgcgtgagccaggacggcttcctgagagtgttcaacttcgacagcgtggagctgcacggcaccatgaagagctacttcggcggcctgctgtgcgtgtgctggagccccgacggcaagtacatcgtgaccggcggcgaggacgacctggtgaccgtgtggagcttcgtggactgcagagtgatcgccagaggccacggccacaagagctgggtgagcgtggtggccttcgacccctacaccaccagcgtggaggagggcgaccccatggagttcagcggcagcgacgaggacttccaggacctgctgcacttcggcagagacagagccaacagcacccagagcagactgagcaagagaaacagcaccgacagcagacccgtgagcgtgacctacagattcggcagcgtgggccaggacacccagctgtgcctgtgggacctgaccgaggacatcctgttcccccaccagcccctgagcagagccagaacccacaccaacgtgatgaacgccaccagcccccccgccggcagcaacggcaacagcgtgaccacccccggcaacagcgtgcccccccccctgcccagaagcaacagcctgccccacagcgccgtgagcaacgccggcagcaagagcagcgtgatggacggcgccatcgccagcggcgtgagcaagttcgccaccctgagcctgcacgacagaaaggagagacaccacgagaaggaccacaagagaaaccacagcatgggccacatcagcagcaagagcagcgacaagctgaacctggtgaccaagaccaagaccgaccccgccaagaccctgggcacccccctgtgccccagaatggaggacgtgcccctgctggagcccctgatctgcaagaagatcgcccacgagagactgaccgtgctgatcttcctggaggactgcatcgtgaccgcctgccaggagggcttcatctgcacctggggcagacccggcaaggtgggcagcctgagcagccccagccaggccagcagccccggcggcaccgtggtgtag

SEQ ID NO: 26013 - DNA, 2763 bp, Artificial Sequence
  Description of Artificial Sequence: Synthetic coding sequence
atgggcaagaagagaaccaccagcggcgagggcagagagagacagagactgcccgccagaagattcagaaccaccagccccgccgccctgagagccgacagcgtggacggcggcagcctgctggcccccctgctgggcctgaccgacagagccttcagcgactgccccgacctggccgacggcgccatggagaagatgagcagagtgaccaccgccctgggcggcagcgtgctgaccggcagaaccatgcactgccacctggacgcccccgccaacgccatcagcgtgtgcagagacgccgcccaggtggtggtggccggcagaagcatcttcaagatctacgccatcgaggaggagcagttcgtggagaagctgaacctgagagtgggcagaaagcccagcctgaacctgagctgcgccgacgtggtgtggcaccagatggacgagaacctgctggccaccgccgccaccaacggcgtggtggtgacctggaacctgggcagacccagcagaaacaagcaggaccagctgttcaccgagcacaagagaaccgtgaacaaggtgtgcttccaccccaccgaggcccacgtgctgctgagcggcagccaggacggcttcatgaagtgcttcgacctgagaagaaaggacagcgtgagcaccttcagcggcgaggccaccgaggccggccccagagagtgggccatggccggctgcgtgcccatcctgcccgtgctgagctgcagaatcctgagactgcaccacagcttcgcccacggccccatgcaggacgccgagagcaccgccaacgacgccagagagagctggggctgccccctgtaccccctgggcctgtgcagcggcccccaggccggccagagcgagagcgtgagagacgtgcagttcagcatcagagactacttcaccttcgccagcaccttcgagaacggcaacgtgcagctgtgggacatcagaagacccgacagatgcgagagaatgttcaccgcccacaacggccccgtgttctgctgcgactggcaccccgaggacagaggctggctggccaccggcggcagagacaagatggtgaaggtgtgggacatgaccacccacagagccaaggagatgcactgcgtgcagaccatcgccagcgtggccagagtgaagtggagacccgagtgcagacaccacctggccacctgcagcatgatggtggaccacaacatctacgtgtgggacgtgagaagacccttcgtgcccgccgccatgttcgaggagcacagagacgtgaccaccggcatcgcctggagacacccccacgaccccagcttcctgctgagcggcagcaaggacagcagcctgtgccagcacctgttcagagacgccagccagcccgtggagagagccaaccccgagggcctgtgctacggcctgttcggcgacctggccttcgccgccaaggagagcctggtggccgccgagagcggcagaaagccctacaccggcgacagaagacaccccatcttcttcaagagaaagctggaccccgccgagcccttcgccggcctggccagcagcgccctgagcgtgttcgagaccgagcccggcggcggcggcatgagatggttcgtggacaccgccgagagatacgccctggccggcagacccctggccgagctgtgcgaccacaacgccaaggtggccagagagctgggcagaaaccaggtggcccagacctggaccatgctgagaatcatctactgcagccccggcctggtgcccaccgccaacctgaaccacagcgtgggcaagggcggcagctgcggcctgcccctgatgaacagcttcaacctgaaggacatggcccccggcctgggcagcgagaccagactggacagaagcaagggcgacgccagaagcgacaccgtgctgctggacagcagcgccaccctgatcaccaacgaggacaacgaggagaccgagggcagcgacgtgcccgccgactacctgctgggcgacgtggagggcgaggaggacgagctgtacctgctggaccccgagcacgcccaccccgaggaccccgagtgcgtgctgccccaggaggccttccccctgagacacgagatcgtggacaccccccccggccccgagcacctgcaggacaaggccgacagcccccacgtgagcggcagcgaggccgacgtggccagcctggcccccgtggacagcagcttcagcctgctgagcgtgagccacgccctgtacgacagcagactgccccccgacttcttcggcgtgctggtgagagacatgctgcacttctacgccgagcagggcgacgtgcagatggccgtgagcgtgctgatcgtgctgggcgagagagtgagaaaggacatcgacgagcagacccaggagcactggtacaccagctacatcgacctgctgcagagattcagactgtggaacgtgagcaacgaggtggtgaagctgagcaccagcagagccgtgagctgcctgaaccaggccagcaccaccctgcacgtgaactgcagccactgcaagagacccatgagcagcagaggctgggtgtgcgacagatgccacagatgcgccagcatgtgcgccgtgtgccaccacgtggtgaagggcctgttcgtgtggtgccagggctgcagccacggcggccacctgcagcacatcatgaagtggctggagggcagcagccactgccccgccggctgcggccacctgtgcgagtacagctag

SEQ ID NO: 26014 - DNA, 2373 bp, Artificial Sequence
  Description of Artificial Sequence: Synthetic coding sequence
atggagaagatgagcagagtgaccaccgccctgggcggcagcgtgctgaccggcagaaccatgcactgccacctggacgcccccgccaacgccatcagcgtgtgcagagacgccgcccaggtggtggtggccggcagaagcatcttcaagatctacgccatcgaggaggagcagttcgtggagaagctgaacctgagagtgggcagaaagcccagcctgaacctgagctgcgccgacgtggtgtggcaccagatggacgagaacctgctggccaccgccgccaccaacggcgtggtggtgacctggaacctgggcagacccagcagaaacaagcaggaccagctgttcaccgagcacaagagaaccgtgaacaaggtgtgcttccaccccaccgaggcccacgtgctgctgagcggcagccaggacggcttcatgaagtgcttcgacctgagaagaaaggacagcgtgagcaccttcagcggccagagcgagagcgtgagagacgtgcagttcagcatcagagactacttcaccttcgccagcaccttcgagaacggcaacgtgcagctgtgggacatcagaagacccgacagatgcgagagaatgttcaccgcccacaacggccccgtgttctgctgcgactggcaccccgaggacagaggctggctggccaccggcggcagagacaagatggtgaaggtgtgggacatgaccacccacagagccaaggagatgcactgcgtgcagaccatcgccagcgtggccagagtgaagtggagacccgagtgcagacaccacctggccacctgcagcatgatggtggaccacaacatctacgtgtgggacgtgagaagacccttcgtgcccgccgccatgttcgaggagcacagagacgtgaccaccggcatcgcctggagacacccccacgaccccagcttcctgctgagcggcagcaaggacagcagcctgtgccagcacctgttcagagacgccagccagcccgtggagagagccaaccccgagggcctgtgctacggcctgttcggcgacctggccttcgccgccaaggagagcctggtggccgccgagagcggcagaaagccctacaccggcgacagaagacaccccatcttcttcaagagaaagctggaccccgccgagcccttcgccggcctggccagcagcgccctgagcgtgttcgagaccgagcccggcggcggcggcatgagatggttcgtggacaccgccgagagatacgccctggccggcagacccctggccgagctgtgcgaccacaacgccaaggtggccagagagctgggcagaaaccaggtggcccagacctggaccatgctgagaatcatctactgcagccccggcctggtgcccaccgccaacctgaaccacagcgtgggcaagggcggcagctgcggcctgcccctgatgaacagcttcaacctgaaggacatggcccccggcctgggcagcgagaccagactggacagaagcaagggcgacgccagaagcgacaccgtgctgctggacagcagcgccaccctgatcaccaacgaggacaacgaggagaccgagggcagcgacgtgcccgccgactacctgctgggcgacgtggagggcgaggaggacgagctgtacctgctggaccccgagcacgcccaccccgaggaccccgagtgcgtgctgccccaggaggccttccccctgagacacgagatcgtggacaccccccccggccccgagcacctgcaggacaaggccgacagcccccacgtgagcggcagcgaggccgacgtggccagcctggcccccgtggacagcagcttcagcctgctgagcgtgagccacgccctgtacgacagcagactgccccccgacttcttcggcgtgctggtgagagacatgctgcacttctacgccgagcagggcgacgtgcagatggccgtgagcgtgctgatcgtgctgggcgagagagtgagaaaggacatcgacgagcagacccaggagcactggtacaccagctacatcgacctgctgcagagattcagactgtggaacgtgagcaacgaggtggtgaagctgagcaccagcagagccgtgagctgcctgaaccaggccagcaccaccctgcacgtgaactgcagccactgcaagagacccatgagcagcagaggctgggtgtgcgacagatgccacagatgcgccagcatgtgcgccgtgtgccaccacgtggtgaagggcctgttcgtgtggtgccagggctgcagccacggcggccacctgcagcacatcatgaagtggctggagggcagcagccactgccccgccggctgcggccacctgtgcgagtacagctag

SEQ ID NO: 26015 - DNA, 1635 bp, Artificial Sequence
  Description of Artificial Sequence: Synthetic coding sequence
atgaccgccagaaccctgagcctgatggccagcctggtggcctacgacgacagcgacagcgaggccgagaccgagcacgccggcagcttcaacgccaccggccagcagaaggacaccagcggcgtggccagaccccccggccaggacttcgccagcggcaccctggacgtgcccaaggccggcgcccagcccaccaagcacggcagctgcgaggaccccggcggctacagactgcccctggcccagctgggcagaagcgactggggcagctgccccagccagagactgcagtggcccggcaaggagccccaggtgaccttccccatcaaggagcccagctgcagcagcctgtggaccagccacgtgcccgccagccacatgcccctggccgccgccagattcaagcaggtgaagctgagcagaaacttccccaagagcagcttccacgcccagagcgagagcgagaccgtgggcaagaacggcagcagcttccagaagaagaagtgcgaggactgcgtggtgccctacacccccagaagactgagacagagacaggccctgagcaccgagaccggcaagggcaaggacgtggagccccagggcccccccgccggcagagcccccgcccccctgtacgtgggccccggcgtgagcgagttcatccagccctacctgaacagccactacaaggagaccaccgtgcccagaaaggtgctgttccacctgagaggccacagaggccccgtgaacaccatccagtggtgccccgtgctgagcaagagccacatgctgctgagcaccagcatggacaagaccttcaaggtgtggaacgccgtggacagcggccactgcctgcagacctacagcctgcacaccgaggccgtgagagccgccagatgggccccctgcggcagaagaatcctgagcggcggcttcgacttcgccctgcacctgaccgacctggagaccggcacccagctgttcagcggcagaagcgacttcagaatcaccaccctgaagttccaccccaaggaccacaacatcttcctgtgcggcggcttcagcagcgagatgaaggcctgggacatcagaaccggcaaggtgatgagaagctacaaggccaccatccagcagaccctggacatcctgttcctgagagagggcagcgagttcctgagcagcaccgacgccagcaccagagacagcgccgacagaaccatcatcgcctgggacttcagaaccagcgccaagatcagcaaccagatcttccacgagagattcacctgccccagcctggccctgcaccccagagagcccgtgttcctggcccagaccaacggcaactacctggccctgttcagcaccgtgtggccctacagaatgagcagaagaagaagatacgagggccacaaggtggagggctacagcgtgggctgcgagtgcagccccggcggcgacctgctggtgaccggcagcgccgacggcagagtgctgatgtacagcttcagaaccgccagcagagcctgcaccctgcagggccacacccaggcctgcgtgggcaccacctaccaccccgtgctgcccagcgtgctggccacctgcagctggggcggcgacatgaagatctggcactag

SEQ ID NO: 26016 - DNA, 1635 bp, Artificial Sequence; identical to SEQ ID NO: 26015
  Description of Artificial Sequence: Synthetic coding sequence

SEQ ID NO: 26017 - DNA, 864 bp, Artificial Sequence
  Description of Artificial Sequence: Synthetic coding sequence
atgcccgccctgtgcctggtgctgtgctggttccagggcctgctgggcgaggtgtggaacgccgtggacagcggccactgcctgcagacctacagcctgcacaccgaggccgtgagagccgccagatgggccccctgcggcagaagaatcctgagcggcggcttcgacttcgccctgcacctgaccgacctggagaccggcacccagctgttcagcggcagaagcgacttcagaatcaccaccctgaagttccaccccaaggaccacaacatcttcctgtgcggcggcttcagcagcgagatgaaggcctgggacatcagaaccggcaaggtgatgagaagctacaaggccaccatccagcagaccctggacatcctgttcctgagagagggcagcgagttcctgagcagcaccgacgccagcaccagagacagcgccgacagaaccatcatcgcctgggacttcagaaccagcgccaagatcagcaaccagatcttccacgagagattcacctgccccagcctggccctgcaccccagagagcccgtgttcctggcccagaccaacggcaactacctggccctgttcagcaccgtgtggccctacagaatgagcagaagaagaagatacgagggccacaaggtggagggctacagcgtgggctgcgagtgcagccccggcggcgacctgctggtgaccggcagcgccgacggcagagtgctgatgtacagcttcagaaccgccagcagagcctgcaccctgcagggccacacccaggcctgcgtgggcaccacctaccaccccgtgctgcccagcgtgctggccacctgcagctggggcggcgacatgaagatctggcactag

SEQ ID NO: 26018 - DNA, 1635 bp, Artificial Sequence; identical to SEQ ID NO: 26015
  Description of Artificial Sequence: Synthetic coding sequence

SEQ ID NO: 26019 - DNA, 2574 bp, Artificial Sequence
  Description of Artificial Sequence: Synthetic coding sequence
atggagaacccccaggacatcttcagcagcaacggcggctgcctgagcgacatcgtgatcgagaagtacctggtggagagcaaggagagcgtgagccacgtgcagctggcctgcagcatgcaggactgcgccttccccctggacggcaccgagctgtgcatctggaacaccaaggaccccagccaccagctgctgatcctgagaggccaccaccagcccatcaccgccatggccttcggcaacaaggtgaaccccctgctgatctgcagcgccagcctggactacgtgatcatgtggaacctggacgagtgcagagagaaggtgctgcagggcctggtgcccagaggcaccgtgatgggcagcctgctgggcaaggtgctgtgcctgcagctgagcctggacgaccacgtggtggccgtgtgcgccggcaacaagatcttcatgctggacatcgagcagagattcagcgtgacctacatcgagagacccgacgtgaacaacagacacaaggtgcccccccccaccttcctgcacaccttcagccagacccaggccgtgagagccgagctgcagggccacctgggccccgtgaccgccgtggagttctgcccctggagagccggcaccctgatcagcgccagcgaggacagaggcttcaaggtgtgggaccactgcaccggcagcctgatctacagcagcagcgtgctgagcgcctaccccctgctgagcctgttcatcgacgccgagagcagacagctggtgaccggctgcgccgacggccagctgtggatcttcagcctgatggacggccaccactacagaagagtggccagagtggacctgagaaagaagaccgagaccttcagcaccagaagagtgaagagcggcctgtgcagccagcccgaggagagccagctgcccagcaccagcgccctgggcaagggcgagcaggtggaggtgaccttccccgtgctgagactggccccctgcgacctgagcctgatccccaacagcgcctgcggctgcctgagcagcgagaacaccagatgcgtgtggatcggcagcagcgtgggcctgttcgtgttcaacctggccaacctggaggtggaggccgccctgtactacaaggacttccagagcctgagcatcctgctggccggcagctgcgccctgagaaacagaaccgccgaccagaaggtgctgtgcctgctggccagcctgttcggcggcaagatcgccgtgctggagatcaaccccgccgccctggtgagagcccagcagtgccccagcatgggccagagcctgagcgtgcccgccagcagctgcgtgctgcccaccagccccctgtacctgggcatcgccaaggagaagagcaccaaggccgccagcgagcagagaagagccgccagaaacgtgatgaaggaccagagactggtgttccacagcaaggtgagaagcagcggctacgccagcgccccccacgtgaccatgttcagccccaagaccaacatcaagagcgagggcaagggcagcagcagaagcagaagcagctgcgccagagaggcctaccccgtggagtgcgccgtgcccaccaagcccggcccccaggtggccgccgcccccacctgcaccagagtgtgctgcatccagtacagcggcgacggccagtggctggcctgcggcctggccaaccacctgctgctggtgttcgacgccagcctgaccggcacccccgccgtgttcagcggccacgacggcgccgtgaacgccgtgtgctggagccaggacagaagatggctgctgagcgccgccagagacggcaccctgagaatgtggagcgccagaggcgccgagctggccctgctgctgggcaaggacatgttcagcaagcccatccagagcgcccagttctactacatcgacgccttcatcctgctgagcagcggccccgagttccagctgctgagataccacatcgacacctgcaaggacgagatcaagagatacaagcagaagagcaagagcaagctgatctgcagactgagcaccaccggcgccgtggacatgaccagcctgagcgccgtgaacgacttctacagccacatcgtgctggccgccggcagaaacagaaccgtggaggtgttcgacctgaacgccggctgcagcgccgccgtgatcgccgaggcccacagcagacccgtgcaccagatctgccagaacaagggcagcagcttcaccacccagcagccccaggcctacaacctgttcctgaccaccgccatcggcgacggcatgagactgtgggacctgagaaccctgagatgcgagagacacttcgagggccaccccaccagaggctacccctgcggcatcgccttcagcccctgcggcagattcgccgcctgcggcgccgaggacagacacgcctacgtgtacgagatgggcagcagcaccttcagccacagactggccggccacaccgacaccgtgaccggcgtggccttcaaccccagcgccccccagctggccaccgccaccctggacggcaagctgcagctgttcctggccgagtag

SEQ ID NO: 26020 - DNA, 546 bp, Artificial Sequence
  Description of Artificial Sequence: Synthetic coding sequence
atggagaacccccaggacatcttcagcagcaacggcggctgcctgagcgacatcgtgatcgagaagtacctggtggagagcaaggagagcgtgagccacgtgcagctggcctgcagcatgcaggactgcgccttccccctggacggcaccgagctgtgcatctggaacaccaaggaccccagccaccagctgctgatcctgagaggccaccaccagcccatcaccgccatggccttcggcaacaaggtgaaccccctgctgatctgcagcgccagcctggactacgtgatcatgtggaacctggacgagtgcagagagaaggtgctgcagggcctggtgcccagaggcaccgtgatgggcagcctgctgggcaaggtgctgtgcctgcagctgagcctggacgaccacgtggtggccgtgtgcgccggcaacaagatcttcatgctggacatcgagcacatcctgttcagcgtgtacagcctgatgcagaaggccggcagctggagccccggcgtgctgaccgccagcttcggcagcagcgtgtag

SEQ ID NO: 26021 - DNA, 2193 bp, Artificial Sequence
  Description of Artificial Sequence: Synthetic coding sequence
atggagaacccccaggacatcttcagcagcaacggcggctgcctgagcgacatcgtgatcgagaagtacctggtggagagcaaggagagcgtgagccacgtgcagctggcctgcagcatgcaggactgcgccttccccctggacggcaccgagctgtgcatctggaacaccaaggaccccagccaccagctgctgatcctgagaggccaccaccagcccatcaccgccatggccttcggcaacaaggtgaaccccctgctgatctgcagcgccagcctggactacgtgatcatgtggaacctggacgagtgcagagagaaggtgctgcaggcctaccccctgctgagcctgttcatcgacgccgagagcagacagctggtgaccggctgcgccgacggccagctgtggatcttcagcctgatggacggccaccactacagaagagtggccagagtggacctgagaaagaagaccgagaccttcagcaccagaagagtgaagagcggcctgtgcagccagcccgaggagagccagctgcccagcaccagcgccctgggcaagggcgagcaggtggaggtgaccttccccgtgctgagactggccccctgcgacctgagcctgatccccaacagcgcctgcggctgcctgagcagcgagaacaccagatgcgtgtggatcggcagcagcgtgggcctgttcgtgttcaacctggccaacctggaggtggaggccgccctgtactacaaggacttccagagcctgagcatcctgctggccggcagctgcgccctgagaaacagaaccgccgaccagaaggtgctgtgcctgctggccagcctgttcggcggcaagatcgccgtgctggagatcaaccccgccgccctggtgagagcccagcagtgccccagcatgggccagagcctgagcgtgcccgccagcagctgcgtgctgcccaccagccccctgtacctgggcatcgccaaggagaagagcaccaaggccgccagcgagcagagaagagccgccagaaacgtgatgaaggaccagagactggtgttccacagcaaggtgagaagcagcggctacgccagcgccccccacgtgaccatgttcagccccaagaccaacatcaagagcgagggcaagggcagcagcagaagcagaagcagctgcgccagagaggcctaccccgtggagtgcgccgtgcccaccaagcccggcccccaggtggccgccgcccccacctgcaccagagtgtgctgcatccagtacagcggcgacggccagtggctggcctgcggcctggccaaccacctgctgctggtgttcgacgccagcctgaccggcacccccgccgtgttcagcggccacgacggcgccgtgaacgccgtgtgctggagccaggacagaagatggctgctgagcgccgccagagacggcaccctgagaatgtggagcgccagaggcgccgagctggccctgctgctgggcaaggacatgttcagcaagcccatccagagcgcccagttctactacatcgacgccttcatcctgctgagcagcggccccgagttccagctgctgagataccacatcgacacctgcaaggacgagatcaagagatacaagcagaagagcaagagcaagctgatctgcagactgagcaccaccggcgccgtggacatgaccagcctgagcgccgtgaacgacttctacagccacatcgtgctggccgccggcagaaacagaaccgtggaggtgttcgacctgaacgccggctgcagcgccgccgtgatcgccgaggcccacagcagacccgtgcaccagatctgccagaacaagggcagcagcttcaccacccagcagccccaggcctacaacctgttcctgaccaccgccatcggcgacggcatgagactgtgggacctgagaaccctgagatgcgagagacacttcgagggccaccccaccagaggctacccctgcggcatcgccttcagcccctgcggcagattcgccgcctgcggcgccgaggacagacacgcctacgtgtacgagatgggcagcagcaccttcagccacagactggccggccacaccgacaccgtgaccggcgtggccttcaaccccagcgccccccagctggccaccgccaccctggacggcaagctgcagctgttcctggccgagtag

SEQ ID NO: 26022 - DNA, 2688 bp, Artificial Sequence
  Description of Artificial Sequence: Synthetic coding sequence
atggagaacccccaggacatcttcagcagcaacggcggctgcctgagcgacatcgtgatcgagaagtacctggtggagagcaaggagagcgtgagccacgtgcagctggcctgcagcatgcaggactgcgccttccccctggacggcaccgagctgtgcatctggaacaccaaggaccccagccaccagctgctgatcctgagaggccaccaccagcccatcaccgccatggccttcggcaacaaggtgaaccccctgctgatctgcagcgccagcctggactacgtgatcatgtggaacctggacgagtgcagagagaaggtgctgcagggcctggtgcccagaggcaccgtgatgggcagcctgctgggcaaggtgctgtgcctgcagctgagcctggacgaccacgtggtggccgtgtgcgccggcaacaagatcttcatgctggacatcgagcagagattcagcgtgacctacatcgagagacccgacgtgaacaacagacacaaggtgcccccccccaccttcctgcacaccttcagccagacccaggccgtgagagccgagctgcagggccacctgggccccgtgaccgccgtggagttctgcccctggagagccggcaccctgatcagcgccagcgaggacagaggcttcaaggtgtgggaccactgcaccggcagcctgatctacagcagcagcgtgctgagcgcctaccccctgctgagcctgttcatcgacgccgagagcagacagctggtgaccggctgcgccgacggccagctgtggatcttcagcctgatggacggccaccactacagaagagtggccagagtggacctgagaaagaagaccgagaccttcagcaccagaagagtgaagagcggcctgtgcagccagcccgaggagagccagctgcccagcaccagcgccctgggcaagggcgagcaggtggaggtgaccttccccgtgctgagactggccccctgcgacctgagcctgatccccaacagcgcctgcggctgcctgagcagcgagaacaccagatgcgtgtggatcggcagcagcgtgggcctgttcgtgttcaacctggccaacctggaggtggaggccgccctgtactacaaggacttccagagcctgagcatcctgctggccggcagctgcgccctgagaaacagaaccgccgaccagaaggtgctgtgcctgctggccagcctgttcggcggcaagatcgccgtgctggagatcaaccccgccgccctggtgagagcccagcagtgccccagcatgggccagagcctgagcgtgcccgccagcagctgcgtgctgcccaccagccccctgtacctgggcatcgccaaggagaagagcaccaaggccgccagcgagcagagaagagccgccagaaacgtgatgaaggaccagagactggtgttccacagcaaggtgagaagcagcggctacgccagcgccccccacgtgaccatgttcagccccaagaccaacatcaagagcgagggcaagggcagcagcagaagcagaagcagctgcgccagagaggcctaccccgtggagtgcgccgtgcccaccaagcccggcccccaggtggccgccgcccccacctgcaccagagtgtgctgcatccagtacagcggcgacggccagtggctggcctgcggcctggccaaccacctgctgctggtgttcgacgccagcctgaccggcacccccgccgtgttcagcggccacgacggcgccgtgaacgccgtgtgctggagccaggacagaagatggctgctgagcgccgccagagacggcaccctgagaatgtggagcgccagaggcgccgagctggccctgctgctgggcaaggacatgttcagcaagcccatccagagcgcccagttctactacatcgacgccttcatcctgctgagcagcggccccgagttccagctgctgagataccacatcgacacctgcaaggacgagatcaagagatacaagcagaagagcaagagcaagctgatctgcagactgagcaccaccggcgccgtggacatgaccagcctgagcgccgtgaacgacttctacagccacatcgtgctggccgccggcagaaacagaaccgtggaggtgttcgacctgaacgccggctgcagcgccgccgtgatcgccgaggcccacagcagacccgtgcaccagatctgccagaacaagggcagcagcttcaccacccagcagccccaggcctacaacctgttcctgaccaccgccatcggcgacggcatgagactgtgggacctgagaaccctgagatgcgagagacacttcgagggccaccccaccagaggctacccctgcggcatcgccttcagcccctgcggcagattcgccgcctgcggcgccgaggacagacacgcctacgtgtacgagatgggcagcagcaccttcagccacagactggccggccacaccgacaccgtgaccggcgtggccttcaaccccagcgccccccagatggagagcagaagcgtggcccacgccggcgtgcagtggcacgacctgggcagcctgcagcccccccccagcagattcaagcagttcttctgcctgagcctgcccagcagctgggactacagcctgccccagctgccctggatggtgaacagcagcagcttctag

SEQ ID NO: 26023 - DNA, 267 bp, Artificial Sequence
  Description of Artificial Sequence: Synthetic coding sequence
atggagaacccccaggacatcttcagcagcaacggcggctgcctgagcgacatcgtgatcgagaagtacctggtggagagcaaggagagcgtgagccacgtgcagctggcctgcagcatgcaggactgcgccttccccctggacggcaccgagctgtgcatctggaacaccaaggaccccagccaccagctgctgatcctgagaggccaccaccagcccatcaccgccatggccttcggcaacaaggtgaaccccctgctgatctag

SEQ ID NO: 26024 - DNA, 1101 bp, Artificial Sequence
  Description of Artificial Sequence: Synthetic coding sequence
atgctgctgctgagatgccagctgaagcaggcccccccccagaaggtgagcttcagattctgcgtggtgatgggcaagcagcagagcaagctgaagcacagcacctacaagtacggccccgacgagatcatcgaggagagaatccagaccaaggccttccaggagtacagccccgcccacatggacaccgtgagcgtggtggccgccctgaacagcgacctgtgcgtgagcggcggcaaggacaagaccgtggtggcctacaactggaagaccggcaacgtggtgaagagattcaagggccacgagcacgagatcaccaaggtggcctgcatccccaagagcagccagttcttcagcgccagcagagacagaatggtgatgatgtgggacctgcacggcagcagccagcccagacagcagctgtgcggccacgccatggtggtgaccggcctggccgtgagccccgacagcagccagctgtgcaccggcagcagagacaacaccctgctgctgtgggacgtggtgaccggccagagcgtggagagagccagcgtgagcagaaacgtggtgacccacctgtgctgggtgcccagagagccctacatcctgcagaccagcgaggacaagaccctgagactgtgggacagcagaggcctgcaggtggcccacatgttccccgccaagcagcacatccagacctactgcgaggtgagcgtggacggccacaagtgcatcagctgcagcaacggcttcggcggcgagggctgcgaggccaccctgtgggacctgagacagaccagaaacagaatctgcgagtacaagggccacttccagaccgtggccagctgcgtgttcctgcccagagccctggccctgatgcccctgatcgccaccagcagccacgactgcaaggtgaagatctggaaccaggacaccggcgcctgcctgttcaccctgagcctggacggcagcggccccctgaccagcctggccgtgggcgacgccatcagcctgctgtgcgccagcttcaacagaggcatccacctgctgagaatggaccacagccagggcctggagctgcaggaggtggccgccttctag

SEQ ID NO: 26025 - DNA, 1104 bp, Artificial Sequence
  Description of Artificial Sequence: Synthetic coding sequence
atgctgctgctgagatgccagctgaagcaggcccccccccagaaggtgagcttcagattctgcgtggtgatgggcaagcagcagagcaagctgaagcacagcacctacaagtacggcagacccgacgagatcatcgaggagagaatccagaccaaggccttccaggagtacagccccgcccacatggacaccgtgagcgtggtggccgccctgaacagcgacctgtgcgtgagcggcggcaaggacaagaccgtggtggcctacaactggaagaccggcaacgtggtgaagagattcaagggccacgagcacgagatcaccaaggtggcctgcatccccaagagcagccagttcttcagcgccagcagagacagaatggtgatgatgtgggacctgcacggcagcagccagcccagacagcagctgtgcggccacgccatggtggtgaccggcctggccgtgagccccgacagcagccagctgtgcaccggcagcagagacaacaccctgctgctgtgggacgtggtgaccggccagagcgtggagagagccagcgtgagcagaaacgtggtgacccacctgtgctgggtgcccagagagccctacatcctgcagaccagcgaggacaagaccctgagactgtgggacagcagaggcctgcaggtggcccacatgttccccgccaagcagcacatccagacctactgcgaggtgagcgtggacggccacaagtgcatcagctgcagcaacggcttcggcggcgagggctgcgaggccaccctgtgggacctgagacagaccagaaacagaatctgcgagtacaagggccacttccagaccgtggccagctgcgtgttcctgcccagagccctggccctgatgcccctgatcgccaccagcagccacgactgcaaggtgaagatctggaaccaggacaccggcgcctgcctgttcaccctgagcctggacggcagcggccccctgaccagcctggccgtgggcgacgccatcagcctgctgtgcgccagcttcaacagaggcatccacctgctgagaatggaccacagccagggcctggagctgcaggaggtggccgccttctag

SEQ ID NO: 26026 - DNA, 729 bp, Artificial Sequence
  Description of Artificial Sequence: Synthetic coding sequence
atggtgatgatgtgggacctgcacggcagcagccagcccagacagcagctgtgcggccacgccatggtggtgaccggcctggccgtgagccccgacagcagccagctgtgcaccggcagcagagacaacaccctgctgctgtgggacgtggtgaccggccagagcgtggagagagccagcgtgagcagaaacgtggtgacccacctgtgctgggtgcccagagagccctacatcctgcagaccagcgaggacaagaccctgagactgtgggacagcagaggcctgcaggtggcccacatgttccccgccaagcagcacatccagacctactgcgaggtgagcgtggacggccacaagtgcatcagctgcagcaacggcttcggcggcgagggctgcgaggccaccctgtgggacctgagacagaccagaaacagaatctgcgagtacaagggccacttccagaccgtggccagctgcgtgttcctgcccagagccctggccctgatgcccctgatcgccaccagcagccacgactgcaaggtgaagatctggaaccaggacaccggcgcctgcctgttcaccctgagcctggacggcagcggccccctgaccagcctggccgtgggcgacgccatcagcctgctgtgcgccagcttcaacagaggcatccacctgctgagaatggaccacagccagggcctggagctgcaggaggtggccgccttctag

SEQ ID NO: 26027 - DNA, 4011 bp, Artificial Sequence
  Description of Artificial Sequence: Synthetic coding sequence
atggccaccgagatcggcagcccccccagattcttccacatgcccagattccagcaccaggcccccagacagctgttctacaagagacccgacttcgcccagcagcaggccatgcagcagctgaccttcgacggcaagagaatgagaaaggccgtgaacagaaagaccatcgactacaaccccagcgtgatcaagtacctggagaacagaatctggcagagagaccagagagacatgagagccatccagcccgacgccggctactacaacgacctggtgccccccatcggcatgctgaacaaccccatgaacgccgtgaccaccaagttcgtgagaaccagcaccaacaaggtgaagtgccccgtgttcgtggtgagatggacccccgagggcagaagactggtgaccggcgccagcagcggcgagttcaccctgtggaacggcctgaccttcaacttcgagaccatcctgcaggcccacgacagccccgtgagagccatgacctggagccacaacgacatgtggatgctgaccgccgaccacggcggctacgtgaagtactggcagagcaacatgaacaacgtgaagatgttccaggcccacaaggaggccatcagagaggccagcttcagccccaccgacaacaagttcgccacctgcagcgacgacggcaccgtgagaatctgggacttcctgagatgccacgaggagagaatcctgagaggccacggcgccgacgtgaagtgcgtggactggcaccccaccaagggcctggtggtgagcggcagcaaggacagccagcagcccatcaagttctgggaccccaagaccggccagagcctggccaccctgcacgcccacaagaacaccgtgatggaggtgaagctgaacctgaacggcaactggctgctgaccgccagcagagaccacctgtgcaagctgttcgacatcagaaacctgaaggaggagctgcaggtgttcagaggccacaagaaggaggccaccgccgtggcctggcaccccgtgcacgagggcctgttcgccagcggcggcagcgacggcagcctgctgttctggcacgtgggcgtggagaaggaggtgggcggcatggagatggcccacgagggcatgatctggagcctggcctggcaccccctgggccacatcctgtgcagcggcagcaacgaccacaccagcaagttctggaccagaaacagacccggcgacaagatgagagacagatacaacctgaacctgctgcccggcatgagcgaggacggcgtggagtacgacgacctggagcccaacagcctggccgtgatccccggcatgggcatccccgagcagctgaagctggccatggagcaggagcagatgggcaaggacgagagcaacgagatcgagatgaccatccccggcctggactggggcatggaggaggtgatgcagaaggaccagaagaaggtgccccagaagaaggtgccctacgccaagcccatccccgcccagttccagcaggcctggatgcagaacaaggtgcccatccccgcccccaacgaggtgctgaacgacagaaaggaggacatcaagctggaggagaagaagaagacccaggccgagatcgagcaggagatggccaccctgcagtacaccaacccccagctgctggagcagctgaagatcgagagactggcccagaagcaggtggagcagatccagcccccccccagcagcggcacccccctgctgggcccccagcccttccccggccagggccccatgagccagatcccccagggcttccagcagccccaccccagccagcagatgcccatgaacatggcccagatgggcccccccggcccccagggccagttcagaccccccggcccccagggccagatgggcccccagggcccccccctgcaccagggcggcggcggcccccagggcttcatgggcccccagggcccccagggccccccccagggcctgcccagaccccaggacatgcacggcccccagggcatgcagagacaccccggcccccacggccccctgggcccccagggcccccccggcccccagggcagcagcggcccccagggccacatgggcccccagggcccccccggcccccagggccacatcggcccccagggcccccccggcccccagggccacctgggcccccagggcccccccggcacccagggcatgcagggcccccccggccccagaggcatgcagggccccccccacccccacggcatccagggcggccccggcagccagggcatccagggccccgtgagccagggccccctgatgggcctgaaccccagaggcatgcagggcccccccggccccagagagaaccagggccccgccccccagggcatgatcatgggccaccccccccaggagatgagaggcccccacccccccggcggcctgctgggccacggcccccaggagatgagaggcccccaggagatcagaggcatgcagggcccccccccccagggcagcatgctgggccccccccaggagctgagaggcccccccggcagccagagccagcagggccccccccagggcagcctgggcccccccccccagggcggcatgcagggcccccccggcccccagggccagcagaaccccgccagaggcccccaccccagccagggccccatccccttccagcagcagaagacccccctgctgggcgacggccccagagcccccttcaaccaggagggccagagcaccggccccccccccctgatccccggcctgggccagcagggcgcccagggcagaatcccccccctgaaccccggccagggccccggccccaacaagggcgacagcagaggcccccccaaccaccacatgggccccatgagcgagagaagacacgagcagagcggcggccccgagcacggccccgagagaggccccttcagaggcggccaggactgcagaggcccccccgacagaagaggcccccaccccgacttccccgacgacttcagcagacccgacgacttccaccccgacaagagattcggccacagactgagagagttcgagggcagaggcggccccctgccccaggaggagaagtggagaagaggcggccccggcccccccttcccccccgaccacagagagttcagcgagggcgacggcagaggcgccgccagaggcccccccggcgcctgggagggcagaagacccggcgacgagagattccccagagaccccgaggaccccagattcagaggcagaagagaggagagcttcagaagaggcgccccccccagacacgagggcagagccccccccagaggcagagacggcttccccggccccgaggacttcggccccgaggagaacttcgacgccagcgaggaggccgccagaggcagagacctgagaggcagaggcagaggcacccccagaggcggcagaaagggcctgctgcccacccccgacgagttccccagattcgagggcggcagaaagcccgacagctgggacggcaacagagagcccggccccggccacgagcacttcagagacacccccagacccgaccaccccccccacgacggccacagccccgccagcagagagagaagcagcagcctgcagggcatggacatggccagcctgccccccagaaagagaccctggcacgacggccccggcaccagcgagcacagagagatggaggcccccggcggccccagcgaggacagaggcggcaagggcagaggcggccccggccccgcccagagagtgcccaagagcggcagaagcagcagcctggacggcgagcaccacgacggctaccacagagacgagcccttcggcggcccccccggcagcggcacccccagcagaggcggcagaagcggcagcaactggggcagaggcagcaacatgaacagcggcccccccagaagaggcgccagcagaggcggcggcagaggcagatag

SEQ ID NO: 26028 - DNA, 774 bp, Artificial Sequence
  Description of Artificial Sequence: Synthetic coding sequence
atggccaccgagatcggcagcccccccagattcttccacatgcccagattccagcaccaggcccccagacagctgttctacaagagacccgacttcgcccagcagcaggccatgcagcagctgaccttcgacggcaagagaatgagaaaggccgtgaacagaaagaccatcgactacaaccccagcgtgatcaagtacctggagaacagaatctggcagagagaccagagagacatgagagccatccagcccgacgccggctactacaacgacctggtgccccccatcggcatgctgaacaaccccatgaacgccgtgaccaccaagttcgtgagaaccagcaccaacaaggtgaagtgccccgtgttcgtggtgagatggacccccgagggcagaagactggtgaccggcgccagcagcggcgagttcaccctgtggaacggcctgaccttcaacttcgagaccatcctgcaggcccacgacagccccgtgagagccatgacctggagccacaacgacatgtggatgctgaccgccgaccacggcggctacgtgaagtactggcagagcaacatgaacaacgtgaagatgttccaggcccacaaggaggccatcagagaggccagcttcagccccaccgacaacaagttcgccacctgcagcgacgacggcaccgtgagaatctgggacttcctgagatgccacgaggagagaatcctgagagacacctgcttccaccactgcagatgctacttcctgagcgtgaagagatag

SEQ ID NO: 26029 - DNA, 357 bp, Artificial Sequence
  Description of Artificial Sequence: Synthetic coding sequence
atggccaccgagatcggcagcccccccagattcttccacatgcccagattccagcaccaggcccccagacagctgttctacaagagacccgacttcgcccagcagcaggccatgcagcagctgaccttcgacggcaagagaatgagaaaggccgtgaacagaaagaccatcgactacaaccccagcgtgatcaagtacctggagaacagaatctggcagagagaccagagagacatgagagccatccagcccgacgccggctactacaacgacctggtgccccccatcggcatgctgaacaaccccatgaacgccgtgaccaccaagttcgtgagaaccagcaccaacaaggtgtag

SEQ ID NO: 26030 - DNA, 981 bp, Artificial Sequence
  Description of Artificial Sequence: Synthetic coding sequence
atggccaccgagatcggcagcccccccagattcttccacatgcccagattccagcaccaggcccccagacagctgttctacaagagacccgacttcgcccagcagcaggccatgcagcagctgaccttcgacggcaagagaatgagaaaggccgtgaacagaaagaccatcgactacaaccccagcgtgatcaagtacctggagaacagaatctggcagagagaccagagagacatgagagccatccagcccgacgccggctactacaacgacctggtgccccccatcggcatgctgaacaaccccatgaacgccgtgaccaccaagttcgtgagaaccagcaccaacaaggtgaagtgccccgtgttcgtggtgagatggacccccgagggcagaagactggtgaccggcgccagcagcggcgagttcaccctgtggaacggcctgaccttcaacttcgagaccatcctgcaggcccacgacagccccgtgagagccatgacctggagccacaacgacatgtggatgctgaccgccgaccacggcggctacgtgaagtactggcagagcaacatgaacaacgtgaagatgttccaggcccacaaggaggccatcagagaggccagattcatccacaacatccccttcagcgtggtgcccatcgtgatggtgaagctgttcagcaagtgcatcctgggcgccgagatgcacggcctgtgccagttcctgggcaacttcctgcaccccatcaacaccatcttcttcttcgtgttcacccacagccccttctgctggcacctgagcgaggtggtgctgagcagataccagcccctgcagtacgtgagagacgtgctgagcgccgccttctgcaccggcttcctgttcagcttcatgatcaacaacgtgtacaccctgttcctgttcatcatctactgcgtgagacaggagtacttcatccccaacaaggagttcagcctgtag

SEQ ID NO: 26031 - DNA, 1485 bp, Artificial Sequence
  Description of Artificial Sequence: Synthetic coding sequence
atgcccaccgagagcgccagctgcagcaccgccagacagaccaagcagaagagaaagagccacagcctgagcatcagaagaaccaacagcagcgagcaggagagaaccggcctgcccagagacatgctggagggccaggacagcaagctgcccagcagcgtgagaagcaccctgctggagctgttcggccagatcgagagagagttcgagaacctgtacatcgagaacctggagctgagaagagagatcgacaccctgaacgagagactggccgccgagggccaggccatcgacggcgccgagctgagcaagggccagctgaagaccaaggccagccacagcaccagccagctgagccagaagctgaagaccacctacaaggccagcaccagcaagatcgtgagcagcttcaagaccaccaccagcagagccgcctgccagctggtgaaggagtacatcggccacagagacggcatctgggacgtgagcgtggccaagacccagcccgtggtgctgggcaccgccagcgccgaccacaccgccctgctgtggagcatcgagaccggcaagtgcctggtgaagtacgccggccacgtgggcagcgtgaacagcatcaagttccaccccagcgagcagctggccctgaccgccagcggcgaccagaccgcccacatctggagatacgccgtgcagctgcccaccccccagcccgtggccgacaccagcatcagcggcgaggacgaggtggagtgcagcgacaaggacgagcccgacctggacggcgacgtgagcagcgactgccccaccatcagagtgcccctgaccagcctgaagagccaccagggcgtggtgatcgccagcgactggctggtgggcggcaagcaggccgtgaccgccagctgggacagaaccgccaacctgtacgacgtggagaccagcgagctggtgcacagcctgaccggccacgaccaggagctgacccactgctgcacccaccccacccagagactggtggtgaccagcagcagagacaccaccttcagactgtgggacttcagagaccccagcatccacagcgtgaacgtgttccagggccacaccgacaccgtgaccagcgccgtgttcaccgtgggcgacaacgtggtgagcggcagcgacgacagaaccgtgaaggtgtgggacctgaagaacatgagaagccccatcgccaccatcagaaccgacagcgccatcaacagaatcaacgtgtgcgtgggccagaagatcatcgccctgccccacgacaacagacaggtgagactgttcgacatgagcggcgtgagactggccagactgcccagaagcagcagacagggccacagaagaatggtgtgctgcagcgcctggagcgaggaccaccccgtgtgcaacctgttcacctgcggcttcgacagacaggccatcggctggaacatcaacatccccgccctgctgcaggagaagtag

SEQ ID NO: 26032 - DNA, 1485 bp, Artificial Sequence; identical to SEQ ID NO: 26031
  Description of Artificial Sequence: Synthetic coding sequence

SEQ ID NO: 26033 - DNA, 750 bp, Artificial Sequence
  Description of Artificial Sequence: Synthetic coding sequence
atgcccaccgagagcgccagctgcagcaccgccagacagaccaagcagaagagaaagagccacagcctgagcatcagaagaaccaacagcagcgagcaggagagaaccggcctgcccagagacatgctggagggccaggacagcaagctgcccagcagcgtgagaagcaccctgctggagctgttcggccagatcgagagagagttcgagaacctgtacatcgagaacctggagctgagaagagagatcgacaccctgaacgagagactggccgccgagggccaggccatcgacggcgccgagctgagcaagggccagctgaagaccaaggccagccacagcaccagccagctgagccagaagctgaagaccacctacaaggccagcaccagcaagatcgtgagcagcttcaagaccaccaccagcagagccgcctgccagctggtgaaggagtacatcggccacagagacggcatctgggacgtgagcgtggccaagacccagcccgtggtgctgggcaccgccagcgccgaccacaccgccctgctgtggagcatcgagaccggcaagtgcctggtgaagtacgccggccacgtgggcagcgtgaacagcatcaagttccaccccagcgagcagctggccctgaccgccagcggcgaccagaccgcccacatctggagatacgccgtgcagctgcccaccccccagcccgtggccgacaccagcgtgagcaccttcccctacctgtag

SEQ ID NO: 26034 - DNA, 630 bp, Artificial Sequence
  Description of Artificial Sequence: Synthetic coding sequence
atgagcagcgacagcgagtgggacagaagcgcctgcagcgacagcaagctgcccagcagcgtgagaagcaccctgctggagctgttcggccagatcgagagagagttcgagaacctgtacatcgagaacctggagctgagaagagagatcgacaccctgaacgagagactggccgccgagggccaggccatcgacggcgccgagctgagcaagggccagctgaagaccaaggccagccacagcaccagccagctgagccagaagctgaagaccacctacaaggccagcaccagcaagatcgtgagcagcttcaagaccaccaccagcagagccgcctgccagctggtgaaggagtacatcggccacagagacggcatctgggacgtgagcgtggccaagacccagcccgtggtgctgggcaccgccagcgccgaccacaccgccctgctgtggagcatcgagaccggcaagtgcctggtgaagtacgccggccacgtgggcagcgtgaacagcatcaagttccaccccagcgagcagctggccctgaccgccagcggcgaccagaccgcccacatctggagatacgccgtgcagctgcccaccccccagcccgtggccgacaccagctag

SEQ ID NO: 26035 - DNA, 945 bp, Artificial Sequence
  Description of Artificial Sequence: Synthetic coding sequence
atgaacagcggcgtgcccgccaccctggccgtgagaagagtgaagttcttcggccagcacggcggcgaggtgaacagcagcgccttcagccccgacggccagatgctgctgaccggcagcgaggacggctgcgtgtacggctgggagaccagaagcggccagctgctgtggagactgggcggccacaccggccccgtgaagttctgcagattcagccccgacggccacctgttcgccagcgccagctgcgactgcaccgtgagactgtgggacgtggccagagccaagtgcctgagagtgctgaagggccaccagagaagcgtggagaccgtgagcttcagccccgacagcagacagctggccagcggcggctgggacaagagagtgatgctgtgggacgtgcagagcggccagatgctgagactgctggtgggccacagagacagcatccagagcagcgacttcagccccaccgtgaactgcctggccaccggcagctgggacagcaccgtgcacatctgggacctgagaatggtgacccccgccgtgagccaccaggccctggagggccacagcgccaacatcagctgcctgtgctacagcgccagcggcctgctggccagcggcagctgggacaagaccatccacatctggaagcccaccaccagcagcctgctgatccagctgaagggccacgtgacctgggtgaagagcatcgccttcagccccgacgagctgtggctggccagcgccggctacagcagaatggtgaaggtgtgggactgcaacaccggcaagtgcctggagaccctgaagggcgtgctggacgtggcccacacctgcgccttcacccccgacggcaagatcctggtgagcggcgccgccgaccagaccagaagacagatcagcagaaccagcaagagccccagagacccccagacctag

SEQ ID NO: 26036 - DNA, 1380 bp, Artificial Sequence
  Description of Artificial Sequence: Synthetic coding sequence
atgctgagatggctgatcggcggcggcagagagccccagggcctggccgagaagagccccctgcagaccatcggcgaggagcagacccagaacccctacaccgagctgctggtgctgaaggcccaccacgacatcgtgagattcctggtgcagctggacgactacagattcgccagcgccggcgacgacggcatcgtggtggtgtggaacgcccagaccggcgagaagctgctggagctgaacggccacacccagaagatcaccgccatcatcaccttccccagcctggagagctgcgaggagaagaaccagctgatcctgaccgccagcgccgacagaaccgtgatcgtgtgggacggcgacaccaccagacaggtgcagagaatcagctgcttccagagcaccgtgaagtgcctgaccgtgctgcagagactggacgtgtggctgagcggcggcaacgacctgtgcgtgtggaacagaaagctggacctgctgtgcaagaccagccacctgagcgacaccggcatcagcgccctggtggagatccccaagaactgcgtggtggccgccgtgggcaaggagctgatcatcttcagactggtggcccccaccgagggcagcctggagtgggacatcctggaggtgaagagactgctggaccaccaggacaacatcctgagcctgatcaacgtgaacgacctgagcttcgtgaccggcagccacgtgggcgagctgatcatctgggacgccctggactggaccatgcaggcctacgagagaaacttctgggaccccagcccccagctggacacccagcaggagatcaagctgtgccagaagagcaacgacatcagcatccaccacttcacctgcgacgaggagaacgtgttcgccgccgtgggcagaggcctgtacgtgtacagcctgcagatgaagagagtgatcgcctgccagaagaccgcccacgacagcaacgtgctgcacgtggccagactgcccaacagacagctgatcagctgcagcgaggacggcagcgtgagaatctgggagctgagagagaagcagcagctggccgccgagcccgtgcccaccggcttcttcaacatgtggggcttcggcagagtgagcaagcaggccagccagcccgtgaagaagcagcaggagaacgccaccagctgcagcctggagctgatcggcgacctgatcggccacagcagcagcgtggagatgttcctgtacttcgaggaccacggcctggtgacctgcagcgccgaccacctgatcatcctgtggaagaacggcgagagagagagcggcctgagaagcctgagactgttccagaagctggaggagaacggcgacctgtacctggccgtgtag

SEQ ID NO: 26037 - DNA, 618 bp, Artificial Sequence
  Description of Artificial Sequence: Synthetic coding sequence
atgcaggcctacgagagaaacttctgggaccccagcccccagctggacacccagcaggagatcaagctgtgccagaagagcaacgacatcagcatccaccacttcacctgcgacgaggagaacgtgttcgccgccgtgggcagaggcctgtacgtgtacagcctgcagatgaagagagtgatcgcctgccagaagaccgcccacgacagcaacgtgctgcacgtggccagactgcccaacagacagctgatcagctgcagcgaggacggcagcgtgagaatctgggagctgagagagaagcagcagctggccgccgagcccgtgcccaccggcttcttcaacatgtggggcttcggcagagtgagcaagcaggccagccagcccgtgaagaagcagcaggagaacgccaccagctgcagcctggagctgatcggcgacctgatcggccacagcagcagcgtggagatgttcctgtacttcgaggaccacggcctggtgacctgcagcgccgaccacctgatcatcctgtggaagaacggcgagagagagagcggcctgagaagcctgagactgttccagaagctggaggagaacggcgacctgtacctggccgtgtag

SEQ ID NO: 26038 - DNA, 1086 bp, Artificial Sequence
  Description of Artificial Sequence: Synthetic coding sequence
atgacccagcagcccctgagaggcgtgaccagcctgagattcaaccaggaccagagctgcttctgctgcgccatggagaccggcgtgagaatctacaacgtggagcccctgatggagaagggccacctggaccacgagcaggtgggcagcatgggcctggtggagatgctgcacagaagcaacctgctggccctggtgggcggcggcagcagccccaagttcagcgagatcagcgccgtgctgatctgggacgacgccagagagggcaaggacagcaaggagaagctggtgctggagttcaccttcaccaagcccgtgctgagcgtgagaatgagacacgacaagatcgtgatcgtgctgaagaacagaatctacgtgtacagcttccccgacaaccccagaaagctgttcgagttcgacaccagagacaaccccaagggcctgtgcgacctgtgccccagcctggagaagcagctgctggtgttccccggccacaagtgcggcagcctgcagctggtggacctggccagcaccaagcccggcaccagcagcgcccccttcaccatcaacgcccaccagagcgacatcgcctgcgtgagcctgaaccagcccggcaccgtggtggccagcgccagccagaagggcaccctgatcagactgttcgacacccagagcaaggagaagctggtggagctgagaagaggcaccgaccccgccaccctgtactgcatcaacttcagccacgacagcagcttcctgtgcgccagcagcgacaagggcaccgtgcacatcttcgccctgaaggacaccagactgaacagaagaagcgccctggccagagtgggcaaggtgggccccatgatcggccagtacgtggacagccagtggagcctggccagcttcaccgtgcccgccgagagcgcctgcatctgcgccttcggcagaaacaccagcaagaacgtgaacagcgtgatcgccatctgcgtggacggcaccttccacaagtacgtgttcacccccgacggcaactgcaacagagaggccttcgacgtgtacctggacatctgcgacgacgacgacttctag

SEQ ID NO: 26039 - DNA, 1833 bp, Artificial Sequence
  Description of Artificial Sequence: Synthetic coding sequence
atggagaccgcccccaagcccggcaaggacgtgccccccaagaaggacaagctgcagaccaagagaaagaagcccagaagatactgggaggaggagaccgtgcccaccaccgccggcgccagccccggcccccccagaaacaagaagaacagagagctgagaccccagagacccaagaacgcctacatcctgaagaagagcagaatcagcaagaagccccaggtgcccaagaagcccagagagtggaagaaccccgagagccagagaggcctgagcggcacccaggaccccttccccggccccgcccccgtgcccgtggaggtggtgcagaagttctgcagaatcgacaagagcagaaagctgccccacagcaaggccaagaccagaagcagactggaggtggccgaggccgaggaggaggagaccagcatcaaggccgccagaagcgagctgctgctggccgaggagcccggcttcctggagggcgaggacggcgaggacaccgccaagatctgccaggccgacatcgtggaggccgtggacatcgccagcgccgccaagcacttcgacctgaacctgagacagttcggcccctacagactgaactacagcagaaccggcagacacctggccttcggcggcagaagaggccacgtggccgccctggactgggtgaccaagaagctgatgtgcgagatcaacgtgatggaggccgtgagagacatcagattcctgcacagcgaggccctgctggccgtggcccagaacagatggctgcacatctacgacaaccagggcatcgagctgcactgcatcagaagatgcgacagagtgaccagactggagttcctgcccttccacttcctgctggccaccgccagcgagaccggcttcctgacctacctggacgtgagcgtgggcaagatcgtggccgccctgaacgccagagccggcagactggacgtgatgagccagaacccctacaacgccgtgatccacctgggccacagcaacggcaccgtgagcctgtggagccccgccatgaaggagcccctggccaagatcctgtgccacagaggcggcgtgagagccgtggccgtggacagcaccggcacctacatggccaccagcggcctggaccaccagctgaagatcttcgacctgagaggcacctaccagcccctgagcaccagaaccctgccccacggcgccggccacctggccttcagccagagaggcctgctggtggccggcatgggcgacgtggtgaacatctgggccggccagggcaaggccagcccccccagcctggagcagccctacctgacccacagactgagcggccccgtgcacggcctgcagttctgccccttcgaggacgtgctgggcgtgggccacaccggcggcatcaccagcatgctggtgcccggcgccggcgagcccaacttcgacggcctggagagcaacccctacagaagcagaaagcagagacaggagtgggaggtgaaggccctgctggagaaggtgcccgccgagctgatctgcctggaccccagagccctggccgaggtggacgtgatcagcctggagcagggcaagaaggagcagatcgagagactgggctacgacccccaggccaaggcccccttccagcccaagcccaagcagaagggcagaagcagcaccgccagcctggtgaagagaaagagaaaggtgatggacgaggagcacagagacaaggtgagacagagcctgcagcagcagcaccacaaggaggccaaggccaagcccaccggcgccagacccagcgccctggacagattcgtgagatag

SEQ ID NO: 26040 - DNA, 1833 bp, Artificial Sequence
  Description of Artificial Sequence: Synthetic coding sequence
atggagaccgcccccaagcccggcaaggacgtgccccccaagaaggacaagctgcagaccaagagaaagaagcccagaagatactgggaggaggagaccgtgcccaccaccgccggcgccagccccggcccccccagaaacaagaagaacagagagctgagaccccagagacccaagaacgcctacatcctgaagaagagcagaatcagcaagaagccccaggtgcccaagaagcccagagagtggaagaaccccgagagccagagaggcctgagcggcgcccaggaccccttccccggccccgcccccgtgcccgtggaggtggtgcagaagttctgcagaatcgacaagagcagaaagctgccccacagcaaggccaagaccagaagcagactggaggtggccgaggccgaggaggaggagaccagcatcaaggccgccagaagcgagctgctgctggccgaggagcccggcttcctggagggcgaggacggcgaggacaccgccaagatctgccaggccgacatcgtggaggccgtggacatcgccagcgccgccaagcacttcgacctgaacctgagacagttcggcccctacagactgaactacagcagaaccggcagacacctggccttcggcggcagaagaggccacgtggccgccctggactgggtgaccaagaagctgatgtgcgagatcaacgtgatggaggccgtgagagacatcagattcctgcacagcgaggccctgctggccgtggcccagaacagatggctgcacatctacgacaaccagggcatcgagctgcactgcatcagaagatgcgacagagtgaccagactggagttcctgcccttccacttcctgctggccaccgccagcgagaccggcttcctgacctacctggacgtgagcgtgggcaagatcgtggccgccctgaacgccagagccggcagactggacgtgatgagccagaacccctacaacgccgtgatccacctgggccacagcaacggcaccgccagcctgtggagccccgccatgaaggagcccctggccaagatcctgtgccacagaggcggcgtgagagccgtggccgtggacagcaccggcacctacatggccaccagcggcctggaccaccagctgaagatcttcgacctgagaggcacctaccagcccctgagcaccagaaccctgccccacggcgccggccacctggccttcagccagagaggcctgctggtggccggcatgggcgacgtggtgaacatctgggccggccagggcaaggccagcccccccagcctggagcagccctacctgacccacagactgagcggccccgtgcacggcctgcagttctgccccttcgaggacgtgctgggcgtgggccacaccggcggcatcaccagcatgctggtgcccggcgccggcgagcccaacttcgacggcctggagagcaacccctacagaagcagaaagcagagacaggagtgggaggtgaaggccctgctggagaaggtgcccgccgagctgatctgcctggaccccagagccctggccgaggtggacgtgatcagcctggagcagggcaagaaggagcagatcgagagactgggctacgacccccaggccaaggcccccttccagcccaagcccaagcagaagggcagaagcagcaccgccagcctggtgaagagaaagagaaaggtgatggacgaggagcacagagacaaggtgagacagagcctgcagcagcagcaccacaaggaggccaaggccaagcccaccggcgccagacccagcgccctggacagattcgtgagatag

SEQ ID NO: 26041 - DNA, 969 bp, Artificial Sequence
  Description of Artificial Sequence: Synthetic coding sequence
aagagcagaatcagcaagaagccccaggtgcccaagaagcccagagagtggaagaaccccgagagccagagaggcctgagcggcgcccaggaccccttccccggccccgcccccgtgcccgtggaggtggtgcagaagttctgcagaatcgacaagagcagaaagctgccccacagcaaggccaagaccagaagcagactggaggtggccgaggccgaggaggaggagaccagcatcaaggccgccagaagcgagctgctgctggccgaggagcccggcttcctggagggcgaggacggcgaggacaccgccaagatctgccaggccgacatcgtggaggccgtggacatcgccagcgccgccaagttcggcccctacagactgaactacagcagaaccggcagacacctggccttcggcggcagaagaggccacgtggccgccctggactgggtgaccaagaagctgatgtgcgagatcaacgtgatggaggccgtgagagacatcagattcctgcacagcgaggccctgctggccgtggcccagaacagatggctgcacatctacgacaaccagggcatcgagctgcactgcatcagaagatgcgacagagtgaccagactggagttcctgcccttccacttcctgctggccaccgccagcgagaccggcttcctgacctacctggacgtgagcgtgggcaagatcgtggccgccctgaacgccagagccggcagactggacgtgatgagccagaacccctacaacgccgtgatccacctgggccacagcaacggcaccgccagcctgtggagccccgccatgaaggagcccctggccaagatcctgtgccacagaggcggcgtgagagccgtggccgtggacagcaccggcacctacatggccaccagcggcctggaccaccagctgaagatcttcgacctgagaggcacctaccagcccctgtag

SEQ ID NO: 26042 - DNA, 1833 bp, Artificial Sequence
  Description of Artificial Sequence: Synthetic coding sequence
atggagaccgcccccaagcccggcaaggacgtgccccccaagaaggacaagctgcagaccaagagaaagaagcccagaagatactgggaggaggagaccgtgcccaccaccgccggcgccagccccggcccccccagaaacaagaagaacagagagctgagaccccagagacccaagaacgcctacatcctgaagaagagcagaatcagcaagaagccccaggtgcccaagaagcccagagagtggaagaaccccgagagccagagaggcctgagcggcgcccaggaccccttccccggccccgcccccgtgcccgtggaggtggtgcagaagttctgcagaatcgacaagagcagaaagctgccccacagcaaggccaagaccagaagcagactggaggtggccgaggccgaggaggaggagaccagcatcaaggccgccagaagcgagctgctgctggccgaggagcccggcttcctggagggcgaggacggcgaggacaccgccaagatctgccaggccgacatcgtggaggccgtggacatcgccagcgccgccaagcacttcgacctgaacctgagacagttcggcccctacagactgaactacagcagaaccggcagacacctggccttcggcggcagaagaggccacgtggccgccctggactgggtgaccaagaagctgatgtgcgagatcaacgtgatggaggccgtgagagacatcagattcctgcacagcgaggccctgctggccgtggcccagaacagatggctgcacatctacgacaaccagggcatcgagctgcactgcatcagaagatgcgacagagtgaccagactggagttcctgcccttccacttcctgctggccaccgccagcgagaccggcttcctgacctacctggacgtgagcgtgggcaagatcgtggccgccctgaacgccagagccggcagactggacgtgatgagccagaacccctacaacgccgtgatccacctgggccacagcaacggcaccgtgagcctgtggagccccgccatgaaggagcccctggccaagatcctgtgccacagaggcggcgtgagagccgtggccgtggacagcaccggcacctacatggccaccagcggcctggaccaccagctgaagatcttcgacctgagaggcacctaccagcccctgagcaccagaaccctgccccacggcgccggccacctggccttcagccagagaggcctgctggtggccggcatgggcgacgtggtgaacatctgggccggccagggcaaggccagcccccccagcctggagcagccctacctgacccacagactgagcggccccgtgcacggcctgcagttctgccccttcgaggacgtgctgggcgtgggccacaccggcggcatcaccagcatgctggtgcccggcgccggcgagcccaacttcgacggcctggagagcaacccctacagaagcagaaagcagagacaggagtgggaggtgaaggccctgctggagaaggtgcccgccgagctgatctgcctggaccccagagccctggccgaggtggacgtgatcagcctggagcagggcaagaaggagcagatcgagagactgggctacgacccccaggccaaggcccccttccagcccaagcccaagcagaagggcagaagcagcaccgccagcctggtgaagagaaagagaaaggtgatggacgaggagcacagagacaaggtgagacagagcctgcagcagcagcaccacaaggaggccaaggccaagcccaccggcgccagacccagcgccctggacagattcgtgagatag

SEQ ID NO: 26043 - DNA, 1833 bp, Artificial Sequence; identical to SEQ ID NO: 26042
  Description of Artificial Sequence: Synthetic coding sequence

SEQ ID NO: 26044 - DNA, 969 bp, Artificial Sequence
  Description of Artificial Sequence: Synthetic coding sequence
aagagcagaatcagcaagaagccccaggtgcccaagaagcccagagagtggaagaaccccgagagccagagaggcctgagcggcgcccaggaccccttccccggccccgcccccgtgcccgtggaggtggtgcagaagttctgcagaatcgacaagagcagaaagctgccccacagcaaggccaagaccagaagcagactggaggtggccgaggccgaggaggaggagaccagcatcaaggccgccagaagcgagctgctgctggccgaggagcccggcttcctggagggcgaggacggcgaggacaccgccaagatctgccaggccgacatcgtggaggccgtggacatcgccagcgccgccaagttcggcccctacagactgaactacagcagaaccggcagacacctggccttcggcggcagaagaggccacgtggccgccctggactgggtgaccaagaagctgatgtgcgagatcaacgtgatggaggccgtgagagacatcagattcctgcacagcgaggccctgctggccgtggcccagaacagatggctgcacatctacgacaaccagggcatcgagctgcactgcatcagaagatgcgacagagtgaccagactggagttcctgcccttccacttcctgctggccaccgccagcgagaccggcttcctgacctacctggacgtgagcgtgggcaagatcgtggccgccctgaacgccagagccggcagactggacgtgatgagccagaacccctacaacgccgtgatccacctgggccacagcaacggcaccgtgagcctgtggagccccgccatgaaggagcccctggccaagatcctgtgccacagaggcggcgtgagagccgtggccgtggacagcaccggcacctacatggccaccagcggcctggaccaccagctgaagatcttcgacctgagaggcacctaccagcccctgtag

SEQ ID NO: 26045 - DNA, 969 bp, Artificial Sequence
  Description of Artificial Sequence: Synthetic coding sequence
aagagcagaatcagcaagaagccccaggtgcccaagaagcccagagagtggaagaaccccgagagccagagaggcctgagcggcacccaggaccccttccccggccccgcccccgtgcccgtggaggtggtgcagaagttctgcagaatcgacaagagcagaaagctgccccacagcaaggccaagaccagaagcagactggaggtggccgaggccgaggaggaggagaccagcatcaaggccgccagaagcgagctgctgctggccgaggagcccggcttcctggagggcgaggacggcgaggacaccgccaagatctgccaggccgacatcgtggaggccgtggacatcgccagcgccgccaagttcggcccctacagactgaactacagcagaaccggcagacacctggccttcggcggcagaagaggccacgtggccgccctggactgggtgaccaagaagctgatgtgcgagatcaacgtgatggaggccgtgagagacatcagattcctgcacagcgaggccctgctggccgtggcccagaacagatggctgcacatctacgacaaccagggcatcgagctgcactgcatcagaagatgcgacagagtgaccagactggagttcctgcccttccacttcctgctggccaccgccagcgagaccggcttcctgacctacctggacgtgagcgtgggcaagatcgtggccgccctgaacgccagagccggcagactggacgtgatgagccagaacccctacaacgccgtgatccacctgggccacagcaacggcaccgtgagcctgtggagccccgccatgaaggagcccctggccaagatcctgtgccacagaggcggcgtgagagccgtggccgtggacagcaccggcacctacatggccaccagcggcctggaccaccagctgaagatcttcgacctgagaggcacctaccagcccctgtag

SEQ ID NO: 26046 - DNA, 969 bp, Artificial Sequence; identical to SEQ ID NO: 26044
  Description of Artificial Sequence: Synthetic coding sequence

SEQ ID NO: 26047 - DNA, 969 bp, Artificial Sequence; identical to SEQ ID NO: 26044
  Description of Artificial Sequence: Synthetic coding sequence

SEQ ID NO: 26048 - DNA, 1833 bp, Artificial Sequence; identical to SEQ ID NO: 26042
  Description of Artificial Sequence: Synthetic coding sequence

SEQ ID NO: 26049 - DNA, 2676 bp, Artificial Sequence
  Description of Artificial Sequence: Synthetic coding sequence
atgaccgccgaggagaccgtgaacgtgaaggaggtggagatcatcaagctgatcctggacttcctgaacagcaagaagctgcacatcagcatgctggccctggagaaggagagcggcgtgatcaacggcctgttcagcgacgacatgctgttcctgagattcagatacatcatcctgaagcagaagttcctggaggccctgtgcgtgaacaacgccatgagcgccgaggacgagccccagcacctggagttcaccatgcaggaggccgtgcagtgcctgcacgccctggaggagtactgccccagcaaggacgactacagcaagctgtgcctgctgctgaccctgcccagactgaccaaccacgccgagttcaaggactggaaccccagcaccgccagagtgcactgcttcgaggaggcctgcgtgatggtggccgagttcatccccgccgacagaaagctgagcgaggccggcttcaaggccagcaacaacagactgttccagctggtgatgaagggcctgctgtacgagtgctgcgtggagttctgccagagcaaggccaccggcgaggagatcaccgagagcgaggtgctgctgggcatcgacctgctgtgcggcaacggctgcgacgacctggacctgagcctgctgagctggctgcagaacctgcccagcagcgtgttcagctgcgccttcgagcagaagatgctgaacatccacgtggacaagctgctgaagcccaccaaggccgcctacgccgacctgctgacccccctgatcagcaagctgagcccctaccccagcagccccatgagaagaccccagagcgccgacgcctacatgaccagaagcctgaaccccgccctggacggcctgacctgcggcctgaccagccacgacaagagaatcagcgacctgggcaacaagaccagccccatgagccacagcttcgccaacttccactaccccggcgtgcagaacctgagcagaagcctgatgctggagaacaccgagtgccacagcatctacgaggagagccccgagagagacacccccgtggacgcccagagacccatcggcagcgagatcctgggccagagcagcgtgagcgagaaggagcccgccaacggcgcccagaaccccggccccgccaagcaggagaagaacgagctgagagacagcaccgagcagttccaggagtactacagacagagactgagataccagcagcacctggagcagaaggagcagcagagacagatctaccagcagatgctgctggagggcggcgtgaaccaggaggacggccccgaccagcagcagaacctgaccgagcagttcctgaacagaagcatccagaagctgggcgagctgaacatcggcatggacggcctgggcaacgaggtgagcgccctgaaccagcagtgcaacggcagcaagggcaacggcagcaacggcagcagcgtgaccagcttcaccacccccccccaggacagcagccagagactgacccacgacgccagcaacatccacaccagcacccccagaaaccccggcagcaccaaccacatccccttcctggaggagagcccctgcggcagccagatcagcagcgagcacagcgtgatcaagccccccctgggcgacagccccggcagcctgagcagaagcaagggcgaggaggacgacaagagcaagaagcagttcgtgtgcatcaacatcctggaggacacccaggccgtgagagccgtggccttccaccccgccggcggcctgtacgccgtgggcagcaacagcaagaccctgagagtgtgcgcctaccccgacgtgatcgaccccagcgcccacgagacccccaagcagcccgtggtgagattcaagagaaacaagcaccacaagggcagcatctactgcgtggcctggagcccctgcggccagctgctggccaccggcagcaacgacaagtacgtgaaggtgctgcccttcaacgccgagacctgcaacgccaccggccccgacctggagttcagcatgcacgacggcaccatcagagacctggccttcatggagggccccgagagcggcggcgccatcctgatcagcgccggcgccggcgactgcaacatctacaccaccgactgccagagaggccagggcctgcacgccctgagcggccacaccggccacatcctggccctgtacacctggagcggctggatgatcgccagcggcagccaggacaagaccgtgagattctgggacctgagagtgcccagctgcgtgagagtggtgggcaccaccttccacggcaccggcagcgccgtggccagcgtggccgtggaccccagcggcagactgctggccaccggccaggaggacagcagctgcatgctgtacgacatcagaggcggcagaatggtgcagagctaccacccccacagcagcgacgtgagaagcgtgagattcagccccggcgcccactacctgctgaccggcagctacgacatgaagatcaaggtgaccgacctgcagggcgacctgaccaagcagctgcccatcatggtggtgggcgagcacaaggacaaggtgatccagtgcagatggcacacccaggacctgagcttcctgagcagcagcgccgacagaaccgtgaccctgtggacctacaacggctag

SEQ ID NO: 26050 - DNA, 2676 bp, Artificial Sequence; identical to SEQ ID NO: 26049
  Description of Artificial Sequence: Synthetic coding sequence

SEQ ID NO: 26051 - DNA, 2760 bp, Artificial Sequence
  Description of Artificial Sequence: Synthetic coding sequence
atgaccgccgaggagaccgtgaacgtgaaggaggtggagatcatcaagctgatcctggacttcctgaacagcaagaagctgcacatcagcatgctggccctggagaaggagagcggcgtgatcaacggcctgttcagcgacgacatgctgttcctgagacagctgatcctggacggccagtgggacgaggtgctgcagttcatccagcccctggagtgcatggagaagttcgacaagaagagattcagatacatcatcctgaagcagaagttcctggaggccctgtgcgtgaacaacgccatgagcgccgaggacgagccccagcacctggagttcaccatgcaggaggccgtgcagtgcctgcacgccctggaggagtactgccccagcaaggacgactacagcaagctgtgcctgctgctgaccctgcccagactgaccaaccacgccgagttcaaggactggaaccccagcaccgccagagtgcactgcttcgaggaggcctgcgtgatggtggccgagttcatccccgccgacagaaagctgagcgaggccggcttcaaggccagcaacaacagactgttccagctggtgatgaagggcctgctgtacgagtgctgcgtggagttctgccagagcaaggccaccggcgaggagatcaccgagagcgaggtgctgctgggcatcgacctgctgtgcggcaacggctgcgacgacctggacctgagcctgctgagctggctgcagaacctgcccagcagcgtgttcagctgcgccttcgagcagaagatgctgaacatccacgtggacaagctgctgaagcccaccaaggccgcctacgccgacctgctgacccccctgatcagcaagctgagcccctaccccagcagccccatgagaagaccccagagcgccgacgcctacatgaccagaagcctgaaccccgccctggacggcctgacctgcggcctgaccagccacgacaagagaatcagcgacctgggcaacaagaccagccccatgagccacagcttcgccaacttccactaccccggcgtgcagaacctgagcagaagcctgatgctggagaacaccgagtgccacagcatctacgaggagagccccgagagagacacccccgtggacgcccagagacccatcggcagcgagatcctgggccagagcagcgtgagcgagaaggagcccgccaacggcgcccagaaccccggccccgccaagcaggagaagaacgagctgagagacagcaccgagcagttccaggagtactacagacagagactgagataccagcagcacctggagcagaaggagcagcagagacagatctaccagcagatgctgctggagggcggcgtgaaccaggaggacggccccgaccagcagcagaacctgaccgagcagttcctgaacagaagcatccagaagctgggcgagctgaacatcggcatggacggcctgggcaacgaggtgagcgccctgaaccagcagtgcaacggcagcaagggcaacggcagcaacggcagcagcgtgaccagcttcaccacccccccccaggacagcagccagagactgacccacgacgccagcaacatccacaccagcacccccagaaaccccggcagcaccaaccacatccccttcctggaggagagcccctgcggcagccagatcagcagcgagcacagcgtgatcaagccccccctgggcgacagccccggcagcctgagcagaagcaagggcgaggaggacgacaagagcaagaagcagttcgtgtgcatcaacatcctggaggacacccaggccgtgagagccgtggccttccaccccgccggcggcctgtacgccgtgggcagcaacagcaagaccctgagagtgtgcgcctaccccgacgtgatcgaccccagcgcccacgagacccccaagcagcccgtggtgagattcaagagaaacaagcaccacaagggcagcatctactgcgtggcctggagcccctgcggccagctgctggccaccggcagcaacgacaagtacgtgaaggtgctgcccttcaacgccgagacctgcaacgccaccggccccgacctggagttcagcatgcacgacggcaccatcagagacctggccttcatggagggccccgagagcggcggcgccatcctgatcagcgccggcgccggcgactgcaacatctacaccaccgactgccagagaggccagggcctgcacgccctgagcggccacaccggccacatcctggccctgtacacctggagcggctggatgatcgccagcggcagccaggacaagaccgtgagattctgggacctgagagtgcccagctgcgtgagagtggtgggcaccaccttccacggcaccggcagcgccgtggccagcgtggccgtggaccccagcggcagactgctggccaccggccaggaggacagcagctgcatgctgtacgacatcagaggcggcagaatggtgcagagctaccacccccacagcagcgacgtgagaagcgtgagattcagccccggcgcccactacctgctgaccggcagctacgacatgaagatcaaggtgaccgacctgcagggcgacctgaccaagcagctgcccatcatggtggtgggcgagcacaaggacaaggtgatccagtgcagatggcacacccaggacctgagcttcctgagcagcagcgccgacagaaccgtgaccctgtggacctacaacggctag

SEQ ID NO: 26052 - DNA, 2763 bp, Artificial Sequence
  Description of Artificial Sequence: Synthetic coding sequence
atgaccgccgaggagaccgtgaacgtgaaggaggtggagatcatcaagctgatcctggacttcctgaacagcaagaagctgcacatcagcatgctggccctggagaaggagagcggcgtgatcaacggcctgttcagcgacgacatgctgttcctgagacagctgatcctggacggccagtgggacgaggtgctgcagttcatccagcccctggagtgcatggagaagttcgacaagaagagattcagatacatcatcctgaagcagaagttcctggaggccctgtgcgtgaacaacgccatgagcgccgaggacgagccccagcacctggagttcaccatgcaggaggccgtgcagtgcctgcacgccctggaggagtactgccccagcaaggacgactacagcaagctgtgcctgctgctgaccctgcccagactgaccaaccacgccgagttcaaggactggaaccccagcaccgccagagtgcactgcttcgaggaggcctgcgtgatggtggccgagttcatccccgccgacagaaagctgagcgaggccggcttcaaggccagcaacaacagactgttccagctggtgatgaagggcctgctgtacgagtgctgcgtggagttctgccagagcaaggccaccggcgaggagatcaccgagagcgaggtgctgctgggcatcgacctgctgtgcggcaacggctgcgacgacctggacctgagcctgctgagctggctgcagaacctgcccagcagcgtgttcagctgcgccttcgagcagaagatgctgaacatccacgtggacaagctgctgaagcccaccaaggccgcctacgccgacctgctgacccccctgatcagcaagctgagcccctaccccagcagccccatgagaagaccccagagcgccgacgcctacatgaccagaagcctgaaccccgccctggacggcctgacctgcggcctgaccagccacgacaagagaatcagcgacctgggcaacaagaccagccccatgagccacagcttcgccaacttccactaccccggcgtgcagaacctgagcagaagcctgatgctggagaacaccgagtgccacagcatctacgaggagagccccgagagaagcgacacccccgtggacgcccagagacccatcggcagcgagatcctgggccagagcagcgtgagcgagaaggagcccgccaacggcgcccagaaccccggccccgccaagcaggagaagaacgagctgagagacagcaccgagcagttccaggagtactacagacagagactgagataccagcagcacctggagcagaaggagcagcagagacagatctaccagcagatgctgctggagggcggcgtgaaccaggaggacggccccgaccagcagcagaacctgaccgagcagttcctgaacagaagcatccagaagctgggcgagctgaacatcggcatggacggcctgggcaacgaggtgagcgccctgaaccagcagtgcaacggcagcaagggcaacggcagcaacggcagcagcgtgaccagcttcaccacccccccccaggacagcagccagagactgacccacgacgccagcaacatccacaccagcacccccagaaaccccggcagcaccaaccacatccccttcctggaggagagcccctgcggcagccagatcagcagcgagcacagcgtgatcaagccccccctgggcgacagccccggcagcctgagcagaagcaagggcgaggaggacgacaagagcaagaagcagttcgtgtgcatcaacatcctggaggacacccaggccgtgagagccgtggccttccaccccgccggcggcctgtacgccgtgggcagcaacagcaagaccctgagagtgtgcgcctaccccgacgtgatcgaccccagcgcccacgagacccccaagcagcccgtggtgagattcaagagaaacaagcaccacaagggcagcatctactgcgtggcctggagcccctgcggccagctgctggccaccggcagcaacgacaagtacgtgaaggtgctgcccttcaacgccgagacctgcaacgccaccggccccgacctggagttcagcatgcacgacggcaccatcagagacctggccttcatggagggccccgagagcggcggcgccatcctgatcagcgccggcgccggcgactgcaacatctacaccaccgactgccagagaggccagggcctgcacgccctgagcggccacaccggccacatcctggccctgtacacctggagcggctggatgatcgccagcggcagccaggacaagaccgtgagattctgggacctgagagtgcccagctgcgtgagagtggtgggcaccaccttccacggcaccggcagcgccgtggccagcgtggccgtggaccccagcggcagactgctggccaccggccaggaggacagcagctgcatgctgtacgacatcagaggcggcagaatggtgcagagctaccacccccacagcagcgacgtgagaagcgtgagattcagccccggcgcccactacctgctgaccggcagctacgacatgaagatcaaggtgaccgacctgcagggcgacctgaccaagcagctgcccatcatggtggtgggcgagcacaaggacaaggtgatccagtgcagatggcacacccaggacctgagcttcctgagcagcagcgccgacagaaccgtgaccctgtggacctacaacggctag

SEQ ID NO: 26053 - DNA, 2784 bp, Artificial Sequence
  Description of Artificial Sequence: Synthetic coding sequence
atgaccgccgaggagaccgtgaacgtgaaggaggtggagatcatcaagctgatcctggacttcctgaacagcaagaagctgcacatcagcatgctggccctggagaaggagagcggcgtgatcaacggcctgttcagcgacgacatgctgttcctgagacagctgatcctggacggccagtgggacgaggtgctgcagttcatccagcccctggagtgcatggagaagttcgacaagaagagattcagatacatcatcctgaagcagaagttcctggaggccctgtgcgtgaacaacgccatgagcgccgaggacgagccccagcacgtgagattcctgttcctgaagctggagttcaccatgcaggaggccgtgcagtgcctgcacgccctggaggagtactgccccagcaaggacgactacagcaagctgtgcctgctgctgaccctgcccagactgaccaaccacgccgagttcaaggactggaaccccagcaccgccagagtgcactgcttcgaggaggcctgcgtgatggtggccgagttcatccccgccgacagaaagctgagcgaggccggcttcaaggccagcaacaacagactgttccagctggtgatgaagggcctgctgtacgagtgctgcgtggagttctgccagagcaaggccaccggcgaggagatcaccgagagcgaggtgctgctgggcatcgacctgctgtgcggcaacggctgcgacgacctggacctgagcctgctgagctggctgcagaacctgcccagcagcgtgttcagctgcgccttcgagcagaagatgctgaacatccacgtggacaagctgctgaagcccaccaaggccgcctacgccgacctgctgacccccctgatcagcaagctgagcccctaccccagcagccccatgagaagaccccagagcgccgacgcctacatgaccagaagcctgaaccccgccctggacggcctgacctgcggcctgaccagccacgacaagagaatcagcgacctgggcaacaagaccagccccatgagccacagcttcgccaacttccactaccccggcgtgcagaacctgagcagaagcctgatgctggagaacaccgagtgccacagcatctacgaggagagccccgagagaagcgacacccccgtggacgcccagagacccatcggcagcgagatcctgggccagagcagcgtgagcgagaaggagcccgccaacggcgcccagaaccccggccccgccaagcaggagaagaacgagctgagagacagcaccgagcagttccaggagtactacagacagagactgagataccagcagcacctggagcagaaggagcagcagagacagatctaccagcagatgctgctggagggcggcgtgaaccaggaggacggccccgaccagcagcagaacctgaccgagcagttcctgaacagaagcatccagaagctgggcgagctgaacatcggcatggacggcctgggcaacgaggtgagcgccctgaaccagcagtgcaacggcagcaagggcaacggcagcaacggcagcagcgtgaccagcttcaccacccccccccaggacagcagccagagactgacccacgacgccagcaacatccacaccagcacccccagaaaccccggcagcaccaaccacatccccttcctggaggagagcccctgcggcagccagatcagcagcgagcacagcgtgatcaagccccccctgggcgacagccccggcagcctgagcagaagcaagggcgaggaggacgacaagagcaagaagcagttcgtgtgcatcaacatcctggaggacacccaggccgtgagagccgtggccttccaccccgccggcggcctgtacgccgtgggcagcaacagcaagaccctgagagtgtgcgcctaccccgacgtgatcgaccccagcgcccacgagacccccaagcagcccgtggtgagattcaagagaaacaagcaccacaagggcagcatctactgcgtggcctggagcccctgcggccagctgctggccaccggcagcaacgacaagtacgtgaaggtgctgcccttcaacgccgagacctgcaacgccaccggccccgacctggagttcagcatgcacgacggcaccatcagagacctggccttcatggagggccccgagagcggcggcgccatcctgatcagcgccggcgccggcgactgcaacatctacaccaccgactgccagagaggccagggcctgcacgccctgagcggccacaccggccacatcctggccctgtacacctggagcggctggatgatcgccagcggcagccaggacaagaccgtgagattctgggacctgagagtgcccagctgcgtgagagtggtgggcaccaccttccacggcaccggcagcgccgtggccagcgtggccgtggaccccagcggcagactgctggccaccggccaggaggacagcagctgcatgctgtacgacatcagaggcggcagaatggtgcagagctaccacccccacagcagcgacgtgagaagcgtgagattcagccccggcgcccactacctgctgaccggcagctacgacatgaagatcaaggtgaccgacctgcagggcgacctgaccaagcagctgcccatcatggtggtgggcgagcacaaggacaaggtgatccagtgcagatggcacacccaggacctgagcttcctgagcagcagcgccgacagaaccgtgaccctgtggacctacaacggctag

SEQ ID NO: 26054 - DNA, 321 bp, Artificial Sequence
  Description of Artificial Sequence: Synthetic coding sequence
atgaccgccgaggagaccgtgaacgtgaaggaggtggagatcatcaagctgatcctggacttcctgaacagcaagaagctgcacatcagcatgctggccctggagaaggagagcggcgtgatcaacggcctgttcagcgacgacatgctgttcctgagacagctgatcctggacggccagtgggacgaggtgctgcagttcatccagcccctggagtgcatggagaagttcgacaagaagagattcagatacatcatcctgaagcagaagttcctggaggccctgtgcgtgaacaacgccatgagcgccgaggacgagtag

SEQ ID NO: 26055 - DNA, 522 bp, Artificial Sequence
  Description of Artificial Sequence: Synthetic coding sequence
atgaccgccgaggagaccgtgaacgtgaaggaggtggagatcatcaagctgatcctggacttcctgaacagcaagaagctgcacatcagcatgctggccctggagaaggagagcggcgtgatcaacggcctgttcagcgacgacatgctgttcctgagacagctgatcctggacggccagtgggacgaggtgctgcagttcatccagcccctggagtgcatggagaagttcgacaagaagagattcagatacatcatcctgaagcagaagttcctggaggccctgtgcgtgaacaacgccatgagcgccgaggacgagccccagcacctggagttcaccatgcaggaggccgtgcagtgcctgcacgccctggaggagtactgccccagcaaggacgactacagcaagctgtgcctgctgctgaccctgcccagactgaccaaccacgccgagttcaaggactggaaccccagcaccgccagagtgcactgcttcgaggaggcctgcgtgatggtggcctag

SEQ ID NO: 26056 - DNA, 2094 bp, Artificial Sequence
  Description of Artificial Sequence: Synthetic coding sequence
atggcctggagagagaagagcaagaagagactgaacatgaccagcttcaacatcgcccagggcatccacgccttcgactaccacagcagactgaacctgatcgccaccgccggcatcaacaacaaggtgtgcctgtggaacccctacgtggtgagcaagcccgtgggcgtgctgtggggccacagcgccagcgtgatcgccgtgcagttcttcgtggagagaaagcagctgttcagcttcagcaaggacaaggtgctgagactgtgggacatccagcaccagctgagcatccagagaatcgcctgcagcttccccaagagccaggacttcagatgcctgttccacttcgacgaggcccacggcagactgttcatcagcttcaacaaccagctggccctgctggccatgaagagcgaggccagcaagagagtgaagagccacgagaaggccgtgacctgcgtgctgtacaacagcatcctgaagcaggtgatcagcagcgacaccggcagcaccgtgagcttctggatgatcgacaccggccagaagatcaagcagttcaccggctgccacggcaacgccgagatcagcaccatggccctggacgccaacgagaccagactgctgaccggcagcaccgacggcaccgtgaagatctgggacttcaacggctactgccaccacaccctgaacgtgggccaggacggcgccgtggacatcagccagatcctgatcctgaagaagaagatcctggtgaccggctgggagagagccatcaccgtgttcagaccccagaacttcaaccagttcttcatccagcccgaggagtggaagggcggcatccagcaccacgacgacatcctgtgcgccgccttcctgcccccccagaccctggtgaccggcagctacgacggcgagatcgtgctgtggaacaacagcaccgagaacgcccaccacgtgctgcaccccgactaccagagactgctgaagagcaagctggacaccaagccccagaagctgctgagcgccggcagaagccagcccagccaccccatggccgaccacagcaccaccggcgtgagaaacttcgagatcgacaccgagggcaagaacgccgtgatgagactgtgcttcctgaaggccagaaagaacaccgccgtgaccggcggcgccaacctggtgagctgcggcggcagcggctacgtgagattctgggacatctacaagaagcagctgctggccgagttcctggcccacagcggcgtgggcagcatcatcatgagcaccgacaagatgaacagatacctgaccaccggcgacctggacggctggctgaagatctggaacatcgaggagtactgcctgaacagcagcaagaacaagatcaccaaggcccccaccctgatcagaagcttccagccccacgaggacagaatcagcagcctggagatgtgcgagcccggcggccagctgctgatcatcagcagcagcgccgactgcagcatctgcgtgaccggcgtgtgcaacgcccccgtgtggatcttcggccaggccaagcactggcacatcgagaactgcctgttcctgcccaagagagacaccaacctggtggagagcgagatccagaaggagatcagcctgttcagcaaggaggagagctgcctggaccccaccgagcacagcctgctgaacaagaagaacaaggacgacagcacctacaacgtgagacccagcgaggacatcaacctggacatcaagtacaaggagagaagcacctgcatgaaggagacccagaagccctactacggcgaggtgatcaagaagagcttcagcaccttcagaagcctgaacatcggcgccctggaggagctgcccgaggtgaacaagcccgccttcctgctggaccccgagaagtacttcagaaaggagcccgaggaggagagaccccagatcctggaggcccccagcctgttcaagaccctgaaggccgtgttcgacgagaagaacctgttccccaaggagatcctgcaccacgagagaaaggccaagcagctgtgccaggagaagagctgcgaggtgaagaagaacaagaagtag

SEQ ID NO: 26057 - DNA, 1989 bp, Artificial Sequence
  Description of Artificial Sequence: Synthetic coding sequence
atgaccatcaactgggccgagctgctgagcggctgccacaagtgctgccacatcctggagcacaagctgcaccagggcgactgggtgagacaggtgacctacaacgccagcctggacgccatcatcagcagcaccaccagcaacaccaacagcgtggtgatggcctggagagagaagagcaagaagagactgaacatgaccagcttcaacatcgcccagggcatccacgccttcgactaccacagcagactgaacctgatcgccaccgccggcatcaacaacaaggtgtgcctgtggaacccctacgtggtgagcaagcccgtgggcgtgctgtggggccacagcgccagcgtgatcgccgtgcagttcttcgtggagagaaagcagctgttcagcttcagcaaggacaaggtgctgagactgtgggacatccagcaccagctgagcatccagagaatcgcctgcagcttccccaagagccaggacttcagatgcctgttccacttcgacgaggcccacggcagactgttcatcagcttcaacaaccagctggccctgctggccatgaagagcgaggccagcaagagagtgaagagccacgagaaggccgtgacctgcgtgctgtacaacagcatcctgaagcaggtgatcagcagcgacaccggcagcaccgtgagcttctggatgatcgacaccggccagaagatcaagcagttcaccggctgccacggcaacgccgagatcagcaccatggccctggacgccaacgagaccagactgctgaccggcagcaccgacggcaccgtgaagatctgggacttcaacggctactgccaccacaccctgaacgtgggccaggacggcgccgtggacatcagccagatcctgatcctgaagaagaagatcctggtgaccggctgggagagatacgactacgccagctggaagaccatcggcagagccatcaccgtgttcagaccccagaacttcaaccagttcttcatccagcccgaggagtggaagggcggcatccagcaccacgacgacatcctgtgcgccgccttcctgcccccccagaccctggtgaccggcagctacgacggcgagatcgtgctgtggaacaacagcaccgagaacgcccaccacgtgctgcaccccgactaccagagactgctgaagagcaagctggacaccaagccccagaagctgctgagcgccggcagaagccagcccagccaccccatggccgaccacagcaccaccggcgtgagaaacttcgagatcgacaccgagggcaagaacgccgtgatgagactgtgcttcctgaaggccagaaagaacaccgccgtgaccggcggcgccaacctggtgagctgcggcggcagcggctacgtgagattctgggacatctacaagaagcagctgctggccgagttcctggcccacagcggcgtgggcagcatcatcatgagcaccgacaagatgaacagatacctgaccaccggcgacctggacggctggctgaagatctggaacatcgaggaggagagctgcctggaccccaccgagcacagcctgctgaacaagaagaacaaggacgacagcacctacaacgtgagacccagcgaggacatcaacctggacatcaagtacaaggagagaagcacctgcatgaaggagacccagaagccctactacggcgaggtgatcaagaagagcttcagcaccttcagaagcctgaacatcggcgccctggaggagctgcccgaggtgaacaagcccgccttcctgctggaccccgagaagtacttcagaaaggagcccgaggaggagagaccccagatcctggaggcccccagcctgttcaagaccctgaaggccgtgttcgacgagaagaacctgttccccaaggagatcctgcaccacgagagaaaggccaagcagctgtgccaggagaagagctgcgaggtgaagaagaacaagaagtag

SEQ ID NO: 26058 - DNA, 2949 bp, Artificial Sequence
  Description of Artificial Sequence: Synthetic coding sequence
atgaaggagcccgacgaccaggacaccgacggcgagaagagcgtgaccagcaagagcgacggcaagaagagcctgagaagcagcaagagcgagagcagaagccccgtgcaggaggacaacaccttcctggaggacgacaccgacgagaccttcaccaagggcgagggcagctacctggaggaggacagcgacgaggagagactggagggcagcctgagcagcttccagtacggcgacctgcagagcaccaccgtgccccagcagacccccgcccccgccgtggaggaggccgaggaggaggtgaagaagaagatcagcgagagcttcttctacgactacatggagctggccagcatgcccttcgtgaccctggacagcaacatccccctggacctgctgaccctggtgcacagcttcggctacgactgcagaaagagagccaacctgcagctgctggacgacagcatcgccatctacatcgccggcaaccagctgatcttcctgaacctgaagaccaaggagcagatctacctgagaagcagcagcggcgagggcatcggcgtgatcggcgtgcacccccacaagacctacttcaccgtggccgagaagggcagcttccccgacatcatcatctacgagtaccccagcctgagaccctacagagtgctgagagacggcaccgagaagggctacgcctacgtggacttcaactacagcggcaacctgctggccagcgtgggcagcaaccccgactacaccctgaccatctggaactggaaggaggagcagcccatcctgagaaccaaggccttcagccaggaggtgttcaaggtgaccttcaaccccgacaaggaggagcagctgaccaccagcggcagcggccacatcaagttctgggagatggccttcaccttcaccggcctgaagctgcagggcagcctgggcagattcggcaagaccatcaccaccgacatcgagggctacatggagctgcccgacggcaaggtgctgagcggcagcgagtggggcaacatgctgctgtgggagggcggcctgatcaaggtggagctgtgcagaggcaccagcaagagctgccacaacggccccatcaaccagatcatgctgtacgagggcgaggtgatcaccgtgggcagcgacggctacgtgagaatctgggacttcgagaccatcgacaccgccgacgtgatcgacgagaccggcctgctggagatcgagcccatcaacgagctgcaggtggacaagaacgtgaacctgttcagcatgatcaagatgaacgagaccggcaacaacttctggctggcccaggacgccaacggcgccatctggaagctggacctgagcttcagcaacatcacccaggaccccgagtgcctgttcagcttccacagcggcgccatcgaggccgtggccgtgagccccctgacctacctgatggccaccaccgccctggactgcagcgtgagaatctacgacttcgccagcaagacccccctggcccagatgaagttcaagcagggcggcaccgccctggtgtgggtgcccagaatggtgaacttcaccggcgcccagatcatcgtgggcttcgaggacggcgtggtgagaatcctggagctgtacgaccccaagggcctgaccatcttcgccggcagaaagaagatcctggacgccgacatccagctgaagcaggtgttcaagccccacaccgcctgcgtgaccgccctggcctacgagagagacggcgagatcctggccaccggcagcaaggaccagaccgtgttcttcttcgaggtggagagagactacaagcccatcggctacatcaacacccccggccccgtgtgccagctgatgtggagccccatgagccaccccgagagcaccctgctgatcatctgcgagaacggctacatcctggaggcccccctgcccaccatcaagcaggaggaggacgaccacgacgtggtgagctacgagatcaaggacatgtgcatcaagtgcttccacttcagcagcgtgaagagcaagatcctgagactgatcgagatcgagaagagagagagacagagagagctgaaggagaagatcagagaggagagaagaaacaagctggccgccgagatgggcgaggacggcgagaaggagttccaggaggaggaggaggagaaggaggaggaggaggaggaggaggagcccctgcccgagatcttcatccccagcacccccagccccatcctgtgcggcttctacagcgagcccggcaagttctgggtgagcctgggcggctacgacagcggcttcctgtaccactgcgagttccccccctgcgacgagagcagcgacttcaaggagcagaaggacgagcccatcgacgtgagatacctggccgacaccgaggacaaccccatccagaccatcaccttcaacatcaacaaggtgatgatgttctgcggcatgaagaacggcgccatcagagtgtacgtgctgaaccagaacgaccccagcctgaccagcctggtggactactggcacttcaacatgcacgacaacaactacggctgcatcaagagcatcgccaacagcttcgacgacagattcctggtgaccgccggcgccgacggcaacatcttcgtgttcaacatcttcagcgagttcatgctgagaaaggacatgaaggccaaggtgcccagccccagattcggcatcgagaccgagcccatccccgaggacatcgaggaccccaaggcctacagcatcgagaacgccagaagaaagagagagcacgacaagctgatgaaggaggtgggcgagatcaaggccagaaagagagagcagatcaaggccctgagaagcgagttctgcaacctgctggagatgaacgagaagctgcccaagcacatgcagttcaagagaaccgtgagcctgatctag

SEQ ID NO: 26059 - DNA, 1206 bp, Artificial Sequence
  Description of Artificial Sequence: Synthetic coding sequence
atgaagctgagcgacctgcaccacgtgaccctgttccaggagatcctgctgctgaagaacttcgagaagcaggagaacatcctgcaggagagagtgaacagcctggacaaggaggagcagtacatgcagtggaagatcaacgagaccctgaaggagatggaggagaagaagaacgagatcaccaagctgcaggagcaggagaaggccctgtacgccggcttccaggccgccatcggcgagaacaacaagttcgccaacttcctgatgaaggtgctgaagaagaagatcaagagagtgaagaagaaggaggtggagggcgacgccgacgaggacgaggagagcgaggagagcagcgaggaggagagcagcctggagagcgacgaggacgagagcgagagcgaggacgaggtgttcgacgacagcatctgccccaccaactgcgacgtggccctgttcgagctggccctgcacctgagagagaagagactggacatcgaggaggccctggtggaggagaagaagatcgtggacaacctgaagaaggagtacgacaccctgagcaagaaggtgaagatcgtggccaccaacctgaacgccgccgaggaggccctggaggcctaccagagagagaagcagcagagactgaacgagctgctggtggtgatccccctgaagctgcaccagatcgagtacgtggtgttcggcgagatccccagcgacctgagcggcaccctggtgttcagcaaccacgccctgagaagactgcaggagagaatccacgagctgcaggaggagaacagcaagcagcagaagctgaacaaggagtggagagagagaagaaagcagctgatcagagagaagagagagatgaccaagaccatccacaagatggaggagaccgtgagacagctgatgatcagcaagttcggcagagtggtgaacctggaggccctgcagaccctgagcgtgaacaccaccctggaggagctgaagatcagaaagctgagaaaggagctggccaacgccaaggagatgaagatgtgggaggagaagatcgcccagatgagatgggagctgatgatgaagaccaaggagcacaccagaaagctgtaccagatgaacgacctgtgcatcgagaagaagaagctggacagcagactgaacaccctgcagaaccagcagaaccccggcaacggcctgagctag

SEQ ID NO: 26060 - DNA, 5565 bp, Artificial Sequence
  Description of Artificial Sequence: Synthetic coding sequence
atgaaggagcccgacgaccaggacaccgacggcgagaagagcgtgaccagcaagagcgacggcaagaagagcctgagaagcagcaagagcgagagcagaagccccgtgcaggaggacaacaccttcctggaggacgacaccgacgagaccttcaccaagggcgagggcagctacctggaggaggacagcgacgaggagagactggagggcagcctgagcagcttccagtacggcgacctgcagagcaccaccgtgccccagcagacccccgcccccgccgtggaggaggccgaggaggaggtgaagaagaagatcagcgagagcttcttctacgactacatggagctggccagcatgcccttcgtgaccctggacagcaacatccccctggacctgctgaccctggtgcacagcttcggctacgactgcagaaagagagccaacctgcagctgctggacgacagcatcgccatctacatcgccggcaaccagctgatcttcctgaacctgaagaccaaggagcagatctacctgagaagcagcagcggcgagggcatcggcgtgatcggcgtgcacccccacaagacctacttcaccgtggccgagaagggcagcttccccgacatcatcatctacgagtaccccagcctgagaccctacagagtgctgagagacggcaccgagaagggctacgcctacgtggacttcaactacagcggcaacctgctggccagcgtgggcagcaaccccgactacaccctgaccatctggaactggaaggaggagcagcccatcctgagaaccaaggccttcagccaggaggtgttcaaggtgaccttcaaccccgacaaggaggagcagctgaccaccagcggcagcggccacatcaagttctgggagatggccttcaccttcaccggcctgaagctgcagggcagcctgggcagattcggcaagaccatcaccaccgacatcgagggctacatggagctgcccgacggcaaggtgctgagcggcagcgagtggggcaacatgctgctgtgggagggcggcctgatcaaggtggagctgtgcagaggcaccagcaagagctgccacaacggccccatcaaccagatcatgctgtacgagggcgaggtgatcaccgtgggcagcgacggctacgtgagaatctgggacttcgagaccatcgacaccgccgacgtgatcgacgagaccggcctgctggagatcgagcccatcaacgagctgcaggtggacaagaacgtgaacctgttcagcatgatcaagatgaacgagaccggcaacaacttctggctggcccaggacgccaacggcgccatctggaagctggacctgagcttcagcaacatcacccaggaccccgagtgcctgttcagcttccacagcggcgccatcgaggccgtggccgtgagccccctgacctacctgatggccaccaccgccctggactgcagcgtgagaatctacgacttcgccagcaagacccccctggcccagatgaagttcaagcagggcggcaccgccctggtgtgggtgcccagaatggtgaacttcaccggcgcccagatcatcgtgggcttcgaggacggcgtggtgagaatcctggagctgtacgaccccaagggcctgaccatcttcgccggcagaaagaagatcctggacgccgacatccagctgaagcaggtgttcaagccccacaccgcctgcgtgaccgccctggcctacgagagagacggcgagatcctggccaccggcagcaaggaccagaccgtgttcttcttcgaggtggagagagactacaagcccatcggctacatcaacacccccggccccgtgtgccagctgatgtggagccccatgagccaccccgagagcaccctgctgatcatctgcgagaacggctacatcctggaggcccccctgcccaccatcaagcaggaggaggacgaccacgacgtggtgagctacgagatcaaggacatgtgcatcaagtgcttccacttcagcagcgtgaagagcaagatcctgagactgatcgagatcgagaagagagagagacagagagagctgaaggagaagatcagagaggagagaagaaacaagctggccgccgagatgggcgaggacggcgagaaggagttccaggaggaggaggaggagaaggaggaggaggaggaggaggaggagcccctgcccgagatcttcatccccagcacccccagccccatcctgtgcggcttctacagcgagcccggcaagttctgggtgagcctgggcggctacgacagcggcttcctgtaccactgcgagttccccccctgcgacgagagcagcgacttcaaggagcagaaggacgagcccatcgacgtgagatacctggccgacaccgaggacaaccccatccagaccatcaccttcaacatcaacaaggtgatgatgttctgcggcatgaagaacggcgccatcagagtgtacgtgctgaaccagaacgaccccagcctgaccagcctggtggactactggcacttcaacatgcacgacaacaactacggctgcatcaagagcatcgccaacagcttcgacgacagattcctggtgaccgccggcgccgacggcaacatcttcgtgttcaacatcttcagcgagttcatgctgagaaaggacatgaaggccaaggtgcccagccccagattcggcatcgagaccgagcccatccccgaggacatcgaggaccccaaggcctacagcatcgagaacgccagaagaaagagagagcacgacaagctgatgaaggaggtgggcgagatcaaggccagaaagagagagcagatcaaggccctgagaagcgagttctgcaacctgctggagatgaacgagaagctgcccaagcacatgcagttcaagagaaccgacttcgacgtggacagccagatcagagccgagatgcacagaaagaccgccttcaagatccagcaggtggagaaggagctggcctgggagaaggagaagcacgagctgggcctgatgaagctgaagaacagattcagagaccccctggagagcgacaccatcgtggtgcacgccatcctgagcgaccacaagatcagcagctacagactggtgcagcccagcaagtacagcaagttcaagagagccagccagagcgagagaaagcccagcaagctggacagattcgagaaggagggccccggcagaaaggacagccagagagacgccggcggcagcgtgaccatccaggaggagagcatcatcgagaagggcaagaagttcagacccaagaccctgagcgagatcatcgtggagaaccagatcgagaagaccagaaagctgatcctgaaggccgagagagcccagctgaagatccagcagagaaagaaggagtgggaggagctgtacaagagcaagcccggcgacgactacgaggaccccaaggacctgcaggccatcaaggaggcccaggtgtacatgggcgacttcaacctgaagaccgcccccgactacaagatccccgagcacatgagaatcaacgccgccaagaaggaggaggagctgggccacctggacagcctggtgcacggcaacaagagacacatgaacaagtgcatcctgagcctgagagacctgaaggtggccgtggtggaggagatccagtgcctggtgcaggagctgaagaacatccagagcaccctgcacatcagcaagcacatccccatccccaagatcccccagatccaccccgaggaggtgcccgagaagagattccagtacgacgaggagaccctgctgaacttcaagcagcagcagatgaagagcaaggacgagaagagccccggcgtggagcagaccggcagcggcggccccgtgggcggcttcctgaagctgagcagcagaaaggacggcgacctgaccaccagagacagcatcagcagaagcagcaaggccagcaccttcagcctggacatccccaagtgcctggagttcgagaaggccgagcccaccgacgtggagctggagatcatgaagagagacgagatcaagcacgtgtacatgcagcagtacctggtgaacagaatcaaggagctggtggtgaccttcgacgccgagctgagactgctgagacaccagaagctgaagctggacacccagatgaagctgagcgacctgcaccacgtgaccctgttccaggagatcctgctgctgaagaacttcgagaagcaggagaacatcctgcaggagagagtgaacagcctggacaaggaggagcagtacatgcagtggaagatcaacgagaccctgaaggagatggaggagaagaagaacgagatcaccaagctgcaggagcaggagaaggccctgtacgccggcttccaggccgccatcggcgagaacaacaagttcgccaacttcctgatgaaggtgctgaagaagaagatcaagagagtgaagaagaaggaggtggagggcgacgccgacgaggacgaggagagcgaggagagcagcgaggaggagagcagcctggagagcgacgaggacgagagcgagagcgaggacgaggtgttcgacgacagcatctgccccaccaactgcgacgtggccctgttcgagctggccctgcacctgagagagaagagactggacatcgaggaggccctggtggaggagaagaagatcgtggacaacctgaagaaggagtacgacaccctgagcaagaaggtgaagatcgtggccaccaacctgaacgccgccgaggaggccctggaggcctaccagagagagaagcagcagagactgaacgagctgctggtggtgatccccctgaagctgcaccagatcgagtacgtggtgttcggcgagatccccagcgacctgagcggcaccctggtgttcagcaaccacgccctgagaagactgcaggagagaatccacgagctgcaggaggagaacagcaagcagcagaagctgaacaaggagtggagagagagaagaaagcagctgatcagagagaagagagagatgaccaagaccatccacaagatggaggagaccgtgagacagctgatgatcagcaagttcggcagagtggtgaacctggaggccctgcagaccctgagcgtgaacaccaccctggaggagctgaagatcagaaagctgagaaaggagctggccaacgccaaggagatgaagatgtgggaggagaagatcgcccagatgagatgggagctgatgatgaagaccaaggagcacaccagaaagctgtaccagatgaacgacctgtgcatcgagaagaagaagctggacagcagactgaacaccctgcagaaccagcagggcaacgccttccagggccccagagaggccgacgtggtggccagagaggaggtgaccgagctgatccagctgcaggccgagagaatcagcgccctgaaggaggagatcgccctgctgagaagaaagggcagcctgatcctgccccccatccagagccccagagagaaggagatccagcccgccgacctgtag

SEQ ID NO: 26061 - DNA, 255 bp, Artificial Sequence
  Description of Artificial Sequence: Synthetic coding sequence
atgaaggagcccgacgaccaggacaccgacggcgagaagagcgtgaccagcaagagcgacggcaagaagagcctgagaagcagcaagagcgagagcagaagccccgtgcaggaggacaacaccttcctggaggacgacaccgacgagaccttcaccaagggcgagggcagctacctggaggaggacagcgacgaggagagactggagggcagcctgagcagcttccagtacggcgacctgcagagcaccacctag

SEQ ID NO: 26062 - DNA, 1077 bp, Artificial Sequence
  Description of Artificial Sequence: Synthetic coding sequence
atggccgtgaagtggaccggcggccacagcagccccgtgctgtgcctgaacgccagcaaggagggcctgctggccagcggcgccgagggcggcgacctgaccgcctggggcgaggacggcacccccctgggccacaccagattccagggcgccgacgacgtgaccagcgtgctgttcagccccagctgccccaccaagctgtacgccagccacggcgagaccatcagcgtgctggacgtgagaagcctgaaggacagcctggaccacttccacgtgaacgaggaggagatcaactgcctgagcctgaaccagaccgagaacctgctggccagcgccgacgacagcggcgccatcaagatcctggacctggagaacaagaaggtgatcagaagcctgaagagacacagcaacatctgcagcagcgtggccttcagaccccagagaccccagagcctggtgagctgcggcctggacatgcaggtgatgctgtggagcctgcagaaggccagacccctgtggatcaccaacctgcaggaggacgagaccgaggagatggagggcccccagagccccggccagctgctgaaccccgccctggcccacagcatcagcgtggccagctgcggcaacatcttcagctgcggcgccgaggacggcaaggtgagaatcttcagagtgatgggcgtgaagtgcgagcaggagctgggcttcaagggccacaccagcggcgtgagccaggtgtgcttcctgcccgagagctacctgctgctgaccggcggcaacgacggcaagatcaccctgtgggacgccaacagcgaggtggagaagaagcagaagagccccaccaagagaacccacagaaagaagcccaagagaggcacctgcaccaagcagggcggcaacaccaacgccagcgtgaccgacgaggaggagcacggcaacatcctgcccaagctgaacatcgagcacggcgagaaggtgaactggctgctgggcaccaagatcaagggccaccagaacatcctggtggccgaccagaccagctgcatcagcgtgtaccccctgaacgagttctag

SEQ ID NO: 26063 - DNA, 465 bp, Artificial Sequence
  Description of Artificial Sequence: Synthetic coding sequence
atggccgtgaagtggaccggcggccacagcagccccgtgctgtgcctgaacgccagcaaggagggcctgctggccagcggcgccgagggcggcgacctgaccgcctggggcgaggacggcacccccctgggccacaccagattccagggcgccgacgacgtgaccagcgtgctgttcagccccagctgccccaccaagctgtacgccagccacggcgagaccatcagcgtgctggacgtgagaagcctgaaggacagcctggaccacttccacgtgaacgaggaggagatcaactgcctgagcctgaaccagaccgagaacctgctggccagcgccgacgacagcggcgccatcaagatcctggacctggagaacaagaaggtgatcagaagcctgaagagacacagcaacatctgcagcagcgtggccttcagaccccagagaccccagagcctggtgagctag

SEQ ID NO: 26064 - DNA, 483 bp, Artificial Sequence
  Description of Artificial Sequence: Synthetic coding sequence
atggccgtgaagtggaccggcggccacagcagccccgtgctgtgcctgaacgccagcaaggagggcctgctggccagcggcgccgagggcggcgacctgaccgcctggggcgaggacggcacccccctgggccacaccagattccagggcgccgacgacgtgaccagcgtgctgttcagccccagctgccccaccaagctgtacgccagccacggcgagaccatcagcgtgctggacgtgagaagcctgaaggacagcctggaccacttccacgtgaacgaggaggagatcaactgcctgagcctgaaccagaccgagaacctgctggccagcgccgacgacagcggcgccatcaagatcctggacctggagaacaagaaggtgatcagaagcctgaagagacacagcaacatctgcagcagcgtggccttcagaccccagagaccccagagcctggtgagctgcggcctggacatgcagtag

SEQ ID NO: 26065 - DNA, 1005 bp, Artificial Sequence
  Description of Artificial Sequence: Synthetic coding sequence
atgttcagatgggagagaagcatccccctgagaggcagcgccgccgccctgtgcaacaacctgagcgtgctgcagctgcccgccagaaacctgacctacttcggcgtggtgcacggccccagcgcccagctgctgagcgccgcccccgagggcgtgcccctggcccagagacagctgcacgccaaggagggcgccggcgtgagcccccccctgatcacccaggtgcactggtgcgtgctgcccttcagagtgctgctggtgctgaccagccacagaggcatccagatgtacgagagcaacggctacaccatggtgtactggcacgccctggacagcggcgacgccagccccgtgcaggccgtgttcgccagaggcatcgccgccagcggccacttcatctgcgtgggcacctggagcggcagagtgctggtgttcgacatccccgccaagggccccaacatcgtgctgagcgaggagctggccggccaccagatgcccatcaccgacatcgccaccgagcccgcccagggccaggactgcgtggccgacatggtgaccgccgacgacagcggcctgctgtgcgtgtggagaagcggccccgagttcaccctgctgaccagaatccccggcttcggcgtgccctgccccagcgtgcagctgtggcagggcatcatcgccgccggctacggcaacggccaggtgcacctgtacgaggccaccaccggcaacctgcacgtgcagatcaacgcccacgccagagccatctgcgccctggacctggccagcgaggtgggcaagctgctgagcgccggcgaggacaccttcgtgcacatctggaagctgagcagaaaccccgagagcggctacatcgaggtggagcactgccacggcgagtgcgtggccgacacccagctgtgcggcgccagattctgcgacagcagcggcaacagcttcgccgtgaccggctacgacctggccgagatcagaagattcagcagcgtgtag

SEQ ID NO: 26066 - DNA, 2925 bp, Artificial Sequence
  Description of Artificial Sequence: Synthetic coding sequence
atggccgccagatggagcagcgagaacgtggtggtggagttcagagacagccaggccaccgccatgagcgtggactgcctgggccagcacgccgtgctgagcggcagaagattcctgtacatcgtgaacctggacgcccccttcgagggccacagaaagatcagcagacagagcaagtgggacatcggcgccgtgcagtggaacccccacgacagcttcgcccactacttcgccgccagcagcaaccagagagtggacctgtacaagtggaaggacggcagcggcgaggtgggcaccaccctgcagggccacaccagagtgatcagcgacctggactgggccgtgttcgagcccgacctgctggtgaccagcagcgtggacacctacatctacatctgggacatcaaggacaccagaaagcccaccgtggccctgagcgccgtggccggcgccagccaggtgaagtggaacaagaagaacgccaactgcctggccaccagccacgacggcgacgtgagaatctgggacaagagaaagcccagcaccgccgtggagtacctggccgcccacctgagcaagatccacggcctggactggcaccccgacagcgagcacatcctggccaccagcagccaggacaacagcgtgaagttctgggactacagacagcccagaaagtacctgaacatcctgccctgccaggtgcccgtgtggaaggccagatacacccccttcagcaacggcctggtgaccgtgatggtgccccagctgagaagagagaacagcctgctgctgtggaacgtgttcgacctgaacacccccgtgcacaccttcgtgggccacgacgacgtggtgctggagttccagtggagaaagcagaaggagggcagcaaggactaccagctggtgacctggagcagagaccagaccctgagaatgtggagagtggacagccagatgcagagactgtgcgccaacgacatcctggacggcgtggacgagttcatcgagagcatcagcctgctgcccgagcccgagaagaccctgcacaccgaggacaccgaccaccagcacaccgccagccacggcgaggaggaggccctgaaggaggacccccccagaaacctgctggaggagagaaagagcgaccagctgggcctgccccagaccctgcagcaggagttcagcctgatcaacgtgcagatcagaaacgtgaacgtggagatggacgccgccgacagaagctgcaccgtgagcgtgcactgcagcaaccacagagtgaagatgctggtgaagttccccgcccagtaccccaacaacgccgcccccagcttccagttcatcaaccccaccaccatcaccagcaccatgaaggccaagctgctgaagatcctgaaggacaccgccctgcagaaggtgaagagaggccagagctgcctggagccctgcctgagacagctggtgagctgcctggagagcttcgtgaaccaggaggacagcgccagcagcaaccccttcgccctgcccaacagcgtgaccccccccctgcccaccttcgccagagtgaccaccgcctacggcagctaccaggacgccaacatccccttccccagaaccagcggcgccagattctgcggcgccggctacctggtgtacttcaccagacccatgaccatgcacagagccgtgagccccaccgagcccacccccagaagcctgagcgccctgagcgcctaccacaccggcctgatcgcccccatgaagatcagaaccgaggcccccggcaacctgagactgtacagcggcagccccaccagaagcgagaaggagcaggtgagcatcagcagcttctactacaaggagagaaagagcagaagatggaagagcaagagagagggcagcgacagcggcaacagacagatcaaggccgccggcaaggtgatcatccaggacatcgcctgcctgctgcccgtgcacaagagcctgggcgagctgtacatcctgaacgtgaacgacatccaggagacctgccagaagaacgccgccagcgccctgctggtgggcagaaaggacctggtgcaggtgtggagcctggccaccgtggccaccgacctgtgcctgggccccaagagcgaccccgacctggagaccccctgggccagacaccccttcggcagacagctgctggagagcctgctggcccactactgcagactgagagacgtgcagaccctggccatgctgtgcagcgtgttcgaggcccagagcagaccccagggcctgcccaaccccttcggccccttccccaacagaagcagcaacctggtggtgagccacagcagataccccagcttcaccagcagcggcagctgcagcagcatgagcgaccccggcctgaacaccggcggctggaacatcgccggcagagaggccgagcacctgagcagcccctggggcgagagcagccccgaggagctgagattcggcagcctgacctacagcgaccccagagagagagagagagaccagcacgacaagaacaagagactgctggaccccgccaacacccagcagttcgacgacttcaagaagtgctacggcgagatcctgtacagatggggcctgagagagaagagagccgaggtgctgaagttcgtgagctgcccccccgacccccacaagggcatcgagttcggcgtgtactgcagccactgcagaagcgaggtgagaggcacccagtgcgccatctgcaagggcttcaccttccagtgcgccatctgccacgtggccgtgagaggcagcagcaacttctgcctgacctgcggccacggcggccacaccagccacatgatggagtggttcagaacccaggaggtgtgccccaccggctgcggctgccactgcctgctggagagcaccttctag

SEQ ID NO: 26067 - DNA, 1377 bp, Artificial Sequence
  Description of Artificial Sequence: Synthetic coding sequence
atgagcgtggactgcctgggccagcacgccgtgctgagcggcagaagattcctgtacatcgtgaacctggacgcccccttcgagggccacagaaagatcagcagacagagcaagtgggacatcggcgccgtgcagtggaacccccacgacagcttcgcccactacttcgccgccagcagcaaccagagagtggacctgtacaagtggaaggacggcagcggcgaggtgggcaccaccctgcagggccacaccagagtgatcagcgacctggactgggccgtgttcgagcccgacctgctggtgaccagcagcgtggacacctacatctacatctgggacatcaaggacaccagaaagcccaccgtggccctgagcgccgtggccggcgccagccaggtgaagtggaacaagaagaacgccaactgcctggccaccagccacgacggcgacgtgagaatctgggacaagagaaagcccagcaccgccgtggagtacctggccgcccacctgagcaagatccacggcctggactggcaccccgacagcgagcacatcctggccaccagcagccaggacaacagcgtgaagttctgggactacagacagcccagaaagtacctgaacatcctgccctgccaggtgcccgtgtggaaggccagatacacccccttcagcaacggcctggtgaccgtgatggtgccccagctgagaagagagaacagcctgctgctgtggaacgtgttcgacctgaacacccccgtgcacaccttcgtgggccacgacgacgtggtgctggagttccagtggagaaagcagaaggagggcagcaaggactaccagctggtgacctggagcagagaccagaccctgagaatgtggagagtggacagccagatgcagagactgtgcgccaacgacatcctggacggcgtggacgagttcatcgagagcatcagcctgctgcccgagcccgagaagaccctgcacaccgaggacaccgaccaccagcacaccgccagccacggcgaggaggaggccctgaaggaggacccccccagaaacctgctggaggagagaaagagcgaccagctgggcctgccccagaccctgcagcaggagttcagcctgatcaacgtgcagatcagaaacgtgaacgtggagatggacgccgccgacagaagctgcaccgtgagcgtgcactgcagcaaccacagagtgaagatgctggtgaagttccccgcccagtaccccaacaacgccgcccccagcttccagttcatcaaccccaccaccatcaccagcaccatgaaggccaagctgctgaaggtgggcgtgtgggtgcccaagttcagcctgctgttctgcatcatcgtgtag

SEQ ID NO: 26068 - DNA, 993 bp, Artificial Sequence
  Description of Artificial Sequence: Synthetic coding sequence
atggccaccaaggagagcagagacgccaaggcccagctggccctgagcagcagcgccaaccagagcaaggaggtgcccgagaaccccaactacgccctgaagtgcaccctggtgggccacaccgaggccgtgagcagcgtgaagttcagccccaacggcgagtggctggccagcagcagcgccgacagactgatcatcatctggggcgcctacgacggcaagtacgagaagaccctgtacggccacaacctggagatcagcgacgtggcctggagcagcgacagcagcagactggtgagcgccagcgacgacaagaccctgaagctgtgggacgtgagaagcggcaagtgcctgaagaccctgaagggccacagcaactacgtgttctgctgcaacttcaacccccccagcaacctgatcatcagcggcagcttcgacgagaccgtgaagatctgggaggtgaagaccggcaagtgcctgaagaccctgagcgcccacagcgaccccgtgagcgccgtgcacttcaactgcagcggcagcctgatcgtgagcggcagctacgacggcctgtgcagaatctgggacgccgccagcggccagtgcctgaagaccctggtggacgacgacaacccccccgtgagcttcgtgaagttcagccccaacggcaagtacatcctgaccgccaccctggacaacaccctgaagctgtgggactacagcagaggcagatgcctgaagacctacaccggccacaagaacgagaagtactgcatcttcgccaacttcagcgtgaccggcggcaagtggatcgtgagcggcagcgaggacaacctggtgtacatctggaacctgcagaccaaggagatcgtgcagaagctgcagggccacaccgacgtggtgatcagcgccgcctgccaccccaccgagaacctgatcgccagcgccgccctggagaacgacaagaccatcaagctgtggatgagcaaccactag

SEQ ID NO: 26069 - DNA, 3201 bp, Artificial Sequence
  Description of Artificial Sequence: Synthetic coding sequence
atggagcccggcaagagaagaaccaaggacgacacctggaaggccgacgacctgagaaagcacctgtgggccatccagagcggcggcagcaaggaggagagaaagcacagagagaagaagctgagaaaggagagcgagatggacctgcccgagcacaaggagcccagatgcagagaccccgaccaggacgccagaagcagagacagagtggccgaggtgcacaccgccaaggagagccccagaggcgagagagacagagacagacagagagagagaagaagagacgccaaggacagagagaaggagaagctgaaggagaagcacagagaggccgagaagagccacagcagaggcaaggacagagagaaggagaaggacagaagagccagaaaggaggagctgagacagaccgtggcccaccacaacctgctgggccaggagaccagagacagacagctgctggagagagccgagagaaagggcagaagcgtgagcaaggtgagaagcgaggagaaggacgaggacagcgagagaggcgacgaggacagagagagaagatacagagagagaaagctgcagtacggcgacagcaaggacaaccccctgaagtactggctgtacaaggaggagggcgagagaagacacagaaagcccagagagcccgacagagacaacaagcacagagagaagagcagcaccagagagaagagagagaagtacagcaaggagaagagcaacagcttcagcgacaagggcgaggagagacacaaggagaagagacacaaggagggcttccacttcgacgacgagagacaccagagcaacgtggacagaaaggagaagagcgccaaggacgagcccagaaagagagagagccagaacggcgagcacagaaacagaggcgccagcagcaagagagacggcaccagcagccagcacgccgagaacctggtgagaaaccacggcaaggacaaggacagcagaagaaagcacggccacgaggagggcagcagcgtgtggtggaagctggaccagagacccggcggcgaggagaccgtggagatcgagaaggaggagaccgacctggagaacgccagagccgacgcctacaccgccagctgcgaggacgacttcgaggactacgaggacgacttcgaggtgtgcgacggcgacgacgacgagagcagcaacgagcccgagagcagagagaagctggaggagctgcccctggcccagaagaaggagatccaggagatccagagagccatcaacgccgagaacgagagaatcggcgagctgagcctgaagctgttccagaagagaggcagaaccgagttcgagaaggagcccagaaccgacaccaacagcagccccagcagagccagcgtgtgcggcatcttcgtggacttcgccagcgccagccacagacagaagagcagaacccaggccctgaagcagaagatgagaagcaccaagctgctgagactgatcgacctggacttcagcttcaccttcagcctgctggacctgccccccgtgaacgagtacgacatgtacatcagaaacttcggcaagaagaacaccaagcaggcctacgtgcagtgcaacgaggacaacgtggagagagacatccagaccgaggagatcgagaccagagaggtgtggacccagcaccccggcgagagcaccgtggtgagcggcggcagcgagcagagagacaccagcgacgccgtggtgatgcccaagatcgacacccccagactgtgcagcttcctgagagccgcctgccaggtgatggccgtgctgctggaggaggacagactggccgccgagcccagctggaacctgagagcccaggacagagccctgtacttcagcgacagcagcagccagctgaacaccagcctgcccttcctgcagaacagaaaggtgagcagcctgcacaccagcagagtgcagagacagatggtggtgagcgtgcacgacctgcccgagaagagcttcgtgcccctgctggacagcaagtacgtgctgtgcgtgtgggacatctggcagcccagcggcccccagaaggtgctgatctgcgagagccaggtgacctgctgctgcctgagccccctgaaggccttcctgctgttcgccggcaccgcccacggcagcgtggtggtgtgggacctgagagaggacagcagactgcactacagcgtgaccctgagcgacggcttctggaccttcagaaccgccaccttcagcaccgacggcatcctgaccagcgtgaaccacagaagccccctgcaggccgtggagcccatcagcaccagcgtgcacaagaagcagagcttcgtgctgagccccttcagcacccaggaggagatgagcggcctgagcttccacatcgccagcctggacgagagcggcgtgctgaacgtgtgggtggtggtggagctgcccaaggccgacatcgccggcagcatcagcgacctgggcctgatgcccggcggcagagtgaagctggtgcacagcgccctgatccagctgggcgacagcctgagccacaagggcaacgagttctggggcaccacccagaccctgaacgtgaagttcctgcccagcgaccccaaccacttcatcatcggcaccgacatgggcctgatcagccacggcaccagacaggacctgagagtggcccccaagctgttcaagccccagcagcacggcatcagacccgtgaaggtgaacgtgatcgacttcagccccttcggcgagcccatcttcctggccggctgcagcgacggcagcatcagactgcaccagctgagcagcgccttccccctgctgcagtgggacagcagcaccgacagccacgccgtgaccggcctgcagtggagccccaccagacccgccgtgttcctggtgcaggacgacaccagcaacatctacatctgggacctgctgcagagcgacctgggccccgtggccaagcagcaggtgagccccaacagactggtggccatggccgccgtgggcgagcccgagaaggccggcggcagcttcctggccctggtgctggccagagccagcggcagcatcgacatccagcacctgaagagaagatgggccgcccccgaggtggacgagtgcaacagactgagactgctgctgcaggaggccctgtggcccgagggcaagctgcacaagtag

SEQ ID NO: 26070 - DNA, 918 bp, Artificial Sequence
  Description of Artificial Sequence: Synthetic coding sequence
atgaccaaccagtacggcatcctgttcaagcaggagcaggcccacgacgacgccatctggagcgtggcctggggcaccaacaagaaggagaacagcgagaccgtggtgaccggcagcctggacgacctggtgaaggtgtggaagtggagagacgagagactggacctgcagtggagcctggagggccaccagctgggcgtggtgagcgtggacatcagccacaccctgcccatcgccgccagcagcagcctggacgcccacatcagactgtgggacctggagaacggcaagcagatcaagagcatcgacgccggccccgtggacgcctggaccctggccttcagccccgacagccagtacctggccaccggcacccacgtgggcaaggtgaacatcttcggcgtggagagcggcaagaaggagtacagcctggacaccagaggcaagttcatcctgagcatcgcctacagccccgacggcaagtacctggccagcggcgccatcgacggcatcatcaacatcttcgacatcgccaccggcaagctgctgcacaccctggagggccacgccatgcccatcagaagcctgaccttcagccccgacagccagctgctggtgaccgccagcgacgacggctacatcaagatctacgacgtgcagcacgccaacctggccggcaccctgagcggccacgccagctgggtgctgaacgtggccttctgccccgacgacacccacttcgtgagcagcagcagcgacaagagcgtgaaggtgtgggacgtgggcaccagaacctgcgtgcacaccttcttcgaccaccaggaccaggtgtggggcgtgaagtacaacggcaacggcagcaagatcgtgagcgtgggcgacgaccaggagatccacatctacgactgccccatctag

SEQ ID NO: 26071 - DNA, 918 bp, Artificial Sequence; identical to SEQ ID NO: 26070
  Description of Artificial Sequence: Synthetic coding sequence

SEQ ID NO: 26072 - DNA, 885 bp, Artificial Sequence
  Description of Artificial Sequence: Synthetic coding sequence
atgaccaaccagtacggcatcctgttcaagcaggagcaggcccacgacgacgccatctggagcgtggcctggggcaccaacaagaaggagaacagcgagaccgtggtgaccggcagcctggacgacctggtgaaggtgtggaagtggagagacgagagactggacctgcagtggagcctggagggccaccagctgggcgtggtgagcgtggacatcagccacaccctgcccatcgccgccagcagcagcctggacgcccacatcagactgtgggacctggagaacggcaagcagatcaagagcatcgacgccggccccgtggacgcctggaccctggccttcagccccgacagccagtacctggccaccggcacccacgtgggcaaggtgaacatcttcggcgtggagagcggcaagaaggagtacagcctggacaccagaggcaagttcatcctgagcatcgcctacagccccgacggcaagtacctggccagcggcgccatcgacggcatcatcaacatcttcgacatcgccaccggcaagctgctgcacaccctggagggccacgccatgcccatcagaagcctgaccttcagccccgacagccagctgctggtgaccgccagcgacgacggctacatcaagatctacgacgtgcagcacgccaacctggccggcaccctgagcggccacgccagctgggtgctgaacgtggccttctgccccgacgacacccacttcgtgagcagcagcagcgacaagagcgtgaaggtgtgggacgtgggcaccagaacctgcgtgcacaccttcttcgaccaccaggaccaggtgtggggcgtgaagtacaacggcaacggcagcaagatcgtgagcgtgggcgactag

SEQ ID NO: 26073 - DNA, 2676 bp, Artificial Sequence
  Description of Artificial Sequence: Synthetic coding sequence
atggcccccaagcagaagaagaagaccagcagaggcaagaagagactgaagcccgtgctggccgccagcgaggacatggagcccgtgaacatggagagcatgggccaccccgagatctaccccctggtgctgaccaccaagacccaggagatcttcaactgcagaatcgacgaggacgtgaccgacgagcagccctacaagctgatcaacaaggaggacatcttcgaggacctgagaaacagagccgccgtgagcgacttccaccccgtgaagaagatcgtgcaggagtaccccggcaacgagctgctgctggtgtacgacaaggacttcaagtacggcctgaacttctacctgatcgccaccgaggagggcaaggagaactacctgaacccccccgaggtgcccgaggagcaggaggagtacaaggagcacatccccgaggacgtgtacatctacaagccccccgtgagcaagccctgggtgagcctgggcagcgagaaggagatcgaggaggagagcgtgaccgagagcaccaagcagatcacctacatgatcagcagaaagagaagcgagttcggcgcccccatcaagttcagcgaccagaacgccagcagcgtgaaggacgcctacatcgagtgcaccgcctaccccgacaagaacttcaccctgaagcagctggagaaggacgtgggcatgcaggtgatcccccagatcaaggacatcagcacccagaccaagtggacctaccccaagaacgccaccacccagtactaccccagagagttcagcgaggaggagaaggagaccctgaagcagagcaagcccctggtggacttcctgaacaacgccagcatcagcgtggagatcgccctgcagcagaacgagatcatgaacaccttcatcgacgactggaagtacctggccgaggaggagggcaccttcggcgacaagaccgacacccacctgaaggagtaccagagcttcaccgacctgcacagccccaccgagaagatgatcacctgcgtgagctggcaccccaccatctacggcctgatcgccgtgagcgtggccgtgagactgagcttcgaggacagagtgcacttcagcggcaagctgctgctgcagcccagcctgatcctgttctggagcttcagcgaccccatccacccccagctgatgctggagagccccgacgacatcttctgcttcaagttctgccccagcgaccccaacatcatcgccggcggctgcatcaacggccagatcgtgatgtgggacatcaccgcccacgccgacagaatcgagaacatcaaggccggcggcagcagaagcaagagagccaccctgaagcccatgttcctgctggagcccgagagcaacaaggaggccatgtacatcagacactgcgccgtgagcagcatcgagaacggccacaagaaggtgatcaccgacatccactggctgagcgacaccttcgagatcaacagaatgggcagcgtgttcgagaacagaagcggcatctgctgccagctggtgacctgcagcgccgactgcaccatctgcttctgggacatcagaccccagaagcccctgaccccccagaccaccgagaagaagaaggaggagagcatcgagatccccttcgacgtgcccagcaccttcctgcacctggacctgagctggaagcccctgaccaaggtgagactgagcaagggcgagaccagcctggaccactgccccaccaagatcagcctgaacgaggaccacctgctgtgcaagacccaggacaagatgctggcccagagcaagaccgagaaggccgaggagatgaacccctaccacaacctggagagcggcatggccaacctgctgaagcccatcgacgacttctgcaccaagttcttcgtgggcaccgaggagggcgaggtgatctacaccgactggaagatggagaaggaccccgagaccggcagactgatgagcaagaagcccgtgagccaccacaccatccacgacggcaccgtgcacaccatccagagaagccccttctacaacgacatcatcctgaccgtgggcggctggaacgtggccatctggaaggagggcgtgatgaccggccccctgctgcagagctgctgcgcccccaagagatacaccagcggccactggagcctgaccagacccggcgtgttctacatcggcagagaggacggctacatcgacatctgggacctgctggagaagacccacgagcccgcccagagccagaacatctgcatcaccatgatcacctacatcaagccctggatcttcagcagcaagcagcagttcatcgccaccgccgactactacggcaccctgcacatcctggagatcccctggaccctgagcagacccagcaccaacgagatggccagcgtgaaccactacttcgagagagaggtgaagcacctggagtacgtggagcagagaaagaagatcagagagcaggagaagaaggagatggagctggagatggccaagaagaaggtgaagacctaccagaagagcaaggagcagatgcaggccgagctgaagatggactacgagagctacctggagctggagaagaccgtgctgatcaacctgggcctgatcaaggtgaccgagaagggcagctacatggaggtgatgtag

SEQ ID NO: 26074 - DNA, 2559 bp, Artificial Sequence
  Description of Artificial Sequence: Synthetic coding sequence
atggcccccaagcagaagaagaagaccagcagaggcaagaagagactgaagcccgtgctggccgccagcgaggacatggagcccgtgaacatggagagcatgggccaccccgagatctaccccctggtgctgaccaccaagacccaggagatcttcaactgcagaatcgacgaggacgtgaccgacgagcagccctacaagctgatcaacaaggaggacatcttcgaggacctgagaaacagagccgccgtgagcgacttccaccccgtgaagaagatcgtgcaggagtaccccggcaacgagctgctgctggtgtacgacaaggacttcaagtacggcctgaacttctacctgatcgccaccgaggagggcaaggagaactacctgaacccccccgaggtgcccgaggagcaggaggagtacaaggagcacatccccgaggacgtgtacatctacaagccccccgtgagcaagccctgggtgagcctgggcagcgagaaggagatcgaggaggagagcgtgaccgagagcaccaagcagatcacctacatgatcagcagaaagagaagcgagttcggcgcccccatcaagttcagcgaccagaacgccagcagcgtgaaggacgcctacatcgagtgcaccgcctaccccgacaagaacttcaccctgaagcagctggagaaggacgtgggcatgcaggtgatcccccagatcaaggacatcagcacccagaccaagtgcgtggagatcgccctgcagcagaacgagatcatgaacaccttcatcgacgactggaagtacctggccgaggaggagggcaccttcggcgacaagaccgacacccacctgaaggagtaccagagcttcaccgacctgcacagccccaccgagaagatgatcacctgcgtgagctggcaccccaccatctacggcctgatcgccgtgagcgtggccgtgagactgagcttcgaggacagagtgcacttcagcggcaagctgctgctgcagcccagcctgatcctgttctggagcttcagcgaccccatccacccccagctgatgctggagagccccgacgacatcttctgcttcaagttctgccccagcgaccccaacatcatcgccggcggctgcatcaacggccagatcgtgatgtgggacatcaccgcccacgccgacagaatcgagaacatcaaggccggcggcagcagaagcaagagagccaccctgaagcccatgttcctgctggagcccgagagcaacaaggaggccatgtacatcagacactgcgccgtgagcagcatcgagaacggccacaagaaggtgatcaccgacatccactggctgagcgacaccttcgagatcaacagaatgggcagcgtgttcgagaacagaagcggcatctgctgccagctggtgacctgcagcgccgactgcaccatctgcttctgggacatcagaccccagaagcccctgaccccccagaccaccgagaagaagaaggaggagagcatcgagatccccttcgacgtgcccagcaccttcctgcacctggacctgagctggaagcccctgaccaaggtgagactgagcaagggcgagaccagcctggaccactgccccaccaagatcagcctgaacgaggaccacctgctgtgcaagacccaggacaagatgctggcccagagcaagaccgagaaggccgaggagatgaacccctaccacaacctggagagcggcatggccaacctgctgaagcccatcgacgacttctgcaccaagttcttcgtgggcaccgaggagggcgaggtgatctacaccgactggaagatggagaaggaccccgagaccggcagactgatgagcaagaagcccgtgagccaccacaccatccacgacggcaccgtgcacaccatccagagaagccccttctacaacgacatcatcctgaccgtgggcggctggaacgtggccatctggaaggagggcgtgatgaccggccccctgctgcagagctgctgcgcccccaagagatacaccagcggccactggagcctgaccagacccggcgtgttctacatcggcagagaggacggctacatcgacatctgggacctgctggagaagacccacgagcccgcccagagccagaacatctgcatcaccatgatcacctacatcaagccctggatcttcagcagcaagcagcagttcatcgccaccgccgactactacggcaccctgcacatcctggagatcccctggaccctgagcagacccagcaccaacgagatggccagcgtgaaccactacttcgagagagaggtgaagcacctggagtacgtggagcagagaaagaagatcagagagcaggagaagaaggagatggagctggagatggccaagaagaaggtgaagacctaccagaagagcaaggagcagatgcaggccgagctgaagatggactacgagagctacctggagctggagaagaccgtgctgatcaacctgggcctgatcaaggtgaccgagaagggcagctacatggaggtgatgtag

SEQ ID NO: 26075 - DNA, 2559 bp, Artificial Sequence; identical to SEQ ID NO: 26074
  Description of Artificial Sequence: Synthetic coding sequence

SEQ ID NO: 26076 - DNA, 3246 bp, Artificial Sequence
  Description of Artificial Sequence: Synthetic coding sequence
atggacatcagaaaggagaagagactgaacatggccctgcagatgagcaacttcaagaaggccctgaacagattcgagaagctggtggagcagaccgccgcccagaagagagacgagagagccggcctgttcatccacaaggaggacgccatcggctacgacaagttctacgccagcgtgcagaagctgttcggccccgacgtgaagaaccaggacgtgaagagattctacagaaagctgtgcaacaacaccgacgccagcgccgactggtgcgagatcttcggctacttcagcagcgaggaggaccccatcgccagccagctggacgaggagaacctggtgttcttcgtgagcagaaagagaagaatcctgatcagcggcagcagaagaagagacgtgatcaagagcatcgtgaagatcccccacctggacctgctgatcaccgccacccagaagggcctgatcaccgtgttcaacaaccaggacaccagctggatcaccggctgcgactacctgctgcagctgaagagaatcgtggccaccaccgagagaaccatcatcgtgtgggactacaaggcccagggcagcagccaggagaactacttcgtgatcaagcccatggaccactgcctgctgtgcgtgtgcgtggtgcccctgcccgaccacctgtgcagagacgacatcctgctgggcgacgacggcggcttcgtgaacagattcaccgtgaacagcgacgacttcggcatcaagcaggccaagagcaagagaaagctgcagaaccaggtgctggacagcaagaacttcaagagcgtgaagagaaagctgcacaacgactgggtgatgaagatcagatacatcagcgccctgaactgcttcggcagctgcagcctggacagcaaccacagcctggtgctggagagcctgaagagactggaggacaacctgcccgtgagagagttcagcatgcccagaggcgccaacaccttctgctactgcgtgaaggccaacgtgatcgtgaccggcggcgacgacaaggtgatcagactgtggcaccccaacatcagcaccaagcccgtgggcaagctggtgggccacatgttcagcatcgccgagatcgtgaccaacgagaaggaccagcacgtggtgagcctgagcagcgccaaggtgttcagagtgtgggacatccagaccctgagcctgctgcaggtgttccacgacagccagggcggccccggcgacatgcagatctacagcatgatctacgacgccaaccacggcatgctgatcaccggcagcagcgtgatggacatgtaccccctgaccagaatgatccaggacaccaagcaggtgccccacacccacgagagagagatcaacgtgatgctgtacaacaagtacttccaccaggtgctgaccatctgcagcgagagcatcatcagagtgtgggagctggagaccggcctgcaggtgtaccagatcctggagccccacggcttcaacaccgaggtgaccagcgccgccgtggacgagagcggcttcctgttcgccaccggcgcctacaacggcaccgtgagaatctgggacttcggcagcggccaggagatgaaggtgctgcccgagggcaaggactggaaggaggacgagcactgcctgagaagactgatcttcctgaaggcccaggagaagcaccagcagctggtgctggccctggagagaaacggcaccatcaagatgatccagggcaaggaggacgacatctacctgatggtgatctgggagctgcccgacgtggtgcccttcctgcaggacggcaagcacgccgtgcacctgagaatgagcaccagagacagaaacatggccatccccttccccgacgtggagctgatcgtggagagaaacttcagccagcccaccgacaaccccaccatggacctgctgagagtgaactgcatcgacctgctgcaggtggagggctacaacctgatcgccgccggcaccctgaacggcgtgatcatcctgtggaacttcgtgaccagcaccgtgaagaaggtgtacagacccgaggactgcttcaccgtgaaccccgacctgcaccccaagcacttcaagatcaacgacatcctgttcctgttcagaacccccgagtgcgccagaagaagcagccaggacagcatctgcagcagcagccagtgcgagagcagcaagggcccccagagcagcaagggcagcaagcagagcatccacgacagcgaggtgaagggcgagcagaccgacgtgatggtgggcaagcagcagcccatggacaagaagcaccccggcatcgccaacctgcccgaggcccagccccccatcctggtgaccgcccacgaggacggccacctgagactgtggaccctggagggcagactgctgaaggacatgctgcccttcaccaagcacagcgccatcagcctgaccagcctgtacaccgacagctgcaccagaatcctgctggccggcaacgtggagggccacgtgatcctgtgcaacatcagcagcttcctggaccccccccacgacgagaagaagttcaagcagctgctgagctggagagcccacagcctggagatcatccaggtgatctacgtggaggagaagcaggtggtgctgaccgccagcatcgacggcagcgtgagactgtggcacgccctgaacggccactactgcggctacttcggccagagaagactgttcgagctgagccagaccagagacttcatcctgccctgcgacgtgaccgagtaccccatcgagatcaaggaggagagcaagttcaccgagaagcagaagtacgagtaccccctgatcttcgacagagagaagtggagaaagatgagcagcgtgagcctgctgttcaagagaaccccccccaaggccttcgaggtggagcaggacttcaagttcttcaagagcctgagcagccccaagatcagaagataccccctggagggcttcgtgaccgagaacagagaggccggcatcgtgttcggcagcctgcccatctacagcatcagcagccccaccagcctgagattcctgcccctgatcggcgtggaggcccagaaggacagcagcgacggcatcaccggcaagaagaagggcggccacgtgcagagagagaaggcccccagaagaagaagcctgaagaagaacctggtgccccagatcaacctggccagcagcttcttccccgccatccccaagtag

SEQ ID NO: 26077 - DNA, 2745 bp, Artificial Sequence
  Description of Artificial Sequence: Synthetic coding sequence
atggacatcagaaaggagaagagactgaacatggccctgcagatgagcaacttcaagaaggccctgaacagattcgagaagctggtggagcagaccgccgcccagaagagagacgagagagccggcctgttcatccacaaggaggacgccatcggctacgacaagttctacgccagcgtgcagaagctgttcggccccgacgtgaagaaccaggacgtgaagagattctacagaaagctgtgcaacaacaccgacgccagcgccgactggtgcgagatcttcggctacttcagcagcgaggaggaccccatcgccagccagctggacgaggagaacctggtgttcttcgtgagcagaaagagaagaatcctgatcagcggcagcagaagaagagacgtgatcaagagcatcgtgaagatcccccacctggacctgctgatcaccgccacccagaagggcctgatcaccgtgttcaacaaccaggacaccagctggatcaccggctgcgactacctgctgcagctgaagagaatcgtggccaccaccgagagaaccatcatcgtgtgggactacaaggcccagggcagcagccaggagaactacttcgtgatcaagcccatggaccactgcctgctgtgcgtgtgcgtggtgcccctgcccgaccacctgtgcagagacgacatcctgctgggcgacgacggcggcttcgtgaacagattcaccgtgaacagcgacgacttcggcatcaagcaggccaagagcaagagaaagctgcagaaccaggtgctggacagcaagaacttcaagagcgtgaagagaaagctgcacaacgactgggtgatgaagatcagatacatcagcgccctgaactgcttcggcagctgcagcctggacagcaaccacagcctggtgctggagagcctgaagagactggaggacaacctgcccgtgagagagttcagcatgcccagaggcgccaacaccttctgctactgcgtgaaggccaacgtgatcgtgaccggcggcgacgacaaggtgatcagactgtggcaccccaacatcagcaccaagcccgtgggcaagctggtgggccacatgttcagcatcgccgagatcgtgaccaacgagaaggaccagcacgtggtgagcctgagcagcgccaaggtgttcagagtgtgggacatccagaccctgagcctgctgcaggtgttccacgacagccagggcggccccggcgacatgcagatctacagcatgatctacgacgccaaccacggcatgctgatcaccggcagcagcgtgatggacatgtaccccctgaccagaatgatccaggacaccaagcaggtgccccacacccacgagagagagatcaacgtgatgctgtacaacaagtacttccaccaggtgctgaccatctgcagcgagagcatcatcagagtgtgggagctggagaccggcctgcaggtgtaccagatcctggagccccacggcttcaacaccgaggtgaccagcgccgccgtggacgagagcggcttcctgttcgccaccggcgcctacaacggcaccgtgagaatctgggacttcggcagcggccaggagatgaaggtgctgcccgagggcaaggactggaaggaggacgagcactgcctgagaagactgatcttcctgaaggcccaggagaagcaccagcagctggtgctggccctggagagaaacggcaccatcaagatgatccagggcaaggaggacgacatctacctgatggtgatctgggagctgcccgacgtggtgcccttcctgcaggacggcaagcacgccgtgcacctgagaatgagcaccagagacagaaacatggccatccccttccccgacgtggagctgatcgtggagagaaacttcagccagcccaccgacaaccccaccatggacctgctgagagtgaactgcatcgacctgctgcaggtggagggctacaacctgatcgccgccggcaccctgaacgagggccacgtgatcctgtgcaacatcagcagcttcctggaccccccccacgacgagaagaagttcaagcagctgctgagctggagagcccacagcctggagatcatccaggtgatctacgtggaggagaagcaggtggtgctgaccgccagcatcgacggcagcgtgagactgtggcacgccctgaacggccactactgcggctacttcggccagagaagactgttcgagctgagccagaccagagacttcatcctgccctgcgacgtgaccgagtaccccatcgagatcaaggaggagagcaagttcaccgagaagcagaagtacgagtaccccctgatcttcgacagagagaagtggagaaagatgagcagcgtgagcctgctgttcaagagaaccccccccaaggccttcgaggtggagcaggacttcaagttcttcaagagcctgagcagccccaagatcagaagataccccctggagggcttcgtgaccgagaacagagaggccggcatcgtgttcggcagcctgcccatctacagcatcagcagccccaccagcctgagattcctgcccctgatcggcgtggaggcccagaaggacagcagcgacggcatcaccggcaagaagaagggcggccacgtgcagagagagaaggcccccagaagaagaagcctgaagaagaacctggtgccccagatcaacctggccagcagcttcttccccgccatccccaagtag

SEQ ID NO: 26078 - DNA, 3450 bp, Artificial Sequence
  Description of Artificial Sequence: Synthetic coding sequence
atgagcgacgccgccgaggcccccagagaggccaccggcgagaacggcgagaccgagatgaaggaggaggaggagcccaaccccaactacaaggaggtggaggacccccagcaggagagcaaggacgacaccatcgcctggagagagagccaggaggaggagagaaagaccggcgaggaggagggcgaggaggagggcaaggaggacaagaagatcgtgatggaggagaccgaggagaaggccggcgaggtgcaggagaaggaggccagcggcatccaggaggagaccaccgtggagccccaggaggtgaccgccagcatgatcagactggagacccagatcaccgacagccagagcatcaccagcggcatcttccccaagacccagagaggcagcaagagcaagctgagcctgcagctggaggacgccgagaccgacgagctgctgagagacctgagcacccagatcgagttcctggacctggaccagatcagccccgaggagcagcagatcagcagccccgagagacagcccagcggcgagctggaggagaagaccgacagaatgccccaggacgagctgggccaggagagaagagacctggagcccgagaacagagaggagggccaggagagaagagtgagcgacatccagagcaaggccggcatcagcagagagagcctggtgagcagcaccaccgaggacatcctgttccagaaggacaagagcacccccgtgtaccccctgaccatgacctggagcttcggctggaacagcagcctgcccgtgtactacatcagagaggagagacagagagtgctgctgtacgtgtgcgcccacaccgccatcatctacaacgtgttcagaaacaaccagtaccacctgcagggccacgccaacatcatcagctgcctgtgcgtgagcgaggacagaagatggatcgccaccgccgacaagggccccgactgcctggtgatcatctgggacagcttcaccggcatccccgtgcacaccatcttcgacagctgccccgagggcaacggcatcatggccatggccatgacccacgacgccaagtacctggccaccatcagcgacgccgaggtgcagaaggtgtgcatctggaagtggaccctggccgtggagacccccgcctgcaccctggagctgcccaccgagtacggcgtgcagaactacgtgaccttcaaccccaccaacaacaaggagctggtgagcaacagcaagaccagagccatctactacgcctggtacgaggagagagacaccctggcccacagcgcccccctgctgaccgagaagaccttcaacaagctggtgggcaagttcagccagagcatcttccacctgaacctgacccagatcctgagcgccaccatggagggcaagctggtggtgtgggacatccacagaccccccagcagcgccagcaccttcctgggcttcccctacatcaagccctgcaagctggtgcacctgcagaaggagggcatcaccgtgctgaccaccatcgacagctacatcgtgaccggcgacatcaagggcaacatcaagttctacgaccacaccctgagcatcgtgaactggtacagccacctgaagctgggcgccatcagaaccctgagcttcagcaagacccccgccaccccccccaccgagaagagcaactacccccccgactgcaccctgaagggcgacctgttcgtgctgagaaacttcatcatcggcaccagcgacgccgccgtgtaccacctgaccaccgacggcaccaagctggagaagctgttcgtggagcccaaggacgccatctgcgccatcagctgccacccctaccagcccctgatcgccatcggcagcatctgcggcatgatcaaggtgtggaactacgagaacaagcagtacctgttcagcagagtgttcgagaagggcctgggcgtgcagagcctgacctacaaccccgagggcgccctgctgggcgccggcttcaccgagggcaccgtgtacatcctggacgccatgagcctggagaacgagagccccgagcccttcaagtacagcagaaccagcgtgacccacatcagcttcagccacgacagccagtacatggccaccgccgacagaagcttcaccgtggccgtgtacatgctggtggtgagaaacggccagagagtgtgggagtacctggccagactgagaagccacagaaagagcatcagaagcctgctgttcggcgtgtacctggacagcaacgagcccagactgctgagcctgggcaccgacagactgctgatcgagtacgacctgctgagaagctacaaggaccacctggaggtgctggacatccaccacaccgaccagggctgctaccccacctgcatggtgtggtacccccccctgaccagagagctgttcctgctgatctgcaacagcggctacaaggtgaagctgttcaacgccaccaccaagatgtgcagaaagaccctgctgggccccgcctacggcagccccatcgagcagacccaggtgctgcccgtgagaagcatggccgagctgcagaagagatacctggtgttcatcaacagagacaaggtgggcctgcagatcctgcccgtggacggcaacccccacaagaccagcgccatcgtgtgccaccccaacggcgtggccggcatggccgtgagctacgacggctgctacgccttcaccgccggcggccacgacagaagcgtggtgcagtggaagatcaccctgagcgtgctggaggccgccgtgagcctgggcggcgaggacctgacccccttctacggcctgctgagcggcggcagagagggcaagttctacagagagctggaggactacttctactacagccagctgagaagccagggcatcgacaccatggagaccagaaaggtgagcgagcacatctgcctgagcgagctgcccttcgtgatgagagccatcggcttctaccccagcgaggagaagatcgacgacatcttcaacgagatcaagttcggcgagtacgtggacaccggcaagctgatcgacaagatcaacctgcccgacttcctgaaggtgtacctgaaccacaagccccccttcggcaacaccatgagcggcatccacaagagcttcgaggtgctgggctacaccaacagcaagggcaagaaggccatcagaagagaggacttcctgagactgctggtgaccaagggcgagcacatgaccgaggaggagatgctggactgcttcgccagcctgttcggcctgaaccccgagggctggaagagcgagcccgccacctgcagcgtgaagggcagcgagatctgcctggaggaggagctgcccgacgagatcaccgccgagatcttcgccaccgagatcctgggcctgaccatcagcgaggacagcggccaggacggccagtag

SEQ ID NO: 26079 - DNA, 2826 bp, Artificial Sequence
  Description of Artificial Sequence: Synthetic coding sequence
atgagcgacgccgccgaggcccccagagaggccaccggcgagaacggcgagaccgagatgaaggaggaggaggagcccaaccccaactacaaggaggtggaggacccccagcaggagagcaaggacgacaccatcgcctggagagagagccaggaggaggagagaaagaccggcgaggaggagggcgaggaggagggcaaggaggacaagaagatcgtgatggaggagaccgaggagaaggccggcgaggtgcaggagaaggaggccagcggcatccaggaggagaccaccgtggagccccaggaggtgaccgccagcatgatcagactggagacccagatcaccgacagccagagcatcaccagcggcatcttccccaagacccagagaggcagcaagagcaagctgagcctgcagctggaggacgccgagaccgacgagctgctgagagacctgagcacccagatcgagttcctggacctggaccagatcagccccgaggagcagcagatcagcagccccgagagacagcccagcggcgagctggaggagaagaccgacagaatgccccaggacgagctgggccaggagagaagagacctggagcccgagaacagagaggagggccaggagagaagagtgagcgacatccagagcaaggccggcatcagcagagagagcctggtgagcagcaccaccgaggacatcctgttccagaaggacaagagcacccccgtgtaccccctgaccatgacctggagcttcggctggaacagcagcctgcccgtgtactacatcagagaggagagacagagagtgctgctgtacgtgtgcgcccacaccgccatcatctacaacgtgttcagaaacaaccagtaccacctgcagggccacgccaacatcatcagctgcctgtgcgtgagcgaggacagaagatggatcgccaccgccgacaagggccccgactgcctggtgatcatctgggacagcttcaccggcatccccgtgcacaccatcttcgacagctgccccgagggcaacggcatcatggccatggccatgacccacgacgccaagtacctggccaccatcagcgacgccgaggtgcagaaggtgtgcatctggaagtggaccctggccgtggagacccccgcctgcaccctggagctgcccaccgagtacggcgtgcagaactacgtgaccttcaaccccaccaacaacaaggagctggtgagcaacagcaagaccagagccatctactacgcctggtacgaggagagagacaccctggcccacagcgcccccctgctgaccgagaagaccttcaacaagctggtgggcaagttcagccagagcatcttccacctgaacctgacccagatcctgagcgccaccatggagggcaagctggtggtgtgggacatccacagaccccccagcagcgccagcaccttcctgggcttcccctacatcaagccctgcaagctggtgcacctgcagaaggagggcatcaccgtgctgaccaccatcgacagctacatcgtgaccggcgacatcaagggcaacatcaagttctacgaccacaccctgagcatcgtgaactggtacagccacctgaagctgggcgccatcagaaccctgagcttcagcaagacccccgccaccccccccaccgagaagagcaactacccccccgactgcaccctgaagggcgacctgttcgtgctgagaaacttcatcatcggcaccagcgacgccgccgtgtaccacctgaccaccgacggcaccaagctggagaagctgttcgtggagcccaaggacgccatctgcgccatcagctgccacccctaccagcccctgatcgccatcggcagcatctgcggcatgatcaaggtgtggaactacgagaacaagcagtacctgttcagcagagtgttcgagaagggcctgggcgtgcagagcctgacctacaaccccgagggcgccctgctgggcgccggcttcaccgagggcaccgtgtacatcctggacgccatgagcctggagaacgagagccccgagcccttcaagtacagcagaaccagcgtgacccacatcagcttcagccacgacagccagtacatggccaccgccgacagaagcttcaccgtggccgtgtacatgctggtggtgagaaacggccagagagtgtgggagtacctggccagactgagaagccacagaaagagcatcagaagcctgctgttcggcgtgtacctggacagcaacgagcccagactgctgagcctgggcaccgacagactgctgatcgagtacgacctgctgagaagctacaaggaccacctggaggtgctggacatccaccacaccgaccagggctgctaccccacctgcatggtgtggtacccccccctgaccagagagctgttcctgctgatctgcaacagcggctacaaggtgaagctgttcaacgccaccaccaagatgtgcagaaagaccctgctgggccccgcctacggcagccccatcgagcagacccaggtgctgcccgtgagaagcatggccgagctgcagaagagatacctggtgttcatcaacagagacaaggtgggcctgcagatcctgcccgtggacggcaacccccacaagaccagcgccatcgtgtgccaccccaacggcgtggccggcatggccgtgagctacgacggctgctacgccttcaccgccggcggccacgacagaagcgtggtgcagtggaagatcaccctgagccaccccggcagccaggcccccatcctgagccccagcgacaccagcagaagctag

SEQ ID NO: 26080 - DNA, 1248 bp, Artificial Sequence
  Description of Artificial Sequence: Synthetic coding sequence
atgaagctgaagagcctgctgctgagatactacccccccggcatcatgctggagtacgagaagcacggcgagctgaagaccaagagcatcgacctgctggacctgggccccagcaccgacgtgagcgccctggtggaggagatccagaaggccgagcccctgctgaccgccagcagaaccgagcaggtgaagctgctgatccagagactgcaggagaagctgggccagaacagcaaccacaccttctacctgttcaaggtgctgaaggcccacatcctgcccctgaccaacgtggccctgaacaagagcggcagctgcttcatcaccggcagctacgacagaacctgcaagctgtgggacaccgccagcggcgaggagctgaacaccctggagggccacagaaacgtggtgtacgccatcgccttcaacaacccctacggcgacaagatcgccaccggcagcttcgacaagacctgcaagctgtggagcgtggagaccggcaagtgctaccacaccttcagaggccacaccgccgagatcgtgtgcctgagcttcaacccccagagcaccctggtggccaccggcagcatggacaccaccgccaagctgtgggacatccagaacggcgaggaggtgtacaccctgagaggccacagcgccgagatcatcagcctgagcttcaacaccagcggcgacagaatcatcaccggcagcttcgaccacaccgtggtggtgtgggacgccgacaccggcagaaaggtgaacatcctgatcggccactgcgccgagatcagcagcgccagcttcaactgggactgcagcctgatcctgaccggcagcatggacaagacctgcaagctgtgggacgccaccaacggcaagtgcgtggccaccctgaccggccacgacgacgagatcctggacagctgcttcgactacaccggcaagctgatcgccaccgccagcgccgacggcaccgccagaatcttcagcgccgccaccagaaagtgcatcgccaagctggagggccacgagggcgagatcagcaagatcagcttcaacccccagggcaaccacctgctgaccggcagcagcgacaagaccgccagaatctgggacgcccagaccggccagtgcctgcaggtgctggagggccacaccgacgagatcttcagctgcgccttcaactacaagggcaacatcgtgatcaccggcagcaaggacaacacctgcagaatctggagatag

SEQ ID NO: 26081 - DNA, 1203 bp, Artificial Sequence
  Description of Artificial Sequence: Synthetic coding sequence
atgctggagtacgagaagcacggcgagctgaagaccaagagcatcgacctgctggacctgggccccagcaccgacgtgagcgccctggtggaggagatccagaaggccgagcccctgctgaccgccagcagaaccgagcaggtgaagctgctgatccagagactgcaggagaagctgggccagaacagcaaccacaccttctacctgttcaaggtgctgaaggcccacatcctgcccctgaccaacgtggccctgaacaagagcggcagctgcttcatcaccggcagctacgacagaacctgcaagctgtgggacaccgccagcggcgaggagctgaacaccctggagggccacagaaacgtggtgtacgccatcgccttcaacaacccctacggcgacaagatcgccaccggcagcttcgacaagacctgcaagctgtggagcgtggagaccggcaagtgctaccacaccttcagaggccacaccgccgagatcgtgtgcctgagcttcaacccccagagcaccctggtggccaccggcagcatggacaccaccgccaagctgtgggacatccagaacggcgaggaggtgtacaccctgagaggccacagcgccgagatcatcagcctgagcttcaacaccagcggcgacagaatcatcaccggcagcttcgaccacaccgtggtggtgtgggacgccgacaccggcagaaaggtgaacatcctgatcggccactgcgccgagatcagcagcgccagcttcaactgggactgcagcctgatcctgaccggcagcatggacaagacctgcaagctgtgggacgccaccaacggcaagtgcgtggccaccctgaccggccacgacgacgagatcctggacagctgcttcgactacaccggcaagctgatcgccaccgccagcgccgacggcaccgccagaatcttcagcgccgccaccagaaagtgcatcgccaagctggagggccacgagggcgagatcagcaagatcagcttcaacccccagggcaaccacctgctgaccggcagcagcgacaagaccgccagaatctgggacgcccagaccggccagtgcctgcaggtgctggagggccacaccgacgagatcttcagctgcgccttcaactacaagggcaacatcgtgatcaccggcagcaaggacaacacctgcagaatctggagatag

SEQ ID NO: 26082 - DNA, 1965 bp, Artificial Sequence
  Description of Artificial Sequence: Synthetic coding sequence
atggagagaagcggccccagcgaggtgaccggcagcgacgccagcggccccgacccccagctggccgtgaccatgggcttcaccggcttcggcaagaaggccagaaccttcgacctggaggccatgttcgagcagaccagaagaaccgccgtggagagaagcagaaagaccctggaggccagagagaaggaggaggagatgaacagagagaaggagctgagaagacagaacgaggacatcgagcccaccagcagcagaagcaacgtggtgagagactgcagcaagagcagcagcagagacaccagcagcagcgagagcgagcagagcagcgacagcagcgacgacgagctgatcggcccccccctgccccccaagatggtgggcaagcccgtgaacttcatggaggaggacatcctgggccccctgcccccccccctgaacgaggaggaggaggaggccgaggaggaggaggaggaggaggaggaggaggagaaccccgtgcacaagatccccgacagccacgagatcaccctgaagcacggcaccaagaccgtgagcgccctgggcctggaccccagcggcgccagactggtgaccggcggctacgactacgacgtgaagttctgggacttcgccggcatggacgccagcttcaaggccttcagaagcctgcagccctgcgagtgccaccagatcaagagcctgcagtacagcaacaccggcgacatgatcctggtggtgagcggcagcagccaggccaaggtgatcgacagagacggcttcgaggtgatggagtgcatcaagggcgaccagtacatcgtggacatggccaacaccaagggccacaccgccatgctgcacaccggcagctggcaccccaagatcaagggcgagttcatgacctgcagcaacgacgccaccgtgagaacctgggaggtggagaaccccaagaagcagaagagcgtgttcaagcccagaaccatgcagggcaagaaggtgatccccaccacctgcacctacagcagagacggcaacctgatcgccgccgcctgccagaacggcagcatccagatctgggacagaaacctgaccgtgcaccccaagttccactacaagcaggcccacgacagcggcaccgacaccagctgcgtgaccttcagctacgacggcaacgtgctggccagcagaggcggcgacgacagcctgaagctgtgggacatcagacagttcaacaagcccctgttcagcgccagcggcctgcccaccatgttccccatgaccgactgctgcttcagccccgacgacaagctgatcgtgaccggcaccagcatccagagaggctgcggcagcggcaagctggtgttcttcgagagaagaaccttccagagagtgtacgagatcgacatcaccgacgccagcgtggtgagatgcctgtggcaccccaagctgaaccagatcatggtgggcaccggcaacggcctggccaaggtgtactacgaccccaacaagagccagagaggcgccaagctgtgcgtggtgaagacccagagaaaggccaagcaggccgagaccctgacccaggactacatcatcaccccccacgccctgcccatgttcagagagcccagacagagaagcaccagaaagcagctggagaaggacagactggaccccctgaagagccacaagcccgagccccccgtggccggccccggcagaggcggcagagtgggcacccacggcggcaccctgagcagctacatcgtgaagaacatcgccctggacaagaccgacgacagcaaccccagagaggccatcctgagacacgccaaggccgccgaggacagcccctactgggtgagccccgcctacagcaagacccagcccaagaccatgttcgcccaggtggagagcgacgacgaggaggccaagaacgagcccgagtggaagaagagaaagatctag

SEQ ID NO: 26083 - DNA, 1137 bp, Artificial Sequence
  Description of Artificial Sequence: Synthetic coding sequence
atggaccccggcgacgactggctggtggagagcctgagactgtaccaggacttctacgccttcgacctgagcggcgccaccagagtgctggagtggatcgacgacaagggcgtgttcgtggccggctacgagagcctgaagaagaacgagatcctgcacctgaagctgcccctgagactgagcgtgaaggagaacaagggcctgttccccgagagagacttcaaggtgagacacggcggcttcagcgacagaagcatcttcgacctgaagcacgtgccccacaccagactgctggtgaccagcggcctgcccggctgctacctgcaggtgtggcaggtggccgaggacagcgacgtgatcaaggccgtgagcaccatcgccgtgcacgagaaggaggagagcctgtggcccagagtggccgtgttcagcaccctggcccccggcgtgctgcacggcgccagactgagaagcctgcaggtggtggacctggagagcagaaagaccacctacaccagcgacgtgagcgacagcgaggagctgagcagcctgcaggtgctggacgccgacaccttcgccttctgctgcgccagcggcagactgggcctggtggacaccagacagaagtgggcccccctggagaacagaagccccggccccggcagcggcggcgagagatggtgcgccgaggtgggcagctggggccagggccccggccccagcatcgccagcctgggcagcgacggcagactgtgcctgctggaccccagagacctgtgccaccccgtgagcagcgtgcagtgccccgtgagcgtgcccagccccgaccccgagctgctgagagtgacctgggcccccggcctgaagaactgcctggccatcagcggcttcgacggcaccgtgcaggtgtacgacgccaccagctgggacggcaccagaagccaggacggcaccagaagccaggtggagcccctgttcacccacagaggccacatcttcctggacggcaacggcatggaccccgcccccctggtgaccacccacacctggcacccctgcagacccagaaccctgctgagcgccaccaacgacgccagcctgcacgtgtgggactgggtggacctgtgcgcccccagatag

SEQ ID NO: 26084 - DNA, 1881 bp, Artificial Sequence
  Description of Artificial Sequence: Synthetic coding sequence
atgagcagaagcggcgccgccgccgagaaggccgacagcagacagagaccccagatgaaggtgaacgagtacaaggagaaccagaacatcgcctacgtgagcctgagacccgcccagaccaccgtgctgatcaagaccgccaaggtgtacctggcccccttcagcctgagcaactaccagctggaccagctgatgtgccccaagagcctgagcgagaagaacagcaacaacgaggtggcctgcaagaagaccaagatcaagaagacctgcagaagaatcatcccccccaagatgaagaacaccagcagcaaggccgagagcaccctgcagaacagcagcagcgccgtgcacaccgagagcaacaagctgcagcccaagagaaccgccgacgccatgaacctgagcgtggacgtggagagcagccaggacggcgacagcgacgaggacaccacccccagcctggacttcagcggcctgagcccctacgagagaaagagactgaagaacatcagcgagaacgccgacttcttcgccagcctgcagctgagcgagagcgccgccagactgagagagatgatcgagaagagacagccccccaagagcaagagaaagaagcccaagagagagaacggcatcggctgcagaagaagcatgagactgctgaaggtggaccccagcggcgtgagcctgcccgccgcccccaccccccccaccctggtggccgacgagacccccctgctgccccccggccccctggagatgaccagcgagaaccaggaggacaacaacgagagattcaagggcttcctgcacacctgggccggcatgagcaagcccagcagcaagaacaccgagaagggcctgagcagcatcaagagctacaaggccaacctgaacggcatggtgatcagcgaggacaccgtgtacaaggtgaccaccggccccatcttcagcatggccctgcaccccagcgagaccagaaccctggtggccgtgggcgccaagttcggccaggtgggcctgtgcgacctgacccagcagcccaaggaggacggcgtgtacgtgttccacccccacagccagcccgtgagctgcctgtacttcagccccgccaaccccgcccacatcctgagcctgagctacgacggcaccctgagatgcggcgacttcagcagagccatcttcgaggaggtgtacagaaacgagagaagcagcttcagcagcttcgacttcctggccgaggacgccagcaccctgatcgtgggccactgggacggcaacatgagcctggtggacagaagaacccccggcaccagctacgagaagctgaccagcagcagcatgggcaagatcagaaccgtgcacgtgcaccccgtgcacagacagtacttcatcaccgccggcctgagagacacccacatctacgacgccagaagactgaacagcagaagaagccagcccctgatcagcctgaccgagcacaccaagagcatcgccagcgcctacttcagccccctgaccggcaacagagtggtgaccacctgcgccgactgcaacctgagaatcttcgacagcagctgcatcagcagcaagatccccctgctgaccaccatcagacacaacaccttcaccggcagatggctgaccagattccaggccatgtgggaccccaagcaggaggactgcgtgatcgtgggcagcatggcccaccccagaagagtggagatcttccacgagaccggcaagagagtgcacagcttcggcggcgagtacctggtgagcgtgtgcagcatcaacgccatgcaccccaccagatacatcctggccggcggcaacagcagcggcaagatccacgtgttcatgaacgagaagagctgctag

SEQ ID NO: 26085 - DNA, 1689 bp, Artificial Sequence
  Description of Artificial Sequence: Synthetic coding sequence
atgtgccccaagagcctgagcgagaagaacagcaacaacgaggtggcctgcaagaagaccaagatcaagaagacctgcagaagaatcatcccccccaagatgaagaacaccagcagcaaggccgagagcaccctgcagaacagcagcagcgccgtgcacaccgagagcaacaagctgcagcccaagagaaccgccgacgccatgaacctgagcgtggacgtggagagcagccaggacggcgacagcgacgaggacaccacccccagcctggacttcagcggcctgagcccctacgagagaaagagactgaagaacatcagcgagaacgccgacttcttcgccagcctgcagctgagcgagagcgccgccagactgagagagatgatcgagaagagacagccccccaagagcaagagaaagaagcccaagagagagaacggcatcggctgcagaagaagcatgagactgctgaaggtggaccccagcggcgtgagcctgcccgccgcccccaccccccccaccctggtggccgacgagacccccctgctgccccccggccccctggagatgaccagcgagaaccaggaggacaacaacgagagattcaagggcttcctgcacacctgggccggcatgagcaagcccagcagcaagaacaccgagaagggcctgagcagcatcaagagctacaaggccaacctgaacggcatggtgatcagcgaggacaccgtgtacaaggtgaccaccggccccatcttcagcatggccctgcaccccagcgagaccagaaccctggtggccgtgggcgccaagttcggccaggtgggcctgtgcgacctgacccagcagcccaaggaggacggcgtgtacgtgttccacccccacagccagcccgtgagctgcctgtacttcagccccgccaaccccgcccacatcctgagcctgagctacgacggcaccctgagatgcggcgacttcagcagagccatcttcgaggaggtgtacagaaacgagagaagcagcttcagcagcttcgacttcctggccgaggacgccagcaccctgatcgtgggccactgggacggcaacatgagcctggtggacagaagaacccccggcaccagctacgagaagctgaccagcagcagcatgggcaagatcagaaccgtgcacgtgcaccccgtgcacagacagtacttcatcaccgccggcctgagagacacccacatctacgacgccagaagactgaacagcagaagaagccagcccctgatcagcctgaccgagcacaccaagagcatcgccagcgcctacttcagccccctgaccggcaacagagtggtgaccacctgcgccgactgcaacctgagaatcttcgacagcagctgcatcagcagcaagatccccctgctgaccaccatcagacacaacaccttcaccggcagatggctgaccagattccaggccatgtgggaccccaagcaggaggactgcgtgatcgtgggcagcatggcccaccccagaagagtggagatcttccacgagaccggcaagagagtgcacagcttcggcggcgagtacctggtgagcgtgtgcagcatcaacgccatgcaccccaccagatacatcctggccggcggcaacagcagcggcaagatccacgtgttcatgaacgagaagagctgctag

SEQ ID NO: 26086 - DNA, 1638 bp, Artificial Sequence
  Description of Artificial Sequence: Synthetic coding sequence
atgacccccggcaagcacagcggcgccagcgccagagccgccaacggcggcgcctggggctacagagacttcagaggcggccagaagaagggctggtgcaccaccccccagctggtggccaccatgcccgtgagccccgccggcagccacaagcagcagaacttcggcctgaacaacgccacccagcccaagaagagcatcagcttcttcgccaccatgaaggccaccagcgtgaagggctacaccggcgccaaccagagcagaatggccgtgagcaagaccgtgctgatcccccccgagctgaagaccgtggagaagcccaaccccaacatcaagaccacccaggtgttcgacatcaacggcaccgacgtgacccccagacccctgtaccaccccgaccccctgaccggcaccgccaagcccagcaagctgctgaccagccaggagggcagcctgggcagcgagttcatcagcagctacagcctgtaccagaacaccatcaaccccagcaccctgggccagttcaccagaagcgtgctgggcagcagcaccgtgagcaagagcagcgtgagcgccagcgagagcatcgccgaggacctggaggagcccagctacaagagagagagactgaccagcttcaccgacctgcaggtgatcagagccgcccccgagaagatcgtgaccaaggaggacctggagaagaacatcgagatcatcctgaccgagaccgagaccctgagattcttcgacctgcccaccgtgatggtgagcgtggagagcgaggaggccgagaaggtgacccagagaaacaagaactacgaggtgctgtgcagaaacagactgggcaacgacctgtacgtggagagaatgatgcagaccttcaacggcgcccccaagaacaaggacgtgcagtgcgacaagatcatcatggaggacaagggcatcatgagcaccgcctgggacctgtacgacagctacaacgccatggagctggtgagcctgagcgtgaagcagagcgtggtggagagcagcagcaaggccaacgtgctgcccaaggaccaggaccagagactgcccggcagcaccaccgagaagaacagcgagaccagcagcctgatggacatcgagaacgtgatcctggccaagatccacgaggacgaggaggaccacagcgacgccatcctgaagagcgacaagttccaccaggacctgttcttcatggagagagtgctgatggagaacatcttccagcccaagctggccgcctacagacagctgcccgtgctgaaggagcccgagcccgaggagcccgaggacgtgctggagagcgccaagcacgaggaggtggaggaggagagcaagaaggaggaggaggaggagatccacgccgaggagagcaccatccccgccaacctggagagactgtggagcttcagctgcgacctgaccaagggcctgaacgtgagcagcctggcctggaacaagaccaaccccgacctgctggccgtgggctacggccacttcggcttcaaggagcagaagagaggcctggcctgctgctggagcatcaagaaccccatggtgacccagaccagaatcagaagcatcttcatctggctgctgaccaagttcagctag

SEQ ID NO: 26087 - DNA, 2547 bp, Artificial Sequence
  Description of Artificial Sequence: Synthetic coding sequence
atgacccccggcaagcacagcggcgccagcgccagagccgccaacggcggcgcctggggctacagagacttcagaggcggccagaagaagggctggtgcaccaccccccagctggtggccaccatgcccgtgagccccgccggcagccacaagcagcagaacttcggcctgaacaacgccacccagcccaagaagagcatcagcttcttcgccaccatgaaggccaccagcgtgaagggctacaccggcgccaaccagagcagaatggccgtgagcaagaccgtgctgatcccccccgagctgaagaccgtggagaagcccaaccccaacatcaagaccacccaggtgttcgacatcaacggcaccgacgtgacccccagacccctgtaccaccccgaccccctgaccggcaccgccaagcccagcaagctgctgaccagccaggagggcagcctgggcagcgagttcatcagcagctacagcctgtaccagaacaccatcaaccccagcaccctgggccagttcaccagaagcgtgctgggcagcagcaccgtgagcaagagcagcgtgagcgccagcgagagcatcgccgaggacctggaggagcccagctacaagagagagagactgaccagcttcaccgacctgcaggtgatcagagccgcccccgagaagatcgtgaccaaggaggacctggagaagaacatcgagatcatcctgaccgagaccgagaccctgagattcttcgacctgcccaccgtgatggtgagcgtggagagcgaggaggccgagaaggtgacccagagaaacaagaactacgaggtgctgtgcagaaacagactgggcaacgacctgtacgtggagagaatgatgcagaccttcaacggcgcccccaagaacaaggacgtgcagtgcgacaagatcatcatggaggacaagggcatcatgagcaccgcctgggacctgtacgacagctacaacgccatggagctggtgagcctgagcgtgaagcagagcgtggtggagagcagcagcaaggccaacgtgctgcccaaggaccaggaccagagactgcccggcagcaccaccgagaagaacagcgagaccagcagcctgatggacatcgagaacgtgatcctggccaagatccacgaggacgaggaggaccacagcgacgccatcctgaagagcgacaagttccaccaggacctgttcttcatggagagagtgctgatggagaacatcttccagcccaagctggccgcctacagacagctgcccgtgctgaaggagcccgagcccgaggagcccgaggacgtgctggagagcgccaagcacgaggaggtggaggaggagagcaagaaggaggaggaggaggagatccacgccgaggagagcaccatccccgccaacctggagagactgtggagcttcagctgcgacctgaccaagggcctgaacgtgagcagcctggcctggaacaagaccaaccccgacctgctggccgtgggctacggccacttcggcttcaaggagcagaagagaggcctggcctgctgctggagcatcaagaaccccatgtggcccgagagaatctaccagagcccctacggcgtgaccgccgtggacttcagcatcggcgcccccaacctgctggccgtgggctaccacaacggcaccatcgccatctacaacgtgagaagcaacagcaacgtgcccgtgctggacagcagcgagagcccccagaagcacctgggccccgtgtggcagctgcagtggatcgagcaggacagaggcaccaccggcgacggcaagagagagatcctggtgagcatcagcgccgacggcagaatcagcaagtgggtgatcagaaagggcctggactgctacgacctgatgagactgaagagaaccaccgccgccagcaacaagaagggcggcgagaaggagaagaaggacgaggccctgatcagcagacaggcccccggcatgtgcttcgccttccaccccaaggacaccaacatctacctggccggcaccgaggagggccacatccacaagtgcagctgcagctacaacgagcagtacctggacacctacagaggccacaagggccccgtgtacaaggtgacctggaaccccttctgccacgacgtgttcctgagctgcagcgccgactggggcgtgatcatctggcagcaggagaacgtgaagcccagcctgagcttctaccccgccaccagcgtggtgtacgacgtggcctggagccccaagagcagctacatcttcgccgccgccaacgagaacagagtggagatctgggacctgcacatcagcaccctggaccccctgatcgtgaacaccgccaaccccggcatcaagttcaccaccatcctgttcgccaagcagaccgactgcctgctggtgggcgacagcgacggccaggtgagcgtgtacgagctgagaaacatgcccaccgtgctggagaccggcagaggcgacatcatggacaccctgctgggcagcaagagcaaccagagcgcctag

SEQ ID NO: 26088 - DNA, 1686 bp, Artificial Sequence
  Description of Artificial Sequence: Synthetic coding sequence
atggtgagcgtggagagcgaggaggccgagaaggtgacccagagaaacaagaactacgaggtgctgtgcagaaacagactgggcaacgacctgtacgtggagagaatgatgcagaccttcaacggcgcccccaagaacaaggacgtgcagtgcgacaagatcatcatggaggacaagggcatcatgagcaccgcctgggacctgtacgacagctacaacgccatggagctggtgagcctgagcgtgaagcagagcgtggtggagagcagcagcaaggccaacgtgctgcccaaggaccaggaccagagactgcccggcagcaccaccgagaagaacagcgagaccagcagcctgatggacatcgagaacgtgatcctggccaagatccacgaggacgaggaggaccacagcgacgccatcctgaagagcgacaagttccaccaggacctgttcttcatggagagagtgctgatggagaacatcttccagcccaagctggccgcctacagacagctgcccgtgctgaaggagcccgagcccgaggagcccgaggacgtgctggagagcgccaagcacgaggaggtggaggaggagagcaagaaggaggaggaggaggagatccacgccgaggagagcaccatccccgccaacctggagagactgtggagcttcagctgcgacctgaccaagggcctgaacgtgagcagcctggcctggaacaagaccaaccccgacctgctggccgtgggctacggccacttcggcttcaaggagcagaagagaggcctggcctgctgctggagcatcaagaaccccatgtggcccgagagaatctaccagagcccctacggcgtgaccgccgtggacttcagcatcggcgcccccaacctgctggccgtgggctaccacaacggcaccatcgccatctacaacgtgagaagcaacagcaacgtgcccgtgctggacagcagcgagagcccccagaagcacctgggccccgtgtggcagctgcagtggatcgagcaggacagaggcaccaccggcgacggcaagagagagatcctggtgagcatcagcgccgacggcagaatcagcaagtgggtgatcagaaagggcctggactgctacgacctgatgagactgaagagaaccaccgccgccagcaacaagaagggcggcgagaaggagaagaaggacgaggccctgatcagcagacaggcccccggcatgtgcttcgccttccaccccaagggccccgtgtacaaggtgacctggaaccccttctgccacgacgtgttcctgagctgcagcgccgactggggcgtgatcatctggcagcaggagaacgtgaagcccagcctgagcttctaccccgccaccagcgtggtgtacgacgtggcctggagccccaagagcagctacatcttcgccgccgccaacgagaacagagtggagatctgggacctgcacatcagcaccctggaccccctgatcgtgaacaccgccaaccccggcatcaagttcaccaccatcctgttcgccaagcagaccgactgcctgctggtgggcgacagcgacggccaggtgagcgtgtacgagctgagaaacatgcccaccgtgctggagaccggcagaggcgacatcatggacaccctgctgggcagcaagagcaaccagagcgcctag

SEQ ID NO: 26089 - DNA, 2673 bp, Artificial Sequence
  Description of Artificial Sequence: Synthetic coding sequence
atggacggcgagccccccgccagcagcggcctgggcctgcccgactacaccagcggcgtgagcttccacgaccaggccgacctgcccgagaccgaggacttccaggccggcctgtacgtgaccgagagcccccagccccaggaggccgaggccgtgagcctgggcagactgagcgacaagagcagcaccagcgagaccagcctgggcgaggagagagcccccgacgagggcggcgcccccgtggacaagagcagcctgagaagcggcgacagcagccaggacctgaagcagagcgagggcagcgaggaggaggaggaggaggaggacagctgcgtggtgctggaggaggaggagggcgagcaggaggaggtgaccggcgccagcgagctgaccctgagcgacaccgtgctgagcatggagaccgtggtggccggcggcagcggcggcgacggcgaggaggaggaggaggccctgcccgagcagagcgagggcaaggagcagaagatcctgctggacaccgcctgcaagatggtgagatggctgagcgccaagctgggccccaccgtggccagcagacacgtggccagaaacctgctgagactgctgaccagctgctacgtgggccccaccagacagcagttcaccgtgagcagcggcgagagcccccccctgagcgccggcaacatctaccagaagagacccgtgctgggcgacatcgtgagcggccccgtgctgagctgcctgctgcacatcgccagactgtacggcgagcccgtgctgacctaccagtacctgccctacatcagctacctggtggcccccggcagcgccagcggccccagcagactgaacagcagaaaggaggccggcctgctggccgccgtgaccctgacccagaagatcatcgtgtacctgagcgacaccaccctgatggacatcctgcccagaatcagccacgaggtgctgctgcccgtgctgagcttcctgaccagcctggtgaccggcttccccagcggcgcccaggccagaaccatcctgtgcgtgaagaccatcagcctgatcgccctgatctgcctgagaatcggccaggagatggtgcagcagcacctgagcgagcccgtggccaccttcttccaggtgttcagccagctgcacgagctgagacagcaggacctgaagctggaccccgccggcagaggcgagggccagctgccccaggtggtgttcagcgacggccagcagagacccgtggaccccgccctgctggacgagctgcagaaggtgttcaccctggagatggcctacaccatctacgtgcccttcagctgcctgctgggcgacatcatcagaaagatcatccccaaccacgagctggtgggcgagctggccgccctgtacctggagagcatcagccccagcagcagaaaccccgccagcgtggagcccaccatgcccggcaccggccccgagtgggacccccacggcggcggctgcccccaggacgacggccacagcggcaccttcggcagcgtgctggtgggcaacagaatccagatccccaacgacagcagacccgagaaccccggccccctgggccccatcagcggcgtgggcggcggcggcctgggcagcggcagcgacgacaacgccctgaagcaggagctgcccagaagcgtgcacggcctgagcggcaactggctggcctactggcagtacgagatcggcgtgagccagcaggacgcccacttccacttccaccagatcagactgcagagcttccccggccacagcggcgccgtgaagtgcgtggcccccctgagcagcgaggacttcttcctgagcggcagcaaggacagaaccgtgagactgtggcccctgtacaactacggcgacggcaccagcgagaccgcccccagactggtgtacacccagcacagaaagagcgtgttcttcgtgggccagctggaggccccccagcacgtggtgagctgcgacggcgccgtgcacgtgtgggaccccttcaccggcaagaccctgagaaccgtggagcccctggacagcagagtgcccctgaccgccgtggccgtgatgcccgccccccacaccagcatcaccatggccagcagcgacagcaccctgagattcgtggactgcagaaagcccggcctgcagcacgagttcagactgggcggcggcctgaaccccggcctggtgagagccctggccatcagccccagcggcagaagcgtggtggccggcttcagcagcggcttcatggtgctgctggacaccagaaccggcctggtgctgagaggctggcccgcccacgagggcgacatcctgcagatcaaggccgtggagggcagcgtgctggtgagcagcagcagcgaccacagcctgaccgtgtggaaggagctggagcagaagcccacccaccactacaagagcgccagcgaccccatccacaccttcgacctgtacggcagcgaggtggtgaccggcaccgtgagcaacaagatcggcgtgtgcagcctgctggagccccccagccaggccaccaccaagctgagcagcgagaacttcagaggcaccctgaccagcctggccctgctgcccaccaagagacacctgctgctgggcagcgacaacggcgtgatcagactgctggcctag

SEQ ID NO: 26090 - DNA, 2079 bp, Artificial Sequence
  Description of Artificial Sequence: Synthetic coding sequence
atggacggcgagccccccgccagcagcggcctgggcctgcccgactacaccagcggcgtgagcttccacgaccaggccgacctgcccgagaccgaggacttccaggccggcctgtacgtgaccgagagcccccagccccaggaggccgaggccgtgagcctgggcagactgagcgacaagagcagcacctaccagtacctgccctacatcagctacctggtggcccccggcagcgccagcggccccagcagactgaacagcagaaaggaggccggcctgctggccgccgtgaccctgacccagaagatcatcgtgtacctgagcgacaccaccctgatggacatcctgcccagaatcagccacgaggtgctgctgcccgtgctgagcttcctgaccagcctggtgaccggcttccccagcggcgcccaggccagaaccatcctgtgcgtgaagaccatcagcctgatcgccctgatctgcctgagaatcggccaggagatggtgcagcagcacctgagcgagcccgtggccaccttcttccaggtgttcagccagctgcacgagctgagacagcaggacctgaagctggaccccgccggcagaggcgagggccagctgccccaggtggtgttcagcgacggccagcagagacccgtggaccccgccctgctggacgagctgcagaaggtgttcaccctggagatggcctacaccatctacgtgcccttcagctgcctgctgggcgacatcatcagaaagatcatccccaaccacgagctggtgggcgagctggccgccctgtacctggagagcatcagccccagcagcagaaaccccgccagcgtggagcccaccatgcccggcaccggccccgagtgggacccccacggcggcggctgcccccaggacgacggccacagcggcaccttcggcagcgtgctggtgggcaacagaatccagatccccaacgacagcagacccgagaaccccggccccctgggccccatcagcggcgtgggcggcggcggcctgggcagcggcagcgacgacaacgccctgaagcaggagctgcccagaagcgtgcacggcctgagcggcaactggctggcctactggcagtacgagatcggcgtgagccagcaggacgcccacttccacttccaccagatcagactgcagagcttccccggccacagcggcgccgtgaagtgcgtggcccccctgagcagcgaggacttcttcctgagcggcagcaaggacagaaccgtgagactgtggcccctgtacaactacggcgacggcaccagcgagaccgcccccagactggtgtacacccagcacagaaagagcgtgttcttcgtgggccagctggaggccccccagcacgtggtgagctgcgacggcgccgtgcacgtgtgggaccccttcaccggcaagaccctgagaaccgtggagcccctggacagcagagtgcccctgaccgccgtggccgtgatgcccgccccccacaccagcatcaccatggccagcagcgacagcaccctgagattcgtggactgcagaaagcccggcctgcagcacgagttcagactgggcggcggcctgaaccccggcctggtgagagccctggccatcagccccagcggcagaagcgtggtggccggcttcagcagcggcttcatggtgctgctggacaccagaaccggcctggtgctgagaggctggcccgcccacgagggcgacatcctgcagatcaaggccgtggagggcagcgtgctggtgagcagcagcagcgaccacagcctgaccgtgtggaaggagctggagcagaagcccacccaccactacaagagcgccagcgaccccatccacaccttcgacctgtacggcagcgaggtggtgaccggcaccgtgagcaacaagatcggcgtgtgcagcctgctggagccccccagccaggccaccaccaagctgagcagcgagaacttcagaggcaccctgaccagcctggccctgctgcccaccaagagacacctgctgctgggcagcgacaacggcgtgatcagactgctggcctag

SEQ ID NO: 26091 - DNA, 2217 bp, Artificial Sequence
  Description of Artificial Sequence: Synthetic coding sequence
atgctggtgagagtggtgctgagcctgacccccagcttccccgagcccagcgccctgtacaccgcctgcaagatggtgagatggctgagcgccaagctgggccccaccgtggccagcagacacgtggccagaaacctgctgagactgctgaccagctgctacgtgggccccaccagacagcagttcaccgtgagcagcggcgagagcccccccctgagcgccggcaacatctaccagaagagacccgtgctgggcgacatcgtgagcggccccgtgctgagctgcctgctgcacatcgccagactgtacggcgagcccgtgctgacctaccagtacctgccctacatcagctacctggtggcccccggcagcgccagcggccccagcagactgaacagcagaaaggaggccggcctgctggccgccgtgaccctgacccagaagatcatcgtgtacctgagcgacaccaccctgatggacatcctgcccagaatcagccacgaggtgctgctgcccgtgctgagcttcctgaccagcctggtgaccggcttccccagcggcgcccaggccagaaccatcctgtgcgtgaagaccatcagcctgatcgccctgatctgcctgagaatcggccaggagatggtgcagcagcacctgagcgagcccgtggccaccttcttccaggtgttcagccagctgcacgagctgagacagcaggacctgaagctggaccccgccggcagaggcgagggccagctgccccaggtggtgttcagcgacggccagcagagacccgtggaccccgccctgctggacgagctgcagaaggtgttcaccctggagatggcctacaccatctacgtgcccttcagctgcctgctgggcgacatcatcagaaagatcatccccaaccacgagctggtgggcgagctggccgccctgtacctggagagcatcagccccagcagcagaaaccccgccagcgtggagcccaccatgcccggcaccggccccgagtgggacccccacggcggcggctgcccccaggacgacggccacagcggcaccttcggcagcgtgctggtgggcaacagaatccagatccccaacgacagcagacccgagaaccccggccccctgggccccatcagcggcgtgggcggcggcggcctgggcagcggcagcgacgacaacgccctgaagcaggagctgcccagaagcgtgcacggcctgagcggcaactggctggcctactggcagtacgagatcggcgtgagccagcaggacgcccacttccacttccaccagatcagactgcagagcttccccggccacagcggcgccgtgaagtgcgtggcccccctgagcagcgaggacttcttcctgagcggcagcaaggacagaaccgtgagactgtggcccctgtacaactacggcgacggcaccagcgagaccgcccccagactggtgtacacccagcacagaaagagcgtgttcttcgtgggccagctggaggccccccagcacgtggtgagctgcgacggcgccgtgcacgtgtgggaccccttcaccggcaagaccctgagaaccgtggagcccctggacagcagagtgcccctgaccgccgtggccgtgatgcccgccccccacaccagcatcaccatggccagcagcgacagcaccctgagattcgtggactgcagaaagcccggcctgcagcacgagttcagactgggcggcggcctgaaccccggcctggtgagagccctggccatcagccccagcggcagaagcgtggtggccggcttcagcagcggcttcatggtgctgctggacaccagaaccggcctggtgctgagaggctggcccgcccacgagggcgacatcctgcagatcaaggccgtggagggcagcgtgctggtgagcagcagcagcgaccacagcctgaccgtgtggaaggagctggagcagaagcccacccaccactacaagagcgccagcgaccccatccacaccttcgacctgtacggcagcgaggtggtgaccggcaccgtgagcaacaagatcggcgtgtgcagcctgctggagccccccagccaggccaccaccaagctgagcagcgagaacttcagaggcaccctgaccagcctggccctgctgcccaccaagagacacctgctgctgggcagcgacaacggcgtgatcagactgctggcctag

SEQ ID NO: 26092 - DNA, 1719 bp, Artificial Sequence
  Description of Artificial Sequence: Synthetic coding sequence
atgggcagcctgagcagccccaccagcacctgccccaccagcgccacctggttccccagcggcgcccaggccagaaccatcctgtgcgtgaagaccatcagcctgatcgccctgatctgcctgagaatcggccaggagatggtgcagcagcacctgagcgagcccgtggccaccttcttccaggtgttcagccagctgcacgagctgagacagcaggacctgaagctggaccccgccggcagaggcgagggccagctgccccaggtggtgttcagcgacggccagcagagacccgtggaccccgccctgctggacgagctgcagaaggtgttcaccctggagatggcctacaccatctacgtgcccttcagctgcctgctgggcgacatcatcagaaagatcatccccaaccacgagctggtgggcgagctggccgccctgtacctggagagcatcagccccagcagcagaaaccccgccagcgtggagcccaccatgcccggcaccggccccgagtgggacccccacggcggcggctgcccccaggacgacggccacagcggcaccttcggcagcgtgctggtgggcaacagaatccagatccccaacgacagcagacccgagaaccccggccccctgggccccatcagcggcgtgggcggcggcggcctgggcagcggcagcgacgacaacgccctgaagcaggagctgcccagaagcgtgcacggcctgagcggcaactggctggcctactggcagtacgagatcggcgtgagccagcaggacgcccacttccacttccaccagatcagactgcagagcttccccggccacagcggcgccgtgaagtgcgtggcccccctgagcagcgaggacttcttcctgagcggcagcaaggacagaaccgtgagactgtggcccctgtacaactacggcgacggcaccagcgagaccgcccccagactggtgtacacccagcacagaaagagcgtgttcttcgtgggccagctggaggccccccagcacgtggtgagctgcgacggcgccgtgcacgtgtgggaccccttcaccggcaagaccctgagaaccgtggagcccctggacagcagagtgcccctgaccgccgtggccgtgatgcccgccccccacaccagcatcaccatggccagcagcgacagcaccctgagattcgtggactgcagaaagcccggcctgcagcacgagttcagactgggcggcggcctgaaccccggcctggtgagagccctggccatcagccccagcggcagaagcgtggtggccggcttcagcagcggcttcatggtgctgctggacaccagaaccggcctggtgctgagaggctggcccgcccacgagggcgacatcctgcagatcaaggccgtggagggcagcgtgctggtgagcagcagcagcgaccacagcctgaccgtgtggaaggagctggagcagaagcccacccaccactacaagagcgccagcgaccccatccacaccttcgacctgtacggcagcgaggtggtgaccggcaccgtgagcaacaagatcggcgtgtgcagcctgctggagccccccagccaggccaccaccaagctgagcagcgagaacttcagaggcaccctgaccagcctggccctgctgcccaccaagagacacctgctgctgggcagcgacaacggcgtgatcagactgctggcctag

SEQ ID NO: 26093 - DNA, 5826 bp, Artificial Sequence
  Description of Artificial Sequence: Synthetic coding sequence
atggcccagggcagcggcggcagagagggcgccctgagaacccccgccggcggctggcacagcccccccagccccgacatgcaggagctgctgagaagcgtggagagagacctgagcatcgaccccagacagctggcccccgcccccggcggcacccacgtggtggccctggtgcccgccagatggctggccagcctgagagacagaagactgcccctgggcccctgccccagagccgagggcctgggcgaggccgaggtgagaaccctgctgcagagaagcgtgcagagactgcccgccggctggaccagagtggaggtgcacggcctgagaaagagaagactgagctaccccctgggcggcggcctgcccttcgaggacggcagctgcggccccgagaccctgaccagattcatgcaggaggtggccgcccagaactacagaaacctgtggagacacgcctaccacacctacggccagccctacagccacagccccgcccccagcgccgtgcccgccctggacagcgtgagacaggccctgcagagagtgtacggctgcagcttcctgcccgtgggcgagaccacccagtgccccagctacgccagagagggcccctgcccccccagaggcagccccgcctgccccagcctgctgagagccgaggccctgctggagagccccgagatgctgtacgtggtgcacccctacgtgcagttcagcctgcacgacgtggtgaccttcagccccgccaagctgaccaacagccaggccaaggtgctgttcatcctgttcagagtgctgagagccatggacgcctgccacagacagggcctggcctgcggcgccctgagcctgtaccacatcgccgtggacgagaagctgtgcagcgagctgagactggacctgagcgcctacgagagacccgaggaggacgagaacgaggaggcccccgtggccagagacgaggccggcatcgtgagccaggaggagcagggcggccagcccggccagcccaccggccaggaggagctgagaagcctggtgctggactgggtgcacggcagaatcagcaacttccactacctgatgcagctgaacagactggccggcagaagacagggcgaccccaactaccaccccgtgctgccctgggtggtggacttcaccaccccccacggcagattcagagacctgagaaagagcaagttcagactgaacaagggcgacaagcagctggacttcacctacgagatgaccagacaggccttcgtggccggcggcgccggcggcggcgagcccccccacgtgccccaccacatcagcgacgtgctgagcgacatcacctactacgtgtacaaggccagaagaacccccagaagcgtgctgtgcggccacgtgagagcccagtgggagccccacgagtaccccgccagcatggagagaatgcagaactggacccccgacgagtgcatccccgagttctacaccgaccccagcatcttcagaagcatccaccccgacatgcccgacctggacgtgcccgcctggtgcagcagcagccaggagttcgtggccgcccacagagccctgctggagagcagagaggtgagcagagacctgcaccactggatcgacctgaccttcggctacaagctgcagggcaaggaggccgtgaaggagaagaacgtgtgcctgcacctggtggacgcccacacccacctggccagctacggcgtggtgcagctgttcgaccagccccacccccagagactggccggcgcccccgccctggcccccgagccccccctgatccccaagctgctggtgcagaccatccaggagaccaccggcagagaggacttcaccgagaaccccggccagctgcccaacggcgtgggcagacccgtgctggaggccaccccctgcgaggccagctggaccagagacagacccgtggccggcgaggacgacctggagcaggccaccgaggccctggacagcatcagcctggccggcaaggccggcgaccagctgggcagcagcagccaggccagccccggcctgctgagcttcagcgtggccagcgccagcagacccggcagaagaaacaaggccgccggcgccgaccccggcgagggcgaggagggcagaatcctgctgcccgagggcttcaaccccatgcaggccctggaggagctggagaagaccggcaacttcctggccaagggcctgggcggcctgctggaggtgcccgagcagcccagagtgcagcccgccgtgcccctgcagtgcctgctgcacagagacatgcaggccctgggcgtgctgctggccgagatggtgttcgccaccagagtgagaaccctgcagcccgacgcccccctgtgggtgagattccaggccgtgagaggcctgtgcaccagacaccccaaggaggtgcccgtgagcctgcagcccgtgctggacaccctgctgcagatgagcggccccgaggtgcccatgggcgccgagagaggcaagctggaccagctgttcgagtacagacccgtgagccagggcctgccccccccctgccccagccagctgctgagccccttcagcagcgtggtgcccttccccccctacttccccgccctgcacagattcatcctgctgtaccaggccagaagagtggaggacgaggcccagggcagagagctggtgttcgccctgtggcagcagctgggcgccgtgctgaaggacatcacccccgagggcctggagatcctgctgcccttcgtgctgagcctgatgagcgaggagcacaccgccgtgtacaccgcctggtacctgttcgagcccgtggccaaggccctgggccccaagaacgccaacaagtacctgctgaagcccctgatcggcgcctacgagagcccctgccagctgcacggcagattctacctgtacaccgactgcttcgtggcccagctgatggtgagactgggcctgcaggccttcctgacccacctgctgccccacgtgctgcaggtgctggccggcgccgaggccagccaggaggagagcaaggacctggccggcgccgccgaggaggaggagagcggcctgcccggcgccggccccggcagctgcgccttcggcgaggagatccccatggacggcgagccccccgccagcagcggcctgggcctgcccgactacaccagcggcgtgagcttccacgaccaggccgacctgcccgagaccgaggacttccaggccggcctgtacgtgaccgagagcccccagccccaggaggccgaggccgtgagcctgggcagactgagcgacaagagcagcaccagcgagaccagcctgggcgaggagagagcccccgacgagggcggcgcccccgtggacaagagcagcctgagaagcggcgacagcagccaggacctgaagcagagcgagggcagcgaggaggaggaggaggaggaggacagctgcgtggtgctggaggaggaggagggcgagcaggaggaggtgaccggcgccagcgagctgaccctgagcgacaccgtgctgagcatggagaccgtggtggccggcggcagcggcggcgacggcgaggaggaggaggaggccctgcccgagcagagcgagggcaaggagcagaagatcctgctggacaccgcctgcaagatggtgagatggctgagcgccaagctgggccccaccgtggccagcagacacgtggccagaaacctgctgagactgctgaccagctgctacgtgggccccaccagacagcagttcaccgtgagcagcggcgagagcccccccctgagcgccggcaacatctaccagaagagacccgtgctgggcgacatcgtgagcggccccgtgctgagctgcctgctgcacatcgccagactgtacggcgagcccgtgctgacctaccagtacctgccctacatcagctacctggtggcccccggcagcgccagcggccccagcagactgaacagcagaaaggaggccggcctgctggccgccgtgaccctgacccagaagatcatcgtgtacctgagcgacaccaccctgatggacatcctgcccagaatcagccacgaggtgctgctgcccgtgctgagcttcctgaccagcctggtgaccggcttccccagcggcgcccaggccagaaccatcctgtgcgtgaagaccatcagcctgatcgccctgatctgcctgagaatcggccaggagatggtgcagcagcacctgagcgagcccgtggccaccttcttccaggtgttcagccagctgcacgagctgagacagcaggacctgaagctggaccccgccggcagaggcgagggccagctgccccaggtggtgttcagcgacggccagcagagacccgtggaccccgccctgctggacgagctgcagaaggtgttcaccctggagatggcctacaccatctacgtgcccttcagctgcctgctgggcgacatcatcagaaagatcatccccaaccacgagctggtgggcgagctggccgccctgtacctggagagcatcagccccagcagcagaaaccccgccagcgtggagcccaccatgcccggcaccggccccgagtgggacccccacggcggcggctgcccccaggacgacggccacagcggcaccttcggcagcgtgctggtgggcaacagaatccagatccccaacgacagcagacccgagaaccccggccccctgggccccatcagcggcgtgggcggcggcggcctgggcagcggcagcgacgacaacgccctgaagcaggagctgcccagaagcgtgcacggcctgagcggcaactggctggcctactggcagtacgagatcggcgtgagccagcaggacgcccacttccacttccaccagatcagactgcagagcttccccggccacagcggcgccgtgaagtgcgtggcccccctgagcagcgaggacttcttcctgagcggcagcaaggacagaaccgtgagactgtggcccctgtacaactacggcgacggcaccagcgagaccgcccccagactggtgtacacccagcacagaaagagcgtgttcttcgtgggccagctggaggccccccagcacgtggtgagctgcgacggcgccgtgcacgtgtgggaccccttcaccggcaagaccctgagaaccgtggagcccctggacagcagagtgcccctgaccgccgtggccgtgatgcccgccccccacaccagcatcaccatggccagcagcgacagcaccctgagattcgtggactgcagaaagcccggcctgcagcacgagttcagactgggcggcggcctgaaccccggcctggtgagagccctggccatcagccccagcggcagaagcgtggtggccggcttcagcagcggcttcatggtgctgctggacaccagaaccggcctggtgctgagaggctggcccgcccacgagggcgacatcctgcagatcaaggccgtggagggcagcgtgctggtgagcagcagcagcgaccacagcctgaccgtgtggaaggagctggagcagaagcccacccaccactacaagagcgccagcgaccccatccacaccttcgacctgtacggcagcgaggtggtgaccggcaccgtgagcaacaagatcggcgtgtgcagcctgctggagccccccagccaggccaccaccaagctgagcagcgagaacttcagaggcaccctgaccagcctggccctgctgcccaccaagagacacctgctgctgggcagcgacaacggcgtgatcagactgctggcctag

SEQ ID NO: 26094 - DNA, 2145 bp, Artificial Sequence
  Description of Artificial Sequence: Synthetic coding sequence
atggtgagatggctgagcgccaagctgggccccaccgtggccagcagacacgtggccagaaacctgctgagactgctgaccagctgctacgtgggccccaccagacagcagttcaccgtgagcagcggcgagagcccccccctgagcgccggcaacatctaccagaagagacccgtgctgggcgacatcgtgagcggccccgtgctgagctgcctgctgcacatcgccagactgtacggcgagcccgtgctgacctaccagtacctgccctacatcagctacctggtggcccccggcagcgccagcggccccagcagactgaacagcagaaaggaggccggcctgctggccgccgtgaccctgacccagaagatcatcgtgtacctgagcgacaccaccctgatggacatcctgcccagaatcagccacgaggtgctgctgcccgtgctgagcttcctgaccagcctggtgaccggcttccccagcggcgcccaggccagaaccatcctgtgcgtgaagaccatcagcctgatcgccctgatctgcctgagaatcggccaggagatggtgcagcagcacctgagcgagcccgtggccaccttcttccaggtgttcagccagctgcacgagctgagacagcaggacctgaagctggaccccgccggcagaggcgagggccagctgccccaggtggtgttcagcgacggccagcagagacccgtggaccccgccctgctggacgagctgcagaaggtgttcaccctggagatggcctacaccatctacgtgcccttcagctgcctgctgggcgacatcatcagaaagatcatccccaaccacgagctggtgggcgagctggccgccctgtacctggagagcatcagccccagcagcagaaaccccgccagcgtggagcccaccatgcccggcaccggccccgagtgggacccccacggcggcggctgcccccaggacgacggccacagcggcaccttcggcagcgtgctggtgggcaacagaatccagatccccaacgacagcagacccgagaaccccggccccctgggccccatcagcggcgtgggcggcggcggcctgggcagcggcagcgacgacaacgccctgaagcaggagctgcccagaagcgtgcacggcctgagcggcaactggctggcctactggcagtacgagatcggcgtgagccagcaggacgcccacttccacttccaccagatcagactgcagagcttccccggccacagcggcgccgtgaagtgcgtggcccccctgagcagcgaggacttcttcctgagcggcagcaaggacagaaccgtgagactgtggcccctgtacaactacggcgacggcaccagcgagaccgcccccagactggtgtacacccagcacagaaagagcgtgttcttcgtgggccagctggaggccccccagcacgtggtgagctgcgacggcgccgtgcacgtgtgggaccccttcaccggcaagaccctgagaaccgtggagcccctggacagcagagtgcccctgaccgccgtggccgtgatgcccgccccccacaccagcatcaccatggccagcagcgacagcaccctgagattcgtggactgcagaaagcccggcctgcagcacgagttcagactgggcggcggcctgaaccccggcctggtgagagccctggccatcagccccagcggcagaagcgtggtggccggcttcagcagcggcttcatggtgctgctggacaccagaaccggcctggtgctgagaggctggcccgcccacgagggcgacatcctgcagatcaaggccgtggagggcagcgtgctggtgagcagcagcagcgaccacagcctgaccgtgtggaaggagctggagcagaagcccacccaccactacaagagcgccagcgaccccatccacaccttcgacctgtacggcagcgaggtggtgaccggcaccgtgagcaacaagatcggcgtgtgcagcctgctggagccccccagccaggccaccaccaagctgagcagcgagaacttcagaggcaccctgaccagcctggccctgctgcccaccaagagacacctgctgctgggcagcgacaacggcgtgatcagactgctggcctag

SEQ ID NO: 26095 - DNA, 834 bp, Artificial Sequence
  Description of Artificial Sequence: Synthetic coding sequence
atgagcagagagttcagaggccacagaaactgcgtgctgaccctggcctacagcgccccctgggacctgcccagcaccccctgcgccgaggaggccgccgccggcggcctgctggtgaccggcagcaccgacggcaccgccaaggtgtggcaggtggccagcggctgctgccaccagaccctgagaggccacaccggcgccgtgctgtgcctggtgctggacacccccggccacaccgccttcaccggcagcaccgacgccaccatcagagcctgggacatcctgagcggcgagcagctgagagtgttcagagagcacagaggcagcgtgatctgcctggagtgcagcagagccgccggcaccctggcccccggccccagcaccagaagcctggagagctgcggcggctgcagcggcgccacccacagcagcagcaccgccagcagatgcaccgccagatgcagcaccccccccagaaccaccgccccctgcgccagcggcacctgcgccggcagcgaggtgcccagaggccccctgagaccctgcgccgccagcagaggcagcagcgccaccagatgggccgccccccccagaccctgcagcagacccgaccccgccggccccctgcagacccccgcccagacccccagcggcagccagagcgcccccccctgctaccccagatggtggagacccatggccggcgagggcagaggcgccagaaagcccggcagagaggagagccccagccaggccagcggcttcagcctggtggccagaagaagatgggagagagagtgcagcccctggggccccccccccttccccttctag

SEQ ID NO: 26096 - DNA, 1131 bp, Artificial Sequence
  Description of Artificial Sequence: Synthetic coding sequence
atgggcggcggcggcagcgccctgagagtgtgcgccgaccacagaggcggcatcaactggctgagcctgagccccgacggccagagactgctgaccggcagcgaggacggcaccgccagactgtggagcaccgccgacggccagtgctgcgccctgctgcagggccacgagagctacgtgaccttctgccagctggaggacgaggccgccttcacctgcagcgccgactgcaccatcagaagatgggacgtgctgaccggccagtgcctgcaggtgtacagaggccacaccagcatcgtgaacagaatcctggtggccaacaaccagctgttcagcagcagctacgacagaaccgccagagtgtggagcgtggacaagggccagatgagcagagagttcagaggccacagaaactgcgtgctgaccctggcctacagcgccccctgggacctgcccagcaccccctgcgccgaggaggccgccgccggcggcctgctggtgaccggcagcaccgacggcaccgccaaggtgtggcaggtggccagcggctgctgccaccagaccctgagaggccacaccggcgccgtgctgtgcctggtgctggacacccccggccacaccgccttcaccggcagcaccgacgccaccatcagagcctgggacatcctgagcggcgagcagctgagagtgttcagagagcacagaggcagcgtgatctgcctggagctggtgaacagactggtgtacagcggcagcgccgacagaaccgtgaagtgctggctggccgacaccggcgagtgcgtgagaaccttcaccgcccacagaagaaacgtgagcgccctgaagtaccacgccggcaccctgttcaccggcagcggcgacgcctgcgccagagccttcgacgcccagagcggcgagctgagaagagtgttcagaggccacaccttcatcatcaactgcatccaggtgcacggccaggtgctgtacaccgccagccacgacggcgccctgagactgtgggacgtgagaggcctgagaggcgcccccagaccccccccccccatgagaagcctgagcagactgttcagcaacaaggtgggctgcgccgccgcccccctgcagcccgcctag

SEQ ID NO: 26097 - DNA, 8622 bp, Artificial Sequence
  Description of Artificial Sequence: Synthetic coding sequence
atgagcagccccagactgatccccctgtggaaggacctgaagctgctgctgaacgacaccatcaacaagagcaagcagcccagcgaggaccccaagaactgcctgatcgtgctgagcgacagaagccaggccgtggcctggatgaagagcaagaccgaggacatggtggagaagagaaccttcagcatgaccgagagactgccccccatccagagcatggtgcacgccggcagcttccacatcctggtggtgtactgcggcgacctgatcctgagactgttcggcgaccacttcagagccttcaagcccctgggcaaggtgccctgcagattcaacatcagctgcctgtgctacgaccccgagatgaagatgctgctgagcggcatcctgggcgccgtggtgacctgggtgatcgagctgggcggcaccggcctgcagatcgcccacatggtgagcatgcccggcgacgagctggtgcaggacatcgtgctgaacggccccagcggcagcctgctggccctgtgcgagaccgtggtgagagtgctgatgcaccagggcaagggccagctgggcgaggtgaagagattcaccagcaccagcagcggcagcagcatcacctgctgcttcacctgcttcgaccagggcttcctgtacgccggcaaccaggccggcgagatccaggtgtggagcctgcagcagggccaccccctgcacagcttccaggcccaccagagcggcgtgatctgcatcagaagcagacccgaggcccacaccctgctgaccgccggcagcgacagcctgatcaaggagtggaacctgaccagcggcagcctgctgagaagactggagctgggcgaggagctgtacagactgcagttcatcgacagcatcaccttcttctgccagaccgcccacagcttcagcctgcacagactgccctgcttctacagcctgttcaacgtgtgcggcagcgccccccagcagctgagaagagtgtgctgcggcaacaactggttcagaatcctgtgcaccaccgaggacggcctgctgagattcgtgagccccgtgaccggcgacctgctggtgatcacctggcccttcagcatcctggaccaggccgtggactgggcctacgaccccggcaaggaggagctgttcgtggccaccggcagcagcgaggtgctggtgttcgacaccaccagatgcccctgccccgccaagtacctgctgggcaccagccccaacagccaggacttcgtgcagtgcctggcctacggccacttcaacctgggcagaggcctggagggcctgatcttcagcggccaccagagcggcgtgatcagagtgctgagccagcacagctgcgccagactggagaagttcatgcacttcggcgccgtgctggccctgagcaccctgagcggcggcatcttcggcggccagggcaacagcctgctgtgcagctacggcatggacgactacgtgcacctgagcgaggccgtgctggacggcgtgaaggtgcagctgagacccctggccagcatcctgagcagctgccacctgacccacctgatcctgctgcccaagagcgtgggcgccatcaccgagaccaactgcctgagactgtggaagttccacgacttcctgagcagcggcagccagaacggcctgaagttcatcgagaccctgcccctgcacctgtgcgccatcaccagcttcgacgtgtgcctgagcctgagcctgttcgtgaccggcagcgccgacggcagcgtgagaatctgggacttccacggcagactgatcggcatcctggacagcagcctgcacttcggccccgtgtgcttcgccaacgacagaggcgacctgctggtgaccttcaaccagagcctgtacctggtgagctgcctgaagctgctgccccccgccctgctgaccagactgagcttcatgagcatcagcgacgaggtgctggaggtgcccaagcccttcatccccagcttcttcttcagcttcgagaccatgttcgtgcccaagtacatctaccccggccaggcccagcagaagctggtgggcctggagaagctggtgaacaacagagccatcgccttcgaccacagcgtgccccacgtgatcgaggaggacgaggagggcagccccgtgctgctgagaagcagcatgcactacagcctgcaggacatggaggactggatgcaggtgagcaagagataccagtgccactacgtgctgcccccccagctgcagctgaccagctgggacggcctgaacccctaccagatcctgagatactacttcggccacggcagagagtggctgttcgcccccgactgctacatccccaacagcgtgatcagagccagactgtggcccgagggcacccccatctacctgcagtgcaacctgcacgccccccagagagagctggagtgggacagaagccaggagttcttcttctggcacagcagagtgagagccatcagcaacaccgagtaccccaagaacaaggaggaggacgagcacttcctggagatgagactgagcaaggacgtgacctacagcgtgctgaccgacggcgccaacagaagctggctgggcagaaagatgagcgagatcaccatcaacagcatgatcgagaccatgctgaacatcatggtgcacgccagcctgctgaagtaccagtgctgcgtgggcgccctgggccagatcttcgccagctaccaggtgagccccgccctgagaagcgagaccgccagaagactgctgaacgacaccaccaacagcaaccccctgatcagagagctggcctgggagggcctgaagagactgggcatgatcacccacctgttcgccatgcccctggcccagggcctgatggacaaggacgagagagtgagaatcaagaccctgagcctgatggccgagatcggcatccacagcagaaccagcctgctgcagctgacccagaagcaggagaccttcagagagatgcagcagcagatgatcggcgaggagcccctggaccacctgctgggcatgagagccaccgacctgcagatcctgagcacccaggtggagcagagactgaacgagaacctgaccctgagccacagagacgagaagcccgccttcagcctggacgtgagcatgcccagcgagctgaagagcagcctgaagccccccaccgtgagcgaggagagcgaggtggccatcaagcccagcaagggccagagaagaggccaggccggcgtgaagaagcacagccagaagtggctgagaggcctgaagaagaccaaggagagagacagcaagcagatgagcaccgagcccggcctgctggaggacgagagcggcaccgaggccgcccccatcgagatggaggaggccagcgtgtacagccagtggagcagcagcaccagcgtgatcaagctgagcaaggacgtggacagccaggagaaggacatcagcaaggaccacatcgccctgaccctgaagagactgcagaagatcagagacaagagagacaagaaggccaccgcccagaagctgaagaagaagcacaagaagaagggcaaggaggccaaggtgatcaacgaggagaccaccccccccgtgatggagcagcccgtgaccaagaaggtgaagatccagggcagaggcgccagcggcatcagcggcagaagaagcaccgccggcgacggcagcagctggagagacgacctgtgcagactgatggccctgagaatcagcggcagccagaccaagatgagcgagaacctgaacgccgagctggtgaccttcgcccaggagatgctggtggacagacaccccagctgggagctgttccaggagatctgccccctgctgaagaaggagagcaaggtgctgctggaggacctggactgggacgtggtgccccccgagaagaagcccatcttcatccaggagggcgccatcagagaggacatgatccagggcgtgacccaggaggtgatcagacacaaggaggtgatgcccagagaggaggagcaggcccagaagaaggccagagacatgctgggcctggaggagacccaggtgatcctgaagaagggcaagaaggtgatcttcctggagcccggcaacgtgaccatgggcaaggagatcagcaagaaggaggagaagaagaccttccagaagagccccaagcagggcagaaaggccgtgcagaaggagagaaaggtgggcaagatcaagagagagatgaccaaggaggagagagacatgagcgaggaggtggaggagatggccaccctggaggagaaggtggtgaagcaggagggcaagctggtgatgatcgagagaacccccagctggcaggactggaagaaggcctgggacgagtggaagcaggtgcacggcgagaccagaaagagctggaaggcctggaaggaggagtgggagaagagactgctgcaggaggaggagaagctgcaccaggccggcgagaagctgagccccgaggaggagatgctgcaggaggacaagaagctgaagtgggaggagtggaagcaggtgtgggagaacatgctgagcagcaagagcaaggagcagcagtacaaggacgaggaggaggtgaccctggaggaggaggtgagcagagagggcgaggagaaggagcagcaggtgaccgaggagcagagacacatccaggaggagcacaagtgggccagaatccacagaaagagagccagagccgagaagaagagagcccaggaggagagaaagctggcccaggaggaggagaagctggcccaggaggagagacagctggcccaggaggagagaaagctggcccaggcctacgtgaagatcacccaggacgacagagagatggcccaggccgagggcaagttcgcccagaaggaggagaccctggcccagagaggcgagaagctgagccaggaggccgagaagctggcccagaagagaaagaagctggccaagaagtgggagaaggtggccagagaggaggagaagctggccaagaagggcggcaagctggccgaggtgaagaacatcctggcccagaaggtggaggagctgccccagagagagcagaacctggactggcaggagaaggagctggcccaggagctggaggagctggagtgggacatggaggagctgagctggaaggaggaggagctgaaccaggaggagggcaagctggtggaggagaagaagaagctggccgaggaggaggaggccctggcctggcagagagagaagctgagcgaggaggagaccaagctggcccaggaggaggagctgctgatccaggagaaggagaagctggcccagcacaaggagaagatgcccgaggaggaggagagactgggcagaaagagagagcagctgatcgagaagaagatgaagctggcccagaagagagagagatggatcaacagcatggaggagctgaccaagaacaagatgatcctgtaccagaagaagaacctggcccaggagaagaagaacctggcccaggagaaggagaagctggcccagagaaaggagaacctgctgtacaacaaggagagactgacccacagcaagaagcagctggtgcaggtgaagaacaagctgggcatgttcaacaagatcctggcccaggtggaggagaagctgacccaggagaaggagaccgtgatcaagaagaaggagaagctggccgagaccgagaagaagctggtgcaggtggaggacagcctggccaagaagcaggagaagctggcccaggagaagatgaagctggccctggagaaggccatggtgcagggcaagaagagactgagaggcgagctggacatcgccaaggaggagaaggccctgaacctggagatgaagagactggccgaggagaagatgagactggtggagggcaaggagaccctgagcaagggcgagacccccgagaccagcagacagagaaagatgacccaggtggagcaggagctgttcgagagaaagctgagcctggaggagaagatcctgctgcacgaggacagaatcctggccatggaggagagcgagatcgccaagggcaagctggagttcaccagaggccagagaatcttcgtgcagggccagagaaagctggccaaggccagcagaaagctgatcaagaagagagagagcctgagcaaggagcccgccaagctgaacaagatcctgaaggccctgcagaagctgaccagagacgagagaaagctgacccaggaggagatcaagatgaccaagatgaagagagccctgttcgtgaaggagagaagactgagcatcgagcagagcaagctggacatcaaggagtgggacttcagcgagaagagaagcgagctgaccaaggacgagaagaagctggccagaaagcagagaaagctggccaacaagatgagaagaatgatcaacaaggaggagaagatgaccgaggaggagagcaagctggccagaaagcacagcgaggtgatcctggacgacgaggaggagggcggcatcgaggaggaggaggtgatccccttcctgaagagaagatggagaaagagaaaggaggccaagagaggcgacaagcccaaggagaagttcagcagccaggtggacgaggtggagagcgaggagcacttcagcgaggagatggagagcctgctggacgagctggagaagcaggagagcctgagcagcgaggaggaggaggagagagaggaggaggaggagagagaggaggaggaggtgagagaggaggaggaggagagaaaggaggaggaggagggcgaggagaagcaggtggagaaggaggaggaggagaagaagaagaagaagaaggagaagaagaaggaggaggtgcaggagaaggaggaggtgttcgaggagaaggaggagatcatgagcgaggaggagaccgagagcctgagcgacgaggaggaggaggaggagagctgcagcctggaggaggaggtggacagagagaaggagatcctgaagaaggagaagcagttcaagctgcaggagcagagaagaaagagcctgagaggcagagagagagtgctgagcatcctgagaggcgtgccccacggcaagggcagagccatcagactgggcgtgctgaagagccccctgaagaagctgatgagcaccgccctggagatgaaggagaagacccccgtgcccgtgcccgagaagcagatcagctgggaggacaagaaggccaccgtggtggagatccccagaaagttcctgggcaccatggacaaggagagagaggtgatgggcaagtacgagcccatccccccccacgtgctgggcaccgtgctggagagccaggcccaggacctgaagacccccttcatgagccacatcctgagaagaaccgtggaggccgaggagctgcagcacaagcccctgggcgcctggtggaagtggttcctgcagcacccccccctgatgggccagaccgaggtgcagctgcccctgagccagatccccgccaaggagcagcacgccgacgtgagcctgagcgacgtggagtggatcagacacgtgctggagagaatggaggccggcgagcagctgagcagagacggcttccacagactgtgccagctgctgaaggacctggccagcaagggcaacctggagtggctgcacctggccaagcacgaggccatcgtgtacagacacagacaggccctggagagccaggacaccagaatcagcagcagacagagcatgagccccaagtacctgaaggtgatcccccccatcaaggccaaggagaaggagagctggcccaagcccctggccgtgcccacccagaagagccccctggccaccaagagaatccccgaccccagagccaagaactggcacctgctgggcgagccctacagaagcgagagagcccagcagatcagcatcgcccacaaggagatggagatgcagtacttctaccccgccaccagagacatcttccccagcgcccacgccagcgtggagaagcagaccctggccctgatgttccagaaggacttctgggacttcaaggacaagagaagattccccaagctgcccaagctggagaagaagacccagcccatcagcaagaagaaggaggagctgcccctgtgggagaccttcgtggccctgtaccacgtgctgagaatgctgcagcagagataccccaaggacagcaccgcctggatggagcagttctaccagctgatggacctgtaccagctgaagagccccagaatccagaagctgctgcaggagctgctgatgagagaggagccccagccccaggagatcatctacgaggaggccctgaaggccaccgagctggtgcccggcgagagactgttctgctgcctgttctgcggcagcagccacacccccagaagcccccaggagttccagggcgccgtgcccctgccctggcagaactgcgtgagaaccatcctgcccgtgggcatcgccagatacggcatcctggagctggcctggaagagcctgcccgaggccgacctgcacctgaccaaggccctgacccacaccgtggcccccaccctgtag

SEQ ID NO: 26098 - DNA, 8739 bp, Artificial Sequence
  Description of Artificial Sequence: Synthetic coding sequence
atgagcagccccagactgatccccctgtggaaggacctgaagctgctgctgaacgacaccatcaacaagagcaagcagcccagcgaggaccccaagaactgcctgatcgtgctgagcgacagaagccaggtgctgttcaaggagagcagatacccccagaacatgccctgcgtgtgctactacttcagcgacgcccacttcttcgccagcctgagctgggtgaccagcaacaccaaggagatccaggccgtggcctggatgaagagcaagaccgaggacatggtggagaagagaaccttcagcatgaccgagagactgccccccatccagagcatggtgcacgccggcagcttccacatcctggtggtgtactgcggcgacctgatcctgagactgttcggcgaccacttcagagccttcaagcccctgggcaaggtgccctgcagattcaacatcagctgcctgtgctacgaccccgagatgaagatgctgctgagcggcatcctgggcgccgtggtgacctgggtgatcgagctgggcggcaccggcctgcagatcgcccacatggtgagcatgcccggcgacgagctggtgcaggacatcgtgctgaacggccccagcggcagcctgctggccctgtgcgagaccgtggtgagagtgctgatgcaccagggcaagggccagctgggcgaggtgaagagattcaccagcaccagcagcggcagcagcatcacctgctgcttcacctgcttcgaccagggcttcctgtacgccggcaaccaggccggcgagatccaggtgtggagcctgcagcagggccaccccctgcacagcttccaggcccaccagagcggcgtgatctgcatcagaagcagacccgaggcccacaccctgctgaccgccggcagcgacagcctgatcaaggagtggaacctgaccagcggcagcctgctgagaagactggagctgggcgaggagctgtacagactgcagttcatcgacagcatcaccttcttctgccagaccgcccacagcttcagcctgcacagactgccctgcttctacagcctgttcaacgtgtgcggcagcgccccccagcagctgagaagagtgtgctgcggcaacaactggttcagaatcctgtgcaccaccgaggacggcctgctgagattcgtgagccccgtgaccggcgacctgctggtgatcacctggcccttcagcatcctggaccaggccgtggactgggcctacgaccccggcaaggaggagctgttcgtggccaccggcagcagcgaggtgctggtgttcgacaccaccagatgcccctgccccgccaagtacctgctgggcaccagccccaacagccaggacttcgtgcagtgcctggcctacggccacttcaacctgggcagaggcctggagggcctgatcttcagcggccaccagagcggcgtgatcagagtgctgagccagcacagctgcgccagactggagaagttcatgcacttcggcgccgtgctggccctgagcaccctgagcggcggcatcttcggcggccagggcaacagcctgctgtgcagctacggcatggacgactacgtgcacctgagcgaggccgtgctggacggcgtgaaggtgcagctgagacccctggccagcatcctgagcagctgccacctgacccacctgatcctgctgcccaagagcgtgggcgccatcaccgagaccaactgcctgagactgtggaagttccacgacttcctgagcagcggcagccagaacggcctgaagttcatcgagaccctgcccctgcacctgtgcgccatcaccagcttcgacgtgtgcctgagcctgagcctgttcgtgaccggcagcgccgacggcagcgtgagaatctgggacttccacggcagactgatcggcatcctggacagcagcctgcacttcggccccgtgtgcttcgccaacgacagaggcgacctgctggtgaccttcaaccagagcctgtacctggtgagctgcctgaagctgctgccccccgccctgctgaccagactgagcttcatgagcatcagcgacgaggtgctggaggtgcccaagcccttcatccccagcttcttcttcagcttcgagaccatgttcgtgcccaagtacatctaccccggccaggcccagcagaagctggtgggcctggagaagctggtgaacaacagagccatcgccttcgaccacagcgtgccccacgtgatcgaggaggacgaggagggcagccccgtgctgctgagaagcagcatgcactacagcctgcaggacatggaggactggatgcaggtgagcaagagataccagtgccactacgtgctgcccccccagctgcagctgaccagctgggacggcctgaacccctaccagatcctgagatactacttcggccacggcagagagtggctgttcgcccccgactgctacatccccaacagcgtgatcagagccagactgtggcccgagggcacccccatctacctgcagtgcaacctgcacgccccccagagagagctggagtgggacagaagccaggagttcttcttctggcacagcagagtgagagccatcagcaacaccgagtaccccaagaacaaggaggaggacgagcacttcctggagatgagactgagcaaggacgtgacctacagcgtgctgaccgacggcgccaacagaagctggctgggcagaaagatgagcgagatcaccatcaacagcatgatcgagaccatgctgaacatcatggtgcacgccagcctgctgaagtaccagtgctgcgtgggcgccctgggccagatcttcgccagctaccaggtgagccccgccctgagaagcgagaccgccagaagactgctgaacgacaccaccaacagcaaccccctgatcagagagctggcctgggagggcctgaagagactgggcatgatcacccacctgttcgccatgcccctggcccagggcctgatggacaaggacgagagagtgagaatcaagaccctgagcctgatggccgagatcggcatccacagcagaaccagcctgctgcagctgacccagaagcaggagaccttcagagagatgcagcagcagatgatcggcgaggagcccctggaccacctgctgggcatgagagccaccgacctgcagatcctgagcacccaggtggagcagagactgaacgagaacctgaccctgagccacagagacgagaagcccgccttcagcctggacgtgagcatgcccagcgagctgaagagcagcctgaagccccccaccgtgagcgaggagagcgaggtggccatcaagcccagcaagggccagagaagaggccaggccggcgtgaagaagcacagccagaagtggctgagaggcctgaagaagaccaaggagagagacagcaagcagatgagcaccgagcccggcctgctggaggacgagagcggcaccgaggccgcccccatcgagatggaggaggccagcgtgtacagccagtggagcagcagcaccagcgtgatcaagctgagcaaggacgtggacagccaggagaaggacatcagcaaggaccacatcgccctgaccctgaagagactgcagaagatcagagacaagagagacaagaaggccaccgcccagaagctgaagaagaagcacaagaagaagggcaaggaggccaaggtgatcaacgaggagaccaccccccccgtgatggagcagcccgtgaccaagaaggtgaagatccagggcagaggcgccagcggcatcagcggcagaagaagcaccgccggcgacggcagcagctggagagacgacctgtgcagactgatggccctgagaatcagcggcagccagaccaagatgagcgagaacctgaacgccgagctggtgaccttcgcccaggagatgctggtggacagacaccccagctgggagctgttccaggagatctgccccctgctgaagaaggagagcaaggtgctgctggaggacctggactgggacgtggtgccccccgagaagaagcccatcttcatccaggagggcgccatcagagaggacatgatccagggcgtgacccaggaggtgatcagacacaaggaggtgatgcccagagaggaggagcaggcccagaagaaggccagagacatgctgggcctggaggagacccaggtgatcctgaagaagggcaagaaggtgatcttcctggagcccggcaacgtgaccatgggcaaggagatcagcaagaaggaggagaagaagaccttccagaagagccccaagcagggcagaaaggccgtgcagaaggagagaaaggtgggcaagatcaagagagagatgaccaaggaggagagagacatgagcgaggaggtggaggagatggccaccctggaggagaaggtggtgaagcaggagggcaagctggtgatgatcgagagaacccccagctggcaggactggaagaaggcctgggacgagtggaagcaggtgcacggcgagaccagaaagagctggaaggcctggaaggaggagtgggagaagagactgctgcaggaggaggagaagctgcaccaggccggcgagaagctgagccccgaggaggagatgctgcaggaggacaagaagctgaagtgggaggagtggaagcaggtgtgggagaacatgctgagcagcaagagcaaggagcagcagtacaaggacgaggaggaggtgaccctggaggaggaggtgagcagagagggcgaggagaaggagcagcaggtgaccgaggagcagagacacatccaggaggagcacaagtgggccagaatccacagaaagagagccagagccgagaagaagagagcccaggaggagagaaagctggcccaggaggaggagaagctggcccaggaggagagacagctggcccaggaggagagaaagctggcccaggcctacgtgaagatcacccaggacgacagagagatggcccaggccgagggcaagttcgcccagaaggaggagaccctggcccagagaggcgagaagctgagccaggaggccgagaagctggcccagaagagaaagaagctggccaagaagtgggagaaggtggccagagaggaggagaagctggccaagaagggcggcaagctggccgaggtgaagaacatcctggcccagaaggtggaggagctgccccagagagagcagaacctggactggcaggagaaggagctggcccaggagctggaggagctggagtgggacatggaggagctgagctggaaggaggaggagctgaaccaggaggagggcaagctggtggaggagaagaagaagctggccgaggaggaggaggccctggcctggcagagagagaagctgagcgaggaggagaccaagctggcccaggaggaggagctgctgatccaggagaaggagaagctggcccagcacaaggagaagatgcccgaggaggaggagagactgggcagaaagagagagcagctgatcgagaagaagatgaagctggcccagaagagagagagatggatcaacagcatggaggagctgaccaagaacaagatgatcctgtaccagaagaagaacctggcccaggagaagaagaacctggcccaggagaaggagaagctggcccagagaaaggagaacctgctgtacaacaaggagagactgacccacagcaagaagcagctggtgcaggtgaagaacaagctgggcatgttcaacaagatcctggcccaggtggaggagaagctgacccaggagaaggagaccgtgatcaagaagaaggagaagctggccgagaccgagaagaagctggtgcaggtggaggacagcctggccaagaagcaggagaagctggcccaggagaagatgaagctggccctggagaaggccatggtgcagggcaagaagagactgagaggcgagctggacatcgccaaggaggagaaggccctgaacctggagatgaagagactggccgaggagaagatgagactggtggagggcaaggagaccctgagcaagggcgagacccccgagaccagcagacagagaaagatgacccaggtggagcaggagctgttcgagagaaagctgagcctggaggagaagatcctgctgcacgaggacagaatcctggccatggaggagagcgagatcgccaagggcaagctggagttcaccagaggccagagaatcttcgtgcagggccagagaaagctggccaaggccagcagaaagctgatcaagaagagagagagcctgagcaaggagcccgccaagctgaacaagatcctgaaggccctgcagaagctgaccagagacgagagaaagctgacccaggaggagatcaagatgaccaagatgaagagagccctgttcgtgaaggagagaagactgagcatcgagcagagcaagctggacatcaaggagtgggacttcagcgagaagagaagcgagctgaccaaggacgagaagaagctggccagaaagcagagaaagctggccaacaagatgagaagaatgatcaacaaggaggagaagatgaccgaggaggagagcaagctggccagaaagcacagcgaggtgatcctggacgacgaggaggagggcggcatcgaggaggaggaggtgatccccttcctgaagagaagatggagaaagagaaaggaggccaagagaggcgacaagcccaaggagaagttcagcagccaggtggacgaggtggagagcgaggagcacttcagcgaggagatggagagcctgctggacgagctggagaagcaggagagcctgagcagcgaggaggaggaggagagagaggaggaggaggagagagaggaggaggaggtgagagaggaggaggaggagagaaaggaggaggaggagggcgaggagaagcaggtggagaaggaggaggaggagaagaagaagaagaagaaggagaagaagaaggaggaggtgcaggagaaggaggaggtgttcgaggagaaggaggagatcatgagcgaggaggagaccgagagcctgagcgacgaggaggaggaggaggagagctgcagcctggaggaggaggtggacagagagaaggagatcctgaagaaggagaagcagttcaagctgcaggagcagagaagaaagagcctgagaggcagagagagagtgctgagcatcctgagaggcgtgccccacggcaagggcagagccatcagactgggcgtgctgaagagccccctgaagaagctgatgagcaccgccctggagatgaaggagaagacccccgtgcccgtgcccgagaagcagatcagctgggaggacaagaaggccaccgtggtggagatccccagaaagttcctgggcaccatggacaaggagagagaggtgatgggcaagtacgagcccatccccccccacgtgctgggcaccgtgctggagagccaggcccaggacctgaagacccccttcatgagccacatcctgagaagaaccgtggaggccgaggagctgcagcacaagcccctgggcgcctggtggaagtggttcctgcagcacccccccctgatgggccagaccgaggtgcagctgcccctgagccagatccccgccaaggagcagcacgccgacgtgagcctgagcgacgtggagtggatcagacacgtgctggagagaatggaggccggcgagcagctgagcagagacggcttccacagactgtgccagctgctgaaggacctggccagcaagggcaacctggagtggctgcacctggccaagcacgaggccatcgtgtacagacacagacaggccctggagagccaggacaccagaatcagcagcagacagagcatgagccccaagtacctgaaggtgatcccccccatcaaggccaaggagaaggagagctggcccaagcccctggccgtgcccacccagaagagccccctggccaccaagagaatccccgaccccagagccaagaactggcacctgctgggcgagccctacagaagcgagagagcccagcagatcagcatcgcccacaaggagatggagatgcagtacttctaccccgccaccagagacatcttccccagcgcccacgccagcgtggagaagcagaccctggccctgatgttccagaaggacttctgggacttcaaggacaagagaagattccccaagctgcccaagctggagaagaagacccagcccatcagcaagaagaaggaggagctgcccctgtgggagaccttcgtggccctgtaccacgtgctgagaatgctgcagcagagataccccaaggacagcaccgcctggatggagcagttctaccagctgatggacctgtaccagctgaagagccccagaatccagaagctgctgcaggagctgctgatgagagaggagccccagccccaggagatcatctacgaggaggccctgaaggccaccgagctggtgcccggcgagagactgttctgctgcctgttctgcggcagcagccacacccccagaagcccccaggagttccagggcgccgtgcccctgccctggcagaactgcgtgagaaccatcctgcccgtgggcatcgccagatacggcatcctggagctggcctggaagagcctgcccgaggccgacctgcacctgaccaaggccctgacccacaccgtggcccccaccctgtag

SEQ ID NO: 26099 - DNA, 1419 bp, Artificial Sequence
  Description of Artificial Sequence: Synthetic coding sequence
atggccagcccccccagatgcagccccaccgcccacgacagagagtgcaagctgcccccccccagcgcccccgccagcgagtactgccccggcaagctgagctggggcaccatggccagagccctgggcagattcaagctgagcatcccccacacccacctgctggccaccctggaccccctggccctggacagagagccccccccccacctgctgcccgagaagcaccaggtgcccgagaagctgatctggggcgaccaggaccccctgagcaagatccccttcaagatcctgagcggccacgagcacgccgtgagcacctgccacttctgcgtggacgacaccaagctgctgagcggcagctacgactgcaccgtgaagctgtgggaccccgtggacggcagcgtggtgagagacttcgagcacagacccaaggcccccgtggtggagtgcagcatcaccggcgacagcagcagagtgatcgccgccagctacgacaagaccgtgagagcctgggacctggagaccggcaagctgctgtggaaggtgagatacgacaccttcatcgtgagctgcaagttcagccccgacggcaagtacgtggtgagcggcttcgacgtggaccacggcatctgcatcatggacgccgagaacatcaccaccgtgagcgtgatcaaggaccaccacaccagaagcatcaccagctgctgcttcgaccccgacagccagagagtggccagcgtgagcctggacagatgcatcaagatctgggacgtgaccagccaggccaccctgctgaccatcaccaaggcccacagcaacgccatcagcaactgctgcttcaccttcagcggccacttcctgtgcaccagcagctgggacaagaacctgaagatctggaacgtgcacaccggcgagttcagaaactgcggcgcctgcgtgaccctgatgcagggccacgagggcagcgtgagcagctgccacttcgccagagacagcagcttcctgatcagcggcggcttcgacagaaccgtggccatctgggacgtggccgagggctacagaaagctgagcctgaagggccacaacgactgggtgatggacgtggccatcagcaacaacaagaagtggatcctgagcgccagcaaggacagaaccatgagactgtggaacatcgaggagatcgacgagatccccctggtgatcaagtacaagaaggccgtgggcctgaagctgaagcagtgcgagagatgcgacagacccttcagcatcttcaagagcgacaccagcagcgagatgttcacccagtgcgtgttctgcagaatcgacaccagaggcctgcccgccgacaccagcagcagcagcagcagcagcgagagagagaacagccccccccccagaggcagcaaggacgactag

SEQ ID NO: 26100 - DNA, 1281 bp, Artificial Sequence
  Description of Artificial Sequence: Synthetic coding sequence
atggccagcccccccagatgcagccccaccgcccacgacagagagtgcaagctgcccccccccagcgcccccgccagcgagtactgccccggcaagctgagctggggcaccatggccagagccctgggcagattcaagctgagcatcccccacacccacctgctggccaccctggaccccctggccctggacagagagccccccccccacctgctgcccgagaagcaccaggtgcccgagaagctgatctggggcgaccaggaccccctgagcaagatccccttcaagatcctgagcggccacgagcacgccgtgagcacctgccacttctgcgtggacgacaccaagctgctgagcggcagctacgactgcaccgtgaagctgtgggaccccgtggacggcagcgtggtgagagacttcgagcacagacccaaggcccccgtggtggagtgcagcatcaccggcgacagcagcagagtgatcgccgccagctacgacaagaccgtgagagcctgggacctggagaccggcaagctgctgtggaaggtgagatacgacaccttcatcgtgagctgcaagttcagccccgacggcaagtacgtggtgagcggcttcgacgtggaccacggcatctgcatcatggacgccgagaacatcaccaccgtgagcgtgatcaaggaccaccacaccagaagcatcaccagctgctgcttcgaccccgacagccagagagtggccagcgtgagcctggacagatgcatcaagatctgggacgtgaccagccaggccaccctgctgaccatcaccaaggcccacagcaacgccatcagcaactgctgcttcaccttcagcggccacttcctgtgcaccagcagctgggacaagaacctgaagatctggaacgtgcacaccggcgagttcagaaactgcggcgcctgcgtgaccctgatgcagggccacgagggcagcgtgagcagctgccacttcgccagagacagcagcttcctgatcagcggcggcttcgacagaaccgtggccatctgggacgtggccgagggctacagaaagctgagcctgaagggccacaacgactgggtgatggacgtggccatcagcaacaacaagaagtggatcctgagcgccagcaaggacagaaccatgagactgtggaacatcgaggagatcgacgagatccccctggtgatcaagtacaagaaggccgtgggcctgaagctgaagcaggagaagaaggaggcctacctgaagctgaagcagggctag

SEQ ID NO: 26101 - DNA, 1164 bp, Artificial Sequence
  Description of Artificial Sequence: Synthetic coding sequence
atggagaagatcgaggagcagttcgccaacctgcacatcgtgaagtgcagcctgggcaccaaggagcccacctacctgctgggcatcgacaccagcaagaccgtgcaggccggcaaggagaacctggtggccgtgctgtgcagcaacggcagcatcagaatctacgacaaggagagactgaacgtgctgagagagttcagcggctaccccggcctgctgaacggcgtgagattcgccaacagctgcgacagcgtgtacagcgcctgcaccgacggcaccgtgaagtgctgggacgccagagtggccagagagaagcccgtgcagctgttcaagggctaccccagcaacatcttcatcagcttcgacatcaactgcaacgaccacatcatctgcgccggcaccgagaaggtggacgacgacgccctgctggtgttctgggacgccagaatgaacagccagaacctgagcaccaccaaggacagcctgggcgcctacagcgagacccacagcgacgacgtgacccaggtgagattccaccccagcaaccccaacatggtggtgagcggcagcagcgacggcctggtgaacgtgttcgacatcaacatcgacaacgaggaggacgccctggtgaccacctgcaacagcatcagcagcgtgagctgcatcggctggagcggcaagggctacaagcagatctactgcatgacccacgacgagggcttctactggtgggacctgaaccacctggacaccgacgagcccgtgaccagactgaacatccaggacgtgagagaggtggtgaacatgaaggaggacgccctggactacctgatcggcggcctgtaccacgagaagaccgacaccctgcacgtgatcggcggcaccaacaagggcagaatccacctgatgaactgcagcatgagcggcctgacccacgtgaccagcctgcagggcggccacgccgccaccgtgagaagcttctgctggaacgtgcaggacgacagcctgctgaccggcggcgaggacgcccagctgctgctgtggaagcccggcgccatcgagaagaccttcaccaagaaggagagcatgaagatcgccagcagcgtgcaccagagagtgagagtgcacagcaacgacagctacaagagaagaaagaagcagtag

SEQ ID NO: 26102 - DNA, 1164 bp, Artificial Sequence; identical to SEQ ID NO: 26101
  Description of Artificial Sequence: Synthetic coding sequence

SEQ ID NO: 26103 - DNA, 900 bp, Artificial Sequence
  Description of Artificial Sequence: Synthetic coding sequence
atgctgtggttcggccagcccggccccggcggctggaacagaaagtgcctgagacccttcaccctgcccagaggccagcacccccagcccagctacggcttcccccaggtgaacgaggtggtgttcagccccggcgagagccactgcgccacctgcagcgaggacggcagcgtgagagtgtgggccctggccagcatggagctggtgatccagttccaggtgctgaaccagagctgcctgtgcctggcctggagccccccctgctgcggcagacccgagcagcagagactggccgccggctacggcgacggcagcctgagaatcttcagcgtgagcagaaccgccatggagctgaagatgcacccccaccccgtggccctgaccaccgtggccttcagcaccgacggccagaccgtgctgagcggcgacaaggacggcctggtggccgtgagccacccctgcaccggcaccaccttcagagtgctgagcgaccaccagggcgcccccatcagcaccatctgcgtgacctgcaaggagacccagggccacctgccccccagcctggccgccttctgcccctgggacggcgccctgctgatgtacgtgggccccggcgtgtacaaggaggtgatcatctacaacctgtgccagaagcaggtggtggagaagatccccctgcccttcttcgccatgagcctgagcctgagccccggcacccacctgctggccgtgggcttcgccgagtgcatgctgagactggtggactgcgccatgggcaccgcccaggacttcgccggccacgacaacgccgtgcacctgtgcagattcacccccagcgccagactgctgttcaccgccgccagaaacgagatcctggtgtgggaggtgcccggcctgtag

SEQ ID NO: 26104 - DNA, 5247 bp, Artificial Sequence
  Description of Artificial Sequence: Synthetic coding sequence
atggccagagcctggcagcaccccttcctgaacgtgttcagacacttcagagtggacgagtggaagagaagcgccaagcagggcgacgtggccgtggtgaccgacaagaccctgaagggcgccgtgtacagaatcagaggcagcgtgagcgccgccaactacatccagctgcccaagagcagcacccagagcctgggcctgaccggcagatacctgtacgtgctgttcagacccctgcccagcaagcacttcgtgatccacctggacgtgagcagcaaggacaaccaggtgatcagagtgagcttcagcaacctgttcaaggagttcaagagcaccgccacctggctgcagttccccctggtgctggaggccagaaccccccagagagacctggtgggcctggcccccagcggcgccagatggacctgcctgcagctggacctgcaggacgtgctgctggtgtacctgaacagatgctacggccacctgaagagcatcagactgtgcgccagcctgctggtgagaaacctgtacaccagcgacctgtgcttcgagcccgccatcagcggcgcccagtgggccaagctgcccgtgacccccatgcccagagagatggccttccccgtgcccaagggcgagagctggcacgacagatacatccacgtgagattccccagcgagagcctgaaggtgcccagcaagcccatcgagaagagctgcagcccccccgaggccgtgctgctgggccccggcccccagcccctgccctgccccgtggccagcagcaagcccgtgagattcagcgtgagccccgtggtgcagacccccagccccaccgccagcggcagagccgccctggcccccagacccttccccgaggtgagcctgagccaggagagaagcgacgccagcaacgccgacggccccggcttccacagcctggagccctgggcccagctggaggccagcgacatccacaccgccgccgccggcacccacgtgctgacccacgagagcgccgaggtgcccgtggccagaaccggcagctgcgagggcttcctgcccgaccccgtgctgagactgaagggcgtgatcggcttcggcggccacggcaccagacaggccctgtggacccccgacggcgccgccgtggtgtacccctgccacgccgtgatcgtggtgctgctggtggacaccggcgagcagagattcttcctgggccacaccgacaaggtgagcgccctggccctggacggcagcagcagcctgctggccagcgcccaggccagagcccccagcgtgatgagactgtgggacttccagaccggcagatgcctgtgcctgttcagaagccccatgcacgtggtgtgcagcctgagcttcagcgacagcggcgccctgctgtgcggcgtgggcaaggaccaccacggcagaaccatggtggtggcctggggcaccggccaggtgggcctgggcggcgaggtggtggtgctggccaaggcccacaccgacttcgacgtgcaggccttcagagtgaccttcttcgacgagaccagaatggccagctgcggccagggcagcgtgagactgtggagactgagaggcggcgtgctgagaagctgccccgtggacctgggcgagcaccacgccctgcagttcaccgacctggccttcaagcaggccagagacggctgccccgagcccagcgccgccatgctgttcgtgtgcagcagaagcggccacatcctggagatcgactgccagagaatggtggtgagacacgccagaagactgctgcccaccagaacccccggcggcccccacccccagaagcagaccttcagcagcggccccggcatcgccatcagcagcctgagcgtgagccccgccatgtgcgccgtgggcagcgaggacggcttcctgagactgtggcccctggacttcagcagcgtgctgctggaggccgagcacgagggccccgtgagcagcgtgtgcgtgagccccgacggcctgagagtgctgagcgccaccagcagcggccacctgggcttcctggacaccctgagcagagtgtaccacatgctggccagaagccacaccgcccccgtgctggccctggccatggagcagagaagaggccagctggccaccgtgagccaggacagaaccgtgagaatctgggacctggccaccctgcagcagctgtacgacttcaccagcagcgaggacgccccctgcgccgtgaccttccaccccaccagacccaccttcttctgcggcttcagcagcggcgccgtgagaagcttcagcctggaggccgccgaggtgctggtggagcacacctgccacagaggcgccgtgaccggcctgaccgccacccccgacggcagactgctgttcagcagctgcagccagggcagcctggcccagtacagctgcgccgacccccagtggcacgtgctgagagtggccgccgacatggtgtgccccgacgcccccgccagccccagcgccctggccgtgagcagagacggcagactgctggccttcgtgggccccagcagatgcaccgtgaccgtgatgggcagcgccagcctggacgagctgctgagagtggacatcggcaccctggacctggccagcagcagactggacagcgccatggccgtgtgcttcggccccgccgccctgggccacctgctggtgagcaccagcagcaacagagtggtggtgctggacgccgtgagcggcagaatcatcagagagctgcccggcgtgcaccccgagccctgccccagcctgaccctgagcgaggacgccagattcctgctgatcgccgccggcagaaccatcaaggtgtgggactacgccacccaggccagccccggcccccaggtgtacatcggccacagcgagcccgtgcaggccgtggccttcagccccgaccagcagcaggtgctgagcgccggcgacgccgtgttcctgtgggacgtgctggcccccaccgagagcgaccagagcttccccggcgccccccccgcctgcaagaccggccccggcgccggccccctggaggacgccgccagcagagccagcgagctgcccagacagcaggtgcccaagccctgccaggccagcccccccagactgggcgtgtgcgccagaccccccgagggcggcgacggcgccagagacaccagaaacagcggcgcccccagaaccacctacctggccagctgcaaggccttcacccccgccagagtgagctgcagcccccacagcgccaagggcacctgccccccccccgccagcggcggctggctgagactgaaggccgtggtgggctacagcggcaacggcagagccaacatggtgtggagacccgacaccggcttcttcgcctacacctgcggcagactggtggtggtggaggacctgcacagcggcgcccagcagcactggagcggccacagcgccgagatcagcaccctggccctgagccacagcgcccaggtgctggccagcgccagcggcagaagcagcaccaccgcccactgccagatcagagtgtgggacgtgagcggcggcctgtgccagcacctgatcttcccccacagcaccaccgtgctggccctggccttcagccccgacgacagactgctggtgaccctgggcgaccacgacggcagaaccctggccctgtggggcaccgccacctacgacctggtgagcagcaccagactgcccgagcccgtgcacggcgtggccttcaacccctgggacgccggcgagctgacctgcgtgggccagggcaccgtgaccttctggctgctgcagcagagaggcgccgacatcagcctgcaggtgagaagagagcccgtgcccgaggccgtgggcgccggcgagctgaccagcctgtgctacggcgccccccccctgctgtactgcggcaccagcagcggccaggtgtgcgtgtgggacaccagagccggcagatgcttcctgagctgggaggccgacgacggcggcatcggcctgctgctgttcagcggcagcagactggtgagcggcagcagcaccggcagactgagactgtgggccgtgggcgccgtgagcgagctgagatgcaagggcagcggcgccagcagcgtgttcatggagcacgagctggtgctggacggcgccgtggtgagcgccagcttcgacgacagcgtggacatgggcgtggtgggcaccaccgccggcaccctgtggttcgtgagctgggccgagggcaccagcaccagactgatcagcggccacagaagcaaggtgaacgaggtggtgttcagccccggcgagagccactgcgccacctgcagcgaggacggcagcgtgagagtgtgggccctggccagcatggagctggtgatccagttccaggtgctgaaccagagctgcctgtgcctggcctggagccccccctgctgcggcagacccgagcagcagagactggccgccggctacggcgacggcagcctgagaatcttcagcgtgagcagaaccgccatggagctgaagatgcacccccaccccgtggccctgaccaccgtggccttcagcaccgacggccagaccgtgctgagcggcgacaaggacggcctggtggccgtgagccacccctgcaccggcaccaccttcagagtgctgagcgaccaccagggcgcccccatcagcaccatctgcgtgacctgcaaggagtgcgaggacctgggcgtggagggcaccgacctgtggctggccgccagcggcgaccagagagtgagcgtgtgggccagcgactggctgagaaaccactgcgagctggtggactggctgagcttccccatgcccgccaccaccgagacccagggccacctgccccccagcctggccgccttctgcccctgggacggcgccctgctgatgtacgtgggccccggcgtgtacaaggaggtgatcatctacaacctgtgccagaagcaggtggtggagaagatccccctgcccttcttcgccatgagcctgagcctgagccccggcacccacctgctggccgtgggcttcgccgagtgcatgctgagactggtggactgcgccatgggcaccgcccaggacttcgccggccacgacaacgccgtgcacctgtgcagattcacccccagcgccagactgctgttcaccgccgccagaaacgagatcctggtgtgggaggtgcccggcctgtag

SEQ ID NO: 26105 - DNA, 1911 bp, Artificial Sequence
  Description of Artificial Sequence: Synthetic coding sequence
atggccgaggccgtggagagaaccgacgagctggtgagagagtacctgctgttcagaggcttcacccacaccctgagacagctggacgccgagatcaaggccgacaaggagaagggcttcagagtggacaagatcgtggaccagctgcagcagctgatgcaggtgtacgacctggccgccctgagagactactggagctacctggagagaagactgttcagcagactggaggacatctacagacccaccatccacaagctgaagaccagcctgttcagattctacctggtgtacaccatccagaccaacagaaacgacaaggcccaggagttcttcgccaagcaggccaccgagctgcagaaccaggccgagtggaaggactggttcgtgctgcccttcctgcccagccccgacaccaaccccaccttcgccacctacttcagcagacagtgggccgacaccttcatcgtgagcctgcacaacttcctgagcgtgctgttccagtgcatgcccgtgcccgtgatcctgaacttcgacgccgagtgccagagaaccaaccaggtgcaggaggagaacgaggtgctgagacagaagctgttcgccctgcaggccgagatccacagactgaagaaggaggagcagcagcccgaggaggaggaggccctggtgcagcacaagctgcccccctacgtgagcaacatggacagactgggcgacagcgagctggccatggtgtgcagccagagaaacgccagcctgagccagagccccagagtgggcttcctgagcagcctgctgccccagagcaagaagagccccagcagactgagccccgcccagggccccccccagccccagagcagcgccaagaaggagagcttcggcggccagggcaccaagggcaaggaccccaccagcggcgccaaggacggcaagagcctgctgagcggcctggccaccggcgagagcggctggagccagcacagacagagaagactgcaggaccacggcaaggagagaaaggagctgttcagcaccaccaccagccagtgcgccgagaagaagcccgaggccagcggccccgaggccgagccctgccccgagctgcacaccgagcccgtggagcccctgaccagagccagcagcgccggccccgagggcggcggcgtgagacccgagcagcccttcatcgtgctgggccaggaggagtacggcgagcaccacagcagcatcatgcactgcagagtggactgcagcggcagaagagtggccagcctggacgtggacggcgtgatcaaggtgtggagcttcaaccccatcatgcagaccaaggccagcagcatcagcaagagccccctgctgagcctggagtgggccaccaagagagacagactgctgctgctgggcagcggcgtgggcaccgtgagactgtacgacaccgaggccaagaagaacctgtgcgagatcaacatcaacgacaacatgcccagaatcctgagcctggcctgcagccccaacggcgccagcttcgtgtgcagcgccgccgcccccagcctgaccagccaggtggacttcagcgcccccgacatcggcagcaagggcatgaaccaggtgcccggcagactgctgctgtgggacaccaagaccatgaagcagcagctgcagttcagcctggaccccgagcccatcgccatcaactgcaccgccttcaaccacaacggcaacctgctggtgaccggcgccgccgacggcgtgatcagactgttcgtgcaccccgtggagcacccccaggagtggccccagggcatcagagtgcagccccccctgagatgccacggccccctgtgcgccgtgtggatccagagactgcaggccggcagcagcccccagggccccaccctgagattctag

SEQ ID NO: 26106 - DNA, 2244 bp, Artificial Sequence
  Description of Artificial Sequence: Synthetic coding sequence
atggccgaggccgtggagagaaccgacgagctggtgagagagtacctgctgttcagaggcttcacccacaccctgagacagctggacgccgagatcaaggccgacaaggagaagggcttcagagtggacaagatcgtggaccagctgcagcagctgatgcaggtgtacgacctggccgccctgagagactactggagctacctggagagaagactgttcagcagactggaggacatctacagacccaccatccacaagctgaagaccagcctgttcagattctacctggtgtacaccatccagaccaacagaaacgacaaggcccaggagttcttcgccaagcaggccaccgagctgcagaaccaggccgagtggaaggactggttcgtgctgcccttcctgcccagccccgacaccaaccccaccttcgccacctacttcagcagacagtgggccgacaccttcatcgtgagcctgcacaacttcctgagcgtgctgttccagtgcatgcccgtgcccgtgatcctgaacttcgacgccgagtgccagagaaccaaccaggtgcaggaggagaacgaggtgctgagacagaagctgttcgccctgcaggccgagatccacagactgaagaaggaggagcagcagcccgaggaggaggaggccctggtgcagcacaagctgcccccctacgtgagcaacatggacagactgggcgacagcgagctggccatggtgtgcagccagagaaacgccagcctgagccagagccccagagtgggcttcctgagcagcctgctgccccagagcaagaagagccccagcagactgagccccgcccagggccccccccagccccagagcagcgccaagaaggagagcttcggcggccagggcaccaagggcaaggaccccaccagcggcgccaaggacggcaagagcctgctgagcggcctggccaccggcgagagcggctggagccagcacagacagagaagactgcaggaccacggcaaggagagaaaggagctgttcagcaccaccaccagccagtgcgccgagaagaagcccgaggccagcggccccgaggccgagccctgccccgagctgcacaccgagcccgtggagcccctgaccagagccagcagcgccggccccgagggcggcggcgtgagacccgagcagcccttcatcgtgctgggccaggaggagtacggcgagcaccacagcagcatcatgcactgcagagtggactgcagcggcagaagagtggccagcctggacgtggacggcgtgatcaaggtgtggagcttcaaccccatcatgcagaccaaggccagcagcatcagcaagagccccctgctgagcctggagtgggccaccaagagagacagactgctgctgctgggcagcggcgtgggcaccgtgagactgtacgacaccgaggccaagaagaacctgtgcgagatcaacatcaacgacaacatgcccagaatcctgagcctggcctgcagccccaacggcgccagcttcgtgtgcagcgccgccgcccccagcctgaccagccaggtggacttcagcgcccccgacatcggcagcaagggcatgaaccaggtgcccggcagactgctgctgtgggacaccaagaccatgaagcagcagctgcagttcagcctggaccccgagcccatcgccatcaactgcaccgccttcaaccacaacggcaacctgctggtgaccggcgccgccgacggcgtgatcagactgttcgacatgcagcagcacgagtgcgccatgagctggagagcccactacggcgaggtgtacagcgtggagttcagctacgacgagaacaccgtgtacagcatcggcgaggacggcaagttcatccagtggaacatccacaagagcggcctgaaggtgagcgagtacagcctgcccagcgacgccaccggccccttcgtgctgagcggctacagcggctacaagcaggtgcaggtgcccagaggcagactgttcgccttcgacagcgagggcaactacatgctgacctgcagcgccaccggcggcgtgatctacaagctgggcggcgacgagaaggtgctggagagctgcctgagcctgggcggccacagagcccccgtggtgaccgtggactggagcaccgccatggactgcggcacctgcctgaccgccagcatggacggcaagatcaagctgaccaccctgctggcccacaaggcctag

SEQ ID NO: 26107 - DNA, 2613 bp, Artificial Sequence
  Description of Artificial Sequence: Synthetic coding sequence
atggccaccaacatcccctgcgaggtggtggccttcagcgacagaaagctgaagcccctgatctacgtgtacagcttccccggcctgaccagaagaaccaagctgaagggcaacatcctgctggactacaccctgctgagcttcagctactgcggcacctacctggccagctacagcagcctgcccgagttcgagctggccctgtggaactgggagagcagcatcatcctgtgcaagaagagccagcccggcatggacgtgaaccagatgagcttcaaccccatgaactggagacagctgtgcctgagcagccccagcaccgtgagcgtgtggaccatcgagagaagcaaccaggagcactgcttcagagccagaagcgtgaagctgcccctggaggacggcagcttcttcaacgagaccgacgtggtgttcccccagagcctgcccaaggacctgatctacggccccgtgctgcccctgagcgccatcgccggcctggtgggcaaggaggccgagaccttcagacccaaggacgacctgtaccccctgctgcaccccaccatgcactgctggacccccaccagcgacctgtacatcggctgcgaggagggccacctgctgatgatcaacggcgacaccctgcaggtgaccgtgctgaacaagatcgaggaggagagccccctggaggacagaagaaacttcatcagccccgtgaccctggtgtaccagaaggagggcgtgctggccagcggcatcgacggcttcgtgtacagcttcatcatcaaggacagaagctacatgatcgaggacttcctggagatcgagagacccgtggagcacatgaccttcagccccaactacaccgtgctgctgatccagaccgacaagggcagcgtgtacatctacaccttcggcaaggagcccaccctgaacaaggtgctggacgcctgcgacggcaagttccaggccatcgacttcatcacccccggcacccagtacttcatgaccctgacctacagcggcgagatctgcgtgtggtggctggaggactgcgcctgcgtgagcaagatctacctgaacaccctggccaccgtgctggcctgctgccccagcagcctgagcgccgccgtgggcaccgaggacggcagcgtgtacttcatcagcgtgtacgacaaggagagcccccaggtggtgcacaaggccttcctgagcgagagcagcgtgcagcacgtggtgtacgaccagcagggcatcttcctgctggtgggcaccgccgagggcaaggtgttcatcatcaacgccaacagcagcagcagcttccagatcatcggcttcaccgaggtggccaaggacatcctgcagatcagcaccgtgagcctgctggagaccgacatcgtggaggtgatggtgctgagcagcctgcccgaggccggcagaagcagactggagatgttcaccctgcccaccctgctgccccaggtgagcaccaccttcgccgacgagagaggcagactgaaggacgagatcatccacaagtacctgtacgagctggagcacgccctgagcagcgccgtgctgggcttccagagcaaccagatctacggcttctgcagccaggtgccctacatctgcagctacctgctgcccgaggaggagcacaccggcatctacatcctgaagccctacaagaaggtgcagagcagacagtacggccccggcctgctgtacctgagcagccacggcctgtggctgatcaccatcgccaagtgcggcatcctgtgcatcagagacgtgtacaccctggagaccttcgcctggtgcagaagccacagccaccagggccacggcatccagagcatgagaatcagcatggacggccagaacatcctggtgaacggcagagacgacggcaccctggtgtacctgaagtggaagagattcggcggccacctggccagcgagatcctggactactaccagaagctgctgatcagcctgagcagcgccatggacaaggagaaccactacctgagcaccacccccaaggtgagcgtggacctgggcagcgacagcgagcacaccaagcagaaggccagcaccgacctgagccaggacgagctggtgctgaccgacgtgaagaaggagatcccctggatccagcagaagagccaggaggccatcaagaaggaggtgaacctgttcagcaagaagagaaaggagatcaagcagggcatcaagagcctgagcaagaccatcctgaacatgatggaggagaacgacaagctggagaacatcgccaagctggaccagcaggagttcggcctggacctggaggagctggagagactgcacgacgagagccaggaggaggtggccaagatgatcaaggacgtggagatgcacaacctggccaagagctacctggccgagctgatcaaggaggagtgctggaacagcatggccgtgaagggcagagccctgaagtgcttccacatcccctgcgtggtggagaacttccccatgaaggccagaaccgtggaggagctgaaggagctggagagagtgctgcagcagaagaagatcgaggccgagtgcctgaaggtgctgttctag

SEQ ID NO: 26108 - DNA, 4998 bp, Artificial Sequence
  Description of Artificial Sequence: Synthetic coding sequence
atggcccagggcagagagagagacgagggcccccacagcgccggcggcgccagcctgagcgtgagatgggtgcagggcttccccaagcagaacgtgcacttcgtgaacgacaacaccatctgctacccctgcggcaactacgtgatcttcatcaacatcgagaccaagaagaagaccgtgctgcagtgcagcaacggcatcgtgggcgtgatggccaccaacatcccctgcgaggtggtggccttcagcgacagaaagctgaagcccctgatctacgtgtacagcttccccggcctgaccagaagaaccaagctgaagggcaacatcctgctggactacaccctgctgagcttcagctactgcggcacctacctggccagctacagcagcctgcccgagttcgagctggccctgtggaactgggagagcagcatcatcctgtgcaagaagagccagcccggcatggacgtgaaccagatgagcttcaaccccatgaactggagacagctgtgcctgagcagccccagcaccgtgagcgtgtggaccatcgagagaagcaaccaggagcactgcttcagagccagaagcgtgaagctgcccctggaggacggcagcttcttcaacgagaccgacgtggtgttcccccagagcctgcccaaggacctgatctacggccccgtgctgcccctgagcgccatcgccggcctggtgggcaaggaggccgagaccttcagacccaaggacgacctgtaccccctgctgcaccccaccatgcactgctggacccccaccagcgacctgtacatcggctgcgaggagggccacctgctgatgatcaacggcgacaccctgcaggtgaccgtgctgaacaagatcgaggaggagagccccctggacagaagaaacttcatcagccccgtgaccctggtgtaccagaaggagggcgtgctggccagcggcatcgacggcttcgtgtacagcttcatcatcaaggacagaagctacatgatcgaggacttcctggagatcgagagacccgtggagcacatgaccttcagccccaactacaccgtgctgctgatccagaccgacaagggcagcgtgtacatctacaccttcggcaaggagcccaccctgaacaaggtgctggacgcctgcgacggcaagttccaggccatcgacttcatcacccccggcacccagtacttcatgaccctgacctacagcggcgagatctgcgtgtggtggctggaggactgcgcctgcgtgagcaagatctacctgaacaccctggccaccgtgctggcctgctgccccagcagcctgagcgccgccgtgggcaccgaggacggcagcgtgtacttcatcagcgtgtacgacaaggagagcccccaggtggtgcacaaggccttcctgagcgagagcagcgtgcagcacgtggtgtacgaccagcagggcatcttcctgctggtgggcaccgccgagggcaaggtgttcatcatcaacgccaacagcagcagcagcttccagatcatcggcttcaccgaggtggccaaggacatcctgcagatcagcaccgtgagcctgctggagaccgacatcgtggaggtgatggtgctgagcagcctgcccgaggccggcagaagcagactggagatgttcaccctgcccaccctgctgccccaggtgagcaccaccttcgccgacgagagaggcagactgaaggacgagatcatccacaagtacctgtacgagctggagcacgccctgagcagcgccgtgctgggcttccagagcaaccagatctacggcttctgcagccaggtgccctacatctgcagctacctgctgcccgaggaggagcacaccggcatctacatcctgaagccctacaagaaggtgcagagcagacagtacggccccggcctgctgtacctgagcagccacggcctgtggctgatcaccatcgccaagtgcggcatcctgtgcatcagagacgtgtacaccctggagaccttcgcctggtgcagaagccacagccaccagggccacggcatccagagcatgagaatcagcatggacggccagaacatcctggtgaacggcagagacgacggcaccctggtgtacctgaagtggaagagattcggcggccacctggccagcgagatcctggactactaccagaagctgctgatcagcctgagcagcgccatggacaaggagaaccactacctgagcaccacccccaaggtgagcgtggacctgggcagcgacagcgagcacaccaagcagaaggccagcaccgacctgagccaggacgagctggtgctgaccgacgtgaagaaggagatcccctggatccagcagaagagccaggaggccatcaagaaggaggtgaacctgttcagcaagaagagaaaggagatcaagcagggcatcaagagcctgagcaagaccatcctgaacatgatggaggagaacgacaagctggagaacatcgccaagctggaccagcaggagttcggcctggacctggaggagctggagagactgcacgacgagagccaggaggaggtggccaagatgatcaaggacgtggagatgcacaacctggccaagagctacctggccgagctgatcaaggaggagtgctggaacagcatggccgtgaagggcagagccctgaagtgcttccacatcccctgcgtggtggagaacttccccatgaaggccagaaccgtggaggagctgaaggagctggagagagtgctgcagcagaagaagatcgaggccgagtgcctgaagctgagaaaggagatcgtggaggcccagagcggcgtgaagctgatcaagcagagacacgaggaggacgacgaggaggaggaggaggaggacaagaccgtgaagtacagcaacctgcccaactacctgctgggcagcctgagcaccgacttcggcgtggacaccagcctgctgagcagccagctggagctgcacagcagagaggagaagatcaaccagatcatcctgctgaaggacatcatctacaaggtgaagaccgtgttcaacaacgagttcgacgccgcctacaagcagaaggagttcgagatcgccagagtgaaggagagaaacgtgagaatcagagagatcatcctggacctggagctggaggaggccgtgtggcagcccgagttcgaggactgcgagaagcccgagagaaccctggtggtgcaggacgaggagatcaccgcccacaagcacatcaagccctggcacaaggccaaggagctgatcgtgaaccacgagaaggagcactggctgctgatccaggacgccagcaccagactgagagccctgatggacatgatgggcggcgtgctggaggtgaagaaggaggacatcctgagaatggtgatcccccagcccgccttcatggccaagcccgacgccgtgtggaccgaggaggagagaaagcagttcaaggactacgagaagaaggtgaaggagctgaacgaggagagagacaagtacagaaagagcctggaggccgagctgaagaagctgcagaacagcatccaggagagcacccaggccttcgacgagcacctgaagagactgttcgagagaagagtgaaggccgagatggtgaccaaccaggaggagctgaagatcagcaacctggccttcagcctgctgctggacgaggagctgagcagcagagagaagttcctgaacaactacctgaccagaaagcagcacgagaagagccagaccagcgaggccgtgagaaagagcagagaggacctggacgtgtgcaaggagcactacgacaacctgctggccgaggacaaggtgatggacagaagcttcaagaaggagttcagcgagatccccggccaccaggtggacatcctgtacaagctgttcaagagaagacccagaatcagcaagcagaagacccacagcgagaccaccagcgtggtgcccttcggcgagctgcccggcagcggcaagctgaacaaggacgccttcgcccagctgatgaaggccatggacgagctggacaacatcagcaacatgcccgagggcctggaccccctggtgtggaaccacttctgcatgaccagaagagccaaggtggagaacgagcagaaggtgaagcagaaggccgccgacctgctggagatggccaccttcctgcagaagagagtggaggaggaggagaaggtgcagcaggagatcgagagagtgttccacgagctgatcctgctgcaggaggagaaggtgagattccagctgaacctgaccatccagatcctgctgaagcagggccaggtggagctggagaacttccagctggtgctggagtacagcgacgccatcctgatcaacaagaacatcatcgaggacctgaacagcgtgatcagaacccagggccagaagaaggtggccagcatgatggagagcaaggacgtgcacaagagaatcctgcagatcgagtgggagcacaagaagatggagatggagagagaggacctgaaccagaaggcctgggacatccagatgctgttcttcagcagagacagacagaagtacctgaacgagcccaactacgaggccctgatcagcatccagatcggcatcatggagcagaccatcgccgtgctggacaagatgcacaagaagaacgtggagaactgcaagaagctgctgaagaagctgggcaagttcagcaaccagaaggacatcgccaactacgccctgagctgcaacctgagagaggagctggtggccgtgagcgagagaaaggacatctgcaacgccatgggcagcaagctgacctgcgagaagatcgtgaaggagagatacgagaacatgatgcagcagcagaagctgaccaacatcagcaagcagcaggccgagcagatcagcatcctgcagaccgaggtggagagactgagaatgaagaccttccccgccctggtgcagatgtag

SEQ ID NO: 26109 - DNA, 912 bp, Artificial Sequence
  Description of Artificial Sequence: Synthetic coding sequence
atggccaccaacatcccctgcgaggtggtggccttcagcgacagaaagctgaagcccctgatctacgtgtacagcttccccggcctgaccagaagaaccaagctgaagggcaacatcctgctggactacaccctgctgagcttcagctactgcggcacctacctggccagctacagcagcctgcccgagttcgagctggccctgtggaactgggagagcagcatcatcctgtgcaagaagagccagcccggcatggacgtgaaccagatgagcttcaaccccatgaactggagacagctgtgcctgagcagccccagcaccgtgagcgtgtggaccatcgagagaagcaaccaggagcactgcttcagagccagaagcgtgaagctgcccctggaggacggcagcttcttcaacgagaccgacgtggtgttcccccagagcctgcccaaggacctgatctacggccccgtgctgcccctgagcgccatcgccggcctggtgggcaaggaggccgagaccttcagacccaaggacgacctgtaccccctgctgcaccccaccatgcactgctggacccccaccagcgacctgtacatcggctgcgaggagggccacctgctgatgatcaacggcgacaccctgcaggtgaccgtgctgaacaagatcgaggaggagagccccctggaggacagaagaaacttcatcagccccgtgaccctggtgtaccagaaggagggcgtgctggccagcggcatcgacggcttcgtgtacagcttcatcatcaaggacagaagctacatgatcgaggacttcctggagatcgagagacccgtggagcacatgaccttcagccccaactacaccgtgctgctgatccagaccgacaaggtgtgctggatggtgatcagctag

SEQ ID NO: 26110 - DNA, 1239 bp, Artificial Sequence
  Description of Artificial Sequence: Synthetic coding sequence
atggccaccaacatcccctgcgaggtggtggccttcagcgacagaaagctgaagcccctgatctacgtgtacagcttccccggcctgaccagaagaaccaagctgaagggcaacatcctgctggactacaccctgctgagcttcagctactgcggcacctacctggccagctacagcagcctgcccgagttcgagctggccctgtggaactgggagagcagcatcatcctgtgcaagaagagccagcccggcatggacgtgaaccagatgagcttcaaccccatgaactggagacagctgtgcctgagcagccccagcaccgtgagcgtgtggaccatcgagagaagcaaccaggagcactgcttcagagccagaagcgtgaagctgcccctggaggacggcagcttcttcaacgagaccgacgtggtgttcccccagagcctgcccaaggacctgatctacggccccgtgctgcccctgagcgccatcgccggcctggtgggcaaggaggccgagaccttcagacccaaggacgacctgtaccccctgctgcaccccaccatgcactgctggacccccaccagcgacctgtacatcggctgcgaggagggccacctgctgatgatcaacggcgacaccctgcaggtgaccgtgctgaacaagatcgaggaggagagccccctggaggacagaagaaacttcatcagccccgtgaccctggtgtaccagaaggagggcgtgctggccagcggcatcgacggcttcgtgtacagcttcatcatcaaggacagaagctacatgatcgaggacttcctggagatcgagagacccgtggagcacatgaccttcagccccaactacaccgtgctgctgatccagaccgacaagggcagcgtgtacatctacaccttcggcaaggagcccaccctgaacaaggtgctggacgcctgcgacggcaagttccaggccatcgacttcatcacccccggcacccagtacttcatgaccctgacctacagcggcgagatctgcgtgtggtggctggaggactgcgcctgcgtgagcaagatctacctgaacaccctggccaccgtgctggcctgctgccccagcagcctgagcgccgccgtgggcaccgaggacggcagcgtgtacttcatcagcgtgtacgacaaggagagcccccaggtggtgcacaaggccttcctgagcgagagcagcgtgcagcacgtggtgtag

SEQ ID NO: 26111 - DNA, 4914 bp, Artificial Sequence
  Description of Artificial Sequence: Synthetic coding sequence
atggcccagggcagagagagagacgagggcccccacagcgccggcggcgccagcctgagcgtgagatgggtgcagggcttccccaagcagaacgtgcacttcgtgaacgacaacaccatctgctacccctgcggcaactacgtgatcttcatcaacatcgagaccaagaagaagaccgtgctgcagtgcagcaacggcatcgtgggcgtgatggccaccaacatcccctgcgaggtggtggccttcagcgacagaaagctgaagcccctgatctacgtgtacagcttccccggcctgaccagaagaaccaagctgaagggcaacatcctgctggactacaccctgctgagcttcagctactgcggcacctacctggccagctacagcagcctgcccgagttcgagctggccctgtggaactgggagagcagcatcatcctgtgcaagaagagccagcccggcatggacgtgaaccagatgagcttcaaccccatgaactggagacagctgtgcctgagcagccccagcaccgtgagcgtgtggaccatcgagagaagcaaccaggagcactgcttcagagccagaagcgtgaagctgcccctggaggacggcagcttcttcaacgagaccgacgtggtgttcccccagagcctgcccaaggacctgatctacggccccgtgctgcccctgagcgccatcgccggcctggtgggcaaggaggccgagaccttcagacccaaggacgacctgtaccccctgctgcaccccaccatgcactgctggacccccaccagcgacctgtacatcggctgcgaggagggccacctgctgatgatcaacggcgacaccctgcaggtgaccgtgctgaacaagatcgaggaggagagccccctggaggacagaagaaacttcatcagccccgtgaccctggtgtaccagaaggagggcgtgctggccagcggcatcgacggcttcgtgtacagcttcatcatcaaggacagaagctacatgatcgaggacttcctggagatcgagagacccgtggagcacatgaccttcagccccaactacaccgtgctgctgatccagaccgacaagggcagcgtgtacatctacaccttcggcaaggagcccaccctgaacaaggtgctggacgcctgcgacggcaagttccaggccatcgacttcatcacccccggcacccagtacttcatgaccctgacctacagcggcgagatctgcgtgtggtggctggaggactgcgcctgcgtgagcaagatctacctgaacaccctggccaccgtgctggcctgctgccccagcagcctgagcgccgccgtgggcaccgaggacggcagcgtgtacttcatcagcgtgtacgacaaggagagcccccaggtggtgcacaaggccttcctgagcgagagcagcgtgcagcacgtggtgtacgaccagcagggcatcttcctgctggtgggcaccgccgagggcaaggtgttcatcatcaacgccaacagcagcagcagcttccagatcatcggcttcaccgaggtggccaaggacatcctgcagatcagcaccgtgagcctgctggagaccgacatcgtggaggtgatggtgctgagcagcctgcccgaggccggcagaagcagactggagatgttcaccctgcccaccctgctgccccaggtgagcaccaccttcgccgacgagagaggcagactgaaggacgagatcatccacaagtacctgtacgagctggagcacgccctgagcagcgccgtgctgggcttccagagcaaccagatctacggcttctgcagccaggtgccctacatctgcagctacctgctgcccgaggaggagcacaccggcatctacatcctgaagccctacaagaaggtgcagagcagacagtacggccccggcctgctgtacctgagcagccacggcctgtggctgatcaccatcgccaagtgcggcatcctgtgcatcagagacgtgtacaccctggagaccttcgcctggtgcagaagccacagccaccagggccacggcatccagagcatgagaatcagcatggacggccagaacatcctggtgaacggcagagacgacggcaccctggtgtacctgaagtggaagagattcggcggccacctggccagcgagatcctggactactaccagaagctgctgatcagcctgagcagcgccatggacaaggagaaccactacctgagcaccacccccaaggtgagcgtggacctgggcagcgacagcgagcacaccaagcagaaggccagcaccgacctgagccaggacgagctggtgctgaccgacgtgaagaaggagatcccctggatccagcagaagagccaggaggccatcaagaaggaggtgaacctgttcagcaagaagagaaaggagatcaagcagggcatcaagagcctgagcaagaccatcctgaacatgatggaggagaacgacaagctggagaacatcgccaagctggaccagcaggagttcggcctggacctggaggagctggagagactgcacgacgagagccaggaggaggtggccaagatgatcaaggacgtggagatgcacaacctggccaagagctacctggccgagctgatcaaggaggagtgctggaacagcatggccgtgaagggcagagccctgaagtgcttccacatcccctgcgtggtggagaacttccccatgaaggccagaaccgtggaggagctgaaggagctggagagagtgctgcagcagaagaagatcgaggccgagtgcctgaagctgagaaaggagatcgtggaggcccagagcggcgtgaagctgatcaagcagagacacgaggaggacgacgaggaggaggaggaggaggacaagaccgtgaagtacagcaacctgcccaactacctgctgggcagcctgagcaccgacttcggcgtggacaccagcctgctgagcagccagctggagctgcacagcagagaggagaagatcaaccagatcatcctgctgaaggacatcatctacaaggtgaagaccgtgttcaacaacgagttcgacgccgcctacaagcagaaggagttcgagatcgccagagtgaaggagagaaacgtgagaatcagagagatcatcctggacctggagctggaggaggccgtgtggcagcccgagttcgaggactgcgagaagcccgagagaaccctggtggtgcaggacgaggagatcaccgcccacaagcacatcaagccctggcacaaggccaaggagctgatcgtgaaccacgagaaggagcactggctgctgatccaggacgccagcaccagactgagagccctgatggacatgatgggcggcgtgctggaggtgaagaaggaggacatcctgagaatggtgatcccccagcccgccttcatggccaagcccgacgccgtgtggaccgaggaggagagaaagcagttcaaggactacgagaagaaggtgaaggagctgaacgaggagagagacaagtacagaaagagcctggaggccgagctgaagaagctgcagaacagcatccaggagagcacccaggccttcgacgagcacctgaagagactgttcgagagaagagtgaaggccgagatggtgaccaaccaggaggagctgaagatcagcaacctggccttcagcctgctgctggacgaggagctgagcagcagagagaagttcctgaacaactacctgaccagaaagcagcacgagaaggtgatggacagaagcttcaagaaggagttcagcgagatccccggccaccaggtggacatcctgtacaagctgttcaagagaagacccagaatcagcaagcagaagacccacagcgagaccaccagcgtggtgcccttcggcgagctgcccggcagcggcaagctgaacaaggacgccttcgcccagctgatgaaggccatggacgagctggacaacatcagcaacatgcccgagggcctggaccccctggtgtggaaccacttctgcatgaccagaagagccaaggtggagaacgagcagaaggtgaagcagaaggccgccgacctgctggagatggccaccttcctgcagaagagagtggaggaggaggagaaggtgcagcaggagatcgagagagtgttccacgagctgatcctgctgcaggaggagaaggtgagattccagctgaacctgaccatccagatcctgctgaagcagggccaggtggagctggagaacttccagctggtgctggagtacagcgacgccatcctgatcaacaagaacatcatcgaggacctgaacagcgtgatcagaacccagggccagaagaaggtggccagcatgatggagagcaaggacgtgcacaagagaatcctgcagatcgagtgggagcacaagaagatggagatggagagagaggacctgaaccagaaggcctgggacatccagatgctgttcttcagcagagacagacagaagtacctgaacgagcccaactacgaggccctgatcagcatccagatcggcatcatggagcagaccatcgccgtgctggacaagatgcacaagaagaacgtggagaactgcaagaagctgctgaagaagctgggcaagttcagcaaccagaaggacatcgccaactacgccctgagctgcaacctgagagaggagctggtggccgtgagcgagagaaaggacatctgcaacgccatgggcagcaagctgacctgcgagaagatcgtgaaggagagatacgagaacatgatgcagcagcagaagctgaccaacatcagcaagcagcaggccgagcagatcagcatcctgcagaccgaggtggagagactgagaatgaagaccttccccgccctggtgcagatgtag

SEQ ID NO: 26112 - DNA, 2994 bp, Artificial Sequence
  Description of Artificial Sequence: Synthetic coding sequence
tgacccggcctgctgtacctgagcagccacggcctgtggctgatcaccatcgccaagtgcggcatcctgtgcatcagagacgtgtacaccctggagaccttcgcctggtgcagaagccacagccaccagggccacggcatccagagcatgagaatcagcatggacggccagaacatcctggtgaacggcagagacgacggcaccctggtgtacctgaagtggaagagattcggcggccacctggccagcgagatcctggactactaccagaagctgctgatcagcctgagcagcgccatggacaaggagaaccactacctgagcaccacccccaaggtgagcgtggacctgggcagcgacagcgagcacaccaagcagaaggccagcaccgacctgagccaggacgagctggtgctgaccgacgtgaagaaggagatcccctggatccagcagaagagccaggaggccatcaagaaggaggtgaacctgttcagcaagaagagaaaggagatcaagcagggcatcaagagcctgagcaagaccatcctgaacatgatggaggagaacgacaagctggagaacatcgccaagctggaccagcaggagttcggcctggacctggaggagctggagagactgcacgacgagagccaggaggaggtggccaagatgatcaaggacgtggagatgcacaacctggccaagagctacctggccgagctgatcaaggaggagtgctggaacagcatggccgtgaagggcagagccctgaagtgcttccacatcccctgcgtggtggagaacttccccatgaaggccagaaccgtggaggagctgaaggagctggagagagtgctgcagcagaagaagatcgaggccgagtgcctgaagctgagaaaggagatcgtggaggcccagagcggcgtgaagctgatcaagcagagacacgaggaggacgacgaggaggaggaggaggaggacaagaccgtgaagtacagcaacctgcccaactacctgctgggcagcctgagcaccgacttcggcgtggacaccagcctgctgagcagccagctggagctgcacagcagagaggagaagatcaaccagatcatcctgctgaaggacatcatctacaaggtgaagaccgtgttcaacaacgagttcgacgccgcctacaagcagaaggagttcgagatcgccagagtgaaggagagaaacgtgagaatcagagagatcatcctggacctggagctggaggaggccgtgtggcagcccgagttcgaggactgcgagaagcccgagagaaccctggtggtgcaggacgaggagatcaccgcccacaagcacatcaagccctggcacaaggccaaggagctgatcgtgaaccacgagaaggagcactggctgctgatccaggacgccagcaccagactgagagccctgatggacatgatgggcggcgtgctggaggtgaagaaggaggacatcctgagaatggtgatcccccagcccgccttcatggccaagcccgacgccgtgtggaccgaggaggagagaaagcagttcaaggactacgagaagaaggtgaaggagctgaacgaggagagagacaagtacagaaagagcctggaggccgagctgaagaagctgcagaacagcatccaggagagcacccaggccttcgacgagcacctgaagagactgttcgagagaagagtgaaggccgagatggtgaccaaccaggaggagctgaagatcagcaacctggccttcagcctgctgctggacgaggagctgagcagcagagagaagttcctgaacaactacctgaccagaaagcagcacgagaaggtgatggacagaagcttcaagaaggagttcagcgagatccccggccaccaggtggacatcctgtacaagctgttcaagagaagacccagaatcagcaagcagaagacccacagcgagaccaccagcgtggtgcccttcggcgagctgcccggcagcggcaagctgaacaaggacgccttcgcccagctgatgaaggccatggacgagctggacaacatcagcaacatgcccgagggcctggaccccctggtgtggaaccacttctgcatgaccagaagagccaaggtggagaacgagcagaaggtgaagcagaaggccgccgacctgctggagatggccaccttcctgcagaagagagtggaggaggaggagaaggtgcagcaggagatcgagagagtgttccacgagctgatcctgctgcaggaggagaaggtgagattccagctgaacctgaccatccagatcctgctgaagcagggccaggtggagctggagaacttccagctggtgctggagtacagcgacgccatcctgatcaacaagaacatcatcgaggacctgaacagcgtgatcagaacccagggccagaagaaggtggccagcatgatggagagcaaggacgtgcacaagagaatcctgcagatcgagtgggagcacaagaagatggagatggagagagaggacctgaaccagaaggcctgggacatccagatgctgttcttcagcagagacagacagaagtacctgaacgagcccaactacgaggccctgatcagcatccagatcggcatcatggagcagaccatcgccgtgctggacaagatgcacaagaagaacgtggagaactgcaagaagctgctgaagaagctgggcaagttcagcaaccagaaggacatcgccaactacgccctgagctgcaacctgagagaggagctggtggccgtgagcgagagaaaggacatctgcaacgccatgggcagcaagctgacctgcgagaagatcgtgaaggagagatacgagaacatgatgcagcagcagaagctgaccaacatcagcaagcagcaggccgagcagatcagcatcctgcagaccgaggtggagagactgagaatgaagaccttccccgccctggtgcagatgtag

SEQ ID NO: 26113 - DNA, 1545 bp, Artificial Sequence
  Description of Artificial Sequence: Synthetic coding sequence
tgatggaccgaggaggagagaaagcagttcaaggactacgagaagaaggtgaaggagctgaacgaggagagagacaagtacagaaagagcctggaggccgagctgaagaagctgcagaacagcatccaggagagcacccaggccttcgacgagcacctgaagagactgttcgagagaagagtgaaggccgagatggtgaccaaccaggaggagctgaagatcagcaacctggccttcagcctgctgctggacgaggagctgagcagcagagagaagttcctgaacaactacctgaccagaaagcagcacgagaagagccagaccagcgaggccgtgagaaagagcagagaggacctggacgtgtgcaaggagcactacgacaacctgctggccgaggacaaggtgatggacagaagcttcaagaaggagttcagcgagatccccggccaccaggtggacatcctgtacaagctgttcaagagaagacccagaatcagcaagcagaagacccacagcgagaccaccagcgtggtgcccttcggcgagctgcccggcagcggcaagctgaacaaggacgccttcgcccagctgatgaaggccatggacgagctggacaacatcagcaacatgcccgagggcctggaccccctggtgtggaaccacttctgcatgaccagaagagccaaggtggagaacgagcagaaggtgaagcagaaggccgccgacctgctggagatggccaccttcctgcagaagagagtggaggaggaggagaaggtgcagcaggagatcgagagagtgttccacgagctgatcctgctgcaggaggagaaggtgagattccagctgaacctgaccatccagatcctgctgaagcagggccaggtggagctggagaacttccagctggtgctggagtacagcgacgccatcctgatcaacaagaacatcatcgaggacctgaacagcgtgatcagaacccagggccagaagaaggtggccagcatgatggagagcaaggacgtgcacaagagaatcctgcagatcgagtgggagcacaagaagatggagatggagagagaggacctgaaccagaaggcctgggacatccagatgctgttcttcagcagagacagacagaagtacctgaacgagcccaactacgaggccctgatcagcatccagatcggcatcatggagcagaccatcgccgtgctggacaagatgcacaagaagaacgtggagaactgcaagaagctgctgaagaagctgggcaagttcagcaaccagaaggacatcgccaactacgccctgagctgcaacctgagagaggagctggtggccgtgagcgagagaaaggacatctgcaacgccatgggcagcaagctgacctgcgagaagatcgtgaaggagagatacgagaacatgatgcagcagcagaagctgaccaacatcagcaagcagcaggccgagcagatcagcatcctgcagaccgaggtggagagactgagaatgaagaccttccccgccctggtgcagatgtag

SEQ ID NO: 26114 - DNA, 1965 bp, Artificial Sequence
  Description of Artificial Sequence: Synthetic coding sequence
atggcccccctggtgcccggcccccccctggaggccagccccaccaccctggacgccgccgtgagatggggcctgcagagacccgtgagaggccacatggcccccggccaggccggcggcagaggcgacgccagcgccctgggcgcccagtacagctgggccagagacggcagaagcgccgtgggcagcaagctgagctgggtgggccccgccgcccccgagagcaaggccgcccagggcagagagatgggcagagacgtgggcaaggccgtggactgcctggacctgagcggccccgacggcgccagctgcctgcagctgagcctgagaaagagcgagctgttccccgccgccagaagacccggcagacccgccgaccccggcctgagccccagatgcctgagaagaccccccctgagacccggccccgccagcacccccctgagaggccccggcgccgccagacccccccccctgcccccccacagcagaggcagaagcgccgtgagcttcctggccttcctgcccccccagagaagccccagcgcccccagagaggccgccggcagcagaggcggcctgagagccagcggcggcagatgcggcggccccgccggcgccgccgccggcagcggcggcggcggcgacgcccccggccccgccggcagagccatgcagagaagcagagccggcgccgacgaggccgccctgctgctggccggcctggccctgagagagctggagcccggctgcggcagccccggcagaggcagaagaggccccagacccggccccggcgacgaggccgcccccgccctgggcagaagaggcaagggcagcggcggccccgaggccggcgccgacggcctgagcagaggcgagagaggccccagaagagccgccgtgcccgagctgagcgcccagcccgccggcagccccagagccagcctggccggcagcgacggcggcggcggcggcggcagcgccagaagcagcggcatcagcctgggctacgaccagagacacggcagccccagaagcggcagaagcgaccccagacccggccccggcccccccagcgtgggcagcgccagaagcagcgtgagcagcctgggcagcagaggcagcgccggcgcctacgccgacttcctgccccccggcgcctgccccgcccccgccagaagccccgagcccgccggccccgcccccttccccctgcccgccctgcccctgccccccggcagagagggcggccccagcgccgccgagagaagactggaggccctgaccagagagctggagagagccctggaggccagaaccgccagagactacttcggcatctgcatcaagtgcggcctgggcatctacggcgcccagcaggcctgccaggccatgggcagcctgtaccacaccgactgcttcacctgcgacagctgcggcagaagactgagaggcaaggccttctacaacgtgggcgagaaggtgtactgccaggaggacttcctgtacagcggcttccagcagaccgccgacaagtgcagcgtgtgcggccacctgatcatggagatgatcctgcaggccctgggcaagagctaccaccccggctgcttcagatgcagcgtgtgcaacgagtgcctggacggcgtgcccttcaccgtggacgtggagaacaacatctactgcgtgagagactaccacaccgtgttcgcccccaagtgcgccagctgcgccagacccatcctgcccgcccagggctgcgagaccaccatcagagtggtgagcatggacagagactaccacgtggcctgctaccactgcgaggactgcggcctgcagctgagcggcgaggagggcagaagatgctaccccctggccggccacctgctgtgcagaagatgccacctgagaagactgcagcccggccccctgcccagccccaccgtgcacgtgaccgagctgtag

SEQ ID NO: 26115 - DNA, 5403 bp, Artificial Sequence
  Description of Artificial Sequence: Synthetic coding sequence
atggccaccgacagcggcgaccccgccagcaccgaggacagcgagaagcccgacggcatcagcttcgagaacagagtgccccaggtggccgccaccctgaccgtggaggccagactgaaggagaagaacagcaccttcagcgccagcggcgagaccgtggagagaaagagattcttcagaaagagcgtggagatgaccgaggacgacaaggtggccgagagcagccccaaggacgagagaatcaaggccgccatgaacatccccagagtggacaagctgcccagcaacgtgctgagaggcggccaggaggtgaagtacgagcagtgcagcaagagcaccagcgagatcagcaaggactgcttcaaggagaagaacgagaaggagatggaggaggaggccgagatgaaggccgtggccaccagccccagcggcagattcctgaagttcgacatcgagctgggcagaggcgccttcaagaccgtgtacaagggcctggacaccgagacctgggtggaggtggcctggtgcgagctgcaggacagaaagctgaccaaggccgagcagcagagattcaaggaggaggccgagatgctgaagggcctgcagcaccccaacatcgtgagattctacgacagctgggagagcatcctgaagggcaagaagtgcatcgtgctggtgaccgagctgatgaccagcggcaccctgaagacctacctgaagagattcaaggtgatgaagcccaaggtgctgagaagctggtgcagacagatcctgaagggcctgcagttcctgcacaccagaaccccccccatcatccacagagacctgaagtgcgacaacatcttcatcaccggccccaccggcagcgtgaagatcggcgacctgggcctggccaccctgatgagaaccagcttcgccaagagcgtgatcggcacccccgagttcatggcccccgagatgtacgaggagcactacgacgagagcgtggacgtgtacgccttcggcatgtgcatgctggagatggccaccagcgagtacccctacagcgagtgccagaacgccgcccagatctacagaaaggtgaccagcggcatcaagcccgccagcttcaacaaggtgaccgaccccgaggtgaaggagatcatcgagggctgcatcagacagaacaagagcgagagactgagcatcagagacctgctgaaccacgccttcttcgccgaggacaccggcctgagagtggagctggccgaggaggacgactgcagcaacagcagcctggccctgagactgtgggtggaggaccccaagaagctgaagggcaagcacaaggacaacgaggccatcgagttcagcttcaacctggagaccgacacccccgaggaggtggcctacgagatggtgaagagcggcttcttccacgagagcgacagcaaggccgtggccaagagcatcagagacagagtgacccccatcaagaagaccagagagaagaagcccgccggctgcctggaggagagaagagacagccagtgcaagagcatgggcaacgtgttcccccagccccagaacaccaccctgcccctggcccccgcccagcagaccggcgccgagtgcgaggagaccgaggtggaccagcacgtgagacagcagctgctgcagagaaagccccagcagcactgcagcagcgtgaccggcgacaacctgagcgaggccggcgccgccagcgtgatccacagcgacaccagcagccagcccagcgtggcctacagcagcaaccagaccatgggcagccagatggtgagcaacatcccccaggccgaggtgaacgtgcccggccagatctacagcagccagcagctggtgggccactaccagcaggtgagcggcctgcagaagcacagcaagctgacccagccccagatcctgcccctggtgcagggccagagcaccgtgctgcccgtgcacgtgctgggccccaccgtggtgagccagccccaggtgagccccctgaccgtgcagaaggtgccccagatcaagcccgtgagccagcccgtgggcgccgagcagcaggccgccctgctgaagcccgacctggtgagaagcctgaaccaggacgtggccaccaccaaggagaacgtgagcagccccgacaaccccagcggcaacggcaagcaggacagaatcaagcagagaagagccagctgccccagacccgagaagggcaccaagttccagctgaccgtgctgcaggtgagcaccagcggcgacaacatggtggagtgccagctggagacccacaacaacaagatggtgaccttcaagttcgacgtggacggcgacgcccccgaggacatcgccgactacatggtggaggacaacttcgtgctggagagcgagaaggagaagttcgtggaggagctgagagccatcgtgggccaggcccaggagatcctgcacgtgcacttcgccaccgagagagccaccggcgtggacagcatcaccgtggacagcaacagcagccagaccggcagcagcgagcaggtgcagatcaacagcaccagcacccagaccagcaacgagagcgccccccagagcagccccgtgggcagatggagattctgcatcaaccagaccatcagaaacagagagacccagagcccccccagcctgcagcacagcatgagcgccgtgcccggcagacaccccctgcccagccccaagaacaccagcaacaaggagatcagcagagacaccctgctgaccatcgagaacaacccctgccacagagccctgttcaccagcaagagcgagcacaaggacgtggtggacggcaagatcagcgagtgcgccagcgtggagaccaagcagcccgccatcctgtaccaggtggaggacaacagacagatcatggcccccgtgaccaacagcagcagctacagcaccaccagcgtgagagccgtgcccgccgagtgcgagggcctgaccaagcaggccagcatcttcatccccgtgtacccctgccaccagaccgccagccaggccgacgccctgatgagccaccccggcgagagcacccagaccagcggcaacagcctgaccaccctggccttcgaccagaagccccagaccctgagcgtgcagcagcccgccatggacgccgagttcatcagccaggagggcgagaccaccgtgaacaccgaggccagcagccccaagaccgtgatccccacccagacccccggcctggagcccaccaccctgcagcccaccaccgtgctggagagcgacggcgagagaccccccaagctggagttcgccgacaacagaatcaagaccctggacgagaagctgagaaacctgctgtaccaggagcacagcatcagcagcatctaccccgagagccagaaggacacccagagcatcgacagccccttcagcagcagcgccgaggacaccctgagctgccccgtgaccgaggtgatcgccatcagccactgcggcatcaaggacagccccgtgcagagccccaacttccagcagaccggcagcaagctgctgagcaacgtggccgccagccagcccgccaacatcagcgtgttcaagagagacctgaacgtgatcaccagcgtgcccagcgagctgtgcctgcacgagatgagcagcgacgccagcctgcccggcgaccccgaggcctaccccgccgccgtgagcagcggcggcgccatccacctgcagaccggcggcggctacttcggcctgagcttcacctgccccagcctgaagaaccccatcagcaagaagagctggaccagaaagctgaagagctgggcctacagactgagacagagcaccagcttcttcaagagaagcaaggtgagacaggtggagaccgaggagatgagaagcgccatcgcccccgaccccatccccctgaccagagagagcaccgccgacaccagagccctgaacagatgcaaggccatgagcggcagcttccagagaggcagattccaggtgatcaccatcccccagcagcagagcgccaagatgaccagcttcggcatcgagcacatcagcgtgttcagcgagaccaaccacagcagcgaggaggccttcatcaagaccgccaagagccagctggtggagatcgagcccgccacccagaaccccaagaccagcttcagctacgagaagctgcaggccctgcaggagacctgcaaggagaacaagggcgtgcccaagcagggcgacaacttcctgagcttcagcgccgcctgcgagaccgacgtgagcagcgtgacccccgagaaggagttcgaggagaccagcgccaccggcagcagcatgcagagcggcagcgagctgctgctgaaggagagagagatcctgaccgccggcaagcagcccagcagcgacagcgagttcagcgccagcctggccggcagcggcaagagcgtggccaagaccggccccgagagcaaccagtgcctgccccaccacgaggagcaggcctacgcccagacccagagcagcctgttctacagccccagcagccccatgagcagcgacgacgagagcgagatcgaggacgaggacctgaaggtggagctgcagagactgagagagaagcacatccaggaggtggtgaacctgcagacccagcagaacaaggagctgcaggagctgtacgagagactgagaagcatcaaggacagcaagacccagagcaccgagatccccctgccccccgccagccccagaagacccagaagcttcaagagcaagctgagaagcagaccccagagcctgacccacgtggacaacggcatcgtggccaccggcaagagctgcctgatcaacgagctggagaaccccctgtgcgtggagagcaacgccgccagctgccagcagagccccgccagcaagaagggcatgttcaccgacgacctgcacaagctggtggacgactggaccaaggaggccgtgggcaacagcctgatcaagcccagcctgaaccagctgaagcagagccagcacaagctggagaccgagaactggaacaaggtgagcgagaacacccccagcaccatgggctacaccagcacctggatcagcagcctgagccagatcagaggcgccgtgcccaccagcctgccccagggcctgagcctgcccagcttccccggccccctgagcagctacggcatgccccacgtgtgccagtacaacgccgtggccggcgccggctaccccgtgcagtgggtgggcatcagcggcaccacccagcagagcgtggtgatccccgcccagagcggcggccccttccagcccggcatgaacatgcaggccttccccaccagcagcgtgcagaaccccgccaccatcccccccggccccaagtag

SEQ ID NO: 26116 - DNA, 1065 bp, Artificial Sequence
  Description of Artificial Sequence: Synthetic coding sequence
atgcagggcctgctgttcagcaccctgctgctggccggcctggcccagttctgctgcagagtgcagggcaccggccccctggacaccacccccgagggcagacccggcgaggtgagcgacgccccccagagaaagcagttctgccactggccctgcaagtgcccccagcagaagcccagatgcccccccggcgtgagcctggtgagagacggctgcggctgctgcaagatctgcgccaagcagcccggcgagatctgcaacgaggccgacctgtgcgacccccacaagggcctgtactgcgactacagcgtggacagacccagatacgagaccggcgtgtgcgcctacctggtggccgtgggctgcgagttcaaccaggtgcactaccacaacggccaggtgttccagcccaaccccctgttcagctgcctgtgcgtgagcggcgccatcggctgcacccccctgttcatccccaagctggccggcagccactgcagcggcgccaagggcggcaagaagagcgaccagagcaactgcagcctggagcccctgctgcagcagctgagcaccagctacaagaccatgcccgcctacagaaacctgcccctgatctggaagaagaagtgcctggtgcaggccaccaagtggaccccctgcagcagaacctgcggcatgggcatcagcaacagagtgaccaacgagaacagcaactgcgagatgagaaaggagaagagactgtgctacatccagccctgcgacagcaacatcctgaagaccatcaagatccccaagggcaagacctgccagcccaccttccagctgagcaaggccgagaagttcgtgttcagcggctgcagcagcacccagagctacaagcccaccttctgcggcatctgcctggacaagagatgctgcatccccaacaagagcaagatgatcaccatccagttcgactgccccaacgagggcagcttcaagtggaagatgctgtggatcaccagctgcgtgtgccagagaaactgcagagagcccggcgacatcttcagcgagctgaagatcctgtag

SEQ ID NO: 26117 - DNA, 2139 bp, Artificial Sequence
  Description of Artificial Sequence: Synthetic coding sequence
atgctgaaggactacctgagcgtggcccaggacgccctgagaacccagaaggagctgtaccacgtgaaggagcagagactggccctggccctggacgagtacgtgagactgaacgacgcctacaaggagaagagcagcagccacaccagcctgttcagcggcagcagcagcagcaccaagtacgaccccgacatcctgaaggccgagatcagcaccaccagactgagagtgaagaagctgaagagagagctgagccagatgaagcaggagctgctgtacaaggagcagggcttcgagaccctgcagcagatcgacaagaagatgagcggcggccagagcggctacgagctgagcgaggccaaggccatcctgaccgagctgaagagcatcagaaaggccatcagcagcggcgagaaggagaagcaggacctgatgcagagcctggccaagctgcaggagagattccacctggaccagaacatcggcagaagcgagcccgacctgagatgcagccccgtgaacagccacctgtgcctgagcagacagaccctggacgccggcagccagaccagcatcagcggcgacatcggcgtgagaagcagaagcaacctggccgagaaggtgagactgagcctgcagtacgaggaggccaagagaagcatggccaacctgaagatcgagctgagcaagctggacagcgaggcctggcccggcgccctggacatcgagaaggagaagctgatgctgatcaacgagaaggaggagctgctgaaggagctgcagttcgtgaccccccagaagagaacccaggacgagctggagagactggaggccgagagacagagactggaggaggagctgctgagcgtgagaggcacccccagcagagccctggccgagagactgagactggaggagagaagaaaggagctgctgcagaagctggaggagaccaccaagctgaccacctacctgcacagccagctgaagagcctgagcgccagcaccctgagcatgagcagcggcagcagcctgggcagcctggccagcagcagaggcagcctgaacaccagcagcagaggcagcctgaacagcctgagcagcaccgagctgtactacagcagccagagcgaccagatcgacgtggactaccagtacaagctggacttcctgctgcaggagaagagcggctacatccccagcggccccatcaccaccatccacgagaacgaggtggtgaagagccccagccagcccggccagagcggcctgtgcggcgtggccgccgccgccaccggccacaccccccccctggccgaggcccccaagagcgtggccagcctgagcagcagaagcagcctgagcagcctgagcccccccggcagccccctggtgctggagggcaccttccccatgagcagcagccacgacgccagcctgcaccagttcaccgccgacttcgaggactgcgagctgagcagccacttcgccgacatcagcctgatcgagaaccagatcctgctggacagcgacagcggcggcgccagccagagcctgagcgaggacaaggacctgaacgagtgcgccagagagcccctgtacgagggcaccgccgacgtggagaagagcctgcccaagagaagagtgatccacctgctgggcgagaagaccacctgcgtgagcgccgccgtgagcgacgagagcgtggccggcgacagcggcgtgtacgaggccttcgtgaagcagcccagcgagatggaggacgtgacctacagcgaggaggacgtggccatcgtggagaccgcccaggtgcagatcggcctgagatacaacgccaagagcagcagcttcatggtgatcatcgcccagctgagaaacctgcacgccttcctgatcccccacaccagcaaggtgtacttcagagtggccgtgctgcccagcagcaccgacgtgagctgcctgttcagaaccaaggtgcacccccccaccgagagcatcctgttcaacgacgtgttcagagtggccatcagccagaccgccctgcagcagaagaccctgagaaagaacttcaccttcgtgaccgccatcacccacggcgtgtgcctgcccctgcccgtgcccatgcccagcttcgcctag

SEQ ID NO: 26118 - DNA, 3579 bp, Artificial Sequence
  Description of Artificial Sequence: Synthetic coding sequence
atgcccagaagagccggcagcggccagctgcccctgcccagaggctgggaggaggccagagactacgacggcaaggtgttctacatcgaccacaacaccagaagaaccagctggatcgaccccagagacagactgaccaagcccctgagcttcgccgactgcgtgggcgacgagctgccctggggctgggaggccggcttcgacccccagatcggcgtgtactacatcgaccacatcaacaagaccacccagatcgaggaccccagaaagcagtggagaggcgagcaggagaagatgctgaaggactacctgagcgtggcccaggacgccctgagaacccagaaggagctgtaccacgtgaaggagcagagactggccctggccctggacgagtacgtgagactgaacgacgcctacaaggagaagagcagcagccacaccagcctgttcagcggcagcagcagcagcaccaagtacgaccccgacatcctgaaggccgagatcagcaccaccagactgagagtgaagaagctgaagagagagctgagccagatgaagcaggagctgctgtacaaggagcagggcttcgagaccctgcagcagatcgacaagaagatgagcggcggccagagcggctacgagctgagcgaggccaaggccatcctgaccgagctgaagagcatcagaaaggccatcagcagcggcgagaaggagaagcaggacctgatgcagagcctggccaagctgcaggagagattccacctggaccagaacatcggcagaagcgagcccgacctgagatgcagccccgtgaacagccacctgtgcctgagcagacagaccctggacgccggcagccagaccagcatcagcggcgacatcggcgtgagaagcagaagcaacctggccgagaaggtgagactgagcctgcagtacgaggaggccaagagaagcatggccaacctgaagatcgagctgagcaagctggacagcgaggcctggcccggcgccctggacatcgagaaggagaagctgatgctgatcaacgagaaggaggagctgctgaaggagctgcagttcgtgaccccccagaagagaacccaggacgagctggagagactggaggccgagagacagagactggaggaggagctgctgagcgtgagaggcacccccagcagagccctggccgagagactgagactggaggagagaagaaaggagctgctgcagaagctggaggagaccaccaagctgaccacctacctgcacagccagctgaagagcctgagcgccagcaccctgagcatgagcagcggcagcagcctgggcagcctggccagcagcagaggcagcctgaacaccagcagcagaggcagcctgaacagcctgagcagcaccgagctgtactacagcagccagagcgaccagatcgacgtggactaccagtacaagctggacttcctgctgcaggagaagagcggctacatccccagcggccccatcaccaccatccacgagaacgaggtggtgaagagccccagccagcccggccagagcggcctgtgcggcgtggccgccgccgccaccggccacaccccccccctggccgaggcccccaagagcgtggccagcctgagcagcagaagcagcctgagcagcctgagcccccccggcagccccctggtgctggagggcaccttccccatgagcagcagccacgacgccagcctgcaccagttcaccgccgacttcgaggactgcgagctgagcagccacttcgccgacatcagcctgatcgagaaccagatcctgctggacagcgacagcggcggcgccagccagagcctgagcgaggacaaggacctgaacgagtgcgccagagagcccctgtacgagggcaccgccgacgtggagaagagcctgcccaagagaagagtgatccacctgctgggcgagaagaccacctgcgtgagcgccgccgtgagcgacgagagcgtggccggcgacagcggcgtgtacgaggccttcgtgaagcagcccagcgagatggaggacgtgacctacagcgaggaggacgtggccatcgtggagaccgcccaggtgcagatcggcctgagatacaacgccaagagcagcagcttcatggtgatcatcgcccagctgagaaacctgcacgccttcctgatcccccacaccagcaaggtgtacttcagagtggccgtgctgcccagcagcaccgacgtgagctgcctgttcagaaccaaggtgcacccccccaccgagagcatcctgttcaacgacgtgttcagagtggccatcagccagaccgccctgcagcagaagaccctgagagtggacctgtgcagcgtgagcaagcacagaagagaggagtgcctggccggcacccagatcagcctggccgacctgcccttcagcagcgaggtgttcaccctgtggtacaacctgctgcccagcaagcagatgccctgcaagaagaacgaggagaacgaggacagcgtgttccagcccaaccagcccctggtggacagcatcgacctggacgccgtgagcgccctgctggccagaaccagcgccgagctgctggccgtggagcaggagctggcccaggaggaggaggaggagagcggccaggaggagcccagaggccccgacggcgactggctgaccatgctgagagaggccagcgacgagatcgtggccgagaaggaggccgaggtgaagctgcccgaggacagcagctgcaccgaggacctgagcagctgcaccagcgtgcccgagatgaacgaggacggcaacagaaaggagagcaactgcgccaaggacctgagaagccagccccccaccagaatccccaccctggtggacaaggagaccaacaccgacgaggccgccaacgacaacatggccgtgagacccaaggagagaagcagcctgagcagcagacagcaccccttcgtgagaagcagcgtgatcgtgagaagccagaccttcagccccggcgagagaaaccagtacatctgcagactgaacagaagcgacagcgacagcagcaccctggccaagaagagcctgttcgtgagaaacagcaccgagagaagaagcctgagagtgaagagaaccgtgtgccagagcgtgctgagaagaaccacccaggagtgccccgtgagaaccagcctggacctggagctggacctgcaggccagcctgaccagacagagcagactgaacgacgagctgcaggccctgagagacctgagacagaagctggaggagctgaaggcccagggcgagaccgacctgccccccggcgtgctggaggacgagagattccagagactgctgaagcaggccgagaagcaggccgagcagagcaaggaggagcagaagcagggcctgaacgccgagaagctgatgagacaggtgagcaaggacgtgtgcagactgagagagcagagccagaaggtgcccagacaggtgcagagcttcagagagaagatcgcctacttcaccagagccaagatcagcatccccagcctgcccgccgacgacgtgtag

SEQ ID NO: 26119 - DNA, 3651 bp, Artificial Sequence
  Description of Artificial Sequence: Synthetic coding sequence
atgcccagaagagccggcagcggccagctgcccctgcccagaggctgggaggaggccagagactacgacggcaaggtgttctacatcgaccacaacaccagaagaaccagctggatcgaccccagagacagactgaccaagcccctgagcttcgccgactgcgtgggcgacgagctgccctggggctgggaggccggcttcgacccccagatcggcgtgtactacatcgaccacatcaacaagaccacccagatcgaggaccccagaaagcagtggagaggcgagcaggagaagatgctgaaggactacctgagcgtggcccaggacgccctgagaacccagaaggagctgtaccacgtgaaggagcagagactggccctggccctggacgagtacgtgagactgaacgacgcctacaaggagaagagcagcagccacaccagcctgttcagcggcagcagcagcagcaccaagtacgaccccgacatcctgaaggccgagatcagcaccaccagactgagagtgaagaagctgaagagagagctgagccagatgaagcaggagctgctgtacaaggagcagggcttcgagaccctgcagcagatcgacaagaagatgagcggcggccagagcggctacgagctgagcgaggccaaggccatcctgaccgagctgaagagcatcagaaaggccatcagcagcggcgagaaggagaagcaggacctgatgcagagcctggccaagctgcaggagagattccacctggaccagaacatcggcagaagcgagcccgacctgagatgcagccccgtgaacagccacctgtgcctgagcagacagaccctggacgccggcagccagaccagcatcagcggcgacatcggcgtgagaagcagaagcaacctggccgagaaggtgagactgagcctgcagtacgaggaggccaagagaagcatggccaacctgaagatcgagctgagcaagctggacagcgaggcctggcccggcgccctggacatcgagaaggagaagctgatgctgatcaacgagaaggaggagctgctgaaggagctgcagttcgtgaccccccagaagagaacccaggacgagctggagagactggaggccgagagacagagactggaggaggagctgctgagcgtgagaggcacccccagcagagccctggccgagagactgagactggaggagagaagaaaggagctgctgcagaagctggaggagaccaccaagctgaccacctacctgcacagccagctgaagagcctgagcgccagcaccctgagcatgagcagcggcagcagcctgggcagcctggccagcagcagaggcagcctgaacaccagcagcagaggcagcctgaacagcctgagcagcaccgagctgtactacagcagccagagcgaccagatcgacgtggactaccagtacaagctggacttcctgctgcaggagaagagcggctacatccccagcggccccatcaccaccatccacgagaacgaggtggtgaagagccccagccagcccggccagagcggcctgtgcggcgtggccgccgccgccaccggccacaccccccccctggccgaggcccccaagagcgtggccagcctgagcagcagaagcagcctgagcagcctgagcccccccggcagccccctggtgctggagggcaccttccccatgagcagcagccacgacgccagcctgcaccagttcaccgccgacttcgaggactgcgagctgagcagccacttcgccgacatcagcctgatcgagaaccagatcctgctggacagcgacagcggcggcgccagccagagcctgagcgaggacaaggacctgaacgagtgcgccagagagcccctgtacgagggcaccgccgacgtggagaagagcctgcccaagagaagagtgatccacctgctgggcgagaagaccacctgcgtgagcgccgccgtgagcgacgagagcgtggccggcgacagcggcgtgtacgaggccttcgtgaagcagcccagcgagatggaggacgtgacctacagcgaggaggacgtggccatcgtggagaccgcccaggtgcagatcggcctgagatacaacgccaagagcagcagcttcatggtgatcatcgcccagctgagaaacctgcacgccttcctgatcccccacaccagcaaggtgtacttcagagtggccgtgctgcccagcagcaccgacgtgagctgcctgttcagaaccaaggtgcacccccccaccgagagcatcctgttcaacgacgtgttcagagtggccatcagccagaccgccctgcagcagaagaccctgagagtggacctgtgcagcgtgagcaagcacagaagagaggagtgcctggccggcacccagatcagcctggccgacctgcccttcagcagcgaggtgttcaccctgtggtacaacctgctgcccagcaagcagatgccctgcaagaagaacgaggagaacgaggacagcgtgttccagcccaaccagcccctggtggacagcatcgacctggacgccgtgagcgccctgctggccagaaccagcgccgagctgctggccgtggagcaggagctggcccaggaggaggaggaggagagcggccaggaggagcccagaggccccgacggcgactggctgaacacctacttcctgtgctgctgggagctgaaggacgacgtgttcaccagactgaccgtgaagcccctgctgaccatgctgagagaggccagcgacgagatcgtggccgagaaggaggccgaggtgaagctgcccgaggacagcagctgcaccgaggacctgagcagctgcaccagcgtgcccgagatgaacgaggacggcaacagaaaggagagcaactgcgccaaggacctgagaagccagccccccaccagaatccccaccctggtggacaaggagaccaacaccgacgaggccgccaacgacaacatggccgtgagacccaaggagagaagcagcctgagcagcagacagcaccccttcgtgagaagcagcgtgatcgtgagaagccagaccttcagccccggcgagagaaaccagtacatctgcagactgaacagaagcgacagcgacagcagcaccctggccaagaagagcctgttcgtgagaaacagcaccgagagaagaagcctgagagtgaagagaaccgtgtgccagagcgtgctgagaagaaccacccaggagtgccccgtgagaaccagcctggacctggagctggacctgcaggccagcctgaccagacagagcagactgaacgacgagctgcaggccctgagagacctgagacagaagctggaggagctgaaggcccagggcgagaccgacctgccccccggcgtgctggaggacgagagattccagagactgctgaagcaggccgagaagcaggccgagcagagcaaggaggagcagaagcagggcctgaacgccgagaagctgatgagacaggtgagcaaggacgtgtgcagactgagagagcagagccagaaggtgcccagacaggtgcagagcttcagagagaagatcgcctacttcaccagagccaagatcagcatccccagcctgcccgccgacgacgtgtag

SEQ ID NO: 26120 - DNA, 963 bp, Artificial Sequence
  Description of Artificial Sequence: Synthetic coding sequence
atgcccagactgagagtgcacggcgcctgcctgcccaccaagagcgtgctgttcctgttctaccacagactgaccatgctgagagaggccagcgacgagatcgtggccgagaaggaggccgaggtgaagctgcccgaggacagcagctgcaccgaggacctgagcagctgcaccagcgtgcccgagatgaacgaggacggcaacagaaaggagagcaactgcgccaaggacctgagaagccagccccccaccagaatccccaccctggtggacaaggagaccaacaccgacgaggccgccaacgacaacatggccgtgagacccaaggagagaagcagcctgagcagcagacagcaccccttcgtgagaagcagcgtgatcgtgagaagccagaccttcagccccggcgagagaaaccagtacatctgcagactgaacagaagcgacagcgacagcagcaccctggccaagaagagcctgttcgtgagaaacagcaccgagagaagaagcctgagagtgaagagaaccgtgtgccagagcgtgctgagaagaaccacccaggagtgccccgtgagaaccagcctggacctggagctggacctgcaggccagcctgaccagacagagcagactgaacgacgagctgcaggccctgagagacctgagacagaagctggaggagctgaaggcccagggcgagaccgacctgccccccggcgtgctggaggacgagagattccagagactgctgaagcaggccgagaagcaggccgagcagagcaaggaggagcagaagcagggcctgaacgccgagaagctgatgagacaggtgagcaaggacgtgtgcagactgagagagcagagccagaaggtgcccagacaggtgcagagcttcagagagaagatcgcctacttcaccagagccaagatcagcatccccagcctgcccgccgacgacgtgtag

SEQ ID NO: 26121 - DNA, 3432 bp, Artificial Sequence
  Description of Artificial Sequence: Synthetic coding sequence
atgcccagaagagccggcagcggccagctgcccctgcccagaggctgggaggaggccagagactacgacggcaaggtgttctacatcgaccacaacaccagaagaaccagctggatcgaccccagagacagactgaccaagcccctgagcttcgccgactgcgtgggcgacgagctgccctggggctgggaggccggcttcgacccccagatcggcgtgtactacatcgaccacatcaacaagaccacccagatcgaggaccccagaaagcagtggagaggcgagcaggagaagatgctgaaggactacctgagcgtggcccaggacgccctgagaacccagaaggagctgtaccacgtgaaggagcagagactggccctggccctggacgagtacgtgagactgaacgacgcctacaaggagaagagcagcagccacaccagcctgttcagcggcagcagcagcagcaccaagtacgaccccgacatcctgaaggccgagatcagcaccaccagactgagagtgaagaagctgaagagagagctgagccagatgaagcaggagctgctgtacaaggagcagggcttcgagaccctgcagcagatcgacaagaagatgagcggcggccagagcggctacgagctgagcgaggccaaggccatcctgaccgagctgaagagcatcagaaaggccatcagcagcggcgagaaggagaagcaggacctgatgcagagcctggccaagctgcaggagagattccacctggaccagaacatcggcagaagcgagcccgacctgagatgcagccccgtgaacagccacctgtgcctgagcagacagaccctggacgccggcagccagaccagcatcagcggcgacatcggcgtgagaagcagaagcaacctggccgagaaggtgagactgagcctgcagtacgaggaggccaagagaagcatggccaacctgaagatcgagctgagcaagctggacagcgaggcctggcccggcgccctggacatcgagaaggagaagctgatgctgatcaacgagaaggaggagctgctgaaggagctgcagttcgtgaccccccagaagagaacccaggacgagctggagagactggaggccgagagacagagactggaggaggagctgctgagcgtgagaggcacccccagcagagccctggccgagagactgagactggaggagagaagaaaggagctgctgcagaagctggaggagaccaccaagctgaccacctacctgcacagccagctgaagagcctgagcgccagcaccctgagcatgagcagcggcagcagcctgggcagcctggccagcagcagaggcagcctgaacaccagcagcagaggcagcctgaacagcctgagcagcaccgagctgtactacagcagccagagcgaccagatcgacgtggactaccagtacaagctggacttcctgctgcaggagaagagcggctacatccccagcggccccatcaccaccatccacgagaacgaggtggtgaagagccccagccagcccggccagagcggcctgtgcggcgtggccgccgccgccaccggccacaccccccccctggccgaggcccccaagagcgtggccagcctgagcagcagaagcagcctgagcagcctgagcccccccggcagccccctggtgctggagggcaccttccccatgagcagcagccacgacgccagcctgcaccagttcaccgccgacttcgaggactacgtggagaagagcctgcccaagagaagagtgatccacctgctgggcgagaagaccacctgcgtgagcgccgccgtgagcgacgagagcgtggccggcgacagcggcgtgtacgaggccttcgtgaagcagcccagcgagatggaggacgtgacctacagcgaggaggacgtggccatcgtggagaccgcccaggtgcagatcggcctgagatacaacgccaagagcagcagcttcatggtgatcatcgcccagctgagaaacctgcacgccttcctgatcccccacaccagcaaggtgtacttcagagtggccgtgctgcccagcagcaccgacgtgagctgcctgttcagaaccaaggtgcacccccccaccgagagcatcctgttcaacgacgtgttcagagtggccatcagccagaccgccctgcagcagaagaccctgagagtggacctgtgcagcgtgagcaagcacagaagagaggagtgcctggccggcacccagatcagcctggccgacctgcccttcagcagcgaggtgttcaccctgtggtacaacctgctgcccagcaagcagatgccctgcaagaagaacgaggagaacgaggacagcgtgttccagcccaaccagcccctggtggacagcatcgacctggacgccgtgagcgccctgctggccagaaccagcgccgagctgctggccgtggagcaggagctggcccaggaggaggaggaggagagcggccaggaggagcccagaggccccgacggcgactggctgaccatgctgagagaggccagcgacgagatcgtggccgagaaggaggccgaggtgaagctgcccgaggacagcagctgcaccgaggacctgagcagctgcaccagcgtgcccgagatgaacgaggacggcaacagaaaggagagcaactgcgccaaggacctgagaagccagccccccaccagaatccccaccctggtggacaaggagaccaacaccgacgaggccgccaacgacaacatggccgtgagacccaaggagagaagcagcctgagcagcagacagcaccccttcgtgagaagcagcgtgatcgtgagaagccagaccttcagccccggcgagagaaaccagtacatctgcagactgaacagaagcgacagcgacagcagcaccctggccaagaagagcctgttcgtgagaaacagcaccgagagaagaagcctgagagtgaagagaaccgtgtgccagagcgtgctgagaagaaccacccaggagtgccccgtgagaaccagcctggacctggagctggacctgcaggccagcctgaccagacagagcagactgaacgacgagctgcaggccctgagagacctgagacagaagctggaggagctgaaggcccagggcgagaccgacctgccccccggcgtgctggaggacgagagattccagagactgctgaagcaggccgagaagcaggccgagcagagcaaggaggagcagaagcagggcctgaacgccgagaagctgatgagacaggtgagcaaggacgtgtgcagactgagagagcagagccagaaggtgcccagacaggtgcagagcttcagagagaagatcgcctacttcaccagagccaagatcagcatccccagcctgcccgccgacgacgtgtag

SEQ ID NO: 26122 - DNA, 315 bp, Artificial Sequence
  Description of Artificial Sequence: Synthetic coding sequence
atgaagagctgccagaagatggagggcaagcccgagaacgagagcgagcccaagcacgaggaggagcccaagcccgaggagaagcccgaggaggaggagaagctggaggaggaggccaaggccaagggcaccttcagagagagactgatccagagcctgcaggagttcaaggaggacatccacaacagacacctgagcaacgaggacatgttcagagaggtggacgagatcgacgagatcagaagagtgagaaacaagctgatcgtgatgagatggaaggtgaacagaaaccacccctacccctacctgatgtag

SEQ ID NO: 26123 - DNA, 315 bp, Artificial Sequence; identical to SEQ ID NO: 26122
  Description of Artificial Sequence: Synthetic coding sequence

SEQ ID NO: 26124 - DNA, 3279 bp, Artificial Sequence
  Description of Artificial Sequence: Synthetic coding sequence
atggaccacatcaacaagctgacccagatcgaggaccccagagagcagtggagaagagagcaggagagaatgctgaaggagtacctgatcgtggcccaggaggccctgaacgccaagaaggagatctaccagatcaagcagcagagattcgagctggcccaggaggagtaccagcagctgcacaagatgtgcgaggacgacagcagaagctacgccagcagcttcagcggctacagcaccaacaccaagtacgacccccaccagatcaaggccgagatcgccagcagaagagacagactgagcagactgaagagagagctgacccagatgaagcaggagctgcagtacaaggagaagggcgtggagaccctgcaggagatcgacagaaagatgagcagcacccacaccagctacaagctggacgaggcccaggccatcatgagcgagctgagaaccatcaagaaggccatctgcaccggcgagaaggagagaagagacctgatgcacagcctggccaagctgaccgacagcttcaagaacagctgcagcgtgaccgacagcctggtggacttcccccaccacgtgggcgtgcccggcgacgccggcgtgccccagcagttctgcgacgccggcagccagaccgacatcatcggcgagttcgtgttcgacgacaagaccagactggtggacagagtgagactgaactggcagtacgaggaggccagaaagagagtggccaacatccagcagcagctggccagactggacaacgagagctggcccagcaccgccgaggccgacagagacagactgcagctgatcaaggagaaggaggccctgctgcaggagctgcagctgatcatcgcccagagaagaagcgccggcgacgtggccagactggaggaggagagagagagactggaggaggagctgagaagagccagagccaccagcgcccagggcgccaccgagagaatcctgctgcaggagaagagaaactgcctgctgatgcagctggaggaggccaccagactgaccagctacctgcagagccagctgaagagcctgtgcgccagcaccctgaccgtgagcagcggcagcagcagaggcagcctggccagcagcagaggcagcctggccagcagcagaggcagcctgagcagcgtgagcttcaccgacatctacggcctgccccagtacgagaagcccgacgccgagggcagccagctgctgagattcgacctgatccccttcgacagcctgggcagagacgcccccttcagcgagccccccggccccagcggcttccacaagcagagaagaagcctggacaccccccagagcctggccagcctgagcagcagaagcagcctgagcagcctgagcccccccagcagccccctggacacccccttcctgcccgccagcagagacagccccctggcccagctggccgacagctgcgagggccccggcctgggcgccctggacagactgagagcccacgccagcgccatgggcgacgaggacctgcccggcatggccgccctgcagccccacggcgtgcccggcgacggcgagggcccccacgagagaggccccccccccgccagcgcccccgtgggcggcaccgtgaccctgagagaggacagcgccaagagactggagagaagagccagaagaatcagcgcctgcctgagcgactacagcctggccagcgacagcggcgtgttcgagcccctgaccaagagaaacgaggacgccgaggagcccgcctacggcgacaccgccagcaacggcgacccccagatccacgtgggcctgctgagagacagcggcagcgagtgcctgctggtgcacgtgctgcagctgaagaaccccgccggcctggccgtgaaggaggactgcaaggtgcacatcagagtgtacctgccccccctggacagcggcacccccaacacctactgcagcaaggccctggagttccaggtgcccctggtgttcaacgaggtgttcagaatccccgtgcacagcagcgccctgaccctgaagagcctgcagctgtacgtgtgcagcgtgaccccccagctgcaggaggagctgctgggcatcgcccagatcaacctggccgactacgacagcctgagcgagatgcagctgagatggcacagcgtgcaggtgttcaccagcagcgagcccagcagaaccagagaggccggctgcgccggcgagagcagcgccagagaccccgcccacaccatcagcatcagcggcaagaccgacgccgtgaccgtgctgctggccagaaccaccgcccagctgcaggccgtggagagagagctggccgaggagagagccaagctggagtacaccgaggaggaggtgctggagatggagagaaaggaggagcaggccgaggccatcagcgagagaagctggcaggccgacagcgtggacagcggctgcagcaactgcacccagaccagccccccctaccccgagccctgctgcatgggcatcgacagcatcctgggccaccccttcgccgcccaggccggcccctacagccccgagaagttccagcccagccccctgaaggtggacaaggagaccaacaccgaggacctgttcctggaggaggccgccagcctggtgaaggagagacccagcagaagagccagaggcagccccttcgtgagaagcggcaccatcgtgagaagccagaccttcagccccggcgccagaagccagtacgtgtgcagactgtacagaagcgacagcgacagcagcaccctgcccagaaagagccccttcgtgagaaacaccctggagagaagaaccctgagatacaagcagagctgcagaagcagcctggccgagctgatggccagaaccagcctggacctggagctggacctgcaggccagcagaaccagacagagacagctgaacgaggagctgtgcgccctgagagagctgagacagagactggaggacgcccagctgagaggccagaccgacctgcccccctgggtgctgagagacgagagactgagaggcctgctgagagaggccgagagacagaccagacagaccaagctggactacagacacgagcaggccgccgagaagatgctgaagaaggccagcaaggagatctaccagctgagaggccagagccacaaggagcccatccaggtgcagaccttcagagagaagatcgccttcttcaccagacccagaatcaacatcccccccctgcccgccgacgacgtgtag

SEQ ID NO: 26125 - DNA, 1749 bp, Artificial Sequence
  Description of Artificial Sequence: Synthetic coding sequence
ctgagccacatcagcgagctgacccagatcgaggaccccagagagcagtggagaagagagcaggagagaatgctgaaggagtacctgatcgtggcccaggaggccctgaacgccaagaaggagatctaccagatcaagcagcagagattcgagctggcccaggaggagtaccagcagctgcacaagatgtgcgaggacgacagcagaagctacgccagcagcttcagcggctacagcaccaacaccaagtacgacccccaccagatcaaggccgagatcgccagcagaagagacagactgagcagactgaagagagagctgacccagatgaagcaggagctgcagtacaaggagaagggcgtggagaccctgcaggagatcgacagaaagatgagcagcacccacaccagctacaagctggacgaggcccaggccatcatgagcgagctgagaaccatcaagaaggccatctgcaccggcgagaaggagagaagagacctgatgcacagcctggccaagctgaccgacagcttcaagaacagctgcagcgtgaccgacagcctggtggacttcccccaccacgtgggcgtgcccggcgacgccggcgtgccccagcagttctgcgacgccggcagccagaccgacatcatcggcgagttcgtgttcgacgacaagaccagactggtggacagagtgagactgaactggcagtacgaggaggccagaaagagagtggccaacatccagcagcagctggccagactggacaacgagagctggcccagcaccgccgaggccgacagagacagactgcagctgatcaaggagaaggaggccctgctgcaggagctgcagctgatcatcgcccagagaagaagcgccggcgacgtggccagactggaggaggagagagagagactggaggaggagctgagaagagccagagccaccagcgcccagggcgccaccgagagaatcctgctgcaggagaagagaaactgcctgctgatgcagctggaggaggccaccagactgaccagctacctgcagagccagctgaagagcctgtgcgccagcaccctgaccgtgagcagcggcagcagcagaggcagcctggccagcagcagaggcagcctggccagcagcagaggcagcctgagcagcgtgagcttcaccgacatctacggcctgccccagtacgagaagcccgacgccgagggcagccagctgctgagattcgacctgatccccttcgacagcctgggcagagacgcccccttcagcgagccccccggccccagcggcttccacaagcagagaagaagcctggacaccccccagagcctggccagcctgagcagcagaagcagcctgagcagcctgagcccccccagcagccccctggacacccccttcctgcccgccagcagagacagccccctggcccagctggccgacagctgcgagggccccggcctgggcgccctggacagactgagagcccacgccagcgccatgggcgacgaggacctgcccggcatggccgccctgcagccccacggcgtgcccggcgacggcgagggcccccacgagagaggccccccccccgccagcgcccccgtgggcggcagcaagtgcggctgcagcgacagcagcagaagacagtgccaggaggtgggcgaggagggcaccccccacctgagaatgagcgtgggcctgttcgccagccagagacagtggggcgtgtag

SEQ ID NO: 26126 - DNA, 3279 bp, Artificial Sequence; identical to SEQ ID NO: 26124
  Description of Artificial Sequence: Synthetic coding sequence

SEQ ID NO: 26127 - DNA, 639 bp, Artificial Sequence
  Description of Artificial Sequence: Synthetic coding sequence
atgcagctggaggaggccaccagactgaccagctacctgcagagccagctgaagagcctgtgcgccagcaccctgaccgtgagcagcggcagcagcagaggcagcctggccagcagcagaggcagcctggccagcagcagaggcagcctgagcagcgtgagcttcaccgacatctacggcctgccccagtacgagaagcccgacgccgagggcagccagctgctgagattcgacctgatccccttcgacagcctgggcagagacgcccccttcagcgagccccccggccccagcggcttccacaagcagagaagaagcctggacaccccccagagcctggccagcctgagcagcagaagcagcctgagcagcctgagcccccccagcagccccctggacacccccttcctgcccgccagcagagacagccccctggcccagctggccgacagctgcgagggccccggcctgggcgccctggacagactgagagcccacgccagcgccatgggcgacgaggacctgcccggcatggccgccctgcagccccacggcgtgcccggcgacggcgagggcccccacgagagaggccccccccccgccagcgcccccgtgggcggcaagatcctgaccagctag

SEQ ID NO: 26128 - DNA, 1764 bp, Artificial Sequence
  Description of Artificial Sequence: Synthetic coding sequence
atgggcgacgaggacctgcccggcatggccgccctgcagccccacggcgtgcccggcgacggcgagggcccccacgagagaggccccccccccgccagcgcccccgtgggcggcaccgtgaccctgagagaggacagcgccaagagactggagagaagagccagaagaatcagcgcctgcctgagcgactacagcctggccagcgacagcggcgtgttcgagcccctgaccaagagaaacgaggacgccgaggagcccgcctacggcgacaccgccagcaacggcgacccccagatccacgtgggcctgctgagagacagcggcagcgagtgcctgctggtgcacgtgctgcagctgaagaaccccgccggcctggccgtgaaggaggactgcaaggtgcacatcagagtgtacctgccccccctggacagcggcacccccaacacctactgcagcaaggccctggagttccaggtgcccctggtgttcaacgaggtgttcagaatccccgtgcacagcagcgccctgaccctgaagagcctgcagctgtacgtgtgcagcgtgaccccccagctgcaggaggagctgctgggcatcgcccagatcaacctggccgactacgacagcctgagcgagatgcagctgagatggcacagcgtgcaggtgttcaccagcagcgagcccagcagaaccagagaggccggctgcgccggcgagagcagcgccagagaccccgcccacaccatcagcatcagcggcaagaccgacgccgtgaccgtgctgctggccagaaccaccgcccagctgcaggccgtggagagagagctggccgaggagagagccaagctggagtacaccgaggaggaggtgctggagatggagagaaaggaggagcaggccgaggccatcagcgagagaagctggcaggccgacagcgtggacagcggctgcagcaactgcacccagaccagccccccctaccccgagccctgctgcatgggcatcgacagcatcctgggccaccccttcgccgcccaggccggcccctacagccccgagaagttccagcccagccccctgaaggtggacaaggagaccaacaccgaggacctgttcctggaggaggccgccagcctggtgaaggagagacccagcagaagagccagaggcagccccttcgtgagaagcggcaccatcgtgagaagccagaccttcagccccggcgccagaagccagtacgtgtgcagactgtacagaagcgacagcgacagcagcaccctgcccagaaagagccccttcgtgagaaacaccctggagagaagaaccctgagatacaagcagagctgcagaagcagcctggccgagctgatggccagaaccagcctggacctggagctggacctgcaggccagcagaaccagacagagacagctgaacgaggagctgtgcgccctgagagagctgagacagagactggaggacgcccagctgagaggccagaccgacctgcccccctgggtgctgagagacgagagactgagaggcctgctgagagaggccgagagacagaccagacagaccaagctggactacagacacgagcaggccgccgagaagatgctgaagaaggccagcaaggagatctaccagctgagaggccagagccacaaggagcccatccaggtgcagaccttcagagagaagatcgccttcttcaccagacccagaatcaacatcccccccctgcccgccgacgacgtgtag

SEQ ID NO: 26129 - DNA, 210 bp, Artificial Sequence
  Description of Artificial Sequence: Synthetic coding sequence
atggagagccccaagaagaagaaccagcagctgaaggtgggcatcctgcacctgggcagcagacagaagaagatcagaatccagctgagaagccaggtgctgggcagagagatgagagacatggagggcgacctgcaggagctgcaccagagcaacaccggcgacaagagcggcttcggcttcagaagacagggcgaggacaacacctag

SEQ ID NO: 26130 - DNA, 441 bp, Artificial Sequence
  Description of Artificial Sequence: Synthetic coding sequence
atgctgctgtggtgccccccccagtgcgcctgcagcctgggcgtgttccccagcgcccccagccccgtgtggggcaccagaagaagctgcgagcccgccaccagagtgcccgaggtgtggatcctgagccccctgctgagacacggcggccacacccagacccagaaccacaccgccagccccagaagccccgtgatggagagccccaagaagaagaaccagcagctgaaggtgggcatcctgcacctgggcagcagacagaagaagatcagaatccagctgagaagccagtgcgccacctggaaggtgatctgcaagagctgcatcagccagacccccggcatcaacctggacctgggcagcggcgtgaaggtgaagatcatccccaaggaggagcactgcaagatgcccgaggccggcgaggagcagccccaggtgtag

SEQ ID NO: 26131 - DNA, 441 bp, Artificial Sequence; identical to SEQ ID NO: 26130
  Description of Artificial Sequence: Synthetic coding sequence

SEQ ID NO: 26132 - DNA, 210 bp, Artificial Sequence; identical to SEQ ID NO: 26129
  Description of Artificial Sequence: Synthetic coding sequence

SEQ ID NO: 26133 - DNA, 336 bp, Artificial Sequence
  Description of Artificial Sequence: Synthetic coding sequence
atgatctggagaggcagaagcacctacagacccagacccagaagaagcgtgcccccccccgagctgatcggccccatgctggagcccggcgacgaggagccccagcaggaggagccccccaccgagagcagagaccccgcccccggccaggagagagaggaggaccagggcgccgccgagacccaggtgcccgacctggaggccgacctgcaggagctgagccagagcaagaccggcggcgagtgcggcaacggccccgacgaccagggcaagatcctgcccaagagcgagcagttcaagatgcccgagggcggcgacagacagccccaggtgtag

SEQ ID NO: 26134 - DNA, 336 bp, Artificial Sequence; identical to SEQ ID NO: 26133
  Description of Artificial Sequence: Synthetic coding sequence

SEQ ID NO: 26135 - DNA, 327 bp, Artificial Sequence
  Description of Artificial Sequence: Synthetic coding sequence
atgagctggagaggcagaagatacagacccagaagatgcctgagactggcccagctggtgggccccatgctggagcccagcgtgcccgagccccagcaggaggagccccccaccgagagccaggaccacacccccggccagaagagagaggacgaccagggcgccgccgagatccaggtgcccaacctggaggccgacctgcaggagctgagccagagcaagaccggcgacgagtgcggcgacagccccgacgtgcagggcaagatcctgcccaagagcgagcagttcaagatgcccgagggcggcgagggcaagccccagctgtag

SEQ ID NO: 26136 - DNA, 246 bp, Artificial Sequence
  Description of Artificial Sequence: Synthetic coding sequence
atggagagccccaagaagaagaaccagcagctgaaggtgggcatcctgcacctgggcagcagacagaagaagatcagaatccagctgagaagccagtgcgccacctggaaggtgatctgcaagagctgcatcagccagacccccggcatcaacctggacctgggcagcggcgtgaaggtgaagatcatccccaaggaggagcactgcaagatgcccgaggccggcgaggagcagccccaggtgtag

SEQ ID NO: 26137 - DNA, 441 bp, Artificial Sequence; identical to SEQ ID NO: 26130
  Description of Artificial Sequence: Synthetic coding sequence

SEQ ID NO: 26138 - DNA, 210 bp, Artificial Sequence; identical to SEQ ID NO: 26129
  Description of Artificial Sequence: Synthetic coding sequence

SEQ ID NO: 26139 - DNA, 336 bp, Artificial Sequence
  Description of Artificial Sequence: Synthetic coding sequence
atgagctggagaggcagaagcacctacagacccagacccagaagaagcctgcagccccccgagctgatcggcgccatgctggagcccaccgacgaggagcccaaggaggagaagccccccaccaagagcagaaaccccacccccgaccagaagagagaggacgaccagggcgccgccgagatccaggtgcccgacctggaggccgacctgcaggagctgtgccagaccaagaccggcgacggctgcgagggcggcaccgacgtgaagggcaagatcctgcccaaggccgagcacttcaagatgcccgaggccggcgagggcaagagccaggtgtag

SEQ ID NO: 26140 - DNA, 336 bp, Artificial Sequence; identical to SEQ ID NO: 26139
  Description of Artificial Sequence: Synthetic coding sequence

SEQ ID NO: 26141 - DNA, 327 bp, Artificial Sequence; identical to SEQ ID NO: 26135
  Description of Artificial Sequence: Synthetic coding sequence

SEQ ID NO: 26142 - DNA, 327 bp, Artificial Sequence; identical to SEQ ID NO: 26135
  Description of Artificial Sequence: Synthetic coding sequence

SEQ ID NO: 26143 - DNA, 228 bp, Artificial Sequence
  Description of Artificial Sequence: Synthetic coding sequence
atgagctggagaggcagaagatacagacccagaagatgcctgagactggcccagctggtgggccccatgctggagcccagcgtgcccgagccccagcaggaggagccccccaccgagagccaggaccacacccccggccagaagagagaggacgaccagggcgccgccgagatccagggcaccagcatcctggcccaggacaagacccagttcagcgagaccggctag

SEQ ID NO: 26144 - DNA, 327 bp, Artificial Sequence; identical to SEQ ID NO: 26135
  Description of Artificial Sequence: Synthetic coding sequence

SEQ ID NO: 26145 - DNA, 270 bp, Artificial Sequence
  Description of Artificial Sequence: Synthetic coding sequence
atgaagtacaccaagcagaacttcatgatgagcgtgctgggcatcatcatctacgtgaccgacctgatcgtggacatctgggtgagcgtgagattcttccacgagggccagtacgtgttcagcgccctggccctgagcttcatgctgttcggcaccctggtggcccagtgcttcagctacagctggttcaaggccgacctgaagaaggccggccaggagagccagcactgcttcctgctgctgcactgcctgcagggcggcgtgttctag

SEQ ID NO: 26146 - DNA, 492 bp, Artificial Sequence
  Description of Artificial Sequence: Synthetic coding sequence
atgagaagactgctgatccccctggccctgtggctgggcgccgtgggcgtgggcgtggccgagctgaccgaggcccagagaagaggcctgcaggtggccctggaggagttccacaagcacccccccgtgcagtgggccttccaggagaccagcgtggagagcgccgtggacacccccttccccgccggcatcttcgtgagactggagttcaagctgcagcagaccagctgcagaaagagagactggaagaagcccgagtgcaaggtgagacccaacggcagaaagagaaagtgcctggcctgcatcaagctgggcagcgaggacaaggtgctgggcagactggtgcactgccccatcgagacccaggtgctgagagaggccgaggagcaccaggagacccagtgcctgagagtgcagagagccggcgaggacccccacagcttctacttccccggccagttcgccttcagcaaggccctgcccagaagctag

SEQ ID NO: 26147 - DNA, 621 bp, Artificial Sequence
  Description of Artificial Sequence: Synthetic coding sequence
atgagctgggtgcaggccgccagcctgatccagggccccggcgacaagggcgacgtgttcgacgaggaggccgacgagagcctgctggcccagagagagtggcagagcaacatgcagagaagagtgaaggagggctacagagacggcatcgacgccggcaaggccgtgaccctgcagcagggcttcaaccagggctacaagaagggcgccgaggtgatcctgaactacggcagactgagaggcaccctgagaaacagcaccgactggagcctgctgggcctgagagcccccctgagaagccccgaggtgggcacccagctgctgcccagacccctgcccgtgcccggccacatggccagcggcgccacccccaagcagcccaccgagctggaggccaccctgctgagcctggtgccccagagcggcagagccacccccagattccccgccagactgagagcccccggccccggcacccccagccacagaagaagattcagaagaaagccccacagagaccccgccgccgcctgccccgcctggccccccgaggcccccagcaacagcgagacccacttcagcacctacaacagaatcatcatcagaggcggccacatctag

SEQ ID NO: 26148 - DNA, 972 bp, Artificial Sequence
  Description of Artificial Sequence: Synthetic coding sequence
atgagcagacccagaatgagactggtggtgaccgccgacgacttcggctactgccccagaagagacgagggcatcgtggaggccttcctggccggcgccgtgaccagcgtgagcctgctggtgaacggcgccgccaccgagagcgccgccgagctggccagaagacacagcatccccaccggcctgcacgccaacctgagcgagggcagacccgtgggccccgccagaagaggcgccagcagcctgctgggccccgagggcttcttcctgggcaagatgggcttcagagaggccgtggccgccggcgacgtggacctgccccaggtgagagaggagctggaggcccagctgagctgcttcagagagctgctgggcagagcccccacccacgccgacggccaccagcacgtgcacgtgctgcccggcgtgtgccaggtgttcgccgaggccctgcaggcctacggcgtgagattcaccagactgcccctggagagaggcgtgggcggctgcacctggctggaggcccccgccagagccttcgcctgcgccgtggagagagacgccagagccgccgtgggccccttcagcagacacggcctgagatggaccgacgccttcgtgggcctgagcacctgcggcagacacatgagcgcccacagagtgagcggcgccctggccagagtgctggagggcaccctggccggccacaccctgaccgccgagctgatggcccaccccggctaccccagcgtgccccccaccggcggctgcggcgagggccccgacgccttcagctgcagctgggagagactgcacgagctgagagtgctgaccgcccccaccctgagagcccagctggcccaggacggcgtgcagctgtgcgccctggacgacctggacagcaagagacccggcgaggaggtgccctgcgagcccaccctggagcccttcctggagcccagcctgctgtag

SEQ ID NO: 26149 - DNA, 450 bp, Artificial Sequence
  Description of Artificial Sequence: Synthetic coding sequence
atgagcagacccagaatgagactggtggtgaccgccgacgacttcggctactgccccagaagagacgagggcatcgtggaggccttcctggccggcgccgtgaccagcgtgagcctgctggtgaacggcgccgccaccgagagcgccgccgagctggccagaagacacagcatccccaccggcctgcacgccaacctgagcgagggcagacccgtgggccccgccagaagaggcgccagcagcctgctgggccccgagggcttcttcctgggcaagatgggcttcagagaggccgtggccgccggcgacgtggacctgccccaggtgagagaggagctggaggcccagctgagctgcttcagagagctgctgggcagagcccccacccacgccgacggccaccagcacgtgcacgtgctgcccggcggccagacccccagctgggcctag

SEQ ID NO: 26150 - DNA, 900 bp, Artificial Sequence
  Description of Artificial Sequence: Synthetic coding sequence
atgagcagcgccgccggccccgaccccagcgaggcccccgaggagagacacttcctgagagccctggagctgcagccccccctggccgacatgggcagagccgagctgagcagcaacgccaccaccagcctggtgcagagaagaaagcaggcctggggcagacagagctggctggagcagatctggaacgccggccccgtgtgccagagcaccgccgaggccgccgccctggagagagagctgctggaggactacagattcggcagacagcagctggtggagctgtgcggccacgccagcgccgtggccgtgaccaaggccttccccctgcccgccctgagcagaaagcagagaaccgtgctggtggtgtgcggccccgagcagaacggcgccgtgggcctggtgtgcgccagacacctgagagtgttcgagtacgagcccaccatcttctaccccaccagaagcctggacctgctgcacagagacctgaccacccagtgcgagaagatggacatccccttcctgagctacctgcccaccgaggtgcagctgatcaacgaggcctacggcctggtggtggacgccgtgctgggccccggcgtggagcccggcgaggtgggcggcccctgcaccagagccctggccaccctgaagctgctgagcatccccctggtgagcctggacatccccagcggctgggacgccgagaccggcagcgacagcgaggacggcctgagacccgacgtgctggtgagcctggccgcccccaagagatgcgccggcagattcagcggcagacaccacttcgtggccggcagattcgtgcccgacgacgtgagaagaaagttcgccctgagactgcccggctacaccggcaccgactgcgtggccgccctgtag

SEQ ID NO: 26151 - DNA, 750 bp, Artificial Sequence
  Description of Artificial Sequence: Synthetic coding sequence
atgagcagcgccgccggccccgaccccagcgaggcccccgaggagagacacttcctgagcaccgccgaggccgccgccctggagagagagctgctggaggactacagattcggcagacagcagctggtggagctgtgcggccacgccagcgccgtggccgtgaccaaggccttccccctgcccgccctgagcagaaagcagagaaccgtgctggtggtgtgcggccccgagcagaacggcgccgtgggcctggtgtgcgccagacacctgagagtgttcgagtacgagcccaccatcttctaccccaccagaagcctggacctgctgcacagagacctgaccacccagtgcgagaagatggacatccccttcctgagctacctgcccaccgaggtgcagctgatcaacgaggcctacggcctggtggtggacgccgtgctgggccccggcgtggagcccggcgaggtgggcggcccctgcaccagagccctggccaccctgaagctgctgagcatccccctggtgagcctggacatccccagcggctgggacgccgagaccggcagcgacagcgaggacggcctgagacccgacgtgctggtgagcctggccgcccccaagagatgcgccggcagattcagcggcagacaccacttcgtggccggcagattcgtgcccgacgacgtgagaagaaagttcgccctgagactgcccggctacaccggcaccgactgcgtggccgccctgtag

SEQ ID NO: 26152 - DNA, 750 bp, Artificial Sequence; identical to SEQ ID NO: 26151
  Description of Artificial Sequence: Synthetic coding sequence

SEQ ID NO: 26153 - DNA, 900 bp, Artificial Sequence; identical to SEQ ID NO: 26150
  Description of Artificial Sequence: Synthetic coding sequence

SEQ ID NO: 26154 - DNA, 822 bp, Artificial Sequence
  Description of Artificial Sequence: Synthetic coding sequence
atggccgccagcaaggtgaagcaggacatgcccccccccggcggctacggccccatcgactacaagagaaacctgcccagaagaggcctgagcggctacagcatgctggccatcggcatcggcaccctgatctacggccactggagcatcatgaagtggaacagagagagaagaagactgcagatcgaggacttcgaggccagaatcgccctgctgcccctgctgcaggccgagaccgacagaagaaccctgcagatgctgagagagaacctggaggaggaggccatcatcatgaaggacgtgcccgactggaaggccttccccctgcccgccctgagcagaaagcagagaaccgtgctggtggtgtgcggccccgagcagaacggcgccgtgggcctggtgtgcgccagacacctgagagtgttcgagtacgagcccaccatcttctaccccaccagaagcctggacctgctgcacagagacctgaccacccagtgcgagaagatggacatccccttcctgagctacctgcccaccgaggtgcagctgatcaacgaggcctacggcctggtggtggacgccgtgctgggccccggcgtggagcccggcgaggtgggcggcccctgcaccagagccctggccaccctgaagctgctgagcatccccctggtgagcctggacatccccagcggcatgcccggcagaggcggccacatcggcgcctggggcgcctgggtggaggcccccgtgccccagctgctggtggcccccgcctgcctgaacctgaacctgcccagcctggacggccccaccctgggctag

SEQ ID NO: 26155 - DNA, 507 bp, Artificial Sequence
  Description of Artificial Sequence: Synthetic coding sequence
atggagttcgtgcccggcggcagcatcagcagcatcatcaacagattcggccccctgcccgagatggtgttctgcaagtacaccaagcagatcctgcagggcgtggcctacctgcacgagaactgcgtggtgcacagagacatcaagggcaacaacgtgatgctgatgcccaccggcatcatcaagctgatcgacttcggctgcgccagaagactggcctgggccggcctgaacggcacccacagcgacatgctgaagagcatgcacggcaccccctactggatggcccccgaggtgatcaacgagagcggctacggcagaaagagcgacatctggagcatcggctgcaccgtgttcgagatggccaccggcaagccccccctggccagcatggacagaatggccgccatgttctacatcggcgcccacagaggcctgatgccccccctgcccgaccacttcagcgagaacgccgccgacttcgtgagaatgtgcctgaccagatag

SEQ ID NO: 26156 - DNA, 3648 bp, Artificial Sequence
  Description of Artificial Sequence: Synthetic coding sequence
atgagcagcatgcccaagcccgagagacacgccgagagcctgctggacatctgccacgacaccaacagcagccccaccgacctgatgaccgtgaccaagaaccagaacatcatcctgcagagcatcagcagaagcgaggagttcgaccaggacggcgactgcagccacagcaccctggtgaacgaggaggaggaccccagcggcggcagacaggactggcagcccagaaccgaggagttcagcaccagccacatgaagtacagcggcagaagcatcaagttcctgctgccccccctgagcctgctgcccaccagaagcggcgtgctgaccatcccccagaaccacaagttccccaaggagaaggagagaaacatccccagcctgaccagcttcgtgcccaagctgagcgtgagcgtgagacagagcgacgagctgagccccagcaacgagccccccggcgccctggtgaagagcctgatggaccccaccctgagaagcagcgacggcttcatctggagcagaaacatgtgcagcttccccaagaccaaccaccacagacagtgcctggagaaggaggagaactggaagagcaaggagatcgaggagtgcaacaagatcgagatcacccacttcgagaagggccagagcctggtgagcttcgagaacctgaaggagggcaacatccccgccgtgagagaggaggacatcgactgccacggcagcaagaccagaaagcccgaggaggagaacagccagtacctgagcagcagaaagaacgagagcagcgtggccaagaactacgagcaggaccccgagatcgtgtgcaccatccccagcaagttccaggagacccagcacagcgagatcacccccagccaggacgaggagatgagaaacaacaaggccgccagcaagagagtgagcctgcacaagaacgaggccatggagcccaacaacatcctggaggagtgcaccgtgctgaagagcctgagcagcgtggtgttcgacgaccccatcgacaagctgcccgagggctgcagcagcatggagaccaacatcaagatcagcatcgccgagagagccaagcccgagatgagcagaatggtgcccctgatccacatcaccttccccgtggacggcagccccaaggagcccgtgatcgccaagcccagcctgcagaccagaaagggcaccatccacaacaaccacagcgtgaacatccccgtgcaccaggagaacgacaagcacaagatgaacagccacagaagcaagctggacagcaagaccaagaccagcaagaagaccccccagaacttcgtgatcagcaccgagggccccatcaagcccaccatgcacaagaccagcatcaagacccagatcttccccgccctgggcctggtggaccccagaccctggcagctgcccagattccagaagaagatgccccagatcgccaagaagcagagcacccacagaacccagaagcccaagaagcagagcttcccctgcatctgcaagaaccccggcacccagaagagctgcgtgcccctgagcgtgcagcccaccgagcccagactgaactacctggacctgaagtacagcgacatgttcaaggagatcaacagcaccgccaacggccccggcatctacgagatgttcggcacccccgtgtactgccacgtgagagagaccgagagagacgagaacacctactacagagagatctgcagcgcccccagcggcagaagaatcaccaacaagtgcagaagcagccacagcgagagaaagagcaacatcagaaccagactgagccagaagaagacccacatgaagtgccccaagaccagcttcggcatcaagcaggagcacaaggtgctgatcagcaaggagaagagcagcaaggccgtgcacagcaacctgcacgacatcgagaacggcgacggcatcagcgagcccgactggcagatcaagagcagcggcaacgagttcctgagcagcaaggacgagatccaccccatgaacctggcccagacccccgagcagagcatgaagcagaacgagttcccccccgtgagcgacctgagcatcgtggaggaggtgagcatggaggagagcaccggcgacagagacatcagcaacaaccagatcctgaccaccagcctgagagacctgcaggagctggaggagctgcaccaccagatccccttcatccccagcgaggacagctgggccgtgcccagcgagaagaacagcaacaagtacgtgcagcaggagaagcagaacaccgccagcctgagcaaggtgaacgccagcagaatcctgaccaacgacctggagttcgacagcgtgagcgaccacagcaagaccctgaccaacttcagcttccaggccaagcaggagagcgccagcagccagacctaccagtactgggtgcactacctggaccacgacagcctggccaacaagagcatcacctaccagatgttcggcaagaccctgagcggcaccaacagcatcagccaggagatcatggacagcgtgaacaacgaggagctgaccgacgagctgctgggctgcctggccgccgagctgctggccctggacgagaaggacaacaacagctgccagaagatggccaacgagaccgaccccgagaacctgaacctggtgctgagatggagaggcagcacccccaaggagatgggcagagagaccaccaaggtgaagatccagagacacagcagcggcctgagaatctacgacagagaggagaagttcctgatcagcaacgagaagaagatcttcagcgagaacagcctgaagagcgaggagcccatcctgtggaccaagggcgagatcctgggcaagggcgcctacggcaccgtgtactgcggcctgaccagccagggccagctgatcgccgtgaagcaggtggccctggacaccagcaacaagctggccgccgagaaggagtacagaaagctgcaggaggaggtggacctgctgaaggccctgaagcacgtgaacatcgtggcctacctgggcacctgcctgcaggagaacaccgtgagcatcttcatggagttcgtgcccggcggcagcatcagcagcatcatcaacagattcggccccctgcccgagatggtgttctgcaagtacaccaagcagatcctgcagggcgtggcctacctgcacgagaactgcgtggtgcacagagacatcaagggcaacaacgtgatgctgatgcccaccggcatcatcaagctgatcgacttcggctgcgccagaagactggcctgggccggcctgaacggcacccacagcgacatgctgaagagcatgcacggcaccccctactggatggcccccgaggtgatcaacgagagcggctacggcagaaagagcgacatctggagcatcggctgcaccgtgttcgagatggccaccggcaagccccccctggccagcatggacagaatggccgccatgttctacatcggcgcccacagaggcctgatgccccccctgcccgaccacttcagcgagaacgccgccgacttcgtgagaatgtgcctgaccagagaccagcacgagagacccagcgccctgcagctgctgaagcacagcttcctggagagaagccactag

SEQ ID NO: 26157 - DNA, 1533 bp, Artificial Sequence
  Description of Artificial Sequence: Synthetic coding sequence
atgagcagcatgcccaagcccgagagacacgccgagagcctgctggacatctgccacgacaccaacagcagccccaccgacctgatgaccgtgaccaagaaccagaacatcatcctgcagagcatcagcagaagcgaggagttcgaccaggacggcgactgcagccacagcaccctggtgaacgaggaggaggaccccagcggcggcagacaggactggcagcccagaaccgagggcgtggagatcaccgtgaccttccccagagacgtgagccccccccaggagatgagccaggaggacctgaaggagaagaacctgatcaacagcagcctgcaggagtgggcccaggcccacgccgtgagccaccccaacgagatcgagaccgtggagctgagaaagaagaagctgaccatgagacccctggtgctgcagaaggaggagagcagcagagagctgtgcaacgtgaacctgggcttcctgctgcccagaagctgcctggagctgaacatcagcaagagcgtgaccagagaggacgccccccacttcctgaaggagcagcagagaaagagcgaggagttcagcaccagccacatgaagtacagcggcagaagcatcaagagacacagcagcggcctgagaatctacgacagagaggagaagttcctgatcagcaacgagaagaagatcttcagcgagaacagcctgaagagcgaggagcccatcctgtggaccaagggcgagatcctgggcaagggcgcctacggcaccgtgtactgcggcctgaccagccagggccagctgatcgccgtgaagcaggtggccctggacaccagcaacaagctggccgccgagaaggagtacagaaagctgcaggaggaggtggacctgctgaaggccctgaagcacgtgaacatcgtggcctacctgggcacctgcctgcaggagaacaccgtgagcatcttcatggagttcgtgcccggcggcagcatcagcagcatcatcaacagattcggccccctgcccgagatggtgttctgcaagtacaccaagcagatcctgcagggcgtggcctacctgcacgagaactgcgtggtgcacagagacatcaagggcaacaacgtgatgctgatgcccaccggcatcatcaagctgatcgacttcggctgcgccagaagactggcctgggccggcctgaacggcacccacagcgacatgctgaagagcatgcacggcaccccctactggatggcccccgaggtgatcaacgagagcggctacggcagaaagagcgacatctggagcatcggctgcaccgtgttcgagatggccaccggcaagccccccctggccagcatggacagaatggccgccatgttctacatcggcgcccacagaggcctgatgccccccctgcccgaccacttcagcgagaacgccgccgacttcgtgagaatgtgcctgaccagagaccagcacgagagacccagcgccctgcagctgctgaagcacagcttcctggagagaagccactag

SEQ ID NO: 26158 - DNA, 3987 bp, Artificial Sequence
  Description of Artificial Sequence: Synthetic coding sequence
atgagcagcatgcccaagcccgagagacacgccgagagcctgctggacatctgccacgacaccaacagcagccccaccgacctgatgaccgtgaccaagaaccagaacatcatcctgcagagcatcagcagaagcgaggagttcgaccaggacggcgactgcagccacagcaccctggtgaacgaggaggaggaccccagcggcggcagacaggactggcagcccagaaccgagggcgtggagatcaccgtgaccttccccagagacgtgagccccccccaggagatgagccaggaggacctgaaggagaagaacctgatcaacagcagcctgcaggagtgggcccaggcccacgccgtgagccaccccaacgagatcgagaccgtggagctgagaaagaagaagctgaccatgagacccctggtgctgcagaaggaggagagcagcagagagctgtgcaacgtgaacctgggcttcctgctgcccagaagctgcctggagctgaacatcagcaagagcgtgaccagagaggacgccccccacttcctgaaggagcagcagagaaagagcgaggagttcagcaccagccacatgaagtacagcggcagaagcatcaagttcctgctgccccccctgagcctgctgcccaccagaagcggcgtgctgaccatcccccagaaccacaagttccccaaggagaaggagagaaacatccccagcctgaccagcttcgtgcccaagctgagcgtgagcgtgagacagagcgacgagctgagccccagcaacgagccccccggcgccctggtgaagagcctgatggaccccaccctgagaagcagcgacggcttcatctggagcagaaacatgtgcagcttccccaagaccaaccaccacagacagtgcctggagaaggaggagaactggaagagcaaggagatcgaggagtgcaacaagatcgagatcacccacttcgagaagggccagagcctggtgagcttcgagaacctgaaggagggcaacatccccgccgtgagagaggaggacatcgactgccacggcagcaagaccagaaagcccgaggaggagaacagccagtacctgagcagcagaaagaacgagagcagcgtggccaagaactacgagcaggaccccgagatcgtgtgcaccatccccagcaagttccaggagacccagcacagcgagatcacccccagccaggacgaggagatgagaaacaacaaggccgccagcaagagagtgagcctgcacaagaacgaggccatggagcccaacaacatcctggaggagtgcaccgtgctgaagagcctgagcagcgtggtgttcgacgaccccatcgacaagctgcccgagggctgcagcagcatggagaccaacatcaagatcagcatcgccgagagagccaagcccgagatgagcagaatggtgcccctgatccacatcaccttccccgtggacggcagccccaaggagcccgtgatcgccaagcccagcctgcagaccagaaagggcaccatccacaacaaccacagcgtgaacatccccgtgcaccaggagaacgacaagcacaagatgaacagccacagaagcaagctggacagcaagaccaagaccagcaagaagaccccccagaacttcgtgatcagcaccgagggccccatcaagcccaccatgcacaagaccagcatcaagacccagatcttccccgccctgggcctggtggaccccagaccctggcagctgcccagattccagaagaagatgccccagatcgccaagaagcagagcacccacagaacccagaagcccaagaagcagagcttcccctgcatctgcaagaaccccggcacccagaagagctgcgtgcccctgagcgtgcagcccaccgagcccagactgaactacctggacctgaagtacagcgacatgttcaaggagatcaacagcaccgccaacggccccggcatctacgagatgttcggcacccccgtgtactgccacgtgagagagaccgagagagacgagaacacctactacagagagatctgcagcgcccccagcggcagaagaatcaccaacaagtgcagaagcagccacagcgagagaaagagcaacatcagaaccagactgagccagaagaagacccacatgaagtgccccaagaccagcttcggcatcaagcaggagcacaaggtgctgatcagcaaggagaagagcagcaaggccgtgcacagcaacctgcacgacatcgagaacggcgacggcatcagcgagcccgactggcagatcaagagcagcggcaacgagttcctgagcagcaaggacgagatccaccccatgaacctggcccagacccccgagcagagcatgaagcagaacgagttcccccccgtgagcgacctgagcatcgtggaggaggtgagcatggaggagagcaccggcgacagagacatcagcaacaaccagatcctgaccaccagcctgagagacctgcaggagctggaggagctgcaccaccagatccccttcatccccagcgaggacagctgggccgtgcccagcgagaagaacagcaacaagtacgtgcagcaggagaagcagaacaccgccagcctgagcaaggtgaacgccagcagaatcctgaccaacgacctggagttcgacagcgtgagcgaccacagcaagaccctgaccaacttcagcttccaggccaagcaggagagcgccagcagccagacctaccagtactgggtgcactacctggaccacgacagcctggccaacaagagcatcacctaccagatgttcggcaagaccctgagcggcaccaacagcatcagccaggagatcatggacagcgtgaacaacgaggagctgaccgacgagctgctgggctgcctggccgccgagctgctggccctggacgagaaggacaacaacagctgccagaagatggccaacgagaccgaccccgagaacctgaacctggtgctgagatggagaggcagcacccccaaggagatgggcagagagaccaccaaggtgaagatccagagacacagcagcggcctgagaatctacgacagagaggagaagttcctgatcagcaacgagaagaagatcttcagcgagaacagcctgaagagcgaggagcccatcctgtggaccaagggcgagatcctgggcaagggcgcctacggcaccgtgtactgcggcctgaccagccagggccagctgatcgccgtgaagcaggtggccctggacaccagcaacaagctggccgccgagaaggagtacagaaagctgcaggaggaggtggacctgctgaaggccctgaagcacgtgaacatcgtggcctacctgggcacctgcctgcaggagaacaccgtgagcatcttcatggagttcgtgcccggcggcagcatcagcagcatcatcaacagattcggccccctgcccgagatggtgttctgcaagtacaccaagcagatcctgcagggcgtggcctacctgcacgagaactgcgtggtgcacagagacatcaagggcaacaacgtgatgctgatgcccaccggcatcatcaagctgatcgacttcggctgcgccagaagactggcctgggccggcctgaacggcacccacagcgacatgctgaagagcatgcacggcaccccctactggatggcccccgaggtgatcaacgagagcggctacggcagaaagagcgacatctggagcatcggctgcaccgtgttcgagatggccaccggcaagccccccctggccagcatggacagaatggccgccatgttctacatcggcgcccacagaggcctgatgccccccctgcccgaccacttcagcgagaacgccgccgacttcgtgagaatgtgcctgaccagagaccagcacgagagacccagcgccctgcagctgctgaagcacagcttcctggagagaagccactag

SEQ ID NO: 26159 - DNA, 1383 bp, Artificial Sequence
  Description of Artificial Sequence: Synthetic coding sequence
atgagcagcatgcccaagcccgagagacacgccgagagcctgctggacatctgccacgacaccaacagcagccccaccgacctgatgaccgtgaccaagaaccagaacatcatcctgcagagcatcagcagaagcgaggagttcgaccaggacggcgactgcagccacagcaccctggtgaacgaggaggaggaccccagcggcggcagacaggactggcagcccagaaccgagggcgtggagatcaccgtgaccttccccagagacgtgagccccccccaggagatgagccaggaggacctgaaggagaagaacctgatcaacagcagcctgcaggagtgggcccaggcccacgccgtgagccaccccaacgagatcgagaccgtggagctgagaaagaagaagctgaccatgagacccctggtgctgcagaaggaggagagcagcagagagctgtgcaacgtgaacctgggcttcctgctgcccagaagctgcctggagctgaacatcagcaagagcgtgaccagagaggacgccccccacttcctgaaggagcagcagagaaagagcgaggagttcagcaccagccacatgaagtacagcggcagaagcatcaaggtgtactgcggcctgaccagccagggccagctgatcgccgtgaagcaggtggccctggacaccagcaacaagctggccgccgagaaggagtacagaaagctgcaggaggaggtggacctgctgaaggccctgaagcacgtgaacatcgtggcctacctgggcacctgcctgcaggagaacaccgtgagcatcttcatggagttcgtgcccggcggcagcatcagcagcatcatcaacagattcggccccctgcccgagatggtgttctgcaagtacaccaagcagatcctgcagggcgtggcctacctgcacgagaactgcgtggtgcacagagacatcaagggcaacaacgtgatgctgatgcccaccggcatcatcaagctgatcgacttcggctgcgccagaagactggcctgggccggcctgaacggcacccacagcgacatgctgaagagcatgcacggcaccccctactggatggcccccgaggtgatcaacgagagcggctacggcagaaagagcgacatctggagcatcggctgcaccgtgttcgagatggccaccggcaagccccccctggccagcatggacagaatggccgccatgttctacatcggcgcccacagaggcctgatgccccccctgcccgaccacttcagcgagaacgccgccgacttcgtgagaatgtgcctgaccagagaccagcacgagagacccagcgccctgcagctgctgaagcacagcttcctggagagaagccactag

SEQ ID NO: 26160 - DNA, 1389 bp, Artificial Sequence
  Description of Artificial Sequence: Synthetic coding sequence
atgagcagcatgcccaagcccgagagacacgccgagagcctgctggacatctgccacgacaccaacagcagccccaccgacctgatgaccgtgaccaagaaccagaacatcatcctgcagagcatcagcagaagcgaggagttcgaccaggacggcgactgcagccacagcaccctggtgaacgaggaggaggaccccagcggcggcagacaggactggcagcccagaaccgagggcgtggagatcaccgtgaccttccccagagacgtgagccccccccaggagatgagccaggaggacctgaaggagaagaacctgatcaacagcagcctgcaggagtgggcccaggcccacgccgtgagccaccccaacgagatcgagaccgtggagctgagaaagaagaagctgaccatgagacccctggtgctgcagaaggaggagagcagcagagagctgtgcaacgtgaacctgggcttcctgctgcccagaagctgcctggagctgaacatcagcaagagcgtgaccagagaggacgccccccacttcctgaaggagcagcagagaaagagcgaggagttcagcaccagccacatgaagtacagcggcagaagcatcaagagacacagcagcggcctgagaatctacgacagagaggagaagttcctgatcagcaacgagaagaagatcttcagcgagaacagcctgaagagcgaggagcccatcctgtggaccaaggtggacctgctgaaggccctgaagcacgtgaacatcgtggcctacctgggcacctgcctgcaggagaacaccgtgagcatcttcatggagttcgtgcccggcggcagcatcagcagcatcatcaacagattcggccccctgcccgagatggtgttctgcaagtacaccaagcagatcctgcagggcgtggcctacctgcacgagaactgcgtggtgcacagagacatcaagggcaacaacgtgatgctgatgcccaccggcatcatcaagctgatcgacttcggctgcgccagaagactggcctgggccggcctgaacggcacccacagcgacatgctgaagagcatgcacggcaccccctactggatggcccccgaggtgatcaacgagagcggctacggcagaaagagcgacatctggagcatcggctgcaccgtgttcgagatggccaccggcaagccccccctggccagcatggacagaatggccgccatgttctacatcggcgcccacagaggcctgatgccccccctgcccgaccacttcagcgagaacgccgccgacttcgtgagaatgtgcctgaccagagaccagcacgagagacccagcgccctgcagctgctgaagcacagcttcctggagagaagccactag

SEQ ID NO: 26161 - DNA, 2094 bp, Artificial Sequence
  Description of Artificial Sequence: Synthetic coding sequence
aagcagagcttcccctgcatctgcaagaaccccggcacccagaagagctgcgtgcccctgagcgtgcagcccaccgagcccagactgaactacctggacctgaagtacagcgacatgttcaaggagatcaacagcaccgccaacggccccggcatctacgagatgttcggcacccccgtgtactgccacgtgagagagaccgagagagacgagaacacctactacagagagatctgcagcgcccccagcggcagaagaatcaccaacaagtgcagaagcagccacagcgagagaaagagcaacatcagaaccagactgagccagaagaagacccacatgaagtgccccaagaccagcttcggcatcaagcaggagcacaaggtgctgatcagcaaggagaagagcagcaaggccgtgcacagcaacctgcacgacatcgagaacggcgacggcatcagcgagcccgactggcagatcaagagcagcggcaacgagttcctgagcagcaaggacgagatccaccccatgaacctggcccagacccccgagcagagcatgaagcagaacgagttcccccccgtgagcgacctgagcatcgtggaggaggtgagcatggaggagagcaccggcgacagagacatcagcaacaaccagatcctgaccaccagcctgagagacctgcaggagctggaggagctgcaccaccagatccccttcatccccagcgaggacagctgggccgtgcccagcgagaagaacagcaacaagtacgtgcagcaggagaagcagaacaccgccagcctgagcaaggtgaacgccagcagaatcctgaccaacgacctggagttcgacagcgtgagcgaccacagcaagaccctgaccaacttcagcttccaggccaagcaggagagcgccagcagccagacctaccagtactgggtgcactacctggaccacgacagcctggccaacaagagcatcacctaccagatgttcggcaagaccctgagcggcaccaacagcatcagccaggagatcatggacagcgtgaacaacgaggagctgaccgacgagctgctgggctgcctggccgccgagctgctggccctggacgagaaggacaacaacagctgccagaagatggccaacgagaccgaccccgagaacctgaacctggtgctgagatggagaggcagcacccccaaggagatgggcagagagaccaccaaggtgaagatccagagacacagcagcggcctgagaatctacgacagagaggagaagttcctgatcagcaacgagaagaagatcttcagcgagaacagcctgaagagcgaggagcccatcctgtggaccaagggcgagatcctgggcaagggcgcctacggcaccgtgtactgcggcctgaccagccagggccagctgatcgccgtgaagcaggtggccctggacaccagcaacaagctggccgccgagaaggagtacagaaagctgcaggaggaggtggacctgctgaaggccctgaagcacgtgaacatcgtggcctacctgggcacctgcctgcaggagaacaccgtgagcatcttcatggagttcgtgcccggcggcagcatcagcagcatcatcaacagattcggccccctgcccgagatggtgttctgcaagtacaccaagcagatcctgcagggcgtggcctacctgcacgagaactgcgtggtgcacagagacatcaagggcaacaacgtgatgctgatgcccaccggcatcatcaagctgatcgacttcggctgcgccagaagactggcctgggccggcctgaacggcacccacagcgacatgctgaagagcatgcacggcaccccctactggatggcccccgaggtgatcaacgagagcggctacggcagaaagagcgacatctggagcatcggctgcaccgtgttcgagatggccaccggcaagccccccctggccagcatggacagaatggccgccatgttctacatcggcgcccacagaggcctgatgccccccctgcccgaccacttcagcgagaacgccgccgacttcgtgagaatgtgcctgaccagatag

SEQ ID NO: 26162 - DNA, 4293 bp, Artificial Sequence
  Description of Artificial Sequence: Synthetic coding sequence
atgagcagacccagcagcgtgagccccagacagcccgcccccggcggcggcggcggcggcggccccagcccctgcggccccggcggcggcggcagagccaagggcctgaaggacatcagaatcgacgaggaggtgaagatcgccgtgaacatcgccctggagagattcagatacggcgaccagagagagatggagttccccagcagcctgaccagcaccgagagagccttcatccacagactgagccagagcctgggcctggtgagcaagagcaagggcaagggcgccaacagatacctgaccgtgaagaagaaggacggcagcgagaccgcccacgccatgatgacctgcaacctgacccacaacaccaagcacgccgtgagaagcctgatccagagattccccgtgaccaacaaggagagaaccgagctgctgcccaagaccgagagaggcaacgtgttcgccgtggaggccgagaacagagagatgagcaagaccagcggcagactgaacaacggcatcccccagatccccgtgaagagaggcgagagcgagttcgacagcttcagacagagcctgcccgtgttcgagaagcaggaggagatcgtgaagatcatcaaggagaacaaggtggtgctgatcgtgggcgagaccggcagcggcaagaccacccagatcccccagttcctgctggacgactgcttcaagaacggcatcccctgcagaatcttctgcacccagcccagaagactggccgccatcgccgtggccgagagagtggccgccgagagaagagagagaatcggccagaccatcggctaccagatcagactggagagcagagtgagccccaagaccctgctgaccttctgcaccaacggcgtgctgctgagaaccctgatggccggcgacagcaccctgagcaccgtgacccacgtgatcgtggacgaggtgcacgagagagacagattcagcgacttcctgctgaccaagctgagagacctgctgcagaagcaccccaccctgaagctgatcctgagcagcgccgccctggacgtgaacctgttcatcagatacttcggcagctgccccgtgatctacatccagggcagacccttcgaggtgaaggagatgttcctggaggacatcctgagaaccaccggctacaccaacaaggagatgctgaagtacaagaaggagaagcagcaggaggagaagcagcagaccaccctgaccgagtggtacagcgcccaggagaacagcttcaagcccgagagccagagacagagaaccgtgctgaacgtgaccgacgagtacgacctgctggacgacggcggcgacgccgtgttcagccagctgaccgagaaggacgtgaactgcctggagccctggctgatcaaggagatggacgcctgcctgagcgacatctggctgcacaaggacatcgacgccttcgcccaggtgttccacctgatcctgaccgagaacgtgagcgtggactacagacacagcgagaccagcgccaccgccctgatggtggccgccggcagaggcttcgccagccaggtggagcagctgatcagcatgggcgccaacgtgcacagcaaggccagcaacggctggatggccctggactgggccaagcacttcggccagaccgagatcgtggacctgctggagagctacagcgccaccctggagttcggcaacctggacgagagcagcctggtgcagaccaacggcagcgacctgagcgccgaggacagagagctgctgaaggcctaccaccacagcttcgacgacgagaaggtggacctggacctgatcatgcacctgctgtacaacatctgccacagctgcgacgccggcgccgtgctgatcttcctgcccggctacgacgagatcgtgggcctgagagacagaatcctgttcgacgacaagagattcgccgacagcacccacagataccaggtgttcatgctgcacagcaacatgcagaccagcgaccagaagaaggtgctgaagaacccccccgccggcgtgagaaagatcatcctgagcaccaacatcgccgagaccagcatcaccgtgaacgacgtggtgttcgtgatcgacagcggcaaggtgaaggagaagagcttcgacgccctgaacttcgtgaccatgctgaagatggtgtggatcagcaaggccagcgccatccagagaaagggcagagccggcagatgcagacccggcatctgcttcagactgttcagcagactgagattccagaacatgctggagttccagacccccgagctgctgagaatgcccctgcaggagctgtgcctgcacaccaagctgctggcccccgtgaactgccccatcgccgacttcctgatgaaggcccccgagcccccccccgccctgatcgtgagaaacgccgtgcagatgctgaagaccatcgacgccatggacacctgggaggacctgaccgagctgggctaccacctggccgacctgcccgtggagccccacctgggcaagatggtgctgtgcgccgtggtgctgaagtgcctggaccccatcctgaccatcgcctgcaccctggcctacagagaccccttcgtgctgcccacccaggccagccagaagagagccgccatgctgtgcagaaagagattcaccgccggcgccttcagcgaccacatggccctgctgagagccttccaggcctggcagaaggccagaagcgacggctgggagagagccttctgcgagaagaacttcctgagccaggccaccatggagatcatcatcggcatgagaacccagctgctgggccagctgagagccagcggcttcgtgagagccagaggcggcggcgacatcagagacgtgaacaccaacagcgagaactgggccgtggtgaaggccgccctggtggccggcatgtaccccaacctggtgcacgtggacagagagaacctggtgctgaccggccccaaggagaagaaggtgagattccaccccgccagcgtgctgagccagccccagtacaagaagatcccccccgccaacggccaggccgccgccatcaaggccctgcccaccgactggctgatctacgacgagatgaccagagcccacagaatcgccaacatcagatgctgcagcgccgtgacccccgtgaccatcctggtgttctgcggccccgccagactggccagcaacgccctgcaggagcccagcagcttcagagtggacggcatccccaacgacagcagcgacagcgagatggaggacaagaccaccgccaacctggccgccctgaagctggacgagtggctgcacttcaccctggagcccgaggccgccagcctgctgctgcagctgagacagaagtggcacagcctgttcctgagaagaatgagagcccccagcaagccctggagccaggtggacgaggccaccatcagagccatcatcgccgtgctgagcaccgaggagcagagcgccggcctgcagcagcccagcggcatcggccagagacccagacccatgagcagcgaggagctgcccctggccagcagctggagaagcaacaacagcagaaagagcagcgccgacaccgagttcagcgacgagtgcaccaccgccgagagagtgctgatgaagagccccagccccgccctgcaccccccccagaagtacaaggacagaggcatcctgcaccccaagagaggcaccgaggacagaagcgaccagagcagcctgaagagcaccgacagcagcagctaccccagcccctgcgccagccccagcccccccagcagcggcaagggcagcaagagccccagccccagacccaacatgcccgtgagatacttcatcatgaagagcagcaacctgagaaacctggagatcagccagcagaagggcatctggagcaccacccccagcaacgagagaaagctgaacagagccttctgggagagcagcatcgtgtacctggtgttcagcgtgcagggcagcggccacttccagggcttcagcagaatgagcagcgagatcggcagagagaagagccaggactggggcagcgccggcctgggcggcgtgttcaaggtggagtggatcagaaaggagagcctgcccttccagttcgcccaccacctgctgaacccctggaacgacaacaagaaggtgcagatcagcagagacggccaggagctggagcccctggtgggcgagcagctgctgcagctgtgggagagactgcccctgggcgagaagaacaccaccgactag

SEQ ID NO: 26163 - DNA, 4023 bp, Artificial Sequence
  Description of Artificial Sequence: Synthetic coding sequence
atgctgagaaagggcgccaacagatacctgaccgtgaagaagaaggacggcagcgagaccgcccacgccatgatgacctgcaacctgacccacaacaccaagcacgccgtgagaagcctgatccagagattccccgtgaccaacaaggagagaaccgagctgctgcccaagaccgagagaggcaacgtgttcgccgtggaggccgagaacagagagatgagcaagaccagcggcagactgaacaacggcatcccccagatccccgtgaagagaggcgagagcgagttcgacagcttcagacagagcctgcccgtgttcgagaagcaggaggagatcgtgaagatcatcaaggagaacaaggtggtgctgatcgtgggcgagaccggcagcggcaagaccacccagatcccccagttcctgctggacgactgcttcaagaacggcatcccctgcagaatcttctgcacccagcccagaagactggccgccatcgccgtggccgagagagtggccgccgagagaagagagagaatcggccagaccatcggctaccagatcagactggagagcagagtgagccccaagaccctgctgaccttctgcaccaacggcgtgctgctgagaaccctgatggccggcgacagcaccctgagcaccgtgacccacgtgatcgtggacgaggtgcacgagagagacagattcagcgacttcctgctgaccaagctgagagacctgctgcagaagcaccccaccctgaagctgatcctgagcagcgccgccctggacgtgaacctgttcatcagatacttcggcagctgccccgtgatctacatccagggcagacccttcgaggtgaaggagatgttcctggaggacatcctgagaaccaccggctacaccaacaaggagatgctgaagtacaagaaggagaagcagcaggaggagaagcagcagaccaccctgaccgagtggtacagcgcccaggagaacagcttcaagcccgagagccagagacagagaaccgtgctgaacgtgaccgacgagtacgacctgctggacgacggcggcgacgccgtgttcagccagctgaccgagaaggacgtgaactgcctggagccctggctgatcaaggagatggacgcctgcctgagcgacatctggctgcacaaggacatcgacgccttcgcccaggtgttccacctgatcctgaccgagaacgtgagcgtggactacagacacagcgagaccagcgccaccgccctgatggtggccgccggcagaggcttcgccagccaggtggagcagctgatcagcatgggcgccaacgtgcacagcaaggccagcaacggctggatggccctggactgggccaagcacttcggccagaccgagatcgtggacctgctggagagctacagcgccaccctggagttcggcaacctggacgagagcagcctggtgcagaccaacggcagcgacctgagcgccgaggacagagagctgctgaaggcctaccaccacagcttcgacgacgagaaggtggacctggacctgatcatgcacctgctgtacaacatctgccacagctgcgacgccggcgccgtgctgatcttcctgcccggctacgacgagatcgtgggcctgagagacagaatcctgttcgacgacaagagattcgccgacagcacccacagataccaggtgttcatgctgcacagcaacatgcagaccagcgaccagaagaaggtgctgaagaacccccccgccggcgtgagaaagatcatcctgagcaccaacatcgccgagaccagcatcaccgtgaacgacgtggtgttcgtgatcgacagcggcaaggtgaaggagaagagcttcgacgccctgaacttcgtgaccatgctgaagatggtgtggatcagcaaggccagcgccatccagagaaagggcagagccggcagatgcagacccggcatctgcttcagactgttcagcagactgagattccagaacatgctggagttccagacccccgagctgctgagaatgcccctgcaggagctgtgcctgcacaccaagctgctggcccccgtgaactgccccatcgccgacttcctgatgaaggcccccgagcccccccccgccctgatcgtgagaaacgccgtgcagatgctgaagaccatcgacgccatggacacctgggaggacctgaccgagctgggctaccacctggccgacctgcccgtggagccccacctgggcaagatggtgctgtgcgccgtggtgctgaagtgcctggaccccatcctgaccatcgcctgcaccctggcctacagagaccccttcgtgctgcccacccaggccagccagaagagagccgccatgctgtgcagaaagagattcaccgccggcgccttcagcgaccacatggccctgctgagagccttccaggcctggcagaaggccagaagcgacggctgggagagagccttctgcgagaagaacttcctgagccaggccaccatggagatcatcatcggcatgagaacccagctgctgggccagctgagagccagcggcttcgtgagagccagaggcggcggcgacatcagagacgtgaacaccaacagcgagaactgggccgtggtgaaggccgccctggtggccggcatgtaccccaacctggtgcacgtggacagagagaacctggtgctgaccggccccaaggagaagaaggtgagattccaccccgccagcgtgctgagccagccccagtacaagaagatcccccccgccaacggccaggccgccgccatcaaggccctgcccaccgactggctgatctacgacgagatgaccagagcccacagaatcgccaacatcagatgctgcagcgccgtgacccccgtgaccatcctggtgttctgcggccccgccagactggccagcaacgccctgcaggagcccagcagcttcagagtggacggcatccccaacgacagcagcgacagcgagatggaggacaagaccaccgccaacctggccgccctgaagctggacgagtggctgcacttcaccctggagcccgaggccgccagcctgctgctgcagctgagacagaagtggcacagcctgttcctgagaagaatgagagcccccagcaagccctggagccaggtggacgaggccaccatcagagccatcatcgccgtgctgagcaccgaggagcagagcgccggcctgcagcagcccagcggcatcggccagagacccagacccatgagcagcgaggagctgcccctggccagcagctggagaagcaacaacagcagaaagagcagcgccgacaccgagttcagcgacgagtgcaccaccgccgagagagtgctgatgaagagccccagccccgccctgcaccccccccagaagtacaaggacagaggcatcctgcaccccaagagaggcaccgaggacagaagcgaccagagcagcctgaagagcaccgacagcagcagctaccccagcccctgcgccagccccagcccccccagcagcggcaagggcagcaagagccccagccccagacccaacatgcccgtgagatacttcatcatgaagagcagcaacctgagaaacctggagatcagccagcagaagggcatctggagcaccacccccagcaacgagagaaagctgaacagagccttctgggagagcagcatcgtgtacctggtgttcagcgtgcagggcagcggccacttccagggcttcagcagaatgagcagcgagatcggcagagagaagagccaggactggggcagcgccggcctgggcggcgtgttcaaggtggagtggatcagaaaggagagcctgcccttccagttcgcccaccacctgctgaacccctggaacgacaacaagaaggtgcagatcagcagagacggccaggagctggagcccctggtgggcgagcagctgctgcagctgtgggagagactgcccctgggcgagaagaacaccaccgactag

SEQ ID NO: 26164 - DNA, 597 bp, Artificial Sequence
  Description of Artificial Sequence: Synthetic coding sequence
atgctgttcctgggcagcctgggcgcctggggcaccaccagcatcagcaccggcagcatcttcagcctgaagaccctgagaagccagcacggcggccaggtgggcctgaaggtgagcagacccagagcccccagaatgggcgccgccacccccacccccagagccccctgggtggccagatggctgatgggcagccaggccttcaccgccacccccagcgccagacccccccccccccccatcaagcacaacatggacatcggcacctgggacaacaagggccccgtgcccaaggcccccgtgccccagcaggcccccagcccccaggccgccccccagccccagcaggtggcccagcccctgcccgcccagccccccgccctggcccagccccagtaccagagcccccagcagcccccccagaccagatgggtggcccccagaaacagaaacgccgccttcggccagagcggcggcgccggcagcgacagcaacagccccggcaacgtgcagcccaacagcgcccccagcgtggagagccaccccgtgctggagaagctgaaggccgcccacagctacaaccccaaggagttctag

SEQ ID NO: 26165 - DNA, 1530 bp, Artificial Sequence
  Description of Artificial Sequence: Synthetic coding sequence
atgagcgacccctacctgagcagctactacccccccagcatcggcttcccctacagcctgaacgaggccccctggagcaccgccggcgacccccccatcccctacctgaccacctacggccagctgagcaacggcgaccaccacttcatgcacgacgccgtgttcggccagcccggcggcctgggcaacaacatctaccagcacagattcaacttcttccccgagaaccccgccttcagcgcctggggcaccagcggcagccagggccagcagacccagagcagcgcctacggcagcagctacacctacccccccagcagcctgggcggcaccgtggtggacggccagcccggcttccacagcgacaccctgagcaaggcccccggcatgaacagcctggagcagggcatggtgggcctgaagatcggcgacgtgagcagcagcgccgtgaagaccgtgggcagcgtggtgagcagcgtggccctgaccggcgtgctgagcggcaacggcggcaccaacgtgaacatgcccgtgagcaagcccaccagctgggccgccatcgccagcaagcccgccaagccccagcccaagatgaagaccaagagcggccccgtgatgggcggcggcctgccccccccccccatcaagcacaacatggacatcggcacctgggacaacaagggccccgtgcccaaggcccccgtgccccagcaggcccccagcccccaggccgccccccagccccagcaggtggcccagcccctgcccgcccagccccccgccctggcccagccccagtaccagagcccccagcagcccccccagaccagatgggtggcccccagaaacagaaacgccgccttcggccagagcggcggcgccggcagcgacagcaacagccccggcaacgtgcagcccaacagcgcccccagcgtggagagccaccccgtgctggagaagctgaaggccgcccacagctacaaccccaaggagttcgagtggaacctgaagagcggcagagtgttcatcatcaagagctacagcgaggacgacatccacagaagcatcaagtacagcatctggtgcagcaccgagcacggcaacaagagactggacagcgccttcagatgcatgagcagcaagggccccgtgtacctgctgttcagcgtgaacggcagcggccacttctgcggcgtggccgagatgaagagccccgtggactacggcaccagcgccggcgtgtggagccaggacaagtggaagggcaagttcgacgtgcagtggatcttcgtgaaggacgtgcccaacaaccagctgagacacatcagactggagaacaacgacaacaagcccgtgaccaacagcagagacacccaggaggtgcccctggagaaggccaagcaggtgctgaagatcatcagcagctacaagcacaccaccagcatcttcgacgacttcgcccactacgagaagagacaggaggaggaggaggtggtgagaaaggagagacagagcagaaacaagcagtag

SEQ ID NO: 26166 - DNA, 1680 bp, Artificial Sequence
  Description of Artificial Sequence: Synthetic coding sequence
atgagcgccaccagcgtggacacccagagaaccaagggccaggacaacaaggtgcagaacggcagcctgcaccagaaggacaccgtgcacgacaacgacttcgagccctacctgaccggccagagcaaccagagcaacagctaccccagcatgagcgacccctacctgagcagctactacccccccagcatcggcttcccctacagcctgaacgaggccccctggagcaccgccggcgacccccccatcccctacctgaccacctacggccagctgagcaacggcgaccaccacttcatgcacgacgccgtgttcggccagcccggcggcctgggcaacaacatctaccagcacagattcaacttcttccccgagaaccccgccttcagcgcctggggcaccagcggcagccagggccagcagacccagagcagcgcctacggcagcagctacacctacccccccagcagcctgggcggcaccgtggtggacggccagcccggcttccacagcgacaccctgagcaaggcccccggcatgaacagcctggagcagggcatggtgggcctgaagatcggcgacgtgagcagcagcgccgtgaagaccgtgggcagcgtggtgagcagcgtggccctgaccggcgtgctgagcggcaacggcggcaccaacgtgaacatgcccgtgagcaagcccaccagctgggccgccatcgccagcaagcccgccaagccccagcccaagatgaagaccaagagcggccccgtgatgggcggcggcctgccccccccccccatcaagcacaacatggacatcggcacctgggacaacaagggccccgtgcccaaggcccccgtgccccagcaggcccccagcccccaggccgccccccagccccagcaggtggcccagcccctgcccgcccagccccccgccctggcccagccccagtaccagagcccccagcagcccccccagaccagatgggtggcccccagaaacagaaacgccgccttcggccagagcggcggcgccggcagcgacagcaacagccccggcaacgtgcagcccaacagcgcccccagcgtggagagccaccccgtgctggagaagctgaaggccgcccacagctacaaccccaaggagttcgagtggaacctgaagagcggcagagtgttcatcatcaagagctacagcgaggacgacatccacagaagcatcaagtacagcatctggtgcagcaccgagcacggcaacaagagactggacagcgccttcagatgcatgagcagcaagggccccgtgtacctgctgttcagcgtgaacggcagcggccacttctgcggcgtggccgagatgaagagccccgtggactacggcaccagcgccggcgtgtggagccaggacaagtggaagggcaagttcgacgtgcagtggatcttcgtgaaggacgtgcccaacaaccagctgagacacatcagactggagaacaacgacaacaagcccgtgaccaacagcagagacacccaggaggtgcccctggagaaggccaagcaggtgctgaagatcatcagcagctacaagcacaccaccagcatcttcgacgacttcgcccactacgagaagagacaggaggaggaggaggtggtgagaaaggagagacagagcagaaacaagcagtag

SEQ ID NO: 26167 - DNA, 879 bp, Artificial Sequence
  Description of Artificial Sequence: Synthetic coding sequence
atgctgagaaagctgtggcagtggttctacgaggagaccgagagcagcgacgacgtggaggtgctgaccctgaagaagttcaagggcgacctggcctacagaagacaggagtaccagaaggccctgcaggagtacagcagcatcagcgagaagctgagcagcaccaacttcgccatgaagagagacgtgcaggagggccaggccagatgcctggcccacctgggcagacacatggaggccctggagatcgccgccaacctggagaacaaggccaccaacaccgaccacctgaccaccgtgctgtacctgcagctggccatctgcagcagcctgcagaacctggagaagaccatcttctgcctgcagaagctgatcagcctgcaccccttcaacccctggaactggggcaagctggccgaggcctacctgaacctgggccccgccctgagcgccgccctggccagcagccagaagcagcacagcttcaccagcagcgacaagaccatcaagagcttcttcccccacagcggcaaggactgcctgctgtgcttccccgagaccctgcccgagagcagcctgttcagcgtggaggccaacagcagcaacagccagaagaacgagaaggccctgaccaacatccagaactgcatggccgagaagagagagaccgtgctgatcgagacccagctgaaggcctgcgccagcttcatcagaaccagactgctgctgcagttcacccagccccagcagaccagcttcgccctggagagaaacctgagaacccagcaggagatcgaggacaagatgaagggcttcagcttcaaggaggacaccctgctgctgatcgccgaggtgagcgtgagcctgggcttcatgtag

SEQ ID NO: 26168 - DNA, 684 bp, Artificial Sequence
  Description of Artificial Sequence: Synthetic coding sequence
atggccgagctggacatcggccagcactgccaggtggagcactgcagacagagagacttcctgcccttcgtgtgcgacgactgcagcggcatcttctgcctggagcacagaagcagagagagccacggctgccccgaggtgaccgtgatcaacgagagactgaagaccgaccagcacaccagctacccctgcagcttcaaggactgcgccgagagagagctggtggccgtgatctgcccctactgcgagaagaacttctgcctgagacacagacaccagagcgaccacgagtgcgagaagctggagatccccaagcccagaatggccgccacccagaagctggtgaaggacatcatcgacagcaagaccggcgagaccgccagcaagagatggaagggcgccaagaacagcgagaccgccgccaaggtggccctgatgaagctgaagatgcacgccgacggcgacaagagcctgccccagaccgagagaatctacttccaggtgttcctgcccaagggcagcaaggagaagagcaagcccatgttcttctgccacagatggagcatcggcaaggccatcgacttcgccgccagcctggccagactgaagaacgacaacaacaagttcaccgccaaggtgaccagccactacaacaacatcagcatcctgatcaaggtgctgtag

SEQ ID NO: 26169 - DNA, 786 bp, Artificial Sequence
  Description of Artificial Sequence: Synthetic coding sequence
atggccgagctggacatcggccagcactgccaggtggagcactgcagacagagagacttcctgcccttcgtgtgcgacgactgcagcggcatcttctgcctggagcacagaagcagagagagccacggctgccccgaggtgaccgtgatcaacgagagactgaagaccgaccagcacaccagctacccctgcagcttcaaggactgcgccgagagagagctggtggccgtgatctgcccctactgcgagaagaacttctgcctgagacacagacaccagagcgaccacgagtgcgagaagctggagatccccaagcccagaatggccgccacccagaagctggtgaaggacatcatcgacagcaagaccggcgagaccgccagcaagagatggaagggcgccaagaacagcgagaccgccgccaaggtggccctgatgaagctgaagatgcacgccgacggcgacaagagcctgccccaggtgttcctgcccaagggcagcaaggagaagagcaagcccatgttcttctgccacagatggagcatcggcaaggccatcgacttcgccgccagcctggccagactgaagaacgacaacaacaagttcaccgccaagaagctgagactgtgccacatcaccagcggcgaggccctgcccctggaccacaccctggagacctggatcgccaaggaggactgccccctgtacaacggcggcaacatcatcctggagtacctgaacgacgaggagcagttctgcaagaacgtggagagctacctggagtag

SEQ ID NO: 26170 - DNA, 3696 bp, Artificial Sequence
  Description of Artificial Sequence: Synthetic coding sequence
atgtgcaagtgctgcaacctgttcagccccaaccagagcgagctgctgagccacgtgagcgagaagcacatggaggagggcgtgaacgtggacgagatcatcatccccctgagacccctgagcacccccgagccccccaacagcagcaagaccggcgacgagttcctggtgatgaagagaaagagaggcagacccaagggcagcaccaagaagagcagcaccgaggaggagctggccgagaacatcgtgagccccaccgaggacagccccctggcccccgaggagggcaacagcctgccccccagcagcctggagtgcagcaagtgctgcagaaagttcagcaacaccagacagctgagaaagcacatctgcatcatcgtgctgaacctgggcgaggaggagggcgaggccggcaacgagagcgacctggagctggagaagaagtgcaaggaggacgacagagagaaggccagcaagagacccagaagccagaagaccgagaaggtgcagaagatcagcggcaaggaggccagacagctgagcggcgccaagaagcccatcatcagcgtggtgctgaccgcccacgaggccatccccggcgccaccaagatcgtgcccgtggaggccggcccccccgagaccggcgccaccaacagcgagaccaccagcgccgacctggtgcccagaagaggctaccaggagtacgccatccagcagaccccctacgagcagcccatgaagagcagcagactgggccccacccagctgaagatcttcacctgcgagtactgcaacaaggtgttcaagttcaagcacagcctgcaggcccacctgagaatccacaccaacgagaagccctacaagtgcccccagtgcagctacgccagcgccatcaaggccaacctgaacgtgcacctgagaaagcacaccggcgagaagttcgcctgcgactactgcagcttcacctgcctgagcaagggccacctgaaggtgcacatcgagagagtgcacaagaagatcaagcagcactgcagattctgcaagaagaagtacagcgacgtgaagaacctgatcaagcacatcagagacgcccacgacccccaggacaagaaggtgaaggaggccctggacgagctgtgcctgatgaccagagagggcaagagacagctgctgtacgactgccacatctgcgagagaaagttcaagaacgagctggacagagacagacacatgctggtgcacggcgacaagtggcccttcgcctgcgagctgtgcggccacggcgccaccaagtaccaggccctggagctgcacgtgagaaagcaccccttcgtgtacgtgtgcgccgtgtgcagaaagaagttcgtgagcagcatcagactgagaacccacatcaaggaggtgcacggcgccgcccaggaggccctggtgttcaccagcagcatcaaccagagcttctgcctgctggagcccggcggcgacatccagcaggaggccctgggcgaccagctgcagctggtggaggaggagttcgccctgcagggcgtgaacgccctgaaggaggaggcctgccccggcgacacccagctggaggagggcagaaaggagcccgaggcccccggcgagatgcccgcccccgccgtgcacctggccagcccccaggccgagagcaccgccctgcccccctgcgagctggagaccaccgtggtgagcagcagcgacctgcacagccaggaggtggtgagcgacgacttcctgctgaagaacgacaccagcagcgccgaggcccacgccgcccccgagaagccccccgacatgcagcacagaagcagcgtgcagacccagggcgaggtgatcaccctgctgctgagcaaggcccagagcgccggcagcgaccaggagagccacggcgcccagagccccctgggcgagggccagaacatggccgtgctgagcgccggcgaccccgaccccagcagatgcctgagaagcaaccccgccgaggccagcgacctgctgccccccgtggccggcggcggcgacaccatcacccaccagcccgacagctgcaaggccgcccccgagcacagaagcggcatcaccgccttcatgaaggtgctgaacagcctgcagaagaagcagatgaacaccagcctgtgcgagagaatcagaaaggtgtacggcgacctggagtgcgagtactgcggcaagctgttctggtaccaggtgcacttcgacatgcacgtgagaacccacaccagagagcacctgtactactgcagccagtgccactacagcagcatcaccaagaactgcctgaagagacacgtgatccagaagcacagcaacatcctgctgaagtgccccaccgacggctgcgactacagcacccccgacaagtacaagctgcaggcccacctgaaggtgcacaccgccctggacaagagaagctacagctgccccgtgtgcgagaagagcttcagcgaggacagactgatcaagagccacatcaagaccaaccaccccgaggtgagcatgagcaccatcagcgaggtgctgggcagaagagtgcagctgaagggcctgatcggcaagagagccatgaagtgcccctactgcgacttctacttcatgaagaacggcagcgacctgcagagacacatctgggcccacgagggcgtgaagcccttcaagtgcagcctgtgcgagtacgccaccagaagcaagagcaacctgaaggcccacatgaacagacacagcaccgagaagacccacctgtgcgacatgtgcggcaagaagttcaagagcaagggcaccctgaagagccacaagctgctgcacaccgccgacggcaagcagttcaagtgcaccgtgtgcgactacaccgccgcccagaagccccagctgctgagacacatggagcagcacgtgagcttcaagcccttcagatgcgcccactgccactacagctgcaacatcagcggcagcctgaagagacactacaacagaaagcaccccaacgaggagtacgccaacgtgggcaccggcgagctggccgccgaggtgctgatccagcagggcggcctgaagtgccccgtgtgcagcttcgtgtacggcaccaagtgggagttcaacagacacctgaagaacaagcacggcctgaaggtggtggagatcgacggcgaccccaagtgggagaccgccaccgaggcccccgaggagcccagcacccagtacctgcacatcaccgaggccgaggaggacgtgcagggcacccaggccgccgtggccgccctgcaggacctgagatacaccagcgagagcggcgacagactggaccccaccgccgtgaacatcctgcagcagatcatcgagctgggcgccgagacccacgacgccaccgccctggccagcgtggtggccatggcccccggcaccgtgaccgtggtgaagcaggtgaccgaggaggagcccagcagcaaccacaccgtgatgatccaggagaccgtgcagcaggccagcgtggagctggccgagcagcaccacctggtggtgagcagcgacgacgtggagggcatcgagaccgtgaccgtgtacacccagggcggcgaggccagcgagttcatcgtgtacgtgcaggaggccatgcagcccgtggaggagcaggccgtggagcagcccgcccaggagctgtag

SEQ ID NO: 26171 - DNA, 1905 bp, Artificial Sequence
  Description of Artificial Sequence: Synthetic coding sequence
atggagcccagccccctgagccccagcggcgccgccctgcccctgcccctgagcctggcccccccccccctgcccctgcccgccgccgccgtggtgcacgtgagcttccccgaggtgaccagcgccctgctggagagcctgaaccagcagagactgcagggccagctgtgcgacgtgagcatcagagtgcagggcagagagttcagagcccacagagccgtgctggccgccagcagcccctacttccacgaccaggtgctgctgaagggcatgaccagcatcagcctgcccagcgtgatggaccccggcgccttcgagaccgtgctggccagcgcctacaccggcagactgagcatggccgccgccgacatcgtgaacttcctgaccgtgggcagcgtgctgcagatgtggcacatcgtggacaagtgcaccgagctgctgagagagggcagagccagcgccaccaccaccatcaccaccgccgccgccaccagcgtgaccgtgcccggcgccggcgtgcccagcggcagcggcggcaccgtggcccccgccaccatgggcagcgccagaagccacgccagcagcagagccagcgagaaccagagccccagcagcagcaactacttcagccccagagagagcaccgacttcagcagcagcagccaggaggccttcgccgccagcgccgtgggcagcggcgagagaagaggcggcggccccgtgttccccgcccccgtggtgggcagcggcggcgccaccagcggcaagctgctgctggaggccgacgagctgtgcgacgacggcggcgacggcagaggcgccgtggtgcccggcgccggcctgagaagacccacctacaccccccccagcatcatgccccagaagcactgggtgtacgtgaagagaggcggcaactgccccgcccccgcccccctggtgccccaggaccccgacctggaggaggaggaggaggaggaggacctggtgctgacctgcgaggacgacgaggacgaggagctgggcggcagcagcagagtgcccgtgggcggcggccccgaggccaccctgagcatcagcgacgtgagaaccctgagcgagccccccgacaagggcgaggagcaggtgaacttctgcgagagcagcaacgacttcggcccctacgagggcggcggccccgtggccggcctggacgacagcggcggccccacccccagcagctacgcccccagccacccccccagacccctgctgcccctggacatgcagggcaaccagatcctggtgttccccagcagcagcagcagcagcagcagccaggcccccggccagccccccggcaaccaggccgagcacggcgccgtgaccgtgggcggcaccagcgtgggcagcctgggcgtgcccggcagcgtgggcggcgtgcccggcggcaccggcagcggcgacggcaacaagatcttcctgtgccactgcggcaaggccttcagccacaagagcatgagagacagacacgtgaacatgcacctgaacctgagacccttcgactgccccgtgtgcaacaagaagttcaagatgaagcaccacctgaccgagcacatgaagacccacaccggcctgaagccctacgagtgcggcgtgtgcgccaagaagttcatgtggagagacagcttcatgagacacagaggccactgcgagagaagacacagactgggcggcgtgggcgccgtgcccggccccggcacccccaccggccccagcctgcccagcaagagagagagccccggcgtgggcggcggcagcggcgacgaggccagcgccgccaccccccccagcagcagaagagtgtggagcccccccagagtgcacaaggtggagatgggcttcggcggcggcggcggcgccaactag

SEQ ID NO: 26172 - DNA, 1905 bp, Artificial Sequence; identical to SEQ ID NO: 26171
  Description of Artificial Sequence: Synthetic coding sequence

SEQ ID NO: 26173 - DNA, 1905 bp, Artificial Sequence; identical to SEQ ID NO: 26171
  Description of Artificial Sequence: Synthetic coding sequence

SEQ ID NO: 26174 - DNA, 450 bp, Artificial Sequence
  Description of Artificial Sequence: Synthetic coding sequence
atggagcccagccccctgagccccagcggcgccgccctgcccctgcccctgagcctggcccccccccccctgcccctgcccgccgccgccgtggtgcacgtgagcttccccgaggtgaccagcgccctgctggagagcctgaaccagcagagactgcagggccagctgtgcgacgtgagcatcagagtgcagggcagagagttcagagcccacagagccgtgctggccgccagcagcccctacttccacgaccaggtgctgctgaagggcatgaccagcatcagcctgcccagcgtgatggaccccggcgccttcgagaccgtgctggccagcgcctacaccggcagactgagcatggccgccgccgacatcgtgaacttcctgaccgtgggcagcgtgctgcagatgtggcacatcgtggacaagtgcaccgagctgctgagagagtag

SEQ ID NO: 26175 - DNA, 450 bp, Artificial Sequence; identical to SEQ ID NO: 26174
  Description of Artificial Sequence: Synthetic coding sequence

SEQ ID NO: 26176 - DNA, 450 bp, Artificial Sequence; identical to SEQ ID NO: 26174
  Description of Artificial Sequence: Synthetic coding sequence

SEQ ID NO: 26177 - DNA, 1905 bp, Artificial Sequence; identical to SEQ ID NO: 26171
  Description of Artificial Sequence: Synthetic coding sequence

SEQ ID NO: 26178 - DNA, 1905 bp, Artificial Sequence; identical to SEQ ID NO: 26171
  Description of Artificial Sequence: Synthetic coding sequence

SEQ ID NO: 26179 - DNA, 1905 bp, Artificial Sequence; identical to SEQ ID NO: 26171
  Description of Artificial Sequence: Synthetic coding sequence

SEQ ID NO: 26180 - DNA, 2019 bp, Artificial Sequence
  Description of Artificial Sequence: Synthetic coding sequence
atggagagcagaaagctgatcagcgccaccgacatccagtacagcggcagcctgctgaacagcctgaacgagcagagaggccacggcctgttctgcgacgtgaccgtgatcgtggaggacagaaagttcagagcccacaagaacatcctgagcgccagcagcacctacttccaccagctgttcagcgtggccggccaggtggtggagctgagcttcatcagagccgagatcttcgccgagatcctgaactacatctacagcagcaagatcgtgagagtgagaagcgacctgctggacgagctgatcaagagcggccagctgctgggcgtgaagttcatcgccgagctgggcgtgcccctgagccaggtgaagagcatcagcggcaccgcccaggacggcaacaccgagcccctgccccccgacagcggcgacaagaacctggtgatccagaagagcaaggacgaggcccaggacaacggcgccaccatcatgcccatcatcaccgagagcttcagcctgagcgccgaggactacgagatgaagaagatcatcgtgaccgacagcgacgacgacgacgacgacgtgatcttctgcagcgagatcctgcccaccaaggagaccctgcccagcaacaacaccgtggcccaggtgcagagcaaccccggccccgtggccatcagcgacgtggcccccagcgccagcaacaacagcccccccctgaccaacatcacccccacccagaagctgcccacccccgtgaaccaggccaccctgagccagacccagggcagcgagaagctgctggtgagcagcgcccccacccacctgacccccaacatcatcctgctgaaccagacccccctgagcaccccccccaacgtgagcagcagcctgcccaaccacatgcccagcagcatcaacctgctggtgcagaaccagcagacccccaacagcgccatcctgaccggcaacaaggccaacgaggaggaggaggaggagatcatcgacgacgacgacgacaccatcagcagcagccccgacagcgccgtgagcaacaccagcctggtgccccaggccgacaccagccagaacaccagcttcgacggcagcctgatccagaagatgcagatccccaccctgctgcaggagcccctgagcaacagcctgaagatcagcgacatcatcaccagaaacaccaacgaccccggcgtgggcagcaagcacctgatggagggccagaagatcatcaccctggacaccgccaccgagatcgagggcctgagcaccggctgcaaggtgtacgccaacatcggcgaggacacctacgacatcgtgatccccgtgaaggacgaccccgacgagggcgaggccagactggagaacgagatccccaagaccagcggcagcgagatggccaacaagagaatgaaggtgaagcacgacgaccactacgagctgatcgtggacggcagagtgtactacatctgcatcgtgtgcaagagaagctacgtgtgcctgaccagcctgagaagacacttcaacatccacagctgggagaagaagtacccctgcagatactgcgagaaggtgttccccctggccgagtacagaaccaagcacgagatccaccacaccggcgagagaagataccagtgcctggcctgcggcaagagcttcatcaactaccagttcatgagcagccacatcaagagcgtgcacagccaggaccccagcggcgacagcaagctgtacagactgcacccctgcagaagcctgcagatcagacagtacgcctacctgagcgacagaagcagcaccatccccgccatgaaggacgacggcatcggctacaaggtggacaccggcaaggagccccccgtgggcaccaccaccagcacccagaacaagcccatgacctgggaggacatcttcatccagcaggagaacgacagcatcttcaagcagaacgtgaccgacggcagcaccgagttcgagttcatcatccccgagagctactag

SEQ ID NO: 26181 - DNA, 609 bp, Artificial Sequence
  Description of Artificial Sequence: Synthetic coding sequence
atgctgaccgccaccctgagcatcaacaccgagaacatcatcgacgtgctggccgccgccagctacatgcagatgttcagcgtggccagcacctgcagcgagttcatgaagagcagcatcctgtggaacacccccaacagccagcccgagaagggcctggacgccggccaggagaacaacagcaactgcaacttcaccagcagagacggcagcatcagccccgtgagcagcgagtgcagcgtggtggagagaaccatccccgtgtgcagagagagcagaagaaagagaaagagctacatcgtgatgagccccgagagccccgtgaagtgcggcacccagaccagcagcccccaggtgctgaacagcagcgccagctacagcgagaacagaaaccagcccgtggacagcagcctggccttcccctggaccttccccttcggcatcgacagaagaatccagcccgagaaggtgaagcaggccgagaacaccagaaccctggagctgcccggccccagcgagaccggcagaagaatggccgactacgtgacctgcgagagcaccaagaccaccctgcccctgggcaccgaggaggacgtgagaagcaagtag

SEQ ID NO: 26182 - DNA, 1713 bp, Artificial Sequence
  Description of Artificial Sequence: Synthetic coding sequence
atgggcgtgaagaccttcacccacagcagcagcagccacagccaggagatgctgggcaagctgaacatgctgagaaacgacggccacttctgcgacatcaccatcagagtgcaggacaagatcttcagagcccacaaggtggtgctggccgcctgcagcgacttcttcagaaccaagctggtgggccaggccgaggacgagaacaagaacgtgctggacctgcaccacgtgaccgtgaccggcttcatccccctgctggagtacgcctacaccgccaccctgagcatcaacaccgagaacatcatcgacgtgctggccgccgccagctacatgcagatgttcagcgtggccagcacctgcagcgagttcatgaagagcagcatcctgtggaacacccccaacagccagcccgagaagggcctggacgccggccaggagaacaacagcaactgcaacttcaccagcagagacggcagcatcagccccgtgagcagcgagtgcagcgtggtggagagaaccatccccgtgtgcagagagagcagaagaaagagaaagagctacatcgtgatgagccccgagagccccgtgaagtgcggcacccagaccagcagcccccaggtgctgaacagcagcgccagctacagcgagaacagaaaccagcccgtggacagcagcctggccttcccctggaccttccccttcggcatcgacagaagaatccagcccgagaaggtgaagcaggccgagaacaccagaaccctggagctgcccggccccagcgagaccggcagaagaatggccgactacgtgacctgcgagagcaccaagaccaccctgcccctgggcaccgaggaggacgtgagagtgaaggtggagagactgagcgacgaggaggtgcacgaggaggtgagccagcccgtgagcgccagccagagcagcctgagcgaccagcagaccgtgcccggcagcgagcaggtgcaggaggacctgctgatcagcccccagagcagcagcatcggcagcgtggacgagggcgtgagcgagggcctgcccaccctgcagagcaccagcagcaccaacgccccccccgacgacgacgacagactggagaacgtgcagtacccctaccagctgtacatcgcccccagcaccagcagcaccgagagacccagccccaacggccccgacagacccttccagtgccccacctgcggcgtgagattcaccagaatccagaacctgaagcagcacatgctgatccacagcggcatcaagcccttccagtgcgacagatgcggcaagaagttcaccagagcctacagcctgaagatgcacagactgaagcacgagggcaagagatgcttcagatgccagatctgcagcgccaccttcaccagcttcggcgagtacaagcaccacatgagagtgagcagacacatcatcagaaagcccagaatctacgagtgcaagacctgcggcgccatgttcaccaacagcggcaacctgatcgtgcacctgagaagcctgaaccacgaggccagcgagctggccaactacttccagagcagcgacttcctggtgcccgactacctgaaccaggagcaggaggagaccctggtgcagtacgacctgggcgagcacggcttcgagagcaacagcagcgtgcagatgcccgtgatcagccagtaccacagcaagggcaaggagccctag

SEQ ID NO: 26183 - DNA, 1713 bp, Artificial Sequence; identical to SEQ ID NO: 26182
  Description of Artificial Sequence: Synthetic coding sequence

SEQ ID NO: 26184 - DNA, 1404 bp, Artificial Sequence
  Description of Artificial Sequence: Synthetic coding sequence
atgggcgtgaagaccttcacccacagcagcagcagccacagccaggagatgctgggcaagctgaacatgctgagaaacgacggccacttctgcgacatcaccatcagagtgcaggacaagatcttcagagcccacaaggtggtgctggccgcctgcagcgacttcttcagaaccaagctggtgggccaggccgaggacgagaacaagaacgtgctggacctgcaccacgtgaccgtgaccggcttcatccccctgctggagtacgcctacaccgccaccctgagcatcaacaccgagaacatcatcgacgtgctggccgccgccagctacatgcagatgttcagcgtggccagcacctgcagcgagttcatgaagagcagcatcctgtggaacacccccaacagccagcccgagaagggcctggacgccggccaggagaacaacagcaactgcaacttcaccagcagagacggcagcatcagccccgtgagcagcgagtgcagcgtggtggagagaaccatccccgtgtgcagagagagcagaagaaagagaaagagctacatcgtgatgagccccgagagccccgtgaagtgcggcacccagaccagcagcccccaggtgctgaacagcagcgccagctacagcgagaacagaaaccagcccgtggacagcagcctggccttcccctggaccttccccttcggcatcgacagaagaatccagcccgagaaggtgaagcaggccgagaacaccagaaccctggagctgcccggccccagcgagaccggcagaagaatggccgactacgtgacctgcgagagcaccaagaccaccctgcccctgggcaccgaggaggacgtgagagtgaaggtggagagactgagcgacgaggaggtgcacgaggaggtgagccagcccgtgagcgccagccagagcagcctgagcgaccagcagaccgtgcccggcagcgagcaggtgcaggaggacctgctgatcagcccccagagcagcagcatcggcagcgtggacgagggcgtgagcgagggcctgcccaccctgcagagcaccagcagcaccaacgccccccccgacgacgacgacagactggagaacgtgcagtacccctaccagctgtacatcgcccccagcaccagcagcaccgagagacccagccccaacggccccgacagacccttccagtgccccacctgcggcgtgagattcaccagaatccagaacctgaagcagcacatgctgatccacagcggcatcaagcccttccagtgcgacagatgcggcaagaagttcaccagagcctacagcctgaagatgcacagactgaagcacgagggccaccccagaaagagcgccagcagaagcagcagcgccaccaactgctgctag

SEQ ID NO: 26185 - DNA, 1362 bp, Artificial Sequence
  Description of Artificial Sequence: Synthetic coding sequence
atgggcgtgaagaccttcacccacagcagcagcagccacagccaggagatgctgggcaagctgaacatgctgagaaacgacggccacttctgcgacatcaccatcagagtgcaggacaagatcttcagagcccacaaggtggtgctggccgcctgcagcgacttcttcagaaccaagctggtgggccaggccgaggacgagaacaagaacgtgctggacctgcaccacgtgaccgtgaccggcttcatccccctgctggagtacgcctacaccgccaccctgagcatcaacaccgagaacatcatcgacgtgctggccgccgccagctacatgcagatgttcagcgtggccagcacctgcagcgagttcatgaagagcagcatcctgtggaacacccccaacagccagcccgagaagggcctggacgccggccaggagaacaacagcaactgcaacttcaccagcagagacggcagcatcagccccgtgagcagcgagtgcagcgtggtggagagaaccatccccgtgtgcagagagagcagaagaaagagaaagagctacatcgtgatgagccccgagagccccgtgaagtgcggcacccagaccagcagcccccaggtgctgaacagcagcgccagctacagcgagaacagaaaccagcccgtggacagcagcctggccttcccctggaccttccccttcggcatcgacagaagaatccagcccgagaaggtgaagcaggccgagaacaccagaaccctggagctgcccggccccagcgagaccggcagaagaatggccgactacgtgacctgcgagagcaccaagaccaccctgcccctgggcaccgaggaggacgtgagagtgaaggtggagagactgagcgacgaggaggtgcacgaggaggtgagccagcccgtgagcgccagccagagcagcctgagcgaccagcagaccgtgcccggcagcgagcaggtgcaggaggacctgctgatcagcccccagagcagcagcatcggcagcgtggacgagggcgtgagcgagggcctgcccaccctgcagagcaccagcagcaccaacgccccccccgacgacgacgacagactggagaacgtgcagtacccctaccagctgtacatcgcccccagcaccagcagcaccgagagacccagccccaacggccccgacagacccttccagtgccccacctgcggcgtgagattcaccagaatccagaacctgaagcagcacatgctgatccacagcggcatcaagcccttccagtgcgacagatgcggcaagaagttcaccagagcctacagcctgaagatgcacagactgaagcacgaggtgatcagctag

SEQ ID NO: 26186 - DNA, 1425 bp, Artificial Sequence
  Description of Artificial Sequence: Synthetic coding sequence
atgggcgtgaagaccttcacccacagcagcagcagccacagccaggagatgctgggcaagctgaacatgctgagaaacgacggccacttctgcgacatcaccatcagagtgcaggacaagatcttcagagcccacaaggtggtgctggccgcctgcagcgacttcttcagaaccaagctggtgggccaggccgaggacgagaacaagaacgtgctggacctgcaccacgtgaccgtgaccggcttcatccccctgctggagtacgcctacaccgccaccctgagcatcaacaccgagaacatcatcgacgtgctggccgccgccagctacatgcagatgttcagcgtggccagcacctgcagcgagttcatgaagagcagcatcctgtggaacacccccaacagccagcccgagaagggcctggacgccggccaggagaacaacagcaactgcaacttcaccagcagagacggcagcatcagccccgtgagcagcgagtgcagcgtggtggagagaaccatccccgtgtgcagagagagcagaagaaagagaaagagctacatcgtgatgagccccgagagccccgtgaagtgcggcacccagaccagcagcccccaggtgctgaacagcagcgccagctacagcgagaacagaaaccagcccgtggacagcagcctggccttcccctggaccttccccttcggcatcgacagaagaatccagcccgagaaggtgaagcaggccgagaacaccagaaccctggagctgcccggccccagcgagaccggcagaagaatggccgactacgtgacctgcgagagcaccaagaccaccctgcccctgggcaccgaggaggacgtgagagtgaaggtggagagactgagcgacgaggaggtgcacgaggaggtgagccagcccgtgagcgccagccagagcagcctgagcgaccagcagaccgtgcccggcagcgagcaggtgcaggaggacctgctgatcagcccccagagcagcagcatcggcagcgtggacgagggcgtgagcgagggcctgcccaccctgcagagcaccagcagcaccaacgccccccccgacgacgacgacagactggagaacgtgcagtacccctaccagctgtacatcgcccccagcaccagcagcaccgagagacccagccccaacggccccgacagacccttccagtgccccacctgcggcgtgagattcaccagaatccagaacctgaagcagcacatgctgatccacagcggcatcaagcccttccagtgcgacagatgcggcaagaagttcaccagagcctacagcctgaagatgcacagactgaagcacgaggtgcccctgcagagacagggcaccatgatcgacaacagccaggccgtggacgagatgaccagaaacggcgagtag

SEQ ID NO: 26187 - DNA, 231 bp, Artificial Sequence
  Description of Artificial Sequence: Synthetic coding sequence
atgaagggcggcagcagagtgagcaaccccgccgtgatggcccaggaggaggaggacgtgagagactacaacctgaccgaggagcagaaggccatcaaggccaagtacccccccgtgaacagaaagtacgagtaccaccagacccacctgctgcagagcccccacagaatctacagccacctgcacagcagcgccatctggaacccctacctgcacctgatgggcacctag

SEQ ID NO: 26188 - DNA, 411 bp, Artificial Sequence
  Description of Artificial Sequence: Synthetic coding sequence
atggcccaggaggaggaggacgtgagagactacaacctgaccgaggagcagaaggccatcaaggccaagtacccccccgtgaacagaaagtacgagtacctggaccacaccgccgacgtgcagctgcacgcctggggcgacaccctggaggaggccttcgagcagtgcgccatggccatgttcggctacatgaccgacaccggcaccgtggagcccctgcagaccgtggaggtggagacccagggcgacgacctgcagagcctgctgttccacttcctggacgagtggctgtacaagttcagcgccgacgagttcttcatccccagagtgggcagaagaatcttcatcgtgcaggcccccagcggcaacagaagccagagcaacaacatcttcagcaacgccggcctgtag

SEQ ID NO: 26189 - DNA, 444 bp, Artificial Sequence
  Description of Artificial Sequence: Synthetic coding sequence
tgaggcggcagcagagtgagcaaccccgccgtgatggcccaggaggaggaggacgtgagagactacaacctgaccgaggagcagaaggccatcaaggccaagtacccccccgtgaacagaaagtacgagtacctggaccacaccgccgacgtgcagctgcacgcctggggcgacaccctggaggaggccttcgagcagtgcgccatggccatgttcggctacatgaccgacaccggcaccgtggagcccctgcagaccgtggaggtggagacccagggcgacgacctgcagagcctgctgttccacttcctggacgagtggctgtacaagttcagcgccgacgagttcttcatccccagagtgggcagaagaatcttcatcgtgcaggcccccagcggcaacagaagccagagcaacaacatcttcagcaacgccggcctgtag

SEQ ID NO: 26190 - DNA, 540 bp, Artificial Sequence
  Description of Artificial Sequence: Synthetic coding sequence
atgaagggcggcagcagagtgagcaaccccgccgtgatggcccaggaggaggaggacgtgagagactacaacctgaccgaggagcagaaggccatcaaggccaagtacccccccgtgaacagaaagtacgagtacctggaccacaccgccgacgtgcagctgcacgcctggggcgacaccctggaggaggccttcgagcagtgcgccatggccatgttcggctacatgaccgacaccggcaccgtggagcccctgcagaccgtggaggtggagacccagggcgacgacctgcagagcctgctgttccacttcctggacgagtggctgtacaagttcagcgccgacgagttcttcatccccagagaggtgaaggtgctgagcatcgaccagagaaacttcaagctgagaagcatcggctggggcgaggagttcagcctgagcaagcacccccagggcaccgaggtgaaggccatcacctacagcgccatgcaggtgtacaacgaggagaaccccgaggtgttcgtgatcatcgacatctag

SEQ ID NO: 26191 - DNA, 1488 bp, Artificial Sequence
  Description of Artificial Sequence: Synthetic coding sequence
atggccgccaactggaccctgagctggggccagggcggcccctgcaacagccccggcagcgacacccccagaagcgtggccagccccgagacccagctgggcaaccacgacagaaaccccgagacctggcacatgaacttcagaatgttcagctgccccgaggagagcgaccccatccaggccctgagaaagctgaccgagctgtgccacctgtggctgagacccgacctgcacaccaaggagcagatcctggacatgctggtgatggagcagttcatgatcagcatgccccaggagctgcaggtgctggtgaaggtgaacggcgtgcagagctgcaaggacctggaggacctgctgagaaacaacagaagacccaagaagtggagcatcgtgaacctgctgggcaaggagtacctgatgctgaacagcgacgtggagatggccgaggcccccgccagcgtgagagacgaccccagagacgtgagcagccagtgggccagcagcgtgaaccagatgcaccccggcaccggccaggccagaagagagcagcagatcctgcccagagtggccgccctgagcagaagacagggcgaggacttcctgctgcacaagagcatcgacgtgaccggcgaccccaacagccccagacccaagcagaccctggagaaggacctgaaggagaacagagaggagaaccccggcctgagcagccccgagccccagctgcccaagagccccaacctggtgagagccaaggagggcaaggagccccagaagagagccagcgtggagaacgtggacgccgacacccccagcgcctgcgtggtggagagagaggccctgacccacagcggcaacagaggcgacgccctgaacctgagcagccccaagagaagcaagcccgacgccagcagcatcagccaggaggagccccagggcgaggccacccccgtgggcaacagagagagccccggccaggccgagatcaaccccgtgcacagccccggccccgccggccccgtgagccaccccgacggccaggaggccaaggccctgccccccttcgcctgcgacgtgtgcaacaagagcttcaagtacttcagccagctgagcatccacagaagaagccacaccggcgacagacccttccagtgcgacctgtgcagaaagagattcctgcagcccagcgacctgagagtgcaccagagagtgcacaccggcgagagaccctacatgtgcgacgtgtgccagaagagattcgcccacgagagcaccctgcagggccacaagagaatccacaccggcgagagacccttcaagtgcaagtactgcagcaaggtgttcagccacaagggcaacctgaacgtgcaccagagaacccacagcggcgagaagccctacaagtgccccacctgccagaaggccttcagacagctgggcaccttcaagagacacctgaagacccacagagagaccaccagccagtag

SEQ ID NO: 26192 - DNA, 1491 bp, Artificial Sequence
  Description of Artificial Sequence: Synthetic coding sequence
atggccgccaactgcaccagcagctggagcctgggcgagagctgcaacagccccggcagcgagcccccccagagcatgcccagccccgccacccagctgggcaaccacgacagcgaccccgagacctgccacgtgaacttcagaatgttcagctgccccaaggagagcgaccccatccaggccctgagaaagctgaccgagctgtgccacctgtggctgagacccgacctgcacaccaaggagcagatcctggacatgctggtgatggagcagttcatgatcagcatgccccaggagctgcaggtgctggtgatgatgaacggcgtgcagagctgcaaggacctggaggacctgctgagaaacaacagaagacccaagaagtggagcgtggtgagcttcctgggcaaggagtacctgatgcaggagagcgacgtggagatggccgaggcccccgccagcgtgagagacgaccccagacacgtgagcagccagagaaccagcagcgtgaaccagatgtgccccgaggagggccaggccagccaggagctgcagaccctgcccagagtgcccgccctgttcagaagacaggaggaggacttcctgctgcccgagaccaccgtgatgaagggcgaccccaaggccctgagacccaagcccaccctggagaaggacctggaggaggacagagaggagaaccccggcctgaccagccccgagccccagctgcccaacagccccaccggcgtggtgggcgccaaggagggcaaggagccccagaagagagccagcgtggagaacgtggacgccgacacccccagcgcctgcgtggtggagagagaggccagcacccacagcggcagcagaggcgacgccctgaacctgagaggcctgaagagaagcaagcccgacgccaccagcatcagccaggaggagccccagggcgaggccacccccgtgggcaacagagagagccccggccaggccgagatcaaccccgtgcacagccccggccccgccggccccgtgagccaccccagcggccaggaggtgaaggagctgctgcccttcgcctgcgaggtgtgcggcaagagattcaagtacagaggcaagctggccgtgcacaccagaagccacaccggcgagagactgttccagtgcaacctgtgcggcaagagattcatgcagagaatcggcctgcagttccaccagagaacccacaccggcgagagaccctacacctgcgacatctgccagaagcagttcacccagaagagctacctgaagtgccacaagagaagccacaccggcgagaagcccttcgagtgcaaggactgcaagaaggtgttcacctacaaggccaacctgaaggagcaccagagaatccacagcggcgagaagccccacaagtgcagcaagtgccccagagccttcggcagacccgccaccctgagaagacaccagaagacccacagagaggccaccagccagtag

SEQ ID NO: 26193 - DNA, 1491 bp, Artificial Sequence; identical to SEQ ID NO: 26192
  Description of Artificial Sequence: Synthetic coding sequence

SEQ ID NO: 26194 - DNA, 2316 bp, Artificial Sequence
  Description of Artificial Sequence: Synthetic coding sequence
atggagaaggtgcagctggagttcgagaaccaggagatggagaagaagctgcaggagttcagaagcaccagaaacaaggagaaggaggacagagagagcagcgagtactactggaagagcggcaaggtgggcaagctggtgaaccagagctacatgatgagccagaacaagggcaacgtggtgaagttcagcgccggcaaggtgaagctgaagctgctgaaggagcagatccaggagcccgtgaagcccaccgtgaactacaagatggccaacagcagcgagtgcgagaagcccaagatcaacggcaaggtgtgcggccagtgcgagaacaaggccgccctgctggtgtgcctggagtgcggcgaggactactgcagcggctgcttcgccaaggtgcaccagaagggcgccctgaagctgcacagaaccaccctgctgcaggccaagagccagatcctgttcaacgtgctggacgtggcccaccagttcatcaaggacgtgaaccccgacgagcccaaggaggagaacaacagcaccaaggagaccagcaagatccagcacaagcccaagagcgtgctgctgcagagaagcagcagcgaggtggagatcaccaccatgaagagagcccagagaaccaagcccagaaagagcctgctgtgcgagggcagcttcgacgaggaggccagcgcccagagcttccaggaggtgctgagccagtggagaaccggcaaccacgacgacaacaagaagcagaacctgcacgccgccgtgaaggacagcctggaggagtgcgaggtgcagaccaacctgaagatctggagagagcccctgaacatcgagctgaaggaggacatcctgagctacatggagaagctgtggctgaagaagcacagaagaaccccccaggagcagctgttcaagatgctgcccgacaccttcccccacccccacgagaccaccggcgacgcccagtgcagccagaacgagaacgacgaggacagcgacggcgaggagaccaaggtgcagcacaccgccctgctgctgcccgtggagaccctgaacatcgagagacccgagcccagcctgaagatcgtggagctggacgacacctacgaggaggagttcgaggaggccgagaacatcgtgccctacaaggtgaagctggccgacgccgacagccagagaagctgcgccttccacgactgccagaagaacagcttcccctacgagaacggcatccaccagcaccacgtgttcgacaagggcaagagagacttcctgaacctgtgcctgagaaacagcagcacctactacaaggacaacagcaaggccgagaccagcaacaccgacttcgacaacatcgtggaccccgacgtgtacagcagcgacatcgagaagatcgaggagagcaccagcttcgagagaaacctgaaggagaagaacatcggcctggagagcaaccagaagagcgacgacagctgcgtgagcctggagagcaaggacaccctgctgggcagagacctggagaaggcccccatcgaggagaagctgagccaggacatcaaggagagcctggagctgagcaacctgtacaagagacccagcttcgaggagagcaagaccaccaagagcagcctgctgctgcaggagatcgcctgcagaagcaagcccatcaccaagcagtaccagggcctggagagattcttcatcttcgacaccaacgagagactgaacctgctgcccagccacagactggagtgcaacaacagcagcaccagaatcaccctggccggccagaagagccagagacccagcaccgccaacttccccctgagcaacagcgtgaaggagagcagcagctgcctgagcagcagccaccccagaagcagaagcgccgccgcccagagcagcagcagagccgccagcgagatcagcgagatcgagtacatcgacatcaccgaccagaacgagctgagcctggacgacaccaccgaccagcacaccctggacaacctggagaaggagctgcaggtgctgagaagcctggccgacaccagcgagaagctgtacagcctgaccagcgaggagttccccgacttcagcagccagagcctgaacatcagccagatcagcaccgacttcctgaagaccagccacgtgagaggcccctgcggcgtggaggagctgagctgcagcggcagagacaccaagatccagagcctgctgagcctgagcgagagcagcaccgacgaggaggaggaggacttcctgaacaagcagcacgtgatcaccctgccctggagcaagagcacctag

SEQ ID NO: 26195 - DNA, 2082 bp, Artificial Sequence
  Description of Artificial Sequence: Synthetic coding sequence
atgatcgcccccctgctgtgcatcctgagctacaacttcaacaccttcgccatcctgaacgtgtacagcaagctgaccatgttctgcaccaccaacagcctgcccatggacctgctgctgaagcagggcagcctgaagcaggaggtggagagcttctgctaccagatcgtgagcgagagcaacgaccagaaggtgggcatcctgcagagcgaggacaagcagctgcagcccagcgtgagcaagaagagcgagggcgagctgagcagagtgaagttcatcagcaacagcaacaagatcaccttcagcaagaagcccaagagaagaaagtacgacgagagctacctgagcttcggcttcacctacttcggcaacagagacgccccccacgcccagtgcgtgctgtgcaagaagatcctgagcaacagcagcctggcccccagcaagctgagaagacacctggagaccaagcacgccgcctacaaggacaaggacatcagcttcttcaagcagcacctggacagccccgagaacaacaagccccccacccccaagatcgtgaacaccgacaacgagagcgccaccgaggccagctacaacgtgagctaccacatcgccctgagcggcgaggcccacaccatcggcgagctgctgatcaagccctgcgccaaggacgtggtgatgagaatgttcgacgagcagtacagcaagaagatcgacgccgtgcagctgagcaacagcaccgtggccagaagaatcaaggacctggccgccgacatcgaggaggagctggtgtgcagactgaagatctgcgacggcttcagcctgcagctggacgagagcgccgacgtgagcggcctggccgtgctgctggtgttcgtgagatacagattcaacaagagcatcgaggaggacctgctgctgtgcgagagcctgcagagcaacgccaccggcgaggagatcttcaactgcatcaacagcttcatgcagaagcacgagatcgagtgggagaagtgcgtggacgtgtgcagcgacgccagcagagccgtggacggcaagatcgccgaggccgtgaccctgatcaagtacgtggcccccgagagcaccagcagccactgcctgctgtacagacacgccctggccgtgaagatcatgcccaccagcctgaagaacgtgctggaccaggccgtgcagatcatcaactacatcaaggccagaccccaccagagcagactgctgaagatcctgtgcgaggagatgggcgcccagcacaccgccctgctgctgaacaccgaggtgagatggctgagcagaggcaaggtgctggtgagactgttcgagctgagaagagagctgctggtgttcatggacagcgccttcagactgagcgactgcctgaccaacagcagctggctgctgagactggcctacctggccgacatcttcaccaagctgaacgaggtgaacctgagcatgcagggcaagaacgtgaccgtgttcaccgtgttcgacaagatgagcagcctgctgagaaagctggagttctgggccagcagcgtggaggaggagaacttcgactgcttccccaccctgagcgacttcctgaccgagatcaacagcaccgtggacaaggacatctgcagcgccatcgtgcagcacctgagaggcctgagagccaccctgctgaagtacttccccgtgaccaacgacaacaacgcctgggtgagaaaccccttcaccgtgaccgtgaagcccgccagcctggtggccagagactacgagagcctgatcgacctgaccagcgacagccaggtgaagcagaacttcagcgagctgagcctgaacgacttctggagcagcctgatccaggagtaccccagcatcgccagaagagccgtgagagtgctgctgcccttcgccaccatgcacctgtgcgagaccggcttcagctactacgccgccaccaagaccaagtacagaaagagactggacgccgccccccacatgagaatcagactgagcaacatcacccccaacatcaagagaatctgcgacaagaagacccagaagcactgcagccactag

SEQ ID NO: 26196 - DNA, 2082 bp, Artificial Sequence; identical to SEQ ID NO: 26195
  Description of Artificial Sequence: Synthetic coding sequence

SEQ ID NO: 26197 - DNA, 1305 bp, Artificial Sequence
  Description of Artificial Sequence: Synthetic coding sequence
atgcccgacagagacagctacgccaacggcaccggcagcagcggcggcggccccggcggcggcggcagcgaggaggccagcggcgccggcgtgggcagcggcggcgccagcagcgacgccatctgcagagacttcctgagaaacgtgtgcaagagaggcaagagatgcagatacagacaccccgacatgagcgaggtgagcaacctgggcgtgagcaagaacgagttcatcttctgccacgacttccagaacaaggagtgcagcagacccaactgcagattcatccacggcagcaaggaggacgaggacggctacaagaagaccggcgagctgccccccagactgagacagaaggtggccgccggcctgggcctgagccccgccgacctgcccaacggcaaggaggaggtgcccatctgcagagacttcctgaagggcgactgccagagaggcgccaagtgcaagttcagacacctgcagagagacttcgagttcgacgccagaggcggcggcggcaccggcggcggcagcaccggcagcgtgctgcccggcagaagacacgacctgtacgacatctacgacctgcccgacagaggcttcgaggaccacgagcccggccccaagagaagaagaggcggctgctgcccccccgacggcccccacttcgagagctacgagtacagcctggccccccccagaggcgtggagtgcagactgctggaggaggagaacgccatgctgagaaagagagtggaggagctgaagaagcaggtgagcaacctgctggccaccaacgaggtgctgctggagcagaacgcccagttcagaaaccaggccaaggtgatcaccctgagcagcaccgcccccgccaccgagcagaccctggcccccaccgtgggcaccgtggccaccttcaaccacggcatcgcccagacccacaccaccctgagcagccaggccctgcagcccagacccgtgagccagcaggagctggtggcccccgccggcgcccccgccgccccccccaccaacgccgccccccccgccgcccccccccccccccccccccacctgacccccgagatcacccccctgagcgccgccctggcccagaccatcgcccagggcatggcccccccccccgtgagcatggcccccgtggccgtgagcgtggcccccgtggcccccgtggccgtgagcatggcccagcccctggccggcatcaccatgagccacaccaccacccccatggtgacctaccccatcgccagccagagcatgagaatcaccgccatgccccactag

SEQ ID NO: 26198 - DNA, 270 bp, Artificial Sequence
  Description of Artificial Sequence: Synthetic coding sequence
atgcccgacagagacagctacgccaacggcaccggcagcagcggcggcggccccggcggcggcggcagcgaggaggccagcggcgccggcgtgggcagcggcggcgccagcagcgacgccatctgcagagacttcctgagaaacgtgtgcaagagaggcaagagatgcagatacagacaccccgacatgagcgaggtgagcaacctgggcgtgagcaagaacgagttcatcttctgccacgacttccagaacaaggagtgcagcagatag

SEQ ID NO: 26199 - DNA, 138 bp, Artificial Sequence
  Description of Artificial Sequence: Synthetic coding sequence
atgcccgacagagacagctacgccaacggcaccggcagcagcggcggcggccccggcggcggcggcagcgaggaggccagcggcgccggcgtgggcagcggcggcgccagcagcgacgccatctgcagagacttctag

SEQ ID NO: 26200 - DNA, 240 bp, Artificial Sequence
  Description of Artificial Sequence: Synthetic coding sequence
atgcccgacagagacagctacgccaacggcaccggcagcagcggcggcggccccggcggcggcggcagcgaggaggccagcggcgccggcgtgggcagcggcggcgccagcagcgacgccatctgcagagacttcctgagaaacgtgtgcaagagaggcaagagatgcagatacagacaccccgacatgagcgaggtgagcaacctgggcgtgagcaagaacgagttcatcttctgctag

SEQ ID NO: 26201 - DNA, 5136 bp, Artificial Sequence
  Description of Artificial Sequence: Synthetic coding sequence
atgatcagcaccgcccccctgtacagcggcgtgcacaactggaccagcagcgacagaatcagaatgtgcggcatcaacgaggagagaagagcccccctgagcgacgaggagagcaccaccggcgactgccagcacttcggcagccaggagttctgcgtgagcagcagcttcagcaaggtggagctgaccgccgtgggcagcggcagcaacgccagaggcgccgaccccgacggcagcgccaccgagaagctgggccacaagagcgaggacaagcccgacgacccccagcccaagatggactacgccggcaacgtggccgaggccgagggcttcctggtgcccctgagcagccccggcgacggcctgaagctgcccgccagcgacagcgccgaggccagcaacagcagagccgactgcagctggacccccctgaacacccagatgagcaagcaggtggactgcagccccgccggcgtgaaggccctggacagcagacagggcgtgggcgagaagaacaccttcatcctggccaccctgggcaccggcgtgcccgtggagggcaccctgcccctggtgaccaccaacttcagccccctgcccgcccccatctgcccccccgcccccggcagcgccagcgtgccccacagcgtgcccgacgccttccaggtgcccctgagcgtgcccgcccccgtgccccacagcggcctggtgcccgtgcaggtggccaccagcgtgcccgcccccagcccccccctggcccccgtgcccgccctggcccccgccccccccagcgtgcccaccctgatcagcgacagcaaccccctgagcgtgagcgccagcgtgctggtgcccgtgcccgccagcgccccccccagcggccccgtgcccctgagcgcccccgcccccgcccccctgagcgtgcccgtgagcgccccccccctggccctgatccaggcccccgtgccccccagcgcccccaccctggtgctggcccccgtgcccacccccgtgctggcccccatgcccgccagcaccccccccgccgcccccgccccccccagcgtgcccatgcccacccccacccccagcagcggcccccccagcacccccaccctgatccccgccttcgcccccacccccgtgcccgcccccacccccgcccccatcttcacccccgcccccacccccatgcccgccgccacccccgccgccatccccaccagcgcccccatccccgccagcttcagcctgagcagagtgtgcttccccgccgcccaggcccccgccatgcagaaggtgcccctgagcttccagcccggcaccgtgctgacccccagccagcccctggtgtacatccccccccccagctgcggccagcccctgagcgtggccaccctgcccaccaccctgggcgtgagcagcaccctgaccctgcccgtgctgcccagctacctgcaggacagatgcctgcccggcgtgctggccagccccgagctgagaagctacccctacgccttcagcgtggccagacccctgaccagcgacagcaagctggtgagcctggaggtgaacagactgccctgcaccagccccagcggcagcaccaccacccagcccgcccccgacggcgtgcccggccccctggccgacaccagcctggtgaccgccagcgccaaggtgctgcccaccccccagcccctgctgcccgcccccagcggcagcagcgcccccccccaccccgccaagatgcccagcggcaccgagcagcagaccgagggcaccagcgtgaccttcagccccctgaagagccccccccagctggagagagagatggccagcccccccgagtgcagcgagatgcccctggacctgagcagcaagagcaacagacagaagctgcccctgcccaaccagagaaagaccccccccatgcccgtgctgacccccgtgcacaccagcagcaaggccctgctgagcaccgtgctgagcagaagccagagaaccacccaggccgccggcggcaacgtgaccagctgcctgggcagcaccagcagccccttcgtgatcttccccgagatcgtgagaaacggcgaccccagcacctgggtgaagaacagcaccgccctgatcagcaccatccccggcacctacgtgggcgtggccaaccccgtgcccgccagcctgctgctgaacaaggaccccaacctgggcctgaacagagaccccagacacctgcccaagcaggagcccatcagcatcatcgaccagggcgagcccaagggcaccggcgccacctgcggcaagaagggcagccaggccggcgccgagggccagcccagcaccgtgaagagatacacccccgccagaatcgcccccggcctgcccggctgccagaccaaggagctgagcctgtggaagcccaccggccccgccaacatctaccccagatgcagcgtgaacggcaagcccaccagcacccaggtgctgcccgtgggctggagcccctaccaccaggccagcctgctgagcatcggcatcagcagcgccggccagctgacccccagccagggcgcccccatcagacccaccagcgtggtgagcgagttcagcggcgtgcccagcctgagcagcagcgaggccgtgcacggcctgcccgagggccagcccagacccggcggcagcttcgtgcccgagcaggaccccgtgaccaagaacaagacctgcagaatcgccgccaagccctacgaggagcaggtgaaccccgtgctgctgaccctgagcccccagaccggcaccctggccctgagcgtgcagcccagcggcggcgacatcagaatgaaccagggccccgaggagagcgagagccacctgtgcagcgacagcacccccaagatggagggcccccagggcgcctgcggcctgaagctggccggcgacaccaagcccaagaaccaggtgctggccacctacatgagccacgagctggtgctggccaccccccagaacctgcccaagatgcccgagctgcccctgctgccccacgacagccaccccaaggagctgatcctggacgtggtgcccagcagcagaagaggcagcagcaccgagagaccccagctgggcagccaggtggacctgggcagagtgaagatggagaaggtggacggcgacgtggtgttcaacctggccacctgcttcagagccgacggcctgcccgtggccccccagagaggccaggccgaggtgagagccaaggccggccaggccagagtgaagcaggagagcgtgggcgtgttcgcctgcaagaacaagtggcagcccgacgacgtgaccgagagcctgccccccaagaagatgaagtgcggcaaggagaaggacagcgaggagcagcagctgcagccccaggccaaggccgtggtgagaagcagccacagacccaagtgcagaaagctgcccagcgacccccaggagagcaccaagaagagccccagaggcgccagcgacagcggcaaggagcacaacggcgtgagaggcaagcacaagcacagaaagcccaccaagcccgagagccagagccccggcaagagagccgacagccacgaggagggcagcctggagaagaaggccaagagcagcttcagagacttcatccccgtggtgctgagcaccagaaccagaagccagagcggcagcatctgcagcagcttcgccggcatggccgacagcgacatgggcagccaggaggtgttccccaccgaggaggaggaggaggtgacccccacccccgccaagagaagaaaggtgagaaagacccagagagacacccagtacagaagccaccacgcccaggacaagagcctgctgagccagggcagaagacacctgtggagagccagagagatgccctggagaaccgaggccgccagacagatgtgggacaccaacgaggaggaggaggaggaggaggaggagggcctgctgaagagaaagaagagaagaagacagaagagcagaaagtaccagaccggcgagtacctgaccgagcaggaggacgagcagagaagaaagggcagagccgacctgaaggccagaaagcagaagaccagcagcagccagagcctggagcacagactgagaaacagaaacctgctgctgcccaacaaggtgcagggcatcagcgacagccccaacggcttcctgcccaacaacctggaggagcccgcctgcctggagaacagcgagaagcccagcggcaagagaaagtgcaagaccaagcacatggccaccgtgagcgaggaggccaaggacgtggtgctgtactgcctgcagaaggacagcgaggacgtgaaccacagagacaacgccggctacaccgccctgcacgaggcctgcagcagaggctggaccgacatcctgaacatcctgctggagcacggcgccaacgtgaactgcagcgcccaggacggcaccagacccgtgcacgacgccgtggtgaacgacaacctggagaccatctggctgctgctgagctacggcgccgaccccaccctggccacctacagcggccagaccgccatgaagctggccagcagcgacaccatgaagagattcctgagcgaccacctgagcgacctgcagggcagagccgagggcgaccccggcgtgagctgggacttctacagcagcagcgtgctggaggagaaggacggcttcgcctgcgacctgctgcacaacccccccggcagcagcgaccaggagggcgacgaccccatggaggaggacgacttcatgttcgagctgagcgacaagcccctgctgccctgctacaacctgcaggtgagcgtgagcagaggcccctgcaactggttcctgttcagcgacgtgctgaagagactgaagctgagcagcagaatcttccaggccagattcccccacttcgagatcaccaccatgcccaaggccgagttctacagacaggtggccagcagccagctgctgacccccgccgagagacccggcggcctggacgacagaagcccccccggcagcagcgagaccgtggagctggtgagatacgagcccgacctgctgagactgctgggcagcgaggtggagttccagagctgcaacagctag

SEQ ID NO: 26202 - DNA, 2511 bp, Artificial Sequence
  Description of Artificial Sequence: Synthetic coding sequence
atgaccgccaccgccgaggtggagacccccaagatggagaagagcgccagcaaggaggagaagcagcagcccaagcaggacagcaccgagcagggcaacgccgacagcgaggagtggatgagcagcgagagcgaccccgagcagatcagcctgaagagcagcgacaacagcaagagctgccagcccagagacggccagctgaagaagaaggagatgcacagcaagccccacagacagctgtgcagaagcccctgcctggacagacccagcttcagccagagcagcatcctgcaggacggcaagctggacctggagaaggagtaccaggccaagatggagttcgccctgaagctgggctacgccgaggagcagatccagagcgtgctgaacaagctgggccccgagagcctgatcaacgacgtgctggccgagctggtgagactgggcaacaagggcgacagcgagggccagatcaacctgagcctgctggtgcccagaggccccagcagcagagagatcgccagccccgagctgagcctggaggacgagatcgacaacagcgacaacctgagacccgtggtgatcgacggcagcaacgtggccatgagccacggcaacaaggaggagttcagctgcagaggcatccagctggccgtggactggttcctggacaagggccacaaggacatcaccgtgttcgtgcccgcctggagaaaggagcagagcagacccgacgcccccatcaccgaccaggacatcctgagaaagctggagaaggagaagatcctggtgttcacccccagcagaagagtgcagggcagaagagtggtgtgctacgacgacagattcatcgtgaagctggccttcgacagcgacggcatcatcgtgagcaacgacaactacagagacctgcaggtggagaagcccgagtggaagaagttcatcgaggagagactgctgatgtacagcttcgtgaacgacaagttcatgccccccgacgaccccctgggcagacacggccccagcctggagaacttcctgagaaagagacccatcgtgcccgagcacaagaagcagccctgcccctacggcaagaagtgcacctacggccacaagtgcaagtactaccaccccgagagagccaaccagccccagagaagcgtggccgacgagctgagaatcagcgccaagctgagcaccgtgaagaccatgagcgagggcaccctggccaagtgcggcaccggcatgagcagcgccaagggcgagatcaccagcgaggtgaagagagtggcccccaagagacagagcgaccccagcatcagaagcgtggccatggagcccgaggagtggctgagcatcgccagaaagcccgaggccagcagcgtgcccagcctggtgaccgccctgagcgtgcccaccatccccccccccaagagccacgccgtgggcgccctgaacaccagaagcgccagcagccccgtgcccggcagcagccacttcccccaccagaaggccagcctggagcacatggccagcatgcagtacccccccatcctggtgaccaacagccacggcacccccatcagctacgccgagcagtaccccaagttcgagagcatgggcgaccacggctactacagcatgctgggcgacttcagcaagctgaacatcaacagcatgcacaacagagagtactacatggccgaggtggacagaggcgtgtacgccagaaaccccaacctgtgcagcgacagcagagtgagccacaccagaaacgacaactacagcagctacaacaacgtgtacctggccgtggccgacacccaccccgagggcaacctgaagctgcacagaagcgccagccagaacagactgcagcccttcccccacggctaccacgaggccctgaccagagtgcagagctacggccccgaggacagcaagcagggcccccacaagcagagcgtgccccacctggccctgcacgcccagcaccccagcaccggcaccagaagcagctgccccgccgactaccccatgccccccaacatccaccccggcgccaccccccagcccggcagagccctggtgatgaccagaatggacagcatcagcgacagcagactgtacgagagcaaccccgtgagacagagaagaccccccctgtgcagagagcagcacgccagctgggaccccctgccctgcaccaccgacagctacggctaccacagctaccccctgagcaacagcctgatgcagccctgctacgagcccgtgatggtgagaagcgtgcccgagaagatggagcagctgtggagaaacccctgggtgggcatgtgcaacgacagcagagagcacatgatccccgagcaccagtaccagacctacaagaacctgtgcaacatcttccccagcaacatcgtgctggccgtgatggagaagaacccccacaccgccgacgcccagcagctggccgccctgatcgtggccaagctgagagccgccagatag

SEQ ID NO: 26203 - DNA, 2478 bp, Artificial Sequence
  Description of Artificial Sequence: Synthetic coding sequence
atggagaagagcgccagcaaggaggagaagcagcagcccaagcaggacagcaccgagcagggcaacgccgacagcgaggagtggatgagcagcgagagcgaccccgagcagatcagcctgaagagcagcgacaacagcaagagctgccagcccagagacggccagctgaagaagaaggagatgcacagcaagccccacagacagctgtgcagaagcccctgcctggacagacccagcttcagccagagcagcatcctgcaggacggcaagctggacctggagaaggagtaccaggccaagatggagttcgccctgaagctgggctacgccgaggagcagatccagagcgtgctgaacaagctgggccccgagagcctgatcaacgacgtgctggccgagctggtgagactgggcaacaagggcgacagcgagggccagatcaacctgagcctgctggtgcccagaggccccagcagcagagagatcgccagccccgagctgagcctggaggacgagatcgacaacagcgacaacctgagacccgtggtgatcgacggcagcaacgtggccatgagccacggcaacaaggaggagttcagctgcagaggcatccagctggccgtggactggttcctggacaagggccacaaggacatcaccgtgttcgtgcccgcctggagaaaggagcagagcagacccgacgcccccatcaccgaccaggacatcctgagaaagctggagaaggagaagatcctggtgttcacccccagcagaagagtgcagggcagaagagtggtgtgctacgacgacagattcatcgtgaagctggccttcgacagcgacggcatcatcgtgagcaacgacaactacagagacctgcaggtggagaagcccgagtggaagaagttcatcgaggagagactgctgatgtacagcttcgtgaacgacaagttcatgccccccgacgaccccctgggcagacacggccccagcctggagaacttcctgagaaagagacccatcgtgcccgagcacaagaagcagccctgcccctacggcaagaagtgcacctacggccacaagtgcaagtactaccaccccgagagagccaaccagccccagagaagcgtggccgacgagctgagaatcagcgccaagctgagcaccgtgaagaccatgagcgagggcaccctggccaagtgcggcaccggcatgagcagcgccaagggcgagatcaccagcgaggtgaagagagtggcccccaagagacagagcgaccccagcatcagaagcgtggccatggagcccgaggagtggctgagcatcgccagaaagcccgaggccagcagcgtgcccagcctggtgaccgccctgagcgtgcccaccatccccccccccaagagccacgccgtgggcgccctgaacaccagaagcgccagcagccccgtgcccggcagcagccacttcccccaccagaaggccagcctggagcacatggccagcatgcagtacccccccatcctggtgaccaacagccacggcacccccatcagctacgccgagcagtaccccaagttcgagagcatgggcgaccacggctactacagcatgctgggcgacttcagcaagctgaacatcaacagcatgcacaacagagagtactacatggccgaggtggacagaggcgtgtacgccagaaaccccaacctgtgcagcgacagcagagtgagccacaccagaaacgacaactacagcagctacaacaacgtgtacctggccgtggccgacacccaccccgagggcaacctgaagctgcacagaagcgccagccagaacagactgcagcccttcccccacggctaccacgaggccctgaccagagtgcagagctacggccccgaggacagcaagcagggcccccacaagcagagcgtgccccacctggccctgcacgcccagcaccccagcaccggcaccagaagcagctgccccgccgactaccccatgccccccaacatccaccccggcgccaccccccagcccggcagagccctggtgatgaccagaatggacagcatcagcgacagcagactgtacgagagcaaccccgtgagacagagaagaccccccctgtgcagagagcagcacgccagctgggaccccctgccctgcaccaccgacagctacggctaccacagctaccccctgagcaacagcctgatgcagccctgctacgagcccgtgatggtgagaagcgtgcccgagaagatggagcagctgtggagaaacccctgggtgggcatgtgcaacgacagcagagagcacatgatccccgagcaccagtaccagacctacaagaacctgtgcaacatcttccccagcaacatcgtgctggccgtgatggagaagaacccccacaccgccgacgcccagcagctggccgccctgatcgtggccaagctgagagccgccagatag

SEQ ID NO: 26204 - DNA, 2652 bp, Artificial Sequence
  Description of Artificial Sequence: Synthetic coding sequence
atgcccggcggcggcagccaggagtacggcgtgctgtgcatccaggagtacagaaagaacagcaaggtggagagcagcaccagaaacaacttcatgggcctgaaggaccacctgggccacgacctgggccacctgtacgtggagagcaccgacccccagctgagccccgccgtgccctggagcaccgtggagaaccccagcatggacaccgtgaacgtgggcaaggacgagaaggaggccagcgaggagaacgccagcagcggcgacagcgaggagaacaccaacagcgaccacgagagcgagcagctgggcagcatcagcgtggagcccggcctgatcaccaagacccacagacagctgtgcagaagcccctgcctggagccccacatcctgaagagaaacgagatcctgcaggacttcaagcccgaggagagccagaccaccagcaaggaggccaagaagccccccgacgtggtgagagagtaccagaccaagctggagttcgccctgaagctgggctacagcgaggagcaggtgcagctggtgctgaacaagctgggcaccgacgccctgatcaacgacatcctgggcgagctggtgaagctgggcaacaagagcgaggccgaccagaccgtgagcaccatcaacaccatcaccagagagaccagcagcctggagagccagagaagcgagagccccatgcaggagatcgtgaccgacgacggcgagaacctgagacccatcgtgatcgacggcagcaacgtggccatgagccacggcaacaaggaggtgttcagctgcagaggcatcaagctggccgtggactggttcctggagagaggccacaaggacatcaccgtgttcgtgcccgcctggagaaaggagcagagcagacccgacgccctgatcaccgaccaggagatcctgagaaagctggagaaggagaagatcctggtgttcacccccagcagaagagtgcagggcagaagagtggtgtgctacgacgacagattcatcgtgaagctggccttcgagagcgacggcatcatcgtgagcaacgacaactacagagacctggccaacgagaagcccgagtggaagaagttcatcgacgagagactgctgatgtacagcttcgtgaacgacaagttcatgccccccgacgaccccctgggcagacacggccccagcctggacaacttcctgagaaagaagcccatcgtgcccgagcacaagaagcagccctgcccctacggcaagaagtgcacctacggccacaagtgcaagtactaccaccccgagagaggcagccagccccagagaagcgtggccgacgagctgagagccatgagcagaaacaccgccgccaagaccgccaacgagggcggcctggtgaagagcaacagcgtgccctgcagcaccaaggccgacagcaccagcgacgtgaagagaggcgcccccaagagacagagcgaccccagcatcagaacccaggtgtaccaggacctggaggagaagctgcccaccaagaacaagctggagaccagaagcgtgcccagcctggtgagcatccccgccaccagcaccgccaagccccagagcaccaccagcctgagcaacggcctgcccagcggcgtgcacttccccccccaggaccagagaccccagggccagtaccccagcatgatgatggccaccaagaaccacggcacccccatgccctacgagcagtaccccaagtgcgacagccccgtggacatcggctactacagcatgctgaacgcctacagcaacctgagcctgagcggccccagaagccccgagagaagattcagcctggacaccgactacagaatcagcagcgtggccagcgactgcagcagcgagggcagcatgagctgcggcagcagcgacagctacgtgggctacaacgacagaagctacgtgagcagccccgacccccagctggaggagaacctgaagtgccagcacatgcacccccacagcagactgaacccccagcccttcctgcagaacttccacgaccccctgaccagaggccagagctacagccacgaggagcccaagttccaccacaagccccccctgccccacctggccctgcacctgccccacagcgccgtgggcgccagaagcagctgccccggcgactaccccagcccccccagcagcgcccacagcaaggccccccacctgggcagaagcctggtggccaccagaatcgacagcatcagcgacagcagactgtacgacagcagccccagcagacagagaaagccctacagcagacaggagggcctgggcagctgggagagacccggctacggcatcgacgcctacggctacagacagacctacagcctgcccgacaacagcacccagccctgctacgagcagttcaccttccagagcctgcccgagcagcaggagcccgcctggagaatcccctactgcggcatgccccaggacccccccagataccaggacaacagagagaagatctacatcaacctgtgcaacatcttcccccccgacctggtgagaatcgtgatgaagagaaacccccacatgaccgacgcccagcagctggccgccgccatcctggtggagaagagccagctgggctactag

SEQ ID NO: 26205 - DNA, 5007 bp, Artificial Sequence
  Description of Artificial Sequence: Synthetic coding sequence
atgagcaagatcagaagaaaggtgaccgtggagaacaccaagaccatcagcgacagcaccagcagaagacccagcgtgttcgagagactgggccccagcaccggcagcaccgccgagacccagtgcagaaactggctgaagaccggcaactgcctgtacggcaacacctgcagattcgtgcacggccccagccccagaggcaagggctacagcagcaactacagaagaagccccgagagacccaccggcgacctgagagagagaatgaagaacaagagacaggacgtggacaccgagccccagaagagaaacaccgaggagagcagcagccccgtgagaaaggagagcagcagaggcagacacagagagaaggaggacatcaagatcaccaaggagagaacccccgagagcgaggaggagaacgtggagtgggagaccaacagagacgacagcgacaacggcgacatcaactacgactacgtgcacgagctgagcctggagatgaagagacagaagatccagagagagctgatgaagctggagcaggagaacatggagaagagagaggagatcatcatcaagaaggaggtgagccccgaggtggtgagaagcaagctgagccccagccccagcctgagaaagagcagcaagagccccaagagaaagagcagccccaagagcagcagcgccagcaagaaggacagaaagaccagcgccgtgagcagccccctgctggaccagcagagaaacagcaagaccaaccagagcaagaagaagggccccagaacccccagcccccccccccccatccccgaggacatcgccctgggcaagaagtacaaggagaagtacaaggtgaaggacagaatcgaggagaagaccagagacggcaaggacagaggcagagacttcgagagacagagagagaagagagacaagcccagaagcaccagccccgccggccagcaccacagccccatcagcagcagacaccacagcagcagcagccagagcggcagcagcatccagagacacagccccagccccagaagaaagagaacccccagccccagctaccagagaaccctgaccccccccctgagaagaagcgccagcccctaccccagccacagcctgagcagcccccagagaaagcagagcccccccagacacagaagccccatgagagagaagggcagacacgaccacgagagaaccagccagagccacgacagaagacacgagagaagagaggacaccagaggcaagagagacagagagaaggacagcagagaggagagagagtacgagcaggaccagagcagcagcagagaccacagagacgacagagagcccagagacggcagagacagaagagacgccagagacaccagagacagaagagagctgagagacagcagagacatgagagacagcagagagatgagagactacagcagagacaccaaggagagcagagaccccagagacagcagaagcaccagagacgcccacgactacagagacagagagggcagagacacccacagaaaggaggacacctaccccgaggagagcagaagctacggcagaaaccacctgagagaggagagcagcagaaccgagatcagaaacgagagcagaaacgagagcagaagcgagatcagaaacgacagaatgggcagaagcagaggcagagtgcccgagctgcccgagaagggcagcagaggcagcagaggcagccagatcgacagccacagcagcaacagcaactaccacgacagctgggagaccagaagcagctaccccgagagagacagataccccgagagagacaacagagaccaggccagagacagcagcttcgagagaagacacggcgagagagacagaagagacaacagagagagagaccagagacccagcagccccatcagacaccagggcagaaacgacgagctggagagagacgagagaagagaggagagaagagtggacagagtggacgacagaagagacgagagagccagagagagagacagagagagagagagagacagagagagagagagagagagagagagagagagagacagagagagagagaaggagagagagctggagagagagagagccagagagagagagagagagagagagaaggagagagacagagagagagacagagacagagaccacgacagagagagagagagagagagagagagagacagagagaaggagagagagagagagagagaggagagagagagagagagagagagagagagagagagagagagagagagagagagagagagagagagagccagagagagagacaaggagagagagagacagagagactgggaggacaaggacaagggcagagacgacagaagagagaagagagaggagatcagagaggacagaaaccccagagacggccacgacgagagaaagagcaagaagagatacagaaacgagggcagccccagccccagacagagccccaagagaagaagagagcacagccccgacagcgacgcctacaacagcggcgacgacaagaacgagaagcacagactgctgagccaggtggtgagaccccaggagagcagaagcctgagccccagccacctgaccgaggacagacagggcagatggaaggaggaggacagaaagcccgagagaaaggagagcagcagaagatacgaggagcaggagctgaaggagaaggtgagcagcgtggacaagcagagagagcagaccgagatcctggagagcagcagaatgagagcccaggacatcatcggccaccaccagagcgaggacagagagaccagcgacagagcccacgacgagaacaagaagaaggccaagatccagaagaagcccatcaagaagaagaaggaggacgacgtgggcatcgagagaggcaacatcgagaccaccagcgaggacggccaggtgttcagccccaagaagggccagaagaagaagagcatcgagaagaagagaaagaagagcaagggcgacagcgacatcagcgacgaggaggccgcccagcagagcaagaagaagagaggccccagaaccccccccatcaccaccaaggaggagctggtggagatgtgcaacggcaagaacggcatcctggaggacagccagaagaaggaggacaccgccttcagcgactggagcgacgaggacgtgcccgacagaaccgaggtgaccgaggccgagcacaccgccaccgccaccacccccggcagcacccccagccccctgagcagcctgctgcccccccccccccccgtggccaccgccaccgccaccaccgtgcccgccaccctggccgccaccaccgccgccgccgccaccagcttcagcaccagcgccatcaccatcagcaccagcgccacccccaccaacaccaccaacaacaccttcgccaacgaggacagccacagaaagtgccacagaaccagagtggagaaggtggagaccccccacgtgaccatcgaggacgcccagcacagaaagcccatggaccagaagagaagcagcagcctgggcagcaacagaagcaacagaagccacaccagcggcagactgagaagccccagcaacgacagcgcccacagaagcggcgacgaccagagcggcagaaagagagtgctgcacagcggcagcagagacagagagaagaccaagagcctggagatcaccggcgagagaaagagcagaatcgaccagctgaagagaggcgagcccagcagaagcaccagcagcgacagacaggacagcagaagccacagcagcagaagaagcagccccgagagcgacagacaggtgcacagcagaagcggcagcttcgacagcagagacagactgcaggagagagacagatacgagcacgacagagagagagagagagagagaagagacaccagacagagagagtgggacagagacgccgacaaggactggcccagaaacagagacagagacagactgagagagagagagagagagagagagagagacaagagaagagacctggacagagagagagagagactgatcagcgacagcgtggagagagacagagacagagacagagacagaaccttcgagagcagccagatcgagagcgtgaagagatgcgaggccaagctggagggcgagcacgagagagacctggagagcaccagcagagacagcctggccctggacaaggagagaatggacaaggacctgggcagcgtgcagggcttcgaggagaccaacaagagcgagagaaccgagagcctggagggcgacgacgagagcaagctggacgacgcccacagcctgggcagcggcgccggcgagggctacgagcccatcagcgacgacgagctggacgagatcctggccggcgacgccgagaagagagaggaccagcaggacgaggagaagatgcccgaccccctggacgtgatcgacgtggactggagcggcctgatgcccaagcaccccaaggagcccagagagcccggcgccgccctgctgaagttcacccccggcgccgtgatgctgagagtgggcatcagcaagaagctggccggcagcgagctgttcgccaaggtgaaggagacctgccagagactgctggagaagcccaaggacgccgacaacctgttcgagcacgagctgggcgccctgaacatggccgccctgctgagaaaggaggagagagccagcctgctgagcaacctgggcccctgctgcaaggccctgtgcttcagaagagacagcgccatcagaaagcagctggtgaagaacgagaagggcaccatcaagcaggcctacaccagcgcccccatggtggacaacgagctgctgagactgagcctgagactgttcaagagaaagaccacctgccacgcccccggccacgagaagaccgaggacaacaagctgagccagagcagcatccagcaggagctgtgcgtgagctag

SEQ ID NO: 26206 - DNA, 4695 bp, Artificial Sequence
  Description of Artificial Sequence: Synthetic coding sequence
atgagcaagatcagaagaaaggtgaccgtggagaacaccaagaccatcagcgacagcaccagcagaagacccagcgtgttcgagagactgggccccagcaccggcagcaccgccgagacccagtgcagaaactggctgaagaccggcaactgcctgtacggcaacacctgcagattcgtgcacggccccagccccagaggcaagggctacagcagcaactacagaagaagccccgagagacccaccggcgacctgagagagagaatgaagaacaagagacaggacgtggacaccgagccccagaagagaaacaccgaggagagcagcagccccgtgagaaaggagagcagcagaggcagacacagagagaaggaggacatcaagatcaccaaggagagaacccccgagagcgaggaggagaacgtggagtgggagaccaacagagacgacagcgacaacggcgacatcaactacgactacgtgcacgagctgagcctggagatgaagagacagaagatccagagagagctgatgaagctggagcaggagaacatggagaagagagaggagatcatcatcaagaaggaggtgagccccgaggtggtgagaagcaagctgagccccagccccagcctgagaaagagcagcaagagccccaagagaaagagcagccccaagagcagcagcgccagcaagaaggacagaaagaccagcgccgtgagcagccccctgctggaccagcagagaaacagcaagaccaaccagagcaagaagaagggccccagaacccccagcccccccccccccatccccgaggacatcgccctgggcaagaagtacaaggagaagtacaaggtgaaggacagaatcgaggagaagaccagagacggcaaggacagaggcagagacttcgagagacagagagagaagagagacaagcccagaagcaccagccccgccggccagcaccacagccccatcagcagcagacaccacagcagcagcagccagagcggcagcagcatccagagacacagccccagccccagaagaaagagaacccccagccccagctaccagagaaccctgaccccccccctgagaagaagcgccagcccctaccccagccacagcctgagcagcccccagagaaagcagagcccccccagacacagaagccccatgagagagaagggcagacacgaccacgagagaaccagccagagccacgacagaagacacgagagaagagaggacaccagaggcaagagagacagagagaaggacagcagagaggagagagagtacgagcaggaccagagcagcagcagagaccacagagacgacagagagcccagagacggcagagacagaagagacgccagagacaccagagacagaagagagctgagagacagcagagacatgagagacagcagagagatgagagactacagcagagacaccaaggagagcagagaccccagagacagcagaagcaccagagacgcccacgactacagagacagagagggcagagacacccacagaaaggaggacacctaccccgaggagagcagaagctacggcagaaaccacctgagagaggagagcagcagaaccgagatcagaaacgagagcagaaacgagagcagaagcgagatcagaaacgacagaatgggcagaagcagaggcagagtgcccgagctgcccgagaagggcagcagaggcagcagaggcagccagatcgacagccacagcagcaacagcaactaccacgacagctgggagaccagaagcagctaccccgagagagacagataccccgagagagacaacagagaccaggccagagacagcagcttcgagagaagacacggcgagagagacagaagagacaacagagagagagaccagagacccagcagccccatcagacaccagggcagaaacgacgagctggagagagacgagagaagagaggagagaagagtggacagagtggacgacagaagagacgagagagccagagagagagacagagagagagagagagacagagagagagagagagagagagagagagagagagacagagagagagagaaggagagagagctggagagagagagagccagagagagagagagagagagagagaaggagagagacagagagagagacagagacagagaccacgacagagagagagagagagagagagagagagacagagagaaggagagagagagagagagagaggagagagagagagagagagagagagagagagagagagagagagagagagagagagagagagagagagccagagagagagacaaggagagagagagacagagagactgggaggacaaggacaagggcagagacgacagaagagagaagagagaggagatcagagaggacagaaaccccagagacggccacgacgagagaaagagcaagaagagatacagaaacgagggcagccccagccccagacagagccccaagagaagaagagagcacagccccgacagcgacgcctacaacagcggcgacgacaagaacgagaagcacagactgctgagccaggtggtgagaccccaggagagcagaagcctgagccccagccacctgaccgaggacagacagggcagatggaaggaggaggacagaaagcccgagagaaaggagagcagcagaagatacgaggagcaggagctgaaggagaaggtgagcagcgtggacaagcagagagagcagaccgagatcctggagagcagcagaatgagagcccaggacatcatcggccaccaccagagcgaggacagagagaccagcgacagagcccacgacgagaacaagaagaaggccaagatccagaagaagcccatcaagaagaagaaggaggacgacgtgggcatcgagagaggcaacatcgagaccaccagcgaggacggccaggtgttcagccccaagaagggccagaagaagaagagcatcgagaagaagagaaagaagagcaagggcgacagcgacatcagcgacgaggaggccgcccagcagagcaagaagaagagaggccccagaaccccccccatcaccaccaaggaggagctggtggagatgtgcaacggcaagaacggcatcctggaggacagccagaagaaggaggacaccgccttcagcgactggagcgacgaggacgtgcccgacagaaccgaggtgaccgaggccgagcacaccgccaccgccaccacccccggcagcacccccagccccctgagcagcctgctgcccccccccccccccgtggccaccgccaccgccaccaccgtgcccgccaccctggccgccaccaccgccgccgccgccaccagcttcagcaccagcgccatcaccatcagcaccagcgccacccccaccaacaccaccaacaacaccttcgccaacgaggacagccacagaaagtgccacagaaccagagtggagaaggtggagaccccccacgtgaccatcgaggacgcccagcacagaaagcccatggaccagaagagaagcagcagcctgggcagcaacagaagcaacagaagccacaccagcggcagactgagaagccccagcaacgacagcgcccacagaagcggcgacgaccagagcggcagaaagagagtgctgcacagcggcagcagagacagagagaagaccaagagcctggagatcaccggcgagagaaagagcagaatcgaccagctgaagagaggcgagcccagcagaagcaccagcagcgacagacaggacagcagaagccacagcagcagaagaagcagccccgagagcgacagacaggtgcacagcagaagcggcagcttcgacagcagagacagactgcaggagagagacagatacgagcacgacagagagagagagagagagagaagagacaccagacagagagagtgggacagagacgccgacaaggactggcccagaaacagagacagagacagactgagagagagagagagagagagagagagagacaagagaagagacctggacagagagagagagagactgatcagcgacagcgtggagagagacagagacagagacagagacagaaccttcgagagcagccagatcgagagcgtgaagagatgcgaggccaagctggagggcgagcacgagagagacctggagagcaccagcagagacagcctggccctggacaaggagagaatggacaaggacctgggcagcgtgcagggcttcgaggagaccaacaagagcgagagaaccgagagcctggaggccggcgacgacgagagcaagctggacgacgcccacagcctgggcagcggcgccggcgagggctacgagcccatcagcgacgacgagctggacgagatcctggccggcgacgccgagaagagagaggaccagcaggacgaggagaagatgcccgaccccctggacgtgatcgacgtggactggagcggcctgatgcccaagcaccccaaggagcccagagagcccggcgccgccctgctgaagttcacccccggcgccgtgatgctgagagtgggcatcagcaagaagctggccggcagcgagctgttcgccaaggtgaaggagacctgccagagactgctggagaagcccaagggcagcttcatcctgctgtag

SEQ ID NO: 26207 - DNA, 1875 bp, Artificial Sequence
  Description of Artificial Sequence: Synthetic coding sequence
atgtgcaacggcaagaacggcatcctggaggacagccagaagaaggaggacaccgccttcagcgactggagcgacgaggacgtgcccgacagaaccgaggtgaccgaggccgagcacaccgccaccgccaccacccccggcagcacccccagccccctgagcagcctgctgcccccccccccccccgtggccaccgccaccgccaccaccgtgcccgccaccctggccgccaccaccgccgccgccgccaccagcttcagcaccagcgccatcaccatcagcaccagcgccacccccaccaacaccaccaacaacaccttcgccaacgaggacagccacagaaagtgccacagaaccagagtggagaaggtggagaccccccacgtgaccatcgaggacgcccagcacagaaagcccatggaccagaagagaagcagcagcctgggcagcaacagaagcaacagaagccacaccagcggcagactgagaagccccagcaacgacagcgcccacagaagcggcgacgaccagagcggcagaaagagagtgctgcacagcggcagcagagacagagagaagaccaagagcctggagatcaccggcgagagaaagagcagaatcgaccagctgaagagaggcgagcccagcagaagcaccagcagcgacagacaggacagcagaagccacagcagcagaagaagcagccccgagagcgacagacaggtgcacagcagaagcggcagcttcgacagcagagacagactgcaggagagagacagatacgagcacgacagagagagagagagagagagaagagacaccagacagagagagtgggacagagacgccgacaaggactggcccagaaacagagacagagacagactgagagagagagagagagagagagagagagacaagagaagagacctggacagagagagagagagactgatcagcgacagcgtggagagagacagagacagagacagagacagaaccttcgagagcagccagatcgagagcgtgaagagatgcgaggccaagctggagggcgagcacgagagagacctggagagcaccagcagagacagcctggccctggacaaggagagaatggacaaggacctgggcagcgtgcagggcttcgaggagaccaacaagagcgagagaaccgagagcctggagggcgacgacgagagcaagctggacgacgcccacagcctgggcagcggcgccggcgagggctacgagcccatcagcgacgacgagctggacgagatcctggccggcgacgccgagaagagagaggaccagcaggacgaggagaagatgcccgaccccctggacgtgatcgacgtggactggagcggcctgatgcccaagcaccccaaggagcccagagagcccggcgccgccctgctgaagttcacccccggcgccgtgatgctgagagtgggcatcagcaagaagctggccggcagcgagctgttcgccaaggtgaaggagacctgccagagactgctggagaagcccaaggacgccgacaacctgttcgagcacgagctgggcgccctgaacatggccgccctgctgagaaaggaggagagagccagcctgctgagcaacctgggcccctgctgcaaggccctgtgcttcagaagagacagcgccatcagaaagcagctggtgaagaacgagaagggcaccatcaagcaggcctacaccagcgcccccatggtggacaacgagctgctgagactgagcctgagactgttcaagagaaagaccacctgccacgcccccggccacgagaagaccgaggacaacaagctgagccagagcagcatccagcaggagctgtgcgtgagctag

SEQ ID NO: 26208 - DNA, 348 bp, Artificial Sequence
  Description of Artificial Sequence: Synthetic coding sequence
atgagcaagatcagaagaaaggtgaccgtggagaacaccaagaccatcagcgacagcaccagcagaagacccagcgtgttcgagagactgggccccagcaccggcagcaccgccgagacccagtgcagaaactggctgaagaccggcaactgcctgtacggcaacacctgcagattcgtgcacggccccagccccagaggcaagggctacagcagcaactacagaagaagccccgagagacccaccggcgacctgagagagagaatgaagaacaagagacaggacgtggacaccgagccccagaagagaaacaccgaggagagcagcagccccgtgagagtgggctag

SEQ ID NO: 26209 - DNA, 1455 bp, Artificial Sequence
  Description of Artificial Sequence: Synthetic coding sequence
atggagaagagagaggagatcatcatcaagaaggaggtgagccccgaggtggtgagaagcaagctgagccccagccccagcctgagaaagagcagcaagagccccaagagaaagagcagccccaagagcagcagcgccagcaagaaggacagaaagaccagcgccgtgagcagccccctgctggaccagcagagaaacagcaagaccaaccagagcaagaagaagggccccagaacccccagcccccccccccccatccccgaggacatcgccctgggcaagaagtacaaggagaagtacaaggtgaaggacagaatcgaggagaagaccagagacggcaaggacagaggcagagacttcgagagacagagagagaagagagacaagcccagaagcaccagccccgccggccagcaccacagccccatcagcagcagacaccacagcagcagcagccagagcggcagcagcatccagagacacagccccagccccagaagaaagagaacccccagccccagctaccagagaaccctgaccccccccctgagaagaagcgccagcccctaccccagccacagcctgagcagcccccagagaaagcagagcccccccagacacagaagccccatgagagagaagggcagacacgaccacgagagaaccagccagagccacgacagaagacacgagagaagagaggacaccagaggcaagagagacagagagaaggacagcagagaggagagagagtacgagcaggaccagagcagcagcagagaccacagagacgacagagagcccagagacggcagagacagaagagacgccagagacaccagagacagaagagagctgagagacagcagagacatgagagacagcagagagatgagagactacagcagagacaccaaggagagcagagaccccagagacagcagaagcaccagagacgcccacgactacagagacagagagggcagagacacccacagaaaggaggacacctaccccgaggagagcagaagctacggcagaaaccacctgagagaggagagcagcagaaccgagatcagaaacgagagcagaaacgagagcagaagcgagatcagaaacgacagaatgggcagaagcagaggcagagtgcccgagctgcccgagaagggcagcagaggcagcagaggcagccagatcgacagccacagcagcaacagcaactaccacgacagctgggagaccagaagcagctaccccgagagagacagataccccgagagagacaacagagaccaggccagagacagcagcttcgagagaagacacggcgagagagacagaagagacaacagagagagagaccagagacccagcagccccatcagacaccagggcagaaacgacgagctggagagagacgagagaagagaggagagaagaaaggagaagaagtag

SEQ ID NO: 26210 - DNA, 3912 bp, Artificial Sequence
  Description of Artificial Sequence: Synthetic coding sequence
atggaggccgcccccggcacccccccccccccccccagcgagagcccccccccccccagcccccccccccccagcacccccagcccccccccctgcagccccgacgccagacccgccaccccccacctgctgcaccacagactgcccctgcccgacgacagagaggacggcgagctggaggagggcgagctggaggacgacggcgccgaggagacccaggacaccagcggcggccccgagagaagcagaaaggagaagggcgagaagcaccacagcgacagcgacgaggagaagagccacagaagactgaagagaaagagaaagaaggagagagagaaggagaagagaagaagcaagaagagaagaaagagcaagcacaagagacacgccagcagcagcgacgacttcagcgacttcagcgacgacagcgacttcagccccagcgagaagggccacagaaagtacagagagtacagccccccctacgcccccagccaccagcagtacccccccagccacgccacccccctgcccaagaaggcctacagcaagatggacagcaagagctacggcatgtacgaggactacgagaacgagcagtacggcgagtacgagggcgacgaggaggaggacatgggcaaggaggactacgacgacttcaccaaggagctgaaccagtacagaagagccaaggagggcagcagcagaggcagaggcagcagaggcagaggcagaggctacagaggcagaggcagcagaggcggcagcagaggcagaggcatgggcagaggcagcagaggcagaggcagaggcagcatgggcggcgaccaccccgaggacgaggaggacttctacgaggaggagatggactacggcgagagcgaggagcccatgggcgacgacgactacgacgagtacagcaaggagctgaaccagtacagaagaagcaaggacagcagaggcagaggcctgagcagaggcagaggcagaggcagcagaggcagaggcaagggcatgggcagaggcagaggcagaggcggcagcagaggcggcatgaacaagggcggcatgaacgacgacgaggacttctacgacgaggacatgggcgacggcggcggcggcagctacagaagcagagaccacgacaagccccaccagcagagcgacaagaagggcaaggtgatctgcaagtacttcgtggagggcagatgcacctggggcgaccactgcaacttcagccacgacatcgagctgcccaagaagagagagctgtgcaagttctacatcaccggcttctgcgccagagccgagaactgcccctacatgcacggcgacttcccctgcaagctgtaccacaccaccggcaactgcatcaacggcgacgactgcatgttcagccacgaccccctgaccgaggagaccagagagctgctggacaagatgctggccgacgacgccgaggccggcgccgaggacgagaaggaggtggaggagctgaagaagcagggcatcaaccccctgcccaagcccccccccggcgtgggcctgctgcccaccccccccagaccccccggcccccaggcccccaccagccccaacggcagacccatgcagggcggcccccccccccccccccccccccccccccccccccccggccccccccagatgcccatgcccgtgcacgagcccctgagcccccagcagctgcagcagcaggacatgtacaacaagaagatccccagcctgttcgagatcgtggtgagacccaccggccagctggccgagaagctgggcgtgagattccccggccccggcggcccccccggccccatgggccccggccccaacatgggcccccccggccccatgggcggccccatgcaccccgacatgcaccccgacatgcaccccgacatgcaccccgacatgcacgccgacatgcacgccgacatgcccatgggccccggcatgaaccccggcccccccatgggccccggcggcccccccatgatgccctacggccccggcgacagcccccacagcggcatgatgccccccatcccccccgcccagaacttctacgagaacttctaccagcagcaggagggcatggagatggagcccggcctgctgggcgacgccgaggactacggccactacgaggagctgcccggcgagcccggcgagcacctgttccccgagcaccccctggagcccgacagcttcagcgagggcggcccccccggcagacccaagcccggcgccggcgtgcccgacttcctgcccagcgcccagagagccctgtacctgagaatccagcagaagcagcaggaggaggaggagagagccagaagactggccgagagcagcaagcaggacagagagaacgaggagggcgacaccggcaactggtacagcagcgacgaggacgagggcggcagcagcgtgaccagcatcctgaagaccctgagacagcagaccagcagcagaccccccgccagcgtgggcgagctgagcagcagcggcctgggcgaccccagactgcagaagggccaccccaccggcagcagactggccgaccccagactgagcagagaccccagactgaccagacacgtggaggccagcggcggcagcggccccggcgacagcggccccagcgaccccagactggccagagccctgcccaccagcaagcccgagggcagcctgcacagcagccccgtgggccccagcagcagcaagggcagcggccccccccccaccgaggaggaggagggcgagagagccctgagagagaaggccgtgaacatccccctggaccccctgcccggccaccccctgagagaccccagaagccagctgcagcagttcagccacatcaagaaggacgtgaccctgagcaagcccagcttcgccagaaccgtgctgtggaaccccgaggacctgatccccctgcccatccccaagcaggacgccgtgccccccgtgcccgccgccctgcagagcatgcccaccctggaccccagactgcacagagccgccaccgccggcccccccaacgccagacagagacccggcgccagcaccgacagcagcacccagggcgccaacctgcccgacttcgagctgctgagcagaatcctgaagaccgtgaacgccaccggcagcagcgccgcccccggcagcagcgacaagcccagcgaccccagagtgagaaaggcccccaccgaccccagactgcagaagcccaccgacagcaccgccagcagcagagccgccaagcccggccccgccgaggcccccagccccaccgccagccccagcggcgacgccagcccccccgccaccgccccctacgaccccagagtgctggccgccggcggcctgggccagggcggcggcggcggccagagcagcgtgctgagcggcatcagcctgtacgaccccagaacccccaacgccggcggcaaggccaccgagcccgccgccgacaccggcgcccagcccaagggcgccgagggcaacggcaagagcagcgccagcaaggccaaggagccccccttcgtgagaaagagcgccctggagcagcccgagaccggcaaggccggcgccgacggcggcacccccaccgacagatacaacagctacaacagacccagacccaaggccgccgccgcccccgccgccaccaccgccacccccccccccgagggcgcccccccccagcccggcgtgcacaacctgcccgtgcccaccctgttcggcaccgtgaagcagacccccaagaccggcagcggcagccccttcgccggcaacagccccgccagagagggcgagcaggacgccgccagcctgaaggacgtgttcaagggcttcgaccccaccgccagccccttctgccagtag

SEQ ID NO: 26211 - DNA, 3570 bp, Artificial Sequence
  Description of Artificial Sequence: Synthetic coding sequence
atgaccgacagcgagcacgccggccacgacagagaggacggcgagctggaggacggcgagatcgacgacgccggcttcgaggagatccaggagaaggaggccaaggagaacgagaagcagaagagcgagaaggcctacagaaagagcagaaagaagcacaagaaggagagagagaagaagaagagcaagagaagaaagagagagaagcacaagcacaacagccccagcagcgacgacagcagcgactacagcctggacagcgacgtggagcacaccgagagcagccacaagaagagaaccggcttctacagagactacgacatccccttcacccagagaggccacatcagcggcagctacatcaccagcaagaagggccagcacaacaagaagttcaagagcaaggagtacgacgagtacagcacctacagcgacgacaacttcggcaactacagcgacgacaacttcggcaactacggccaggagaccgaggaggacttcgccaaccagctgaagcagtacagacaggccaaggagaccagcaacatcgccctgggcagcagcttcagcaaggagagcggcaagaagcagagaatgaagggcgtgcagcagggcatcgagcagagagtgaagagcttcaacgtgggcagaggcagaggcctgcccaagaagatcaagagaaaggagagaggcggcagaaccaacaagggccccaacgtgttcagcgtgagcgacgacttccaggagtacaacaagcccggcaagaagtggaaggtgatgacccaggagttcatcaaccagcacaccgtggagcacaagggcaagcagatctgcaagtacttcctggagggcagatgcatcaagggcgaccagtgcaagttcgaccacgacgccgagctggagaagagaaaggagatctgcaagttctacctgcagggctactgcaccaagggcgagaactgcatctacatgcacaacgagttcccctgcaagttctaccacagcggcgccaagtgctaccagggcgacaactgcaagttcagccacgacgacctgaccaaggagaccaagaagctgctggacaaggtgctgaacaccgacgaggagctgatcaacgaggacgagagagagctggaggagctgagaaagagaggcatcacccccctgcccaagcccccccccggcgtgggcctgctgcccaccccccccgagcacttccccttcagcgaccccgaggacgacttccagaccgacttcagcgacgacttcagaaagatccccagcctgttcgagatcgtggtgaagcccaccgtggacctggcccacaagatcggcagaaagccccccgccttctacaccagcgccagcccccccggcccccagttccagggcagcagcccccacccccagcacatctacagcagcggcagcagccccggccccggccccaacatgagccagggccacagcagccccgtgatgcaccccggcagccccggccaccacccctgcgccggcccccccggcctgcccgtgccccagagcccccccctgccccccggcccccccgagatcgtgggcccccagaaccaggccggcgtgctggtgcagcccgacaccagcctgaccccccccagcatgggcggcgcctaccacagccccggcttccccggccacgtgatgaaggtgcccagagagaaccactgcagccccggcagcagctaccagcagagccccggcgagatgcagctgaacaccaactacgagagcctgcagaaccccgccgagttctacgacaactactacgcccagcacagcatccacaacttccagccccccaacaacagcggcgacggcatgtggcacggcgagttcgcccagcagcagccccccgtggtgcaggacagccccaaccacggcagcggcagcgacggcagcagcaccagaaccggccacggccccctgcccgtgcccggcctgctgcccgccgtgcagagagccctgttcgtgagactgacccagagataccaggaggacgaggagcagaccagcacccagccccacagagcccccagcaaggaggaggacgacaccgtgaactggtacagcagcagcgaggaggaggagggcagcagcgtgaagagcatcctgaagaccctgcagaagcagaccgagaccctgagaaaccagcagcagcccagcaccgagctgagcacccccaccgaccccagactggccaaggagaagagcaagggcaaccaggtggtggaccccagactgagaaccatccccagacaggacatcagaaagcccagcgagagcgcccccctggacctgagactggcctgggaccccagaaagctgagaggcaacggcagcggccacatcggcagcagcgtgggcggcgccaagttcgacctgcaccacgccaacgccggcaccaacgtgaagcacaagagaggcgacgacgacgacgaggacaccgagagagagctgagagagaaggccttcctgatccccctggacgccagccccggcatcatgctgcaggaccccagaagccagctgagacagttcagccacatcaagatggacatcaccctgaccaagcccaacttcgccaagcacatcgtgtgggcccccgaggacctgctgcccgtgcccctgcccaagcccgaccccgtgagcagcatcaacctgcccctgccccccctgatcgccgaccagagactgaacagactgtggaacaccaagagcgacctgcaccagaacaccgtgagcatcgaccccaagctggccgccaaggccaagatcaacaccaccaacagagagggctacctggagcagttcggcgacagccacggcagcggcgccaagctgggcgaccccagactgcagaagaacttcgaccccagactgcacagactgcccaacaccgagagccaccaggtggtgatgaaggacagccacgccagcaagggcgccccccacctgcccagaagcaaccccggcagcagccagcccagcggcgccggcaccagcaacagcggcagcggcgccctgcccccctacgcccccaagctgagcagcagcgccggcctgcccctgggcaccagcaccagcgtgctgagcggcatcagcctgtacgaccccagagaccacggcagcagcagcaccagcgagctggccaccgccagcagcggcgagaacagcaagaaccagaagaagagcggcggcctgaagagcagcgacaagaccgagcccagccccggcgaggccatcctgccccagaagcccagccccaacgtgggcgtgaccctggagggccccgccgacccccaggccgacgtgcccagaagcagcggcaaggtgcaggtgcccgccgtgcacagcctgcccgtgcaggccctgaccggcctgatcagaccccagtacagcgaccccagacaggccagacagcccggccagggcagccccacccccgacaacgaccccggcagagagaccgacgacaagagcctgaaggaggtgttcaagaccttcgaccccaccgccagccccttctgctag

SEQ ID NO: 26212 - DNA, 3570 bp, Artificial Sequence; identical to SEQ ID NO: 26211
  Description of Artificial Sequence: Synthetic coding sequence

SEQ ID NO: 26213 - DNA, 2679 bp, Artificial Sequence
  Description of Artificial Sequence: Synthetic coding sequence
atgcaggacctgaagaagtacaagaagaagaagcagaagagaatgaagagcagaaaggtgagaaagcccaccgagaaccaggagaagaacatcagaaagagagagagaaagaagagcaagagaagaaagagagagaagcacaagcacaacagccccagcagcgacgacagcagcgactacagcctggacagcgacgtggagcacaccgagagcagccacaagaagagaaccggcttctacagagactacgacatccccttcacccagagaggccacatcagcggcagctacatcaccagcaagaagggccagcacaacaagaagttcaagagcaaggagtacgacgagtacagcacctacagcgacgacaacttcggcaactacagcgacgacaacttcggcaactacggccaggagaccgaggaggacttcgccaaccagctgaagcagtacagacaggccaaggagaccagcaacatcgccctgggcagcagcttcagcaaggagagcggcaagaagcagagaatgaagggcgtgcagcagggcatcgagcagagagtgaagagcttcaacgtgggcagaggcagaggcctgcccaagaagatcaagagaaaggagagaggcggcagaaccaacaagggccccaacgtgttcagcgtgagcgacgacttccaggagtacaacaagcccggcaagaagtggaaggtgatgacccaggagttcatcaaccagcacaccgtggagcacaagggcaagcagatctgcaagtacttcctggagggcagatgcatcaagggcgaccagtgcaagttcgaccacgacgccgagctggagaagagaaaggagatctgcaagttctacctgcagggctactgcaccaagggcgagaactgcatctacatgcacaacgagttcccctgcaagttctaccacagcggcgccaagtgctaccagggcgacaactgcaagttcagccacgacgacctgaccaaggagaccaagaagctgctggacaaggtgctgaacaccgacgaggagctgatcaacgaggacgagagagagctggaggagctgagaaagagaggcatcacccccctgcccaagcccccccccggcgtgggcctgctgcccaccccccccgagcacttccccttcagcgaccccgaggacgacttccagaccgacttcagcgacgacttcagaaagatccccagcctgttcgagatcgtggtgaagcccaccgtggacctggcccacaagatcggcagaaagccccccgccttctacaccagcgccagcccccccggcccccagttccagggcagcagcccccacccccagcacatctacagcagcggcagcagccccggccccggccccaacatgagccagggccacagcagccccgtgatgcaccccggcagccccggccaccacccctgcgccggcccccccggcctgcccgtgccccagagcccccccctgccccccggcccccccgagatcgtgggcccccagaaccaggccggcgtgctggtgcagcccgacaccagcctgaccccccccagcatgggcggcgcctaccacagccccggcttccccggccacgtgatgaaggtgcccagagagaaccactgcagccccggcagcagctaccagcagagccccggcgagatgcagctgaacaccaactacgagagcctgcagaaccccgccgagttctacgacaactactacgcccagcacagcatccacaacttccagccccccaacaacagcggcgacggcatgtggcacggcgagttcgcccagcagcagccccccgtggtgcaggacagccccaaccacggcagcggcagcgacggcagcagcaccagaaccggccacggccccctgcccgtgcccggcctgctgcccgccgtgcagagagccctgttcgtgagactgacccagagataccaggaggacgaggagcagaccagcacccagccccacagagcccccagcaaggaggaggacgacaccgtgaactggtacagcagcagcgaggaggaggagggcagcagcgtgaagagcatcctgaagaccctgcagaagcagaccgagaccctgagaaaccagcagcagcccagcaccgagctgagcacccccaccgaccccagactggccaaggagaagagcaagggcaaccaggtggtggaccccagactgagaaccatccccagacaggacatcagaaagcccagcgagagcgcccccctggacctgagactggcctgggaccccagaaagctgagaggcaacggcagcggccacatcggcagcagcgtgggcggcgccaagttcgacctgcaccacgccaacgccggcaccaacgtgaagcacaagagaggcgacgacgacgacgaggacaccgagagagagctgagagagaaggccttcctgatccccctggacgccagccccggcatcatgctgcaggaccccagaagccagctgagacagttcagccacatcaagatggacatcaccctgaccaagcccaacttcgccaagcacatcgtgtgggcccccgaggacctgctgcccgtgcccctgcccaagcccgaccccgtgagcagcatcaacctgcccctgccccccctgatcgccgaccagagactgaacagactgtggtag

SEQ ID NO: 26214 - DNA, 903 bp, Artificial Sequence
  Description of Artificial Sequence: Synthetic coding sequence
atggccgagcccaccgtgtgcagcttcctgaccaaggtgctgtgcgcccacggcggcagaatgttcctgaaggacctgagaggccacgtggagctgagcgaggccagactgagagacgtgctgcagagagccggccccgagagattcctgctgcaggaggtggagacccaggagggcctgggcgacgccgaggccgaggccgccgccggcgccgtgggcggcggcggcaccagcgcctggagagtggtggccgtgagcagcgtgagactgtgcgccagataccagagaggcgagtgccaggcctgcgaccagctgcacttctgcagaagacacatgctgggcaagtgccccaacagagactgctggagcacctgcaccctgagccacgacatccacacccccgtgaacatgcaggtgctgaagagccacggcctgttcggcctgaacgagaaccagctgagaatcctgctgctgcagaacgacccctgcctgctgcccgaggtgtgcctgctgtacaacaagggcgaggccctgtacggctactgcaacctgaaggacaagtgcaacaagttccacgtgtgcaagagcttcgtgaagggcgagtgcaagctgcagacctgcaagagaagccaccagctgatccacgccgccagcctgaagctgctgcaggaccagggcctgaacatccccagcgtggtgaacttccagatcatcagcacctacaagcacatgaagctgcacaagatgctggagaacaccgacaacagcagccccagcaccgagcacagccagggcctggagaagcagggcgtgcacgccgccggcgccgccgaggccggccccctggccagcgtgcccgcccagagcgccaagaagccctgccccgtgagctgcgagaagtag

SEQ ID NO: 26215 - DNA, 309 bp, Artificial Sequence
  Description of Artificial Sequence: Synthetic coding sequence
atggccgagcccaccgtgtgcagcttcctgaccaaggtgctgtgcgcccacggcggcagaatgttcctgaaggacctgagaggccacgtggagctgagcgaggccagactgagagacgtgctgcagagagccggccccgagagattcctgctgcaggaggtggagacccaggagggcctgggcgacgccgaggccgaggccgccgccggcgccgtgggcggcggcggcaccagcgcctggagagtggtggccgtgagcggcaccatcggcgcctgccaccacacccagctgatcttcctgggcttctag

SEQ ID NO: 26216 - DNA, 1575 bp, Artificial Sequence
  Description of Artificial Sequence: Synthetic coding sequence
atgatgaccaccctgcagaacaaggaggagtgcggcaagggccccaagagaatcttcgccccccccgcccagaagagctacagcctgctgccctgcagccccaacagccccaaggaggagacccccggcatcagcagccccgagaccgaggccagaatcagcctgcccaaggccagcctgaagaagaaggaggagaaggccaccatgaagaacgtgcccagcagagagcaggagaagaagagaaaggcccagatcaacaagcaggccgagaagaaggagaaggagaagagcagcctgaccaacgccgagttcgaggagatcgtgcagatcgtgctgcagaagagcctgcaggagtgcctgggcatgggcagcggcctggacttcgccgagaccagctgcgcccagcccgtggtgagcacccagagcgacaaggagcccggcatcaccgccagcgccaccgacaccgacaacgccaacggcgaggaggtgccccacacccaggagatcagcgtgagctgggagggcgaggccgcccccgagatcagaaccagcaagctgggccagcccgaccccgcccccagcaagaagaagagcaacagactgaccctgagcaagagaaagaaggaggcccaggacgagaaggtggagaagacccagggcggccacgagcacagacaggaggacagactgaagaagaccgtgcaggaccacagccagatcagagaccagcagaagggcgagatcagcggcttcggccagtgcctggtgtgggtgcagtgcagcttccccaactgcggcaagtggagaagactgtgcggcaacatcgaccccagcgtgctgcccgacaactggagctgcgaccagaacaccgacgtgcagtacaacagatgcgacatccccgaggagacctggaccggcctggagagcgacgtggcctacgccagctacatccccggcagcatcatctgggccaagcagtacggctacccctggtggcccggcatgatcgagagcgaccccgacctgggcgagtacttcctgttcaccagccacctggacagcctgcccagcaagtaccacgtgaccttcttcggcgagaccgtgagcagagcctggatccccgtgaacatgctgaagaacttccaggagctgagcctggagctgagcgtgatgaagaagagaagaaacgactgcagccagaagctgggcgtggccctgatgatggcccaggaggccgagcagatcagcatccaggagagagtgaacctgttcggcttctggagcagattcaacggcagcaacagcaacggcgagagaaaggacctgcagctgagcggcctgaacagccccggcagctgcctggagaagaaggagaaggaggaggagctggagaaggaggagggcgagaagaccgccctgagaaagaacctgaagctgcccagagccagaccctggcagcccgccttccagagagagaagaagctggagcagtgccagagaacctgggcctaccagagagtgagaggccccgccccccacctgagaaagaagagccccgacaccggcaacccctag

SEQ ID NO: 26217 - DNA, 330 bp, Artificial Sequence
  Description of Artificial Sequence: Synthetic coding sequence
cccatggtgggcctgctggtgcacaccgccgccaccttcaactacagcttcagaaagatcagaggcctgctgtgcccccagcacaagcagagaggcgtgcaggccaaccagacccccgtgctgttcctgcacatcagctgcgtgtactacagcctgtacctgttcttcctgttctgctgcctgttcctgatccccctggagcagaagatgaccaccagccccctgccctacccctgcgacaacatccacgtgaccgtgtggcccctgggcgaggtgctgatggagaccagaatgtgggagagcaagatcggcctggagatgagactgtag

SEQ ID NO: 26218 - DNA, 399 bp, Artificial Sequence
  Description of Artificial Sequence: Synthetic coding sequence
atgagaaacatgatcccccaggacaacgagaaccccccccagcagggcgaggccaaccagaacgacttcgccctggtggcccaggccggcgtgcagtggctggacctgggcccccagctgcccctgctgcccggcttcaagcagttcttctgcctgagcctgctgagcagctgcggctacagctggagcctggccctgagccccagactggagtgcagcggcgccatcagcgcctacggcaagctgagactgcccggcagctgccacagccccgccagcgccagcagagtggccagaaccaccggcgccagacaccacaccagactgatcttcgtgttcctggtggagaccagattccacagagtgagccaggacggcctggacctgctgaccagctag

SEQ ID NO: 26219 - DNA, 891 bp, Artificial Sequence
  Description of Artificial Sequence: Synthetic coding sequence
atgatcgccgagagactggccagactgagacaggagaacaagcccaagctggtgcccagccaggccgagatcgaggccagactggccgccctgaaggacgagagacagggcagcatccccagcacccaggagatggaggccagactggccgccctgcagggcagagtgctgcccagccagaccccccagcccgcccaccacacccccgacaccagaacccaggcccagcagacccaggacctgctgacccagctggccgccgaggtggccatcgacgagagctggaagggcggcggccccgccgccagcctgcagaacgacctgaaccagggcggccccggcagcaccaacagcaagagacaggccaactggagcctggaggaggagaagagcagactgctggccgaggccgccctggagctgagagaggagaacaccagacaggagagaatcctggccctggccaagagactggccatgctgagaggccaggaccccgagagagtgaccctgcaggactacagactgcccgacagcgacgacgacgaggacgaggagaccgccatccagagagtgctgcagcagctgaccgaggaggccagcctggacgaggccagcggcttcaacatccccgccgagcaggccagcagaccctggacccagcccagaggcgccgagcccgaggcccaggacgtggaccccagacccgaggccgaggaggaggagctgccctggtgctgcatctgcaacgaggacgccaccctgagatgcgccggctgcgacggcgacctgttctgcgccagatgcttcagagagggccacgacgccttcgagctgaaggagcaccagaccagcgcctacagcccccccagagccggccaggagcactag

SEQ ID NO: 26220 - DNA, 1584 bp, Artificial Sequence
  Description of Artificial Sequence: Synthetic coding sequence
atgtaccagcccgaggacgacaacaacagcgacgtgaccagcgacgacgacatgaccagaaacagaagagagagcagccccccccacagcgtgcacagcttcagcggcgacagagactgggacagaagaggcagaagcagagacatggagcccagagacagatggagccacaccagaaaccccagaagcagaatgccccccagagacctgagcctgcccgtggtggccaagaccagcttcgagatggacagagaggacgacagagacagcagagcctacgagagcagaagccaggacgccgagagctaccagaacgtggtggacctggccgaggacagaaagccccacaacaccatccaggacaacatggagaactacagaaagctgctgagcctgggcttcctggcccaggacagcgtgcccgccgagaagagaaacaccgagatgctggacaacctgcccagcgccggcagccagttccccgacttcaagcacctgggcaccttcctggtgttcgaggagctggtgaccttcgaggacgtgctggtggacttcagccccgaggagctgagcagcctgagcgccgcccagagaaacctgtacagagaggtgatgctggagaactacagaaacctggtgagcctgggccaccagttcagcaagcccgacatcatcagcagactggaggaggaggagagctacgccatggagaccgacagcagacacaccgtgatctgccagggcgagagccacgacgaccccctggagccccaccagggcaaccaggagaagctgctgacccccatcaccatgaacgaccccaagaccctgacccccgagagaagctacggcagcgacgagttcgagagaagcagcaacctgagcaagcagagcaaggaccccctgggcaaggacccccaggagggcaccgcccccggcatctgcaccagcccccagagcgccagccaggagaacaagcacaacagatgcgagttctgcaagagaaccttcagcacccaggtggccctgagaagacacgagagaatccacaccggcaagaagccctacgagtgcaagcagtgcgccgaggccttctacctgatgccccacctgaacagacaccagaagacccacagcggcagaaagaccagcggctgcaacgagggcagaaagcccagcgtgcagtgcgccaacctgtgcgagagagtgagaatccacagccaggaggactacttcgagtgcttccagtgcggcaaggccttcctgcagaacgtgcacctgctgcagcacctgaaggcccacgaggccgccagagtgctgccccccggcctgagccacagcaagacctacctgatcagataccagagaaagcacgactacgtgggcgagagagcctgccagtgctgcgactgcggcagagtgttcagcagaaacagctacctgatccagcactacagaacccacacccaggagagaccctaccagtgccagctgtgcggcaagtgcttcggcagacccagctacctgacccagcactaccagctgcacagccaggagaagaccgtggagtgcgaccactgctag

SEQ ID NO: 26221 - DNA, 1809 bp, Artificial Sequence
  Description of Artificial Sequence: Synthetic coding sequence
atggccagactgaccaagagaagacaggccgacaccaaggccatccagcacctgtgggccgccatcgagatcatcagaaaccagaagcagatcgccaacatcgacagaatcaccaagtacatgagcagagtgcacggcatgcaccccaaggagaccaccagacagctgagcctggccgtgaaggacggcctgatcgtggagaccctgaccgtgggctgcaagggcagcaaggccggcatcgagcaggagggctactggctgcccggcgacgagatcgactgggagaccgagaaccacgactggtactgcttcgagtgccacctgcccggcgaggtgctgatctgcgacctgtgcttcagagtgtaccacagcaagtgcctgagcgacgagttcagactgagagacagcagcagcccctggcagtgccccgtgtgcagaagcatcaagaagaagaacaccaacaagcaggagatgggcacctacctgagattcatcgtgagcagaatgaaggagagagccatcgacctgaacaagaagggcaaggacaacaagcaccccatgtacagaagactggtgcacagcgccgtggacgtgcccaccatccaggagaaggtgaacgagggcaagtacagaagctacgaggagttcaaggccgacgcccagctgctgctgcacaacaccgtgatcttctacggcgccgacagcgagcaggccgacatcgccagaatgctgtacaaggacacctgccacgagctggacgagctgcagctgtgcaagaactgcttctacctgagcaacgccagacccgacaactggttctgctacccctgcatccccaaccacgagctggtgtgggccaagatgaagggcttcggcttctggcccgccaaggtgatgcagaaggaggacaaccaggtggacgtgagattcttcggccaccaccaccagagagcctggatccccagcgagaacatccaggacatcaccgtgaacatccacagactgcacgtgaagagaagcatgggctggaagaaggcctgcgacgagctggagctgcaccagagattcctgagagagggcagattctggaagagcaagaacgaggacagaggcgaggaggaggccgagagcagcatcagcagcaccagcaacgagcagctgaaggtgacccaggagcccagagccaagaagggcagaagaaaccagagcgtggagcccaagaaggaggagcccgagcccgagaccgaggccgtgagcagcagccaggagatccccaccatgccccagcccatcgagaaggtgagcgtgagcacccagaccaagaagctgagcgccagcagccccagaatgctgcacagaagcacccagaccaccaacgacggcgtgtgccagagcatgtgccacgacaagtacaccaagatcttcaacgacttcaaggacagaatgaagagcgaccacaagagagagaccgagagagtggtgagagaggccctggagaagctgagaagcgagatggaggaggagaagagacaggccgtgaacaaggccgtggccaacatgcagggcgagatggacagaaagtgcaagcaggtgaaggagaagtgcaaggaggagttcgtggaggagatcaagaagctggccacccagcacaagcagctgatcagccagaccaagaagaagcagtggtgctacaactgcgaggaggaggccatgtaccactgctgctggaacaccagctactgcagcatcaagtgccagcaggagcactggcacgccgagcacaagagaacctgcagaagaaagagatag

SEQ ID NO: 26222 - DNA, 1920 bp, Artificial Sequence
  Description of Artificial Sequence: Synthetic coding sequence
atgacccccgccagcgccagcggcgaggacagcggcagcttctacagctggcagaaggccaagagagagcagggcctggtgaccttcgaggacgtggccgtggacttcacccaggaggagtggcagtacctgaaccccccccagagaaccctgtacagagacgtgatgctggagacctacagcaacctggtgttcgtgggccagcaggtgaccaagcccaacctgatcctgaagctggaggtggaggagtgccccgccgagggcaagatccccttctggaacttccccgaggtgtgccaggtggacgagcagatcgagagacagcaccaggacgaccaggacaagtgcctgctgatgcaggtgggcttcagcgacaagaagaccatcatcaccaagagcgccagagactgccacgagttcggcaacatcctgcacctgagcaccaacctggtggccagcatccagagacccgacaagcacgagagcttcggcaacaacatggtggacaacctggacctgttcagcagaagcagcgccgagaacaagtacgacaacggctgcgccaagctgttcttccacaccgagtacgagaagaccaaccccggcatgaagccctacggctacaaggagtgcggcaagggcctgagaagaaagaagggcctgagcctgcaccagagaatcaagaacggcgagaagcccttcgagtgcaccgcctgcagaaagaccttcagcaagaagagccacctgatcgtgcactggagaacccacaccggcgagaagcccttcggctgcaccgagtgcggcaaggccttcagccagaagagccagctgatcatccacctgagaacccacaccggcgagagacccttcgagtgccccgagtgcggcaaggccttcagagagaagagcaccgtgatcatccactacagaacccacaccggcgagaagccctacgagtgcaacgagtgcggcaaggccttcacccagaagagcaacctgatcgtgcaccagaagacccacaccggcgagaagacctacgagtgcaccaagtgcggcgagagcttcatccagaagctggacctgatcatccaccacagcacccacaccggcaagaagccccacgagtgcaacgagtgcaagaagaccttcagcgacaagagcaccctgatcatccaccagagaacccacaccggcgagaagccccacaagtgcaccgagtgcggcaagagcttcaacgagaagagcaccctgatcgtgcaccagagaacccacaccggcgagaagccctacgagtgcgacgtgtgcggcaagaccttcacccagaagagcaacctgggcgtgcaccagagaacccacagcggcgagaagcccttcgagtgcaacgagtgcgagaaggccttcagccagaagagctacctgatgctgcaccagagaggccacaccggcgagaagccctacgagtgcaacgagtgcgagaaggccttcagccagaagagctacctgatcatccaccagagaacccacaccgaggagaagccctacaagtgcaacgagtgcggcaaggccttcagagagaagagcaagctgatcatccaccagagaatccacaccggcgagaagccctacgagtgccccgtgtgctggaaggccttcagccagaagagccagctgatcatccaccagagaacccacaccggcgagaagccctacgcctgcaccgagtgcggcaaggccttcagagagaagagcaccttcaccgtgcaccagagaacccacaccggcgagaagccctacaagtgcaccgagtgcggcaaggccttcacccagaagagcaacctgatcgtgcaccagagaacccacgccggcaagaaggcccacggcagaggccacaccagaaagagcaagttcatggcccactag

SEQ ID NO: 26223 - DNA, 993 bp, Artificial Sequence
  Description of Artificial Sequence: Synthetic coding sequence
tgaagcgagatggccgccagagacgagctgggcctgggcggcgacagcctggaggccatgcccgtgcccgccgccagaggcagacccagaatcaccaacggccccgaggagctggccgcccccagccccgccgccctggccgactacgagggcaaggacgtggccaccagagtgggcgaggcctggcaggagagacccggcgcccccagaggcggccagggcgaccccgccgtgcccgcccagcagcccgccgaccccagcacccccgagagacagagcagccccagcggcagcgagcagctggtgagaagagagagctgcggcagcagcgtgctgaccgacttcgagggcaaggacgtggccaccaaggtgggcgaggcctggcaggacagacccggcgcccccagaggcggccagggcgaccccgccgtgcccacccagcagcccgccgaccccagcacccccgagcagcagaacagccccagcggcagcgagcagttcgtgagaagagagagctgcaccagcagagtgagaagccccagcagctgcatggtgaccgtgaccgtgaccgccaccagcgagcagccccacatctacatccccgcccccgccagcgagctggacagcagcagcaccaccaagggcatcctgttcgtgaaggagtacgtgaacgccagcgaggtgagcagcggcaagcccgtgagcgccagatacagcaacgtgagcagcatcgaggacagcttcgccatggagaagaagcccccctgcggcagcaccccctacagcgagagaaccaccggcggcatctgcacctactgcaacagagagatcagagactgccccaagatcaccctggagcacctgggcatctgctgccacgagtactgcttcaagtgcggcatctgcagcaagcccatgggcgacctgctggaccagatcttcatccacagagacaccatccactgcggcaagtgctacgagaagctgttctag

SEQ ID NO: 26224 - DNA, 1167 bp, Artificial Sequence
  Description of Artificial Sequence: Synthetic coding sequence
atggccgccgtgagccccaccaccagatgccaggagagcgtgaccttcgaggacgtggccgtggtgttcaccgacgaggagtggagcagactggtgcccatccagagagacctgtacaaggaggtgatgctggagaactacaacagcatcgtgagcctggactgggagaccaagcccgagatccacgacgccagcgacaagaagagcgagggcagcctgagagagtgcctgggcagacagagccccctgtgccccaagttcgaggtgcacacccccaacggcagaatgggcaccgagaagcagagccccagcggcgagaccagaaagaagagcctgagcagagacaagggcctgagaagaagaagaagcgccctgagcagagagatcctgaccaaggagagacaccaggagtgcagcgactgcggcaagaccttcttcgaccacagcagcctgaccagacaccagagaacccacaccggcgagaagccctacgactgcagagagtgcggcaaggccttcagccacagaagcagcctgagcagacacctgatgagccacaccggcgagagcccctacgagtgcagcgtgtgcagcaaggccttcttcgacagaagcagcctgaccgtgcaccagagaatccacaccggcgagaagcccttccagtgcaacgagtgcggcaaggccttcttcgacagaagcagcctgaccagacaccagagaatccacaccggcgagagcccctacgagtgccaccagtgcggcaaggccttcagccagaagagcatcctgaccagacaccagctgatccacaccggcagaaagccctacgagtgcaacgagtgcggcaaggccttctacggcgtgagcagcctgaacagacaccagaaggcccacgccggcgaccccagataccagtgcaacgagtgcggcaaggccttcttcgacagaagcagcctgacccagcaccagaagatccacaccggcgacaagccctacgagtgcagcgagtgcggcaaggccttcagccagagatgcagactgaccagacaccagagagtgcacaccggcgagaagcccttcgagtgcaccgtgtgcggcaaggtgttcagcagcaagagcagcgtgatccagcaccagagaagatacgccaagcagggcatcgactag

SEQ ID NO: 26225 - DNA, 2049 bp, Artificial Sequence
  Description of Artificial Sequence: Synthetic coding sequence
atgatccccaagcaggacatcagcgaggagctggagagccagagagccaagagcgaggaccacgtgagaaacatcttcaaggagaccgaggagatgagcaagaccgagggcaagctggagaactgctggagaaagtacgccgtggagggcgtgaagaacagcttcagccagaagagcaacttcagagagatcaccatgagatacgtgaagaccctgagcagagagaacggccagaagttcaacgccgtgggcgagaactgcatcaccgacagcaaccccgccaagcacctgagaggcagcagagaggagagcctgcaccccagcgtgagcagcgtggagaacctgcagcagcacgaggacctgatcaacctgcagagcttccagctgggcgagagagcctaccagaccgacgtgctggtgaaggtgcccagacagagcagcgtgctgagcgagaaccagagaatgaacaaccccgagagatggttcgagagcaccggctgcggcaagacctacaaccagaacagagccttcaaccagcaccagagattccacagcggcgagaagacctacgagcacaacgagtgcggcaaggccttcagctggcccagcatcctgagcaagcaccagagaatccacaccggcaagaagctgtacacctgcgaggactgcggcaagagcttcagcgtgcacagctacttcatccagcactgcaagatccacaccagagagaagccctacgagtgcatcaagtgcggcaaggccttcagcacccacagcagctacgtgcagcacctgaagatccacaccggcgagaagcaccacgagtgcaaccagtgcggcaaggccttcagccacagcagcaacctgatccaccaccagagaatccacagcggcgagaagccctacaagtgcaaggagtgcggcaaggccttcaacagacagagcaacctgatccagcaccagagaatccacagcggcgagaagccctacgactgcaaggagtgcggcaaggccttcagcacccagctgttcctgatccagcaccagagaatccacaccggcgagaagccctacgagtgcaacgagtgcgccaagagcttcagcctgaacagaaccctgaccgtgcaccagagaatccacaccggcgagaagccctacagatgcaacgagtgcggcaagagcttcagccagtgcagccaggtgatccagcacaagagaatccacaccggcgagaagccctacatctgcaacgagtgcggcaagagcttcggcgccagactgagcctgatccagcaccagagaatccacaccggcgagaagccctacggctgcagagagaagccctacgagtgcagcgagtgcggcaaggccttcagccagagcttcaacctgatccaccaccagagaacccacaacggcgagaagagctacgagtgcaacgagtgcgacaaggccttcagcctgctgagcagcctggtgcagcaccagagaatccacaacggcgacaagccctacgagtgccacaagtgcggcaaggccttcagccagggcagccacctgatccagcaccagagaagccacatcggcgagaagccctacgagtgcaacgagtgcggcaagaccttcggccagatcagcaccctgatcaagcacgagagaacccacaacggcgagaagccctacgagtgcagcgactgcggcaaggccttcagccagagcgcccacctgatccaccaccagagaatccacaccggcgagaacccctacgagtgcagcgagtgcggcaaggccttcaacgtgtgcagcagcctgatccagcaccacagaatccacaccggcgagaagccctacgagtgcagcgactgcggcaaggccttcagccagcacagccagttcatccagcaccagagaatccacaccggcgagaagccctacatgtgcaacgagtgcgagaagagcttcagcgcctgcctgagcctgatccagcacaagagaatccacaccggcgagaagccctacgtgtgcgccaagtgcggcaagagcttctag

SEQ ID NO: 26226 - DNA, 1419 bp, Artificial Sequence
  Description of Artificial Sequence: Synthetic coding sequence
atgatgggcacctacggcaacctgctgagcctgggctgcgacagcagaatcgagaaggaggagatgatccccaagcaggacatcagcgaggagctggagagccagagagccaagagcgaggaccacgtgagaaacatcttcaaggagaccgaggagatgagcaagaccgagggcaagctggagaactgctggagaaagtacgccgtggagggcgtgaagaacagcttcagccagaagagcaacttcagagagatcaccatgagatacgtgaagaccctgagcagagagaacggccagaagttcaacgccgtgggcgagaactgcatcaccgacagcaaccccgccaagcacctgagaggcagcagagaggagagcctgcaccccagcgtgagcagcgtggagaacctgcagcagcacgaggacctgatcaacctgcagagcttccagctgggcgagagagcctaccagaccgacgtgctggtgaaggtgcccagacagagcagcgtgctgagcgagaaccagagaatgaacaaccccgagagatggttcgagagcaccggctgcggcaagacctacaaccagaacagagccttcaaccagcaccagagattccacagcggcgagaagacctacgagcacaacgagtgcggcaaggccttcagctggcccagcatcctgagcaagcaccagagaatccacaccggcaagaagctgtacacctgcgaggactgcggcaagagcttcagcgtgcacagctacttcatccagcactgcaagatccacaccagagagaagccctacgagtgcatcaagtgcggcaaggccttcagcacccacagcagctacgtgcagcacctgaagatccacaccggcgagaagcaccacgagtgcaaccagtgcggcaaggccttcagccacagcagcaacctgatccaccaccagagaatccacagcggcgagaagccctacaagtgcaaggagtgcggcaagaccttcggccagatcagcaccctgatcaagcacgagagaacccacaacggcgagaagccctacgagtgcagcgactgcggcaaggccttcagccagagcgcccacctgatccaccaccagagaatccacaccggcgagaacccctacgagtgcagcgagtgcggcaaggccttcaacgtgtgcagcagcctgatccagcaccacagaatccacaccggcgagaagccctacgagtgcagcgactgcggcaaggccttcagccagcacagccagttcatccagcaccagagaatccacaccggcgagaagccctacatgtgcaacgagtgcgagaagagcttcagcgcctgcctgagcctgatccagcacaagagaatccacaccggcgagaagccctacgtgtgcgccaagtgcggcaagagcttctag

SEQ ID NO: 26227 - DNA, 1200 bp, Artificial Sequence
  Description of Artificial Sequence: Synthetic coding sequence
atgagccaggtgaccttcagcgacgtggccatcgacttcagccacgaggagtgggcctgcctggacagcgcccagagagacctgtacaaggacgtgatggtgcagaactacgagaacctggtgagcgtgggcctgagcgtgaccaagccctacgtgatcatgctgctggaggacggcaaggagccctggatgatggagaagaagctgagcaaggactgggagagcagatgggagaacaaggagctgagcaccaagaaggacatctacgacgaggacagcccccagcccgtgaccatggagaaggtggtgaagcagagctacgagttcagcaacagcaacaagaacctggagtacaccgagtgcgacaccttcagaagcaccttccacagcaagagcaccctgagcgagccccagaacaacagcgccgagggcaacagccacaagtacgacatcctgaagaagaacctgagcaagaagagcgtgatcaagagcgagagaatcaacggcggcaagaagctgctgaacagcaacaagagcggcgccgccttcaaccagagcaagagcctgaccctgccccagacctgcaacagagagaagatctacacctgcagcgagtgcggcaaggccttcggcaagcagagcatcctgagcagacactggagaatccacaccggcgagaagccctacgagtgcagagagtgcggcaagaccttcagccacggcagcagcctgaccagacaccagatcagccacagcggcgagaagccctacaagtgcatcgagtgcggcaaggccttcagccacggcagcagcctgaccaaccaccagagcacccacaccggcgagaagccctacgagtgcatgaactgcggcaagagcttcagcagagtgagcctgctgatccagcacctgagaatccacacccaggagaagagatacgagtgcagaatctgcggcaaggccttcatccacagcagcagcctgatccaccaccagaagagccacaccggcgagaagccctacgagtgcagagagtgcggcaaggccttctgctgcagcagccacctgacccagcaccagagaatccacagcatgaagaagaagtacgagtgcaacaagtgcctgaaggtgttcagcagcttcagcttcctggtgcagcaccagagcatccacaccgaggagaagcccttcgaggtgtag

SEQ ID NO: 26228 - DNA, 1332 bp, Artificial Sequence
  Description of Artificial Sequence: Synthetic coding sequence
atgagccagagacagtaccccgagtgctacctggcccccaacggctgcctggtgagcaactgcggcgtgaacaagatgagcaacgaggagctggtgggccagaaccacggcatggagggcgaggcctgcaccggcggcgacgtgaccttcagcgacgtggccatcgacttcagccacgaggagtgggcctgcctggacagcgcccagagagacctgtacaaggacgtgatggtgcagaactacgagaacctggtgagcgtgggcctgagcgtgaccaagccctacgtgatcatgctgctggaggacggcaaggagccctggatgatggagaagaagctgagcaaggactgggagagcagatgggagaacaaggagctgagcaccaagaaggacatctacgacgaggacagcccccagcccgtgaccatggagaaggtggtgaagcagagctacgagttcagcaacagcaacaagaacctggagtacaccgagtgcgacaccttcagaagcaccttccacagcaagagcaccctgagcgagccccagaacaacagcgccgagggcaacagccacaagtacgacatcctgaagaagaacctgagcaagaagagcgtgatcaagagcgagagaatcaacggcggcaagaagctgctgaacagcaacaagagcggcgccgccttcaaccagagcaagagcctgaccctgccccagacctgcaacagagagaagatctacacctgcagcgagtgcggcaaggccttcggcaagcagagcatcctgagcagacactggagaatccacaccggcgagaagccctacgagtgcagagagtgcggcaagaccttcagccacggcagcagcctgaccagacaccagatcagccacagcggcgagaagccctacaagtgcatcgagtgcggcaaggccttcagccacggcagcagcctgaccaaccaccagagcacccacaccggcgagaagccctacgagtgcatgaactgcggcaagagcttcagcagagtgagcctgctgatccagcacctgagaatccacacccaggagaagagatacgagtgcagaatctgcggcaaggccttcatccacagcagcagcctgatccaccaccagaagagccacaccggcgagaagccctacgagtgcagagagtgcggcaaggccttctgctgcagcagccacctgacccagcaccagagaatccacagcatgaagaagaagtacgagtgcaacaagtgcctgaaggtgttcagcagcttcagcttcctggtgcagcaccagagcatccacaccgaggagaagcccttcgaggtgtag

SEQ ID NO: 26229 - DNA, 1200 bp, Artificial Sequence; identical to SEQ ID NO: 26227
  Description of Artificial Sequence: Synthetic coding sequence

SEQ ID NO: 26230 - DNA, 429 bp, Artificial Sequence
  Description of Artificial Sequence: Synthetic coding sequence
atgagccaggtgaccttcagcgacgtggccatcgacttcagccacgaggagtgggcctgcctggacagcgcccagagagacctgtacaaggacgtgatggtgcagaactacgagaacctggtgagcgtgggcctgagcgtgaccaagccctacgtgatcatgctgctggaggacggcaaggagccctggatgatggagaagaagctgagcaaggactgggagagcagatgggagaacaaggagctgagcaccaagaaggacatctacgacgaggacagcccccagcccgtgaccatggagaaggtggtgaagcagagctacgagttcagcaacagcaacaagaacctggagtacaccgagtgcgacaccttcagaagcaccttccacagcaagagcaccctgagcgagccccagaacaacagcgcctag

SEQ ID NO: 26231 - DNA, 1200 bp, Artificial Sequence; identical to SEQ ID NO: 26227
  Description of Artificial Sequence: Synthetic coding sequence

SEQ ID NO: 26232 - DNA, 399 bp, Artificial Sequence
  Description of Artificial Sequence: Synthetic coding sequence
atgagccaggtgaccttcagcgacgtggccatcgacttcagccacgaggagtgggcctgcctggacagcgcccagagagacctgtacaaggacgtgatggtgcagaactacgagaacctggtgagcgtggccggcctgagcgtgaccaagccctacgtgatcatgctgctggaggacggcaaggagccctggatgatggagaagaagctgagcaaggcctaccccttccccctgagccacagcgtgcccgccagcgtgaacttcggcttcagcgccctgttcgagcactgcagcgaggtgaccgagatcttcgagctgagcgagctgtgcgtgttctgggtgctgcacttcctgagcaacagccccaacagcaccgtggaggccttcttcaagaagtag

SEQ ID NO: 26233 - DNA, 399 bp, Artificial Sequence; identical to SEQ ID NO: 26232
  Description of Artificial Sequence: Synthetic coding sequence

SEQ ID NO: 26234 - DNA, 2001 bp, Artificial Sequence
  Description of Artificial Sequence: Synthetic coding sequence
atgcaggaggtggtgctgctggacgagagcagcggcccccccagccagctgctgtggaccagacaggacacccagctgccccaggagagcgccctgctgcccgccccctaccccgccttcaccaaggacggcagccagggcaacctgccccaggccgacatcaccctgatgagccaggcccaggagagcgtgaccttcgaggacgtggccgtgaacttcaccaacagagagtggcagtgcctgacctacgcccagagacacctgtacaaggacgtgatgctggagaactacggcaacatggtgagcctgggcttccccttccccaagccccccctgatcagccacctggagagagaggtggacccctgcgtgcaggacccccaggacagagagagcctgagctgcagctaccccgtgagcgccgacaagatgtggcccgagaacgagaaggccagcagccagcaggagatcttcgagaacggcgaggcctactggatgaagttcaacagcctgctgaaggtggacagcagagaccccaaggtgagagaggtgtgcgtgcaggacgtgaagctggagaaccagtgggagaccagcatcagagagaagctgagagaggagaaggagggcagcgaggaggtgacctgcaagaagggcaagaaccagaaggtgctgagcaagaacctgaaccccaacagcaagcacagccagtgcaacaaggtgctgatcgcccagaagctgcacgagtgcgccagatgcggcaagaacttcagctggcacagcgacctgatcctgcacgagcagatccacagcggcgagaagccccacgtgtgcaacgagtgcggcaaggccttcaagaccagaaaccagctgagcatgcacagaatcatccacaccggcgagaagcccttcaactgcacccagtgcggcaaggccttcaacagcagaagcgccctgtgcagacacaagaagacccacagcggcgagaagccccacgagtgcagagactgcggcaaggccttcaagaccagaaacagactgtgcatgcaccagctgatccacaccggcgagaagccctacaagtgcaactgctgcggcaaggccttccagttcaagcacagcctgaccatccacggcagaatccacaccggcgagaagccctacgagtgcgaggagtgcggcaaggccttcagcggcagcagcgacctgaccaagcacatcagaatccacaccggcgagagaccctacgagtgcagcaagtgcggcagagccttcagcagaagcagcgacctgagcaagcacaagagaatccacaccagagagaagcactacggctgcccccagtgcggcaaggacttcagcatcaaggccgagctgaccaagcacagaagaatccacaccgaggagaagagatacagatgcgaggagtgcggcaaggccttcagacacaactgcaagagaagagcccacgagagagagcacaccggcgagaagccctaccagtgcagagactgcggcaagaccttccaggaccagcactgcctgaccatccaccagagaatccacaccggcgagaagccctacaagtgcctggagtgcggcaaggccttcagcggcaagagcaacctgaccaaccacagaagaatccacaccggcgagaagccccacaagtgcgaggtgtgcggcatggccttccaccacagcagcgtgctgagacagcacaagagaatccacaccggcgagaagccctacacctgcagcgagtgcggcaccagcttcagacagggcagcgccctgatcggccacaagagagtgcacaccggcgagaagccctacgagtgcgaggagtgcggcaaggccttcagagtgagcagcaacctgaccggccacaagaagagaaagcaccaggtgtggagcacccacgagctggacggcagcagaaagagcctgagccccgtgaccgtgagccagaccagcgtggtgagcatcctgaccagcgcctag

SEQ ID NO: 26235 - DNA, 1725 bp, Artificial Sequence
  Description of Artificial Sequence: Synthetic coding sequence
atgctggagaactacggcaacatggtgagcctgggcttccccttccccaagccccccctgatcagccacctggagagagaggtggacccctgcgtgcaggacccccaggacagagagagcctgagctgcagctaccccgtgagcgccgacaagatgtggcccgagaacgagaaggccagcagccagcaggagatcttcgagaacggcgaggcctactggatgaagttcaacagcctgctgaaggtggacagcagagaccccaaggtgagagaggtgtgcgtgcaggacgtgaagctggagaaccagtgggagaccagcatcagagagaagctgagagaggagaaggagggcagcgaggaggtgacctgcaagaagggcaagaaccagaaggtgctgagcaagaacctgaaccccaacagcaagcacagccagtgcaacaaggtgctgatcgcccagaagctgcacgagtgcgccagatgcggcaagaacttcagctggcacagcgacctgatcctgcacgagcagatccacagcggcgagaagccccacgtgtgcaacgagtgcggcaaggccttcaagaccagaaaccagctgagcatgcacagaatcatccacaccggcgagaagcccttcaactgcacccagtgcggcaaggccttcaacagcagaagcgccctgtgcagacacaagaagacccacagcggcgagaagccccacgagtgcagagactgcggcaaggccttcaagaccagaaacagactgtgcatgcaccagctgatccacaccggcgagaagccctacaagtgcaactgctgcggcaaggccttccagttcaagcacagcctgaccatccacggcagaatccacaccggcgagaagccctacgagtgcgaggagtgcggcaaggccttcagcggcagcagcgacctgaccaagcacatcagaatccacaccggcgagagaccctacgagtgcagcaagtgcggcagagccttcagcagaagcagcgacctgagcaagcacaagagaatccacaccagagagaagcactacggctgcccccagtgcggcaaggacttcagcatcaaggccgagctgaccaagcacagaagaatccacaccgaggagaagagatacagatgcgaggagtgcggcaaggccttcagacacaactgcaagagaagagcccacgagagagagcacaccggcgagaagccctaccagtgcagagactgcggcaagaccttccaggaccagcactgcctgaccatccaccagagaatccacaccggcgagaagccctacaagtgcctggagtgcggcaaggccttcagcggcaagagcaacctgaccaaccacagaagaatccacaccggcgagaagccccacaagtgcgaggtgtgcggcatggccttccaccacagcagcgtgctgagacagcacaagagaatccacaccggcgagaagccctacacctgcagcgagtgcggcaccagcttcagacagggcagcgccctgatcggccacaagagagtgcacaccggcgagaagccctacgagtgcgaggagtgcggcaaggccttcagagtgagcagcaacctgaccggccacaagaagagaaagcaccaggtgtggagcacccacgagctggacggcagcagaaagagcctgagccccgtgaccgtgagccagaccagcgtggtgagcatcctgaccagcgcctag

SEQ ID NO: 26236 - DNA, 702 bp, Artificial Sequence
  Description of Artificial Sequence: Synthetic coding sequence
atgctgagagaggaggccaccaagaagagcaaggagaaggagcccggcatggccctgccccagggcagactgaccttcagagacgtggccatcgagttcagcctggaggagtggaagtgcctgaaccccgcccagagagccctgtacagagccgtgatgctggagaactacagaaacctggagttcgtggacatcagcagcaagtgcatgatgaaggagttcagcagcaccgcccagggcaacaccgaggtgatccacaccggcaccctgcagagacacgagagccaccacatcagagacttctgcttccaggagatcgagaaggacatccacaacttcgagttccagtggcaggaggaggagagaaacggccacgaggcccccatgaccgagatcaaggagctgaccggcagcaccgacagacacgaccagagacacgccggcaacaagcccatcaaggaccagctgggcagcagcttccacagccacctgcccgagctgcacatcttccagcccgagtggaagatcggcaaccaggtggagaagagcatcatcaacgccagcctgatcctgaccagccagagaatcagctgcagccccaagaccagaatcagcaacaactacggcaacaacagcctgcacagcagcctgcccatccagaagctgggcagcacccacgagagaaagatcttccccatgtag

SEQ ID NO: 26237 - DNA, 1209 bp, Artificial Sequence
  Description of Artificial Sequence: Synthetic coding sequence
atgtacaccagcgaggagaagtgcaaccagagaacccagaagagaaagatctacaacgtgtgccccagaaagggcaagaagatcttcatccacatgcacgagatcatccagatcgacggccacatctaccagtgcctggagtgcaagcagaacttctgcgagaacctggccctgatcatgtgcgagagaacccacaccggcgagaagccctacaagtgcgacatgtgcgagaagaccttcgtgcagagcagcgacctgaccagccaccagagaatccacaactacgagaagccctacaagtgcagcaagtgcgagaagagcttctggcaccacctggccctgagcggccaccagagaacccacgccggcaagaagttctacacctgcgacatctgcggcaagaacttcggccagagcagcgacctgctggtgcaccagagaagccacaccggcgagaagccctacctgtgcagcgagtgcgacaagtgcttcagcagaagcaccaacctgatcagacacagaagaacccacaccggcgagaagcccttcaagtgcctggagtgcgagaaggccttcagcggcaagagcgacctgatcagccaccagagaacccacaccggcgagagaccctacaagtgcaacaagtgcgagaagagctacagacacagaagcgccttcatcgtgcacaagagagtgcacaccggcgagaagccctacaagtgcggcgcctgcgagaagtgcttcggccagaagagcgacctgatcgtgcaccagagagtgcacaccggcgagaagccctacaagtgcctggagtgcatgagaagcttcaccagaagcgccaacctgatcagacaccaggccacccacacccacaccttcaagtgcctggagtacgagaagagcttcaactgcagcagcgacctgatcgtgcaccagagaatccacatggaggagaagccccaccagtggagcgcctgcgagagcggcttcctgctgggcatggacttcgtggcccagcagaagatgagaacccagaccgaggagctgcactacaagtacaccgtgtgcgacaagagcttccaccagagcagcgccctgctgcagcaccagaccgtgcacatcggcgagaagcccttcgtgtgcaacgtgagcgagaagggcctggagctgagccccccccacgccagcgaggccagccagatgagctag

SEQ ID NO: 26238 - DNA, 744 bp, Artificial Sequence
  Description of Artificial Sequence: Synthetic coding sequence
atggtgacccagctgagatacgagagcttctgcctgcaccagttccaggagcaggacggcgagagcatccccgagaaccaggagctggccagcaagcaggagatcctgaaggagatggagcacctgggcgacagcaagctgcagagagacgtgagcctggacagcaagtacagagagacctgcaagagagacagcaaggccgagaagcagcaggcccacagcaccggcgagagaagacacagatgcaacgagtgcggcaagagcttcaccaagagcagcgtgctgatcgagcaccagagaatccacaccggcgagaagccctacgagtgcgaggagtgcggcaaggccttcagcagaagaagcagcctgaacgagcacagaagaagccacaccggcgagaagccctaccagtgcaaggagtgcggcaaggccttcagcgccagcaacggcctgaccagacacagaagaatccacaccggcgagaagccctacgagtgcaaggtgtgcggcaaggccttcctgctgagcagctgcctggtgcagcaccagagaatccacaccggcgagaagagataccagtgcagagagtgcggcaaggccttcatccagaacgccggcctgttccagcacctgagagtgcacaccggcgagaagccctaccagtgcagccagtgcagcaagctgttcagcaagagaaccctgctgaagaagcaccagaagatccacaccggcgagagaccctag

SEQ ID NO: 26239 - DNA, 1653 bp, Artificial Sequence
  Description of Artificial Sequence: Synthetic coding sequence
caggtgcccctgaccttcagcgacgtggccatcgacttcagccaggaggagtgggagtacctgaacagcgaccagagagacctgtacagagacgtgatgctggagaactacaccaacctggtgagcctggacttcaacttcaccaccgagagcaacaagctgagcagcgagaagagaaactacgaggtgaacgcctaccaccaggagacctggaagagaaacaagaccttcaacctgatgagattcatcttcagaaccgacccccagtacaccatcgagttcggcagacagcagagacccaaggtgggctgcttcagccagatgatcttcaagaagcacaagagcctgcccctgcacaagagaaacaacaccagagagaagagctacgagtgcaaggagtacaagaagggcttcagaaagtacctgcacctgaccgagcacctgagagaccacaccggcgtgatcccctacgagtgcaacgagtgcggcaaggccttcgtggtgttccagcacttcatcagacacagaaagatccacaccgacctgaagccctacgagtgcaacggctgcgagaaggccttcagattctacagccagctgatccagcaccagatcatccacaccggcatgaagccctacgagtgcaagcagtgcggcaaggccttcagaagacacagccacctgaccgagcaccagaagatccacgtgggcctgaagcccttcgagtgcaaggagtgcggcgagaccttcagactgtacagacacatgtgcctgcaccagaagatccaccacggcgtgaagccctacaagtgcaaggagtgcggcaaggccttcggccacagaagcagcctgtaccagcacaagaagatccacagcggcgagaagccctacaagtgcgagcagtgcgagaaggccttcgtgagaagctacctgctggtggagcaccagagaagccacaccggcgagaagccccacgagtgcatggagtgcggcaaggccttcggcaagggcagcagcctgctgaagcacaagagaatccacagcagcgagaagctgtacgactgcaaggactgcggcaaggccttctgcagaggcagccagctgacccagcaccagagaatccacaccggcgagaagccccacgagtgcaaggagtgcggcaagaccttcaagctgcacagctacctgatccagcaccagatcatccacaccgacctgaagccctacgagtgcaagcagtgcggcaaggccttcagcagagtgggcgacctgaagacccaccagagcatccacgccggcgagaagccctacgagtgcaaggagtgcggcaagaccttcagactgaacagccagctgatctaccaccagaccatccacaccggcctgaagccctacgtgtgcaaggagtgcaagaaggccttcagaagcatcagcggcctgagccagcacaagagaatccacaccggcgagaagccctacgagtgcaaggagtgcgacaaggccttcaacagaagcgacagactgacccagcacgagaccatccacaccggcgtgaagccccagaagtgcaaggagtgcggcaaggccttcagccactgctaccagctgagccagcaccagagattccaccacggcgagagactgctgatgtag

SEQ ID NO: 26240 - DNA, 1668 bp, Artificial Sequence
  Description of Artificial Sequence: Synthetic coding sequence
atggccttcacccagctgaccttcagagacgtggccatcgagttcagccaggacgagtggaagtgcctgaacagcacccagagaaccctgtacagagacgtgatgctggagaactacagaaacctggtgagcctggacctgagcagaaactgcgtgatcaaggagctggccccccagcaggagggcaaccccggcgaggtgttccacaccgtgaccctggagcagcacgagaagcacgacatcgaggagttctgcttcagagagatcaagaagaagatccacgacttcgactgccagtggagagacgacgagagaaactgcaacaaggtgaccaccgcccccaaggagaacctgacctgcagaagagaccagagagacagaagaggcatcggcaacaagagcatcaagcaccagctgggcctgagcttcctgccccacccccacgagctgcagcagttccaggccgagggcaagatctacgagtgcaaccacgtggagaagagcgtgaaccacggcagcagcgtgagccccccccagatcatcagcagcaccatcaagacccacgtgagcaacaagtacggcaccgacttcatctgcagcagcctgctgacccaggagcagaagagctgcatcagagagaagccctacagatacatcgagtgcgacaaggccctgaaccacggcagccacatgaccgtgagacaggtgagccacagcggcgagaagggctacaagtgcgacctgtgcggcaaggtgttcagccagaagagcaacctggccagacactggagagtgcacaccggcgagaagccctacaagtgcaacgagtgcgacagaagcttcagcagaaacagctgcctggccctgcacagaagagtgcacaccggcgagaagccctacaagtgctacgagtgcgacaaggtgttcagcagaaacagctgcctggccctgcaccagaagacccacatcggcgagaagccctacacctgcaaggagtgcggcaaggccttcagcgtgagaagcaccctgaccaaccaccaggtgatccacagcggcaagaagccctacaagtgcaacgagtgcggcaaggtgttcagccagaccagcagcctggccacccaccagagaatccacaccggcgagaagccctacaagtgcaacgagtgcggcaaggtgttcagccagaccagcagcctggccagacactggagaatccacaccggcgagaagccctacaagtgcaacgagtgcggcaaggtgttcagctacaacagccacctggccagccacagaagagtgcacaccggcgagaagccctacaagtgcaacgagtgcggcaaggccttcagcgtgcacagcaacctgaccacccaccaggtgatccacaccggcgagaagccctacaagtgcaaccagtgcggcaagggcttcagcgtgcacagcagcctgaccacccaccaggtgatccacaccggcgagaagccctacaagtgcaacgagtgcggcaagagcttcagcgtgagacccaacctgaccagacaccagatcatccacaccggcaagaagccctacaagtgcagcgactgcggcaagagcttcagcgtgagacccaacctgttcagacaccagatcatccacaccaaggagaagccctacaagagaaactag

SEQ ID NO: 26241 - DNA, 1704 bp, Artificial Sequence
  Description of Artificial Sequence: Synthetic coding sequence
atgcccgagctgtacaccgaggacttcatccagggctgcgacgtgggcgagctgcaggagcccggcctgcccggcctggagtgcaacggcgccatcagcgcccactgcaacctgagactgcccgacagcaacgacagccccgccagcgccagcagagtggccggcatcaccgacctgagcagaaactgcgtgatcaaggagctggccccccagcaggagggcaaccccggcgaggtgttccacaccgtgaccctggagcagcacgagaagcacgacatcgaggagttctgcttcagagagatcaagaagaagatccacgacttcgactgccagtggagagacgacgagagaaactgcaacaaggtgaccaccgcccccaaggagaacctgacctgcagaagagaccagagagacagaagaggcatcggcaacaagagcatcaagcaccagctgggcctgagcttcctgccccacccccacgagctgcagcagttccaggccgagggcaagatctacgagtgcaaccacgtggagaagagcgtgaaccacggcagcagcgtgagccccccccagatcatcagcagcaccatcaagacccacgtgagcaacaagtacggcaccgacttcatctgcagcagcctgctgacccaggagcagaagagctgcatcagagagaagccctacagatacatcgagtgcgacaaggccctgaaccacggcagccacatgaccgtgagacaggtgagccacagcggcgagaagggctacaagtgcgacctgtgcggcaaggtgttcagccagaagagcaacctggccagacactggagagtgcacaccggcgagaagccctacaagtgcaacgagtgcgacagaagcttcagcagaaacagctgcctggccctgcacagaagagtgcacaccggcgagaagccctacaagtgctacgagtgcgacaaggtgttcagcagaaacagctgcctggccctgcaccagaagacccacatcggcgagaagccctacacctgcaaggagtgcggcaaggccttcagcgtgagaagcaccctgaccaaccaccaggtgatccacagcggcaagaagccctacaagtgcaacgagtgcggcaaggtgttcagccagaccagcagcctggccacccaccagagaatccacaccggcgagaagccctacaagtgcaacgagtgcggcaaggtgttcagccagaccagcagcctggccagacactggagaatccacaccggcgagaagccctacaagtgcaacgagtgcggcaaggtgttcagctacaacagccacctggccagccacagaagagtgcacaccggcgagaagccctacaagtgcaacgagtgcggcaaggccttcagcgtgcacagcaacctgaccacccaccaggtgatccacaccggcgagaagccctacaagtgcaaccagtgcggcaagggcttcagcgtgcacagcagcctgaccacccaccaggtgatccacaccggcgagaagccctacaagtgcaacgagtgcggcaagagcttcagcgtgagacccaacctgaccagacaccagatcatccacaccggcaagaagccctacaagtgcagcgactgcggcaagagcttcagcgtgagacccaacctgttcagacaccagatcatccacaccaaggagaagccctacaagagaaactag

SEQ ID NO: 26242 - DNA, 1629 bp, Artificial Sequence
  Description of Artificial Sequence: Synthetic coding sequence
atgtgggagcacagaaaggagccctggaccatcgagagccaggtgagagtggccagaaagcccaagggctgggagtggatcaagggcgtgaagaccgacctgagcagaaactgcgtgatcaaggagctggccccccagcaggagggcaaccccggcgaggtgttccacaccgtgaccctggagcagcacgagaagcacgacatcgaggagttctgcttcagagagatcaagaagaagatccacgacttcgactgccagtggagagacgacgagagaaactgcaacaaggtgaccaccgcccccaaggagaacctgacctgcagaagagaccagagagacagaagaggcatcggcaacaagagcatcaagcaccagctgggcctgagcttcctgccccacccccacgagctgcagcagttccaggccgagggcaagatctacgagtgcaaccacgtggagaagagcgtgaaccacggcagcagcgtgagccccccccagatcatcagcagcaccatcaagacccacgtgagcaacaagtacggcaccgacttcatctgcagcagcctgctgacccaggagcagaagagctgcatcagagagaagccctacagatacatcgagtgcgacaaggccctgaaccacggcagccacatgaccgtgagacaggtgagccacagcggcgagaagggctacaagtgcgacctgtgcggcaaggtgttcagccagaagagcaacctggccagacactggagagtgcacaccggcgagaagccctacaagtgcaacgagtgcgacagaagcttcagcagaaacagctgcctggccctgcacagaagagtgcacaccggcgagaagccctacaagtgctacgagtgcgacaaggtgttcagcagaaacagctgcctggccctgcaccagaagacccacatcggcgagaagccctacacctgcaaggagtgcggcaaggccttcagcgtgagaagcaccctgaccaaccaccaggtgatccacagcggcaagaagccctacaagtgcaacgagtgcggcaaggtgttcagccagaccagcagcctggccacccaccagagaatccacaccggcgagaagccctacaagtgcaacgagtgcggcaaggtgttcagccagaccagcagcctggccagacactggagaatccacaccggcgagaagccctacaagtgcaacgagtgcggcaaggtgttcagctacaacagccacctggccagccacagaagagtgcacaccggcgagaagccctacaagtgcaacgagtgcggcaaggccttcagcgtgcacagcaacctgaccacccaccaggtgatccacaccggcgagaagccctacaagtgcaaccagtgcggcaagggcttcagcgtgcacagcagcctgaccacccaccaggtgatccacaccggcgagaagccctacaagtgcaacgagtgcggcaagagcttcagcgtgagacccaacctgaccagacaccagatcatccacaccggcaagaagccctacaagtgcagcgactgcggcaagagcttcagcgtgagacccaacctgttcagacaccagatcatccacaccaaggagaagccctacaagagaaactag

SEQ ID NO: 26243 - DNA, 1812 bp, Artificial Sequence
  Description of Artificial Sequence: Synthetic coding sequence
atgcccgagctgtacaccgaggacttcatccagggctgcgacgtgggcgagctgcaggagcccggcctgcccggcgtgctgagctacgtgggcgcccaggagagagccctggaccacagaaagcccagcaccagcagcaagaagaccaagagagtgggcatggaccagagatgcgagaacagactggagtgcaacggcgccatcagcgcccactgcaacctgagactgcccgacagcaacgacagccccgccagcgccagcagagtggccggcatcaccgacctgagcagaaactgcgtgatcaaggagctggccccccagcaggagggcaaccccggcgaggtgttccacaccgtgaccctggagcagcacgagaagcacgacatcgaggagttctgcttcagagagatcaagaagaagatccacgacttcgactgccagtggagagacgacgagagaaactgcaacaaggtgaccaccgcccccaaggagaacctgacctgcagaagagaccagagagacagaagaggcatcggcaacaagagcatcaagcaccagctgggcctgagcttcctgccccacccccacgagctgcagcagttccaggccgagggcaagatctacgagtgcaaccacgtggagaagagcgtgaaccacggcagcagcgtgagccccccccagatcatcagcagcaccatcaagacccacgtgagcaacaagtacggcaccgacttcatctgcagcagcctgctgacccaggagcagaagagctgcatcagagagaagccctacagatacatcgagtgcgacaaggccctgaaccacggcagccacatgaccgtgagacaggtgagccacagcggcgagaagggctacaagtgcgacctgtgcggcaaggtgttcagccagaagagcaacctggccagacactggagagtgcacaccggcgagaagccctacaagtgcaacgagtgcgacagaagcttcagcagaaacagctgcctggccctgcacagaagagtgcacaccggcgagaagccctacaagtgctacgagtgcgacaaggtgttcagcagaaacagctgcctggccctgcaccagaagacccacatcggcgagaagccctacacctgcaaggagtgcggcaaggccttcagcgtgagaagcaccctgaccaaccaccaggtgatccacagcggcaagaagccctacaagtgcaacgagtgcggcaaggtgttcagccagaccagcagcctggccacccaccagagaatccacaccggcgagaagccctacaagtgcaacgagtgcggcaaggtgttcagccagaccagcagcctggccagacactggagaatccacaccggcgagaagccctacaagtgcaacgagtgcggcaaggtgttcagctacaacagccacctggccagccacagaagagtgcacaccggcgagaagccctacaagtgcaacgagtgcggcaaggccttcagcgtgcacagcaacctgaccacccaccaggtgatccacaccggcgagaagccctacaagtgcaaccagtgcggcaagggcttcagcgtgcacagcagcctgaccacccaccaggtgatccacaccggcgagaagccctacaagtgcaacgagtgcggcaagagcttcagcgtgagacccaacctgaccagacaccagatcatccacaccggcaagaagccctacaagtgcagcgactgcggcaagagcttcagcgtgagacccaacctgttcagacaccagatcatccacaccaaggagaagccctacaagagaaactag

SEQ ID NO: 26244 - DNA, 1812 bp, Artificial Sequence; identical to SEQ ID NO: 26243
  Description of Artificial Sequence: Synthetic coding sequence

SEQ ID NO: 26245 - DNA, 1668 bp, Artificial Sequence
  Description of Artificial Sequence: Synthetic coding sequence
atggacggcgacggcctgaccttcagagacgtggccatcgagttcagccaggacgagtggaagtgcctgaacagcacccagagaaccctgtacagagacgtgatgctggagaactacagaaacctggtgagcctggacctgagcagaaactgcgtgatcaaggagctggccccccagcaggagggcaaccccggcgaggtgttccacaccgtgaccctggagcagcacgagaagcacgacatcgaggagttctgcttcagagagatcaagaagaagatccacgacttcgactgccagtggagagacgacgagagaaactgcaacaaggtgaccaccgcccccaaggagaacctgacctgcagaagagaccagagagacagaagaggcatcggcaacaagagcatcaagcaccagctgggcctgagcttcctgccccacccccacgagctgcagcagttccaggccgagggcaagatctacgagtgcaaccacgtggagaagagcgtgaaccacggcagcagcgtgagccccccccagatcatcagcagcaccatcaagacccacgtgagcaacaagtacggcaccgacttcatctgcagcagcctgctgacccaggagcagaagagctgcatcagagagaagccctacagatacatcgagtgcgacaaggccctgaaccacggcagccacatgaccgtgagacaggtgagccacagcggcgagaagggctacaagtgcgacctgtgcggcaaggtgttcagccagaagagcaacctggccagacactggagagtgcacaccggcgagaagccctacaagtgcaacgagtgcgacagaagcttcagcagaaacagctgcctggccctgcacagaagagtgcacaccggcgagaagccctacaagtgctacgagtgcgacaaggtgttcagcagaaacagctgcctggccctgcaccagaagacccacatcggcgagaagccctacacctgcaaggagtgcggcaaggccttcagcgtgagaagcaccctgaccaaccaccaggtgatccacagcggcaagaagccctacaagtgcaacgagtgcggcaaggtgttcagccagaccagcagcctggccacccaccagagaatccacaccggcgagaagccctacaagtgcaacgagtgcggcaaggtgttcagccagaccagcagcctggccagacactggagaatccacaccggcgagaagccctacaagtgcaacgagtgcggcaaggtgttcagctacaacagccacctggccagccacagaagagtgcacaccggcgagaagccctacaagtgcaacgagtgcggcaaggccttcagcgtgcacagcaacctgaccacccaccaggtgatccacaccggcgagaagccctacaagtgcaaccagtgcggcaagggcttcagcgtgcacagcagcctgaccacccaccaggtgatccacaccggcgagaagccctacaagtgcaacgagtgcggcaagagcttcagcgtgagacccaacctgaccagacaccagatcatccacaccggcaagaagccctacaagtgcagcgactgcggcaagagcttcagcgtgagacccaacctgttcagacaccagatcatccacaccaaggagaagccctacaagagaaactag

SEQ ID NO: 26246 - DNA, 567 bp, Artificial Sequence
  Description of Artificial Sequence: Synthetic coding sequence
atgaccgagaccagagagcccgccgagaccggcggctacgccagcctggaggaggacgacgaggacctgagccccggccccgagcacagcagcgacagcgagtacaccctgagcgagcccgacagcgaggaggaggaggacgaggaggaggaggaggaggagaccaccgacgaccccgagtacgaccccggctacaaggtgaagcagagactgggcggcggcagaggcggccccagcagaagagcccccagagccgcccagccccccgcccagccctgccagctgtgcggcagaagccccctgggcgaggccccccccggcacccccccctgcagactgtgctgccccgccaccgccccccaggaggcccccgcccccgagggcagagccctgggcgaggaggaggaggagccccccagagccggcgagggcagacccgccggcagagaggaggaggaggaggaggaggaggagggcacctaccactgcaccgagtgcgaggacagcttcgacaacctgggcgagctgcacggccacttcatgctgcacgccagaggcgaggtgtag

SEQ ID NO: 26247 - DNA, 375 bp, Artificial Sequence
  Description of Artificial Sequence: Synthetic coding sequence
atgaccgagaccagagagcccgccgagaccggcggctacgccagcctggaggaggacgacgaggacctgagccccggccccgagcacagcagcgacagcgagtacaccctgagcgagcccgacagcgaggaggaggaggacgaggaggaggaggaggaggagaccaccgacgaccccgagtacgaccccggctacaaggtgaagcagagactgggcggcggcagaggcggccccagcagaagagcccccagagccgcccagccccccgcccagccctgccagctgtgcggcagaagccccctgggcgaggccccccccggcacccccccctacggcgagctgggcagaagaggcggcgtgggcggcggcggctag

SEQ ID NO: 26248 - DNA, 2412 bp, Artificial Sequence
  Description of Artificial Sequence: Synthetic coding sequence
atggacgtggccatcgagttctgcctggaggagtggcagtgcctggacatcgcccagcagaacctgtacagaaacgtgatgctggagaactacagaaacctggtgttcctgggcatcgccgtgagcaagcccgacctgatcacctgcctggagcaggagaaggagccctgggagcccatgagaagacacgagatggtggccaagccccccgtgatgtgcagccacttcacccaggacttctggcccgagcagcacatcaaggaccccttccagaaggccaccctgagaagatacaagaactgcgagcacaagaacgtgcacctgaagaaggaccacaagagcgtggacgagtgcaaggtgcacagaggcggctacaacggcttcaaccagtgcctgcccgccacccagagcaagatcttcctgttcgacaagtgcgtgaaggccttccacaagttcagcaacagcaacagacacaagatcagccacaccgagaagaagctgttcaagtgcaaggagtgcggcaagagcttctgcatgctgccccacctggcccagcacaagatcatccacaccagagtgaacttctgcaagtgcgagaagtgcggcaaggccttcaactgccccagcatcatcaccaagcacaagagaatcaacaccggcgagaagccctacacctgcgaggagtgcggcaaggtgttcaactggagcagcagactgaccacccacaagaagaactacaccagatacaagctgtacaagtgcgaggagtgcggcaaggccttcaacaagagcagcatcctgaccacccacaagatcatcagaaccggcgagaagttctacaagtgcaaggagtgcgccaaggccttcaaccagagcagcaacctgaccgagcacaagaagatccaccccggcgagaagccctacaagtgcgaggagtgcggcaaggccttcaactggcccagcaccctgaccaagcacaagagaatccacaccggcgagaagccctacacctgcgaggagtgcggcaaggccttcaaccagttcagcaacctgaccacccacaagagaatccacaccgccgagaagttctacaagtgcaccgagtgcggcgaggccttcagcagaagcagcaacctgaccaagcacaagaagatccacaccgagaagaagccctacaagtgcgaggagtgcggcaaggccttcaagtggagcagcaagctgaccgagcacaagctgacccacaccggcgagaagccctacaagtgcgaggagtgcggcaaggccttcaactggcccagcaccctgaccaagcacaacagaatccacaccggcgagaagccctacaagtgcgaggtgtgcggcaaggccttcaaccagttcagcaacctgaccacccacaagagaatccacaccgccgagaagccctacaagtgcgaggagtgcggcaaggccttcagcagaagcagcaacctgaccaagcacaagaagatccacatcgagaagaagccctacaagtgcgaggagtgcggcaaggccttcaagtggagcagcaagctgaccgagcacaagatcacccacaccggcgagaagccctacaagtgcgaggagtgcggcaaggccttcaaccacttcagcatcctgaccaagcacaagagaatccacaccggcgagaagccctacaagtgcgaggagtgcggcaaggccttcacccagagcagcaacctgaccacccacaagaagatccacaccggcgagaagttctacaagtgcgaggagtgcggcaaggccttcacccagagcagcaacctgaccacccacaagaagatccacaccggcggcaagccctacaagtgcgaggagtgcggcaaggccttcaaccagttcagcaccctgaccaagcacaagatcatccacaccgaggagaagccctacaagtgcgaggagtgcggcaaggccttcaagtggagcagcaccctgaccaagcacaagatcatccacaccggcgagaagccctacaagtgcgaggagtgcggcaaggccttcaagctgagcagcaccctgagcacccacaagatcatccacaccggcgagaagccctacaagtgcgagaagtgcggcaaggccttcaacagaagcagcaacctgatcgagcacaagaagatccacaccggcgagcagccctacaagtgcgaggagtgcggcaaggccttcaactacagcagccacctgaacacccacaagagaatccacaccaaggagcagccctacaagtgcaaggagtgcggcaaggccttcaaccagtacagcaacctgaccacccacaacaagatccacaccggcgagaagctgtacaagcccgaggacgtgaccgtgatcctgaccaccccccagaccttcagcaacatcaagtag

SEQ ID NO: 26249 - DNA, 1095 bp, Artificial Sequence
  Description of Artificial Sequence: Synthetic coding sequence
atggagagaggcaagaagaagagaatcagcaacaagctgcagcagaccttccaccacagcaaggagcccaccttcctgatcaaccaggccggcctgctgagcagcgacagctacagcagcctgagccccgagaccgagagcgtgaaccccggcgagaacatcaagaccgacacccagaagaagagacccggcaccgtgatcctgagcaagctgagcagcagaagaatcatcagcgagagccagctgagcccccccgtgatccccgccagaagacccggcttcagagtgtgctacatctgcggcagagagttcggcagccagagcatcgccatccacgagccccagtgcctgcagaagtggcacatcgagaacagcaagctgcccaagcacctgagaagacccgagcccagcaagccccagagcctgagcagcagcggcagctacagcctgcaggccaccaacgaggccgccttccagagcgcccaggcccagctgctgccctgcgagagctgcggcagaaccttcctgcccgaccacctgctggtgcaccacagaagctgcaagcccaagggcgagggccccagagccccccacagcaacagcagcgaccacctgaccggcctgaagaaggcctgcagcggcacccccgccagacccagaaccgtgatctgctacatctgcggcaaggagttcggcaccctgagcctgcccatccacgagcccaagtgcctggagaagtggaagatggagaacgacagactgcccgtggagctgcaccagcccctgccccagaagccccagcccctgcccaacgcccagagcagccaggccggccccaaccaggcccagctggtgttctgcccccactgcagcagaatcttcaccagcgacagactgctggtgcaccagagaagctgcaagacccacccctacggccccaagtaccagaacctgaacctgggcagcaagggcggcctgaaggagtacaccaacagcaagcagcagagaaacagagccgcccccagcgtgaccgacaaggtgatccacgccacccaggacgccctgggcgagcccggcggcgccctgtgcctgtag

SEQ ID NO: 26250 - DNA, 192 bp, Artificial Sequence
  Description of Artificial Sequence: Synthetic coding sequence
atggagagaggcaagaagaagagaatcagcaacaagctgcagcagaccttccaccacagcaaggagcccaccttcctgatcaaccaggccggcctgctgagcagcgacagctacagcagcctgagccccgagaccgagagcgtgaaccccggcgagaacatcaagaccgacacccagaagaagagaccctag

SEQ ID NO: 26251 - DNA, 111 bp, Artificial Sequence
  Description of Artificial Sequence: Synthetic coding sequence
atggagagaggcaagaagaagagaatcagcaacaagctgcagcagaccttccaccacagcaaggagcccaccttcctgatcaaccaggccggcctgctgagcagcgactag

SEQ ID NO: 26252 - DNA, 4452 bp, Artificial Sequence
  Description of Artificial Sequence: Synthetic coding sequence
atgcccagcgagcagaagcagctgttctgcgacgagaagcagaccaccctgaagaaggactacgacgtgaagaacgagatcgtggacagaagcgcccccaagcccaagatcagcggcagcatccactacgccctgaagaacgtgaagatcgacctgcccaagatcaacatccccaacgaggtgctgctgaagcacgaggtggacaagtacagaaagctgttccagagcaagcagcagaccgccagaaagagcatcagcatcaagaccgtgagctgcgtggaggagtgcaccctgctgcacaagagcgagagagccgaggaggagggcgtgaagatgagcgccaagatcctgaacttcagctgcctgaagtgcagagacaacaccagatacagccccaacgacctgcagaagcacttccagatgtggcaccacggcgagctgcccagctacccctgcgagatgtgcaacttcagcgccaacgacttccaggtgttcaagcagcacagaagaacccacagaagcaccctggtgaagtgcgacatctgcaacaacgagagcgtgtacaccctgctgaacctgaccaagcacttcaccagcacccactgcgtgaacggcaacttccagtgcgagaagtgcaagttcagcacccaggacgtgggcaccttcgtgcagcacatccacagacacaacgagatccactacaagtgcggcaagtgccaccacgtgtgcttcaccaagggcgagctgcagaagcacctgcacatccacagcggcaccttccccttcacctgccagtactgcagctacggcgccaccagaagagagcacctggtgagacacgtgatcaccctgcacaaggagcacctgtacgccaaggagaagctggagaaggacaagtacgagaagagaatggccaagaccagcgccggcctgaagctgatcctgaagagatacaagatcggcgccagcagaaagaccttctggaagagaaagaagatcaacagcggcagcgacagaagcatcgagaagaacacccaggtgctgaagaagatgaacaagacccagaccaagagcgaggaccagagccacgtggtgcaggagcacctgagcgaggagaaggacgagagactgcactgcgagaacaacgacaaggcccccgagagcgagagcgagaagcccacccccctgagcaccggccagggcaacagagccgaggagggccccaacgccagcagcggcttcatgaagaccgccgtgctgggccccaccctgaagaacgtgatgatgaagaacaacaagctggccgtgagccccaactacaacgccaccttcatgggcttcaagatgatggacggcaagcagcacatcgtgctgaagctggtgcccatcaagcagaacgtgtgcagccccggcagccagagcggcgccgccaaggacggcaccgccaacctgcagccccagaccctggacaccaacggcttcctgaccggcgtgaccaccgagctgaacgacaccgtgtacatgaaggccgccacccccttcagctgcagcagcagcatcctgagcggcaaggccagcagcgagaaggagatgaccctgatcagccagagaaacaacatgctgcagaccatggactacgagaagagcgtgagcagcctgagcgccaccagcgagctggtgaccgccagcgtgaacctgaccaccaagttcgagaccagagacaacgtggacttctggggcaaccacctgacccagagccaccccgaggtgctgggcaccaccatcaagagccccgacaaggtgaactgcgtggccaagcccaacgcctacaacagcggcgacatgcacaactactgcatcaactacggcaactgcgagctgcccgtggagagcagcaaccagggcagcctgcccttccacaactacagcaaggtgaacaacagcaacaagagaagaagattcagcggcaccgccgtgtacgagaacccccagagagagagcagcagcagcaagaccgtggtgcagcagcccatcagcgagagcttcctgagcctggtgagacaggagagcagcaagcccgacagcctgctggccagcatcagcctgctgaacgacaaggacggcaccctgaaggccaagagcgagatcgaggagcagtacgtgctggagaagggccagaacatcgacggccagaacctgtacagcaacgagaaccagaacctggagtgcgccaccgagaagagcaagtgggaggacttcagcaacgtggacagccccatgatgcccagaatcaccagcgtgttcagcctgcagagccagcaggccagcgagttcctgccccccgaggtgaaccagctgctgcaggacgtgctgaagatcaagcccgacgtgaagcaggacagcagcaacacccccaacaagggcctgcccctgcactgcgaccagagcttccagaagcacgagagagagggcaagatcgtggagagcagcaaggacttcaaggtgcagggcatcttccccgtgccccccggcagcgtgggcatcaacgtgcccaccaacgacctgaacctgaagttcggcaaggagaagcaggtgagcagcatcccccaggacgtgagagacagcgagaagatgcccagaatcagcggcttcggcaccctgctgaagacccagagcgacgccatcatcacccagcagctggtgaaggacaagctgagagccaccacccagaacctgggcagcttctacatgcagagccccctgctgaacagcgagcagaagaagaccatcatcgtgcagaccagcaagggcttcctgatccccctgaacatcaccaacaagcccggcctgcccgtgatccccggcaacgccctgcccctggtgaacagccagggcatccccgccagcctgttcgtgaacaagaagcccggcatggtgctgaccctgaacaacggcaagctggagggcgtgagcgccgtgaagaccgagggcgcccccgccagaggcaccgtgaccaaggagccctgcaagacccccatcctgaaggtggagcccaacaacaactgcctgacccccggcctgtgcagcagcatcggcagctgcctgagcatgaagagcagcagcgagaacaccctgcccctgaagggcccctacatcctgaagcccaccagcagcgtgaaggccgtgctgatccccaacatgctgagcgagcagcagagcaccaagctgaacatcagcgacagcgtgaagcagcagaacgagatcttccccaagccccccctgtacaccttcctgcccgacggcaagcaggccgtgttcctgaagtgcgtgatgcccaacaagaccgagctgctgaagcccaagctggtgcagaacagcacctaccagaacatccagcccaagaagcccgagggcaccccccagagaatcctgctgaagatcttcaaccccgtgctgaacgtgaccgccgccaacaacctgagcgtgagcaacagcgccagcagcctgcagaaggacaacgtgcccagcaaccagatcatcggcggcgagcagaaggagcccgagagcagagacgccctgcccttcctgctggacgacctgatgcccgccaacgagatcgtgatcaccagcaccgccacctgccccgagagcagcgaggagcccatctgcgtgagcgactgcagcgagagcagagtgctgagatgcaagaccaactgcagaatcgagagaaacttcaacagaaagaagaccagcaagaagatcttcagcaagaccaagacccacggcagcaaggacagcgagaccgccttcgtgagcagaaacagaaactgcaagagaaagtgcagagacagctaccaggagccccccagaagaaaggccaccctgcacagaaagtgcaaggagaaggccaagcccgaggacgtgagagagaccttcggcttcagcagacccagactgagcaaggacagcatcagaaccctgagactgttccccttcagcagcaagcagctggtgaagtgccccagaagaaaccagcccgtggtggtgctgaaccaccccgacgccgacgcccccgaggtggtgagcgtgatgaagaccatcgccaagttcaacggccacgtgctgaaggtgagcctgagcaagagaaccatcaacgccctgctgaagcccgtgtgctacaacccccccaagaccacctacgacgacttcagcaagagacacaagaccttcaagcccgtgagcagcgtgaaggagagattcgtgctgaagctgaccctgaagaagaccagcaagaacaactaccagatcgtgaagaccaccagcgagaacatcctgaaggccaagttcaactgctggttctgcggcagagtgttcgacaaccaggacacctgggccggccacggccagagacacctgatggaggccaccagagactggaacatgctggagtag

SEQ ID NO: 26253 - DNA, 1734 bp, Artificial Sequence
  Description of Artificial Sequence: Synthetic coding sequence
atggccgtgggcctgtgcaaggccatgagccagggcctggtgaccttcagagacgtggccctggacttcagccaggaggagtgggagtggctgaagcccagccagaaggacctgtacagagacgtgatgctggagaactacagaaacctggtgtggctggactgggagagctggtgcgagatcgaggagctgagccccaagtggttcatcgacgaggacgagatcagccaggagatggtgatggagagactggccagccacggcctggagtgcagcagcttcagagaggcctggaagtacaagggcgagttcgagctgcaccagggcaacgccgagagacacttcatgcaggtgaccgccgtgaaggagatcagcaccggcaagagagacaacgagttcagcaacagcggcagaagcatccccctgaagagcgtgttcctgacccagcagaaggtgcccaccatccagcaggtgcacaagttcgacatctacgacaagctgttcccccagaacagcgtgatcatcgagtacaagagactgcacgccgagaaggagagcctgatcggcaacgagtgcgaggagttcaaccagagcacctacctgagcaaggacatcggcatcccccccggcgagaagccctacgagagccacgacttcagcaagctgctgagcttccacagcctgttcacccagcaccagaccacccacttcggcaagctgccccacggctacgacgagtgcggcgacgccttcagctgctacagcttcttcacccagccccagagaatccacagcggcgagaagccctacgcctgcaacgactgcggcaaggccttcagccacgacttcttcctgagcgagcaccagagaacccacatcggcgagaagccctacgagtgcaaggagtgcaacaaggccttcagacagagcgcccacctggcccagcaccagagaatccacaccggcgagaagcccttcgcctgcaacgagtgcggcaaggccttcagcagatacgccttcctggtggagcaccagagaatccacaccggcgagaagccctacgagtgcaaggagtgcaacaaggccttcagacagagcgcccacctgaaccagcaccagagaatccacaccggcgagaagccctacgagtgcaaccagtgcggcaaggccttcagcagaagaatcgccctgaccctgcaccagagaatccacaccggcgagaagcccttcaagtgcagcgagtgcggcaagaccttcggctacagaagccacctgaaccagcaccagagaatccacaccggcgagaagccctacgagtgcatcaagtgcggcaagttcttcagaaccgacagccagctgaacagacaccacagaatccacaccggcgagagacccttcgagtgcagcaagtgcggcaaggccttcagcgacgccctggtgctgatccaccacaagagaagccacgccggcgagaagccctacgagtgcaacaagtgcggcaaggccttcagctgcggcagctacctgaaccagcaccagagaatccacaccggcgagaagccctacgagtgcagcgagtgcggcaaggccttccaccagatcctgagcctgagactgcaccagagaatccacgccggcgagaagccctacaagtgcaacgagtgcggcaacaacttcagctgcgtgagcgccctgagaagacaccagagaatccacaacagagagaccctgtag

SEQ ID NO: 26254 - DNA, 1830 bp, Artificial Sequence
  Description of Artificial Sequence: Synthetic coding sequence
atggccgtgggcctgtgcaaggccatgagccagggcctggtgaccttcagagacgtggccctggacttcagccaggaggagtgggagtggctgaagcccagccagaaggacctgtacagagacgtgatgctggagaactacagaaacctggtgtggctgggcctgagcatcagcaagcccaacatgatcagcctgctggagcagggcaaggagccctggatggtggagagaaagatgagccagggccactgcgccgactgggagagctggtgcgagatcgaggagctgagccccaagtggttcatcgacgaggacgagatcagccaggagatggtgatggagagactggccagccacggcctggagtgcagcagcttcagagaggcctggaagtacaagggcgagttcgagctgcaccagggcaacgccgagagacacttcatgcaggtgaccgccgtgaaggagatcagcaccggcaagagagacaacgagttcagcaacagcggcagaagcatccccctgaagagcgtgttcctgacccagcagaaggtgcccaccatccagcaggtgcacaagttcgacatctacgacaagctgttcccccagaacagcgtgatcatcgagtacaagagactgcacgccgagaaggagagcctgatcggcaacgagtgcgaggagttcaaccagagcacctacctgagcaaggacatcggcatcccccccggcgagaagccctacgagagccacgacttcagcaagctgctgagcttccacagcctgttcacccagcaccagaccacccacttcggcaagctgccccacggctacgacgagtgcggcgacgccttcagctgctacagcttcttcacccagccccagagaatccacagcggcgagaagccctacgcctgcaacgactgcggcaaggccttcagccacgacttcttcctgagcgagcaccagagaacccacatcggcgagaagccctacgagtgcaaggagtgcaacaaggccttcagacagagcgcccacctggcccagcaccagagaatccacaccggcgagaagcccttcgcctgcaacgagtgcggcaaggccttcagcagatacgccttcctggtggagcaccagagaatccacaccggcgagaagccctacgagtgcaaggagtgcaacaaggccttcagacagagcgcccacctgaaccagcaccagagaatccacaccggcgagaagccctacgagtgcaaccagtgcggcaaggccttcagcagaagaatcgccctgaccctgcaccagagaatccacaccggcgagaagcccttcaagtgcagcgagtgcggcaagaccttcggctacagaagccacctgaaccagcaccagagaatccacaccggcgagaagccctacgagtgcatcaagtgcggcaagttcttcagaaccgacagccagctgaacagacaccacagaatccacaccggcgagagacccttcgagtgcagcaagtgcggcaaggccttcagcgacgccctggtgctgatccaccacaagagaagccacgccggcgagaagccctacgagtgcaacaagtgcggcaaggccttcagctgcggcagctacctgaaccagcaccagagaatccacaccggcgagaagccctacgagtgcagcgagtgcggcaaggccttccaccagatcctgagcctgagactgcaccagagaatccacgccggcgagaagccctacaagtgcaacgagtgcggcaacaacttcagctgcgtgagcgccctgagaagacaccagagaatccacaacagagagaccctgtag

SEQ ID NO: 26255 - DNA, 1674 bp, Artificial Sequence
  Description of Artificial Sequence: Synthetic coding sequence
accggcctgagcatcagcaagcccaacatgatcagcctgctggagcagggcaaggagccctggatggtggagagaaagatgagccagggccactgcgccgactgggagagctggtgcgagatcgaggagctgagccccaagtggttcatcgacgaggacgagatcagccaggagatggtgatggagagactggccagccacggcctggagtgcagcagcttcagagaggcctggaagtacaagggcgagttcgagctgcaccagggcaacgccgagagacacttcatgcaggtgaccgccgtgaaggagatcagcaccggcaagagagacaacgagttcagcaacagcggcagaagcatccccctgaagagcgtgttcctgacccagcagaaggtgcccaccatccagcaggtgcacaagttcgacatctacgacaagctgttcccccagaacagcgtgatcatcgagtacaagagactgcacgccgagaaggagagcctgatcggcaacgagtgcgaggagttcaaccagagcacctacctgagcaaggacatcggcatcccccccggcgagaagccctacgagagccacgacttcagcaagctgctgagcttccacagcctgttcacccagcaccagaccacccacttcggcaagctgccccacggctacgacgagtgcggcgacgccttcagctgctacagcttcttcacccagccccagagaatccacagcggcgagaagccctacgcctgcaacgactgcggcaaggccttcagccacgacttcttcctgagcgagcaccagagaacccacatcggcgagaagccctacgagtgcaaggagtgcaacaaggccttcagacagagcgcccacctggcccagcaccagagaatccacaccggcgagaagcccttcgcctgcaacgagtgcggcaaggccttcagcagatacgccttcctggtggagcaccagagaatccacaccggcgagaagccctacgagtgcaaggagtgcaacaaggccttcagacagagcgcccacctgaaccagcaccagagaatccacaccggcgagaagccctacgagtgcaaccagtgcggcaaggccttcagcagaagaatcgccctgaccctgcaccagagaatccacaccggcgagaagcccttcaagtgcagcgagtgcggcaagaccttcggctacagaagccacctgaaccagcaccagagaatccacaccggcgagaagccctacgagtgcatcaagtgcggcaagttcttcagaaccgacagccagctgaacagacaccacagaatccacaccggcgagagacccttcgagtgcagcaagtgcggcaaggccttcagcgacgccctggtgctgatccaccacaagagaagccacgccggcgagaagccctacgagtgcaacaagtgcggcaaggccttcagctgcggcagctacctgaaccagcaccagagaatccacaccggcgagaagccctacgagtgcagcgagtgcggcaaggccttccaccagatcctgagcctgagactgcaccagagaatccacgccggcgagaagccctacaagtgcaacgagtgcggcaacaacttcagctgcgtgagcgccctgagaagacaccagagaatccacaacagagagaccctgtag

SEQ ID NO: 26256 - DNA, 1692 bp, Artificial Sequence
  Description of Artificial Sequence: Synthetic coding sequence
atggccaacagcagcttcatcggcgaccacgtgcacggcgccccccacgccgtgatgcccgaggtggagttccccgaccagttcttcaccgtgctgaccatggaccacgagctggtgaccctgagagacgtggtgatcaacttcagccaggaggagtgggagtacctggacagcgcccagagaaacctgtactgggacgtgatgatggagaactacagcaacctgctgagcctggacctggagagcagaaacgagaccaagcacctgagcgtgggcaaggacatcatccagaacaccggcagccagtgggaggtgatggagagcagcaagctgtgcggcctggagggcagcatcttcagaaacgactggcagagcaagagcaagatcgacctgcagggccccgaggtgggctacttcagccagatgaagatcatcagcgagaacgtgcccagctacaagacccacgagagcctgaccctgcccagaagaacccacgacagcgagaagccctacgagtacaaggagtacgagaaggtgttcagctgcgacctggagttcgacgagtaccagaagatccacaccggcggcaagaactacgagtgcaaccagtgctggaagaccttcggcatcgacaacagcagcatgctgcagctgaacatccacaccggcgtgaagccctgcaagtacatggagtacggcaacacctgcagcttctacaaggacttcaacgtgtaccagaagatccacaacgagaagttctacaagtgcaaggagtacagaagaaccttcgagagagtgggcaaggtgacccccctgcagagagtgcacgacggcgagaagcacttcgagtgcagcttctgcggcaagagcttcagagtgcacgcccagctgaccagacaccagaagatccacaccgacgagaagacctacaagtgcatggagtgcggcaaggacttcagattccacagccagctgaccgagcaccagagaatccacaccggcgagaagccctacaagtgcatgcactgcgagaaggtgttcagaatcagcagccagctgatcgagcaccagagaatccacaccggcgagaagccctacgcctgcaaggagtgcggcaaggccttcggcgtgtgcagagagctggccagacaccagagaatccacaccggcaagaagccctacgagtgcaaggcctgcggcaaggtgttcagaaacagcagcagcctgaccagacaccagagaatccacaccggcgagaagccctacaagtgcaaggagtgcgagaaggccttcggcgtgggcagcgagctgaccagacacgagagaatccacagcggccagaagccctacgagtgcaaggagtgcggcaagttcttcagactgaccagcgccctgatccagcaccagagaatccacagcggcgagaagccctacgagtgcaaggtgtgcggcaaggccttcagacacagcagcgccctgaccgagcaccagagaatccacaccggcgagaagccctacgagtgcaaggcctgcggcaaggccttcagacacagcagcagcttcaccaagcaccagagaatccacaccgacgacaagccctacgagtgcaaggagtgcggcaacagcttcagcgtggtgggccacctgacctgccagcccaagatctacaccggcgagaagagcttcgactag

SEQ ID NO: 26257 - DNA, 1692 bp, Artificial Sequence; identical to SEQ ID NO: 26256
  Description of Artificial Sequence: Synthetic coding sequence

SEQ ID NO: 26258 - DNA, 1209 bp, Artificial Sequence
  Description of Artificial Sequence: Synthetic coding sequence
atggccgccgtgatcctgcccagcaccgccgcccccagcagcctgttccccgccagccagcagaagggccacacccagggcggcgagctggtgaacgagctgctgaccagctggctgagaggcctggtgaccttcgaggacgtggccgtggagttcacccaggaggagtgggccctgctggaccccgcccagagaaccctgtacagagacgtgatgctggagaactgcagaaacctggccagcctgggctgcagagtgaacaagcccagcctgatcagccagctggagcaggacaagaaggtggtgaccgaggagagaggcatcctgcccagcacctgccccgacctggagaccctgctgaaggccaagtggctgacccccaagaagaacgtgttcagaaaggagcagagcaagggcgtgaagaccgagagaagccacagaggcgtgaagctgaacgagtgcaaccagtgcttcaaggtgttcagcaccaagagcaacctgacccagcacaagagaatccacaccggcgagaagccctacgactgcagccagtgcggcaagagcttcagcagcagaagctacctgaccatccacaagagaatccacaacggcgagaagccctacgagtgcaaccactgcggcaaggccttcagcgaccccagcagcctgagactgcacctgagaatccacaccggcgagaagccctacgagtgcaaccagtgcttccacgtgttcagaaccagctgcaacctgaagagccacaagagaatccacaccggcgagaaccaccacgagtgcaaccagtgcggcaaggccttcagcaccagaagcagcctgaccggccacaacagcatccacaccggcgagaagccctacgagtgccacgactgcggcaagaccttcagaaagagcagctacctgacccagcacgtgagaacccacaccggcgagaagccctacgagtgcaacgagtgcggcaagagcttcagcagcagcttcagcctgaccgtgcacaagagaatccacaccggcgagaagccctacgagtgcagcgactgcggcaaggccttcaacaacctgagcgccgtgaagaagcacctgagaacccacaccggcgagaagccctacgagtgcaaccactgcggcaagagcttcaccagcaacagctacctgagcgtgcacaagagaatccacaacagatggatctag

SEQ ID NO: 26259 - DNA, 1098 bp, Artificial Sequence
  Description of Artificial Sequence: Synthetic coding sequence
atgagagagaagagcttccagtgcaacgagaccggcgaggccttcaactgcagcagcttcgtgagaaagcaccagatcatccacctgggcgagaagcagtacaagttcgacatctgcggcaaggtgttcaacgagaagagatacctggccagacacagaagatgccacaccagcgagaagccctacaagtgcaacgagtgcggcaagagcttcagctacaagagcagcctgacctgccacagaagatgccacaccggcgagaagccctacaagtgcaacgagtgcggcaagagcttcagctacaagagcagcctgacctgccaccacagatgccacaccggcgagaagccctacaagtgcaacgagtgcggcaagagcttcagctacaagagcagcctgagatgccacagaagactgcacaccggcatcaagccctacaagtgcaacgagtgcggcaagatgttcggccagaacagcaccctggtgatccacaaggccatccacaccggcgagaagccctacaagtgcaacgagtgcggcaaggccttcaaccagcagagccacctgagcagacaccacagactgcacaccggcgagaagccctacaagtgcaacgactgcggcaaggccttcatccaccagagcagcctggccagacaccacagactgcacaccggcgagaagagctacaagtgcgaggagtgcgacagagtgttcagccagaagagcaacctggagagacacaagatcatccacaccggcgagaagccctacaagtgcaacgagtgccacaagaccttcagccacagaagcagcctgccctgccacagaagactgcacagcggcgagaagccctacaagtgcaacgagtgcggcaagaccttcaacgtgcagagccacctgagcagacaccacagactgcacaccggcgagaagccctacaagtgcaaggtgtgcgacaaggccttcatgtgccacagctacctggccaaccacaccagaatccacagcggcgagaagccctacaagtgcaacgagtgcggcaaggcccacaaccacctgatcgacagcagcatcaagccctgcatgagcagctag

SEQ ID NO: 26260 - DNA, 1773 bp, Artificial Sequence
  Description of Artificial Sequence: Synthetic coding sequence
atgctgcacgaggaggccgcccagaagagaaagggcaaggagcccggcatggccctgccccagggcagactgaccttcagagacgtggccatcgagttcagcctggccgagtggaagttcctgaaccccgcccagagagccctgtacagagaggtgatgctggagaactacagaaacctggaggccgtggacatcagcagcaagagaatgatgaaggaggtgctgagcaccggccagggcaacaccgaggtgatccacaccggcatgctgcagagacacgagagctaccacaccggcgacttctgcttccaggagatcgagaaggacatccacgacttcgagttccagagccagaaggacgagagaaacggccacgaggccagcatgcccaagatcaaggagctgatgggcagcaccgacagacacgaccagagacacgccggcaacaagcccatcaaggaccagctgggcctgagcttccacctgcacctgcccgagctgcacatcttccagcccgaggagaagatcgccaaccaggtggagaagagcgtgaacgacgccagcagcatcagcaccagccagagaatcagctgcagacccgagacccacacccccaacaactacggcaacaacttcttccacagcagcctgctgacccagaagcaggaggtgcacatgagagagaagagcttccagtgcaacgagaccggcgaggccttcaactgcagcagcttcgtgagaaagcaccagatcatccacctgggcgagaagcagtacaagttcgacatctgcggcaaggtgttcaacgagaagagatacctggccagacacagaagatgccacaccagcgagaagccctacaagtgcaacgagtgcggcaagagcttcagctacaagagcagcctgacctgccacagaagatgccacaccggcgagaagccctacaagtgcaacgagtgcggcaagagcttcagctacaagagcagcctgacctgccaccacagatgccacaccggcgagaagccctacaagtgcaacgagtgcggcaagagcttcagctacaagagcagcctgagatgccacagaagactgcacaccggcatcaagccctacaagtgcaacgagtgcggcaagatgttcggccagaacagcaccctggtgatccacaaggccatccacaccggcgagaagccctacaagtgcaacgagtgcggcaaggccttcaaccagcagagccacctgagcagacaccacagactgcacaccggcgagaagccctacaagtgcaacgactgcggcaaggccttcatccaccagagcagcctggccagacaccacagactgcacaccggcgagaagagctacaagtgcgaggagtgcgacagagtgttcagccagaagagcaacctggagagacacaagatcatccacaccggcgagaagccctacaagtgcaacgagtgccacaagaccttcagccacagaagcagcctgccctgccacagaagactgcacagcggcgagaagccctacaagtgcaacgagtgcggcaagaccttcaacgtgcagagccacctgagcagacaccacagactgcacaccggcgagaagccctacaagtgcaaggtgtgcgacaaggccttcatgtgccacagctacctggccaaccacaccagaatccacagcggcgagaagccctacaagtgcaacgagtgcggcaaggcccacaaccacctgatcgacagcagcatcaagccctgcatgagcagctag

SEQ ID NO: 26261 - DNA, 1773 bp, Artificial Sequence; identical to SEQ ID NO: 26260
  Description of Artificial Sequence: Synthetic coding sequence

SEQ ID NO: 26262 - DNA, 279 bp, Artificial Sequence
  Description of Artificial Sequence: Synthetic coding sequence
atggagctggtgaccttcagagacgtggccatcgagttcagccccgaggagtggaagtgcctggaccccgcccagcagaacctgtacagagacgtgatgctggagaactacagaaacctggtgagcctgggcttcgtgatcagcaaccccgacctggtgacctgcctggagcagatcaaggagccctgcaacctgaagatccacgagaccgccgccaagccccccggcagcgacctgcaggtgtacaaggagagccagtgccccctgtacagactgtag

SEQ ID NO: 26263 - DNA, 2715 bp, Artificial Sequence
  Description of Artificial Sequence: Synthetic coding sequence
atggccgccgccggcggcgccgagggcagaagagccgacatggaggccgaggccgccgccgcccccgagagagagggcggcagctgcgtgctgtgctgcggcgacctggaggccaccgccctgggcagatgcgaccaccccgtgtgctacagatgcagcaccaagatgagagtgctgtgcgagcagagatactgcgccgtgtgcagagaggagctgagacaggtggtgttcggcaagaagctgcccgccttcgccaccatccccatccaccagctgcagcacgagaagaagtacgacatctacttcgccgacggcaaggtgtacgccctgtacagacagctgctgcagcacgagtgccccagatgccccgagctgccccccttcagcctgttcggcgacctggagcagcacatgagaagacagcacgagctgttctgctgcagactgtgcctgcagcacctgcagatcttcacctacgagagaaagtggtacagcagaaaggacctggccagacacagaatgcagggcgaccccgacgacaccagccacagaggccaccccctgtgcaagttctgcgacgagagatacctggacaacgacgagctgctgaagcacctgagaagagaccactacttctgccacttctgcgacagcgacggcgcccaggactactacagcgactacgcctacctgagagagcacttcagagagaagcacttcctgtgcgaggagggcagatgcagcaccgagcagttcacccacgccttcagaaccgagatcgacctgaaggcccacagaaccgcctgccacagcagaagcagagccgaggccagacagaacagacacatcgacctgcagttcagctacgcccccagacacagcagaagaaacgagggcgtggtgggcggcgaggactacgaggaggtggacagatacagcagacagggcagagtggccagagccggcaccagaggcgcccagcagagcagaagaggcagctggagatacaagagagaggaggaggacagagaggtggccgccgccgtgagagccagcgtggccgcccagcagcaggaggaggccagaagaagcgaggaccaggaggagggcggcagacccaagaaggaggaggccgccgccagaggccccgaggaccccagaggccccagaagaagccccagaacccagggcgagggccccggccccaaggagaccagcaccaacggccccgtgagccaggaggccttcagcgtgaccggccccgccgcccccggctgcgtgggcgtgcccggcgccctgcccccccccagccccaagctgaaggacgaggacttccccagcctgagcgccagcaccagcagcagctgcagcaccgccgccacccccggccccgtgggcctggccctgccctacgccatccccgccagaggcagaagcgccttccaggaggaggacttccccgccctggtgagcagcgtgcccaagcccggcaccgcccccaccagcctggtgagcgcctggaacagcagcagcagcagcaagaaggtggcccagccccccctgagcgcccaggccaccggcagcggccagcccaccagaaaggccggcaagggcagcagaggcggcagaaagggcggcccccccttcacccaggaggaggaggaggacggcggccccgccctgcaggagctgctgagcaccagacccaccggcagcgtgagcagcaccctgggcctggccagcatccagcccagcaaggtgggcaagaagaagaaggtgggcagcgagaagcccggcaccaccctgccccagcccccccccgccacctgcccccccggcgccctgcaggcccccgaggcccccgccagcagagccgagggccccgtggccgtggtggtgaacggccacatggagggccccgcccccgccagaagcgcccccaaggagccccccggcctgcccagacccctgggcagcttcccctgccccaccccccaggaggacttccccgccctgggcggcccctgcccccccagaatgccccccccccccggcttcagcgccgtggtgctgctgaagggcaccccccccccccccccccccggcctggtgccccccatcagcaagcccccccccggcttcagcggcctgctgcccagcccccaccccgcctgcgtgcccagccccgccaccaccaccaccaccaaggcccccagactgctgcccgcccccagagcctacctggtgcccgagaacttcagagagagaaacctgcagctgatccagagcatcagagacttcctgcagagcgacgaggccagattcagcgagttcaagagccacagcggcgagttcagacagggcctgatcagcgccgcccagtactacaagagctgcagagacctgctgggcgagaacttccagaaggtgttcaacgagctgctggtgctgctgcccgacaccgccaagcagcaggagctgctgagcgcccacaccgacttctgcaacagagagaagcccctgagcaccaagagcaagaagaacaagaagagcgcctggcaggccaccacccagcaggccggcctggactgcagagtgtgccccacctgccagcaggtgctggcccacggcgacgccagcagccaccaggccctgcacgccgccagagacgacgacttccccagcctgcaggccatcgccagaatcatcacctag

SEQ ID NO: 26264 - DNA, 2550 bp, Artificial Sequence
  Description of Artificial Sequence: Synthetic coding sequence
atgagagtgctgtgcgagcagagatactgcgccgtgtgcagagaggagctgagacaggtggtgttcggcaagaagctgcccgccttcgccaccatccccatccaccagctgcagcacgagaagaagtacgacatctacttcgccgacggcaaggtgtacgccctgtacagacagctgctgcagcacgagtgccccagatgccccgagctgccccccttcagcctgttcggcgacctggagcagcacatgagaagacagcacgagctgttctgctgcagactgtgcctgcagcacctgcagatcttcacctacgagagaaagtggtacagcagaaaggacctggccagacacagaatgcagggcgaccccgacgacaccagccacagaggccaccccctgtgcaagttctgcgacgagagatacctggacaacgacgagctgctgaagcacctgagaagagaccactacttctgccacttctgcgacagcgacggcgcccaggactactacagcgactacgcctacctgagagagcacttcagagagaagcacttcctgtgcgaggagggcagatgcagcaccgagcagttcacccacgccttcagaaccgagatcgacctgaaggcccacagaaccgcctgccacagcagaagcagagccgaggccagacagaacagacacatcgacctgcagttcagctacgcccccagacacagcagaagaaacgagggcgtggtgggcggcgaggactacgaggaggtggacagatacagcagacagggcagagtggccagagccggcaccagaggcgcccagcagagcagaagaggcagctggagatacaagagagaggaggaggacagagaggtggccgccgccgtgagagccagcgtggccgcccagcagcaggaggaggccagaagaagcgaggaccaggaggagggcggcagacccaagaaggaggaggccgccgccagaggccccgaggaccccagaggccccagaagaagccccagaacccagggcgagggccccggccccaaggagaccagcaccaacggccccgtgagccaggaggccttcagcgtgaccggccccgccgcccccggctgcgtgggcgtgcccggcgccctgcccccccccagccccaagctgaaggacgaggacttccccagcctgagcgccagcaccagcagcagctgcagcaccgccgccacccccggccccgtgggcctggccctgccctacgccatccccgccagaggcagaagcgccttccaggaggaggacttccccgccctggtgagcagcgtgcccaagcccggcaccgcccccaccagcctggtgagcgcctggaacagcagcagcagcagcaagaaggtggcccagccccccctgagcgcccaggccaccggcagcggccagcccaccagaaaggccggcaagggcagcagaggcggcagaaagggcggcccccccttcacccaggaggaggaggaggacggcggccccgccctgcaggagctgctgagcaccagacccaccggcagcgtgagcagcaccctgggcctggccagcatccagcccagcaaggtgggcaagaagaagaaggtgggcagcgagaagcccggcaccaccctgccccagcccccccccgccacctgcccccccggcgccctgcaggcccccgaggcccccgccagcagagccgagggccccgtggccgtggtggtgaacggccacatggagggccccgcccccgccagaagcgcccccaaggagccccccggcctgcccagacccctgggcagcttcccctgccccaccccccaggaggacttccccgccctgggcggcccctgcccccccagaatgccccccccccccggcttcagcgccgtggtgctgctgaagggcaccccccccccccccccccccggcctggtgccccccatcagcaagcccccccccggcttcagcggcctgctgcccagcccccaccccgcctgcgtgcccagccccgccaccaccaccaccaccaaggcccccagactgctgcccgcccccagagcctacctggtgcccgagaacttcagagagagaaacctgcagctgatccagagcatcagagacttcctgcagagcgacgaggccagattcagcgagttcaagagccacagcggcgagttcagacagggcctgatcagcgccgcccagtactacaagagctgcagagacctgctgggcgagaacttccagaaggtgttcaacgagctgctggtgctgctgcccgacaccgccaagcagcaggagctgctgagcgcccacaccgacttctgcaacagagagaagcccctgagcaccaagagcaagaagaacaagaagagcgcctggcaggccaccacccagcaggccggcctggactgcagagtgtgccccacctgccagcaggtgctggcccacggcgacgccagcagccaccaggccctgcacgccgccagagacgacgacttccccagcctgcaggccatcgccagaatcatcacctag

SEQ ID NO: 26265 - DNA, 4539 bp, Artificial Sequence
  Description of Artificial Sequence: Synthetic coding sequence
atgagcgtgaacatcagcaccgccggcaagggcgtggaccccaacaccgtggacacctacgacagcggcgacgactgggagatcggcgtgggcaacctgatcatcgacctggacgccgacctggagaaggacagacagaagttcgagatgaacaacagcaccaccaccaccagcagcagcaacagcaaggactgcggcggccccgccagcagcggcgccggcgccaccgccgccctggccgacggcctgaagttcgccagcgtgcaggccagcgccccccagggcaacagccacaaggagaccagcaagagcaaggtgaagagaagcaagaccagcaaggacgccaacaagagcctgcccagcgccgccctgtacggcatccccgagatcagcagcaccggcaagagacaggaggtgcagggcagacccggcgaggccaccggcatgaacagcgccctgggccagagcgtgagcagcggcggcagcggcaaccccaacagcaacagcaccagcaccagcaccagcgccgccaccgccggcgccggcagctgcggcaagagcaaggaggagaagcccggcaagagccagagcagcagaggcgccaagagagacaaggacgccggcaagagcagaaaggacaagcacgacctgctgcagggccaccagaacggcagcggcagccaggcccccagcggcggccacctgtacggcttcggcgccaagagcaacggcggcggcgccagccccttccactgcggcggcaccggcagcggcagcgtggccgccgccggcgaggtgagcaagagcgcccccgacagcggcctgatgggcaacagcatgctggtgaagaaggaggaggaggaggaggagagccacagaagaatcaagaagctgaagaccgagaaggtggaccccctgttcaccgtgcccgccccccccccccccatcagcagcagcctgaccccccagatcctgcccagctacttcagccccagcagcagcaacatcgccgcccccgtggagcagctgctggtgagaaccagaagcgtgggcgtgaacacctgcgaggtgggcgtggtgaccgagcccgagtgcctgggcccctgcgagcccggcaccagcgtgaacctggagggcatcgtgtggcacgagaccgaggagggcgtgctggtggtgaacgtgacctggagaaacaagacctacgtgggcaccctgctggactgcaccaagcacgactgggccccccccagattctgcgagagccccaccagcgacctggagatgagaggcggcagaggcagaggcaagagagccagaagcgccgccgccgcccccggcagcgaggccagcttcaccgagagcagaggcctgcagaacaagaacagaggcggcgccaacggcaagggcagaagaggcagcctgaacgccagcggcagaagaaccccccccaactgcgccgccgaggacatcaaggccagccccagcagcaccaacaagagaaagaacaagccccccatggagctggacctgaacagcagcagcgaggacaacaagcccggcaagagagtgagaaccaacagcagaagcacccccaccaccccccagggcaagcccgagaccaccttcctggaccagggctgcagcagccccgtgctgatcgactgcccccaccccaactgcaacaagaagtacaagcacatcaacggcctgagataccaccaggcccacgcccacctggaccccgagaacaagctggagttcgagcccgacagcgaggacaagatcagcgactgcgaggagggcctgagcaacgtggccctggagtgcagcgagcccagcaccagcgtgagcgcctacgaccagctgaaggcccccgccagccccggcgccggcaacccccccggcacccccaagggcaagagagagctgatgagcaacggccccggcagcatcatcggcgccaaggccggcaagaacagcggcaagaagaagggcctgaacaacgagctgaacaacctgcccgtgatcagcaacatgaccgccgccctggacagctgcagcgccgccgacggcagcctggccgccgagatgcccaagctggaggccgagggcctgatcgacaagaagaacctgggcgacaaggagaagggcaagaaggccaccaactgcaagaccgacaagaacctgagcaagctgaagagcgccagacccatcgcccccgcccccgcccccacccccccccagctgatcgccatccccaccgccaccttcaccaccaccaccaccggcaccatccccggcctgcccagcctgaccaccaccgtggtgcaggccacccccaagagcccccccctgaagcccatccagcccaagcccaccatcatgggcgagcccatcaccgtgaaccccgccctggtgagcctgaaggacaagaagaagaaggagaagagaaagctgaaggacaaggagggcaaggagaccggcagccccaagatggacgccaagctgggcaagctggaggacagcaagggcgccagcaaggacctgcccggccacttcctgaaggaccacctgaacaagaacgagggcctggccaacggcctgagcgagagccaggagagcagaatggccagcatcaaggccgaggccgacaaggtgtacaccttcaccgacaacgcccccagccccagcatcggcagcgccagcagactggagtgcagcaccctggtgaacggccaggcccccatggcccccctgcacgtgctgacccagaacggcgccgagagcagcgccgccaagaccagcagccccgcctacagcgacatcagcgacgccgccgacgacggcggcagcgacagcagaagcgagggcatgagaagcaaggccagcagccccagcgacatcatcagcagcaaggacagcgtggtgaagggccacagcagcaccaccgcccagagcagccagctgaaggagagccacagcccctactaccacagctacgacccctactacagccccagctacatgcaccccggccaggtgggcgcccccgccgccggcaacagcggcagcacccagggcatgaagatcaagaaggagagcgaggaggacgccgagaagaaggacaaggccgagcagctggacagcaagaaggtggaccacaacagcgccagcctgcagccccagcaccagagcgtgatcacccagagacaccccgccctggcccagagcctgtactacggccagtacgcctacggcctgtacatggaccagaagagcctgatggccaccagccccgcctacagacagcagtacgagaagtactacgaggaccagagactggccgagcagaagatggcccagaccggcagaggcgactgcgagagaaagagcgagctgcccctgaaggagctgggcaaggaggagaccaagcagaagaacatgcccagcgccaccatcagcaaggcccccagcacccccgagcccaacaagaaccacagcaagctgggccccagcgtgcccaacaagaccgaggagaccggcaagagccagctgctgagcaaccaccagcagcagctgcaggccgacagcttcaaggccaagcagatggagaaccaccagctgatcaaggaggccgtggagatgaagagcgtgatggacagcatgaagcagaccggcgtggaccccaccagcagattcaagcaggaccccgacagcagaacctggcaccactacgtgtaccagcccaagtacctggaccagcagaagagcgaggagctggacagagagaagaagctgaaggaggacagccccagaaagacccccaacaaggagagcggcgtgcccagcctgcccgtgagcctgaccagcatcaaggaggagcccaaggaggccaagcaccccgacagccagagcatggaggagagcaagctgaagaacgacgacagaaagacccccgtgaactggaaggacagcagaggcaccagagtggccgtgagcagccccatgagccagcaccagagctacatccagtacctgcacgcctacccctacccccagatgtacgaccccagccaccccgcctacagagccgtgagccccgtgctgatgcacagctaccccggcgcctacctgagccccggcttccactaccccgtgtacggcaagatgagcggcagagaggagaccgagaaggtgaacaccagccccagcgtgaacaccaagaccaccaccgagagcaaggccctggacctgctgcagcagcacgccaaccagtacagaagcaagagccccgcccccgtggagaaggccaccgccgagagagagagagaggccgagagagagagagacagacacagccccttcggccagagacacctgcacacccaccaccacacccacgtgggcatgggctaccccctgatccccggccagtacgaccccttccagggcctgaccagcgccgccctggtggccagccagcaggtggccgcccaggccagcgccagcggcatgttccccggccagagaagagagtag

SEQ ID NO: 26266 - DNA, 3258 bp, Artificial Sequence
  Description of Artificial Sequence: Synthetic coding sequence
atgagaggcggcagaggcagaggcaagagagccagaagcgccgccgccgcccccggcagcgaggccagcttcaccgagagcagaggcctgcagaacaagaacagaggcggcgccaacggcaagggcagaagaggcagcctgaacgccagcggcagaagaaccccccccaactgcgccgccgaggacatcaaggccagccccagcagcaccaacaagagaaagaacaagccccccatggagctggacctgaacagcagcagcgaggacaacaagcccggcaagagagtgagaaccaacagcagaagcacccccaccaccccccagggcaagcccgagaccaccttcctggaccagggctgcagcagccccgtgctgatcgactgcccccaccccaactgcaacaagaagtacaagcacatcaacggcctgagataccaccaggcccacgcccacctggaccccgagaacaagctggagttcgagcccgacagcgaggacaagatcagcgactgcgaggagggcctgagcaacgtggccctggagtgcagcgagcccagcaccagcgtgagcgcctacgaccagctgaaggcccccgccagccccggcgccggcaacccccccggcacccccaagggcaagagagagctgatgagcaacggccccggcagcatcatcggcgccaaggccggcaagaacagcggcaagaagaagggcctgaacaacgagctgaacaacctgcccgtgatcagcaacatgaccgccgccctggacagctgcagcgccgccgacggcagcctggccgccgagatgcccaagctggaggccgagggcctgatcgacaagaagaacctgggcgacaaggagaagggcaagaaggccaccaactgcaagaccgacaagaacctgagcaagctgaagagcgccagacccatcgcccccgcccccgcccccacccccccccagctgatcgccatccccaccgccaccttcaccaccaccaccaccggcaccatccccggcctgcccagcctgaccaccaccgtggtgcaggccacccccaagagcccccccctgaagcccatccagcccaagcccaccatcatgggcgagcccatcaccgtgaaccccgccctggtgagcctgaaggacaagaagaagaaggagaagagaaagctgaaggacaaggagggcaaggagaccggcagccccaagatggacgccaagctgggcaagctggaggacagcaagggcgccagcaaggacctgcccggccacttcctgaaggaccacctgaacaagaacgagggcctggccaacggcctgagcgagagccaggagagcagaatggccagcatcaaggccgaggccgacaaggtgtacaccttcaccgacaacgcccccagccccagcatcggcagcgccagcagactggagtgcagcaccctggtgaacggccaggcccccatggcccccctgcacgtgctgacccagaacggcgccgagagcagcgccgccaagaccagcagccccgcctacagcgacatcagcgacgccgccgacgacggcggcagcgacagcagaagcgagggcatgagaagcaaggccagcagccccagcgacatcatcagcagcaaggacagcgtggtgaagggccacagcagcaccaccgcccagagcagccagctgaaggagagccacagcccctactaccacagctacgacccctactacagccccagctacatgcaccccggccaggtgggcgcccccgccgccggcaacagcggcagcacccagggcatgaagatcaagaaggagagcgaggaggacgccgagaagaaggacaaggccgagcagctggacagcaagaaggtggaccacaacagcgccagcctgcagccccagcaccagagcgtgatcacccagagacaccccgccctggcccagagcctgtactacggccagtacgcctacggcctgtacatggaccagaagagcctgatggccaccagccccgcctacagacagcagtacgagaagtactacgaggaccagagactggccgagcagaagatggcccagaccggcagaggcgactgcgagagaaagagcgagctgcccctgaaggagctgggcaaggaggagaccaagcagaagaacatgcccagcgccaccatcagcaaggcccccagcacccccgagcccaacaagaaccacagcaagctgggccccagcgtgcccaacaagaccgaggagaccggcaagagccagctgctgagcaaccaccagcagcagctgcaggccgacagcttcaaggccaagcagatggagaaccaccagctgatcaaggaggccgtggagatgaagagcgtgatggacagcatgaagcagaccggcgtggaccccaccagcagattcaagcaggaccccgacagcagaacctggcaccactacgtgtaccagcccaagtacctggaccagcagaagagcgaggagctggacagagagaagaagctgaaggaggacagccccagaaagacccccaacaaggagagcggcgtgcccagcctgcccgtgagcctgaccagcatcaaggaggagcccaaggaggccaagcaccccgacagccagagcatggaggagagcaagctgaagaacgacgacagaaagacccccgtgaactggaaggacagcagaggcaccagagtggccgtgagcagccccatgagccagcaccagagctacatccagtacctgcacgcctacccctacccccagatgtacgaccccagccaccccgcctacagagccgtgagccccgtgctgatgcacagctaccccggcgcctacctgagccccggcttccactaccccgtgtacggcaagatgagcggcagagaggagaccgagaaggtgaacaccagccccagcgtgaacaccaagaccaccaccgagagcaaggccctggacctgctgcagcagcacgccaaccagtacagaagcaagagccccgcccccgtggagaaggccaccgccgagagagagagagaggccgagagagagagagacagacacagccccttcggccagagacacctgcacacccaccaccacacccacgtgggcatgggctaccccctgatccccggccagtacgaccccttccagggcctgaccagcgccgccctggtggccagccagcaggtggccgcccaggccagcgccagcggcatgttccccggccagagaagagagtag

SEQ ID NO: 26267 - DNA, 2148 bp, Artificial Sequence
  Description of Artificial Sequence: Synthetic coding sequence
atgagcgtgaacatcagcaccgccggcaagggcgtggaccccaacaccgtggacacctacgacagcggcgacgactgggagatcggcgtgggcaacctgatcatcgacctggacgccgacctggagaaggacagacagaagttcgagatgaacaacagcaccaccaccaccagcagcagcaacagcaaggactgcggcggccccgccagcagcggcgccggcgccaccgccgccctggccgacggcctgaagttcgccagcgtgcaggccagcgccccccagggcaacagccacaaggagaccagcaagagcaaggtgaagagaagcaagaccagcaaggacgccaacaagagcctgcccagcgccgccctgtacggcatccccgagatcagcagcaccggcaagagacaggaggtgcagggcagacccggcgaggccaccggcatgaacagcgccctgggccagagcgtgagcagcggcggcagcggcaaccccaacagcaacagcaccagcaccagcaccagcgccgccaccgccggcgccggcagctgcggcaagagcaaggaggagaagcccggcaagagccagagcagcagaggcgccaagagagacaaggacgccggcaagagcagaaaggacaagcacgacctgctgcagggccaccagaacggcagcggcagccaggcccccagcggcggccacctgtacggcttcggcgccaagagcaacggcggcggcgccagccccttccactgcggcggcaccggcagcggcagcgtggccgccgccggcgaggtgagcaagagcgcccccgacagcggcctgatgggcaacagcatgctggtgaagaaggaggaggaggaggaggagagccacagaagaatcaagaagctgaagaccgagaaggtggaccccctgttcaccgtgcccgccccccccccccccatcagcagcagcctgaccccccagatcctgcccagctacttcagccccagcagcagcaacatcgccgcccccgtggagcagctgctggtgagaaccagaagcgtgggcgtgaacacctgcgaggtgggcgtggtgaccgagcccgagtgcctgggcccctgcgagcccggcaccagcgtgaacctggagggcatcgtgtggcacgagaccgaggagggcgtgctggtggtgaacgtgacctggagaaacaagacctacgtgggcaccctgctggactgcaccaagcacgactgggccccccccagattctgcgagagccccaccagcgacctggagatgagaggcggcagaggcagaggcaagagagccagaagcgccgccgccgcccccggcagcgaggccagcttcaccgagagcagaggcctgcagaacaagaacagaggcggcgccaacggcaagggcagaagaggcagcctgaacgccagcggcagaagaaccccccccaactgcgccgccgaggacatcaaggccagccccagcagcaccaacaagagaaagaacaagccccccatggagctggacctgaacagcagcagcgaggacaacaagcccggcaagagagtgagaaccaacagcagaagcacccccaccaccccccagggcaagcccgagaccaccttcctggaccagggctgcagcagccccgtgctgatcgactgcccccaccccaactgcaacaagaagtacaagcacatcaacggcctgagataccaccaggcccacgcccacctggaccccgagaacaagctggagttcgagcccgacagcgaggacaagatcagcgactgcgaggagggcctgagcaacgtggccctggagtgcagcgagcccagcaccagcgtgagcgcctacgaccagctgaaggcccccgccagccccggcgccggcaacccccccggcacccccaagggcaagagagagctgatgagcaacggccccggcagcatcatcggcgccaaggccggcaagaacagcggcaagaagaagggcctgaacaacgagctgaacaacctgcccgtgatcagcaacatgaccgccgccctggacagctgcagcgccgccgacggcagcctggccgccgagatgcccaagctggaggccgagggcctgatcgacaagaagaacctgggcgacaaggagtag

SEQ ID NO: 26268 - DNA, 2124 bp, Artificial Sequence
  Description of Artificial Sequence: Synthetic coding sequence
atgagcgtgaacatcagcaccgccggcaagggcgtggaccccaacaccgtggacacctacgacagcggcgacgactgggagatcggcgtgggcaacctgatcatcgacctggacgccgacctggagaaggacagacagaagttcgagatgaacaacagcaccaccaccaccagcagcagcaacagcaaggactgcggcggccccgccagcagcggcgccggcgccaccgccgccctggccgacggcctgaagttcgccagcgtgcaggccagcgccccccagggcaacagccacaaggagaccagcaagagcaaggtgaagagaagcaagaccagcaaggacgccaacaagagcctgcccagcgccgccctgtacggcatccccgagatcagcagcaccggcaagagacaggaggtgcagggcagacccggcgaggccaccggcatgaacagcgccctgggccagagcgtgagcagcggcggcagcggcaaccccaacagcaacagcaccagcaccagcaccagcgccgccaccgccggcgccggcagctgcggcaagagcaaggaggagaagcccggcaagagccagagcagcagaggcgccaagagagacaaggacgccggcaagagcagaaaggacaagcacgacctgctgcagggccaccagaacggcagcggcagccaggcccccagcggcggccacctgtacggcttcggcgccaagagcaacggcggcggcgccagccccttccactgcggcggcaccggcagcggcagcgtggccgccgccggcgaggtgagcaagagcgcccccgacagcggcctgatgggcaacagcatgctggtgaagaaggaggaggaggaggaggagagccacagaagaatcaagaagctgaagaccgagaaggtggaccccctgttcaccgtgcccgccccccccccccccatcagcagcagcctgaccccccagatcctgcccagctacttcagccccagcagcagcaacatcgccgcccccgtggagcagctgctggtgagaaccagaagcgtgggcgtgaacacctgcgaggtgggcgtggtgaccgagcccgagtgcctgggcccctgcgagcccggcaccagcgtgaacctggagggcatcgtgtggcacgagaccgaggagggcgtgctggtggtgaacgtgacctggagaaacaagacctacgtgggcaccctgctggactgcaccaagcacgactgggccccccccagattctgcgagagccccaccagcgacctggagatgagaggcggcagaggcagaggcaagagagccagaagcgccgccgccgcccccggcagcgaggccagcttcaccgagagcagaggcctgcagaacaagaacagaggcggcgccaacggcaagggcagaagaggcagcctgaacgccagcggcagaagaaccccccccaactgcgccgccgaggacatcaaggccagccccagcagcaccaacaagagaaagaacaagccccccatggagctggacctgaacagcagcagcgaggacaacaagcccggcaagagagtgagaaccaacagcagaagcacccccaccaccccccagggcaagcccgagaccaccttcctggaccagggctgcagcagccccgtgctgatcgactgcccccaccccaactgcaacaagaagtacaagcacatcaacggcctgagataccaccaggcccacgcccacctggaccccgagaacaagctggagttcgagcccgacagcgaggacaagatcagcgactgcgaggagggcctgagcaacgtggccctggagtgcagcgagcccagcaccagcgtgagcgcctacgaccagctgaaggcccccgccagccccggcgccggcaacccccccggcacccccaagggcaagagagagctgatgagcaacggccccggcagcatcatcggcgccaaggccggcaagaacagcggcaagaagaagggcctgaacaacgagctgaacaacctgcccgtgatcagcaacatgaccgccgccctggacagctgcagcgccgccgacggcagcctggccgccgagatgcccaagctggaggccgagggcctgatcgactag

SEQ ID NO: 26269 - DNA, 1503 bp, Artificial Sequence
  Description of Artificial Sequence: Synthetic coding sequence
ctgttcctgttcctggccgtggtgtgcagctacttcgcccaggacttctggcccaagcagggcatcaagaactgcttccagaaggtgatcctgaagagatacaagaagtgcggccacgagaacctgcagctgggcaagtactgcaagagcatggacgagtgcaaggtgcacgaggagtgctacaacggcctgaaccagtgcctgagaaccacccagagcaagatcctgcagtgcgacaagtacgtgaaggtgttccacaagttcagcaacagcaacagatacaagatcagacacaccggcaagaagcccttcaagtgcaaggagtgcgagaagagcttctgcatgctgagccacctggcccagcacaagagaatccacaccagagagaagccctacaagtgcaaggagtgcggcaaggcctacaacgaggccagcaacctgagcacccacaagagaatccacaccggcaagaagccctacaagtgcgagcagtgcggcaaggccttcaacagactgagccacctgaccacccacaagatcatccacaccggcaagaagccctacatctgcgaggactgcggcaaggccttcaaccagagcgccaacctgaccacccacaagagaatccacaccggcgagaagccctacaagtgcgaggagagcggcaaggccttcagccagagcagcaccctgaccacccacaagatcatccacgccggcgagaagccctacaagtacgaggagtgcggcaagagcttcaaccagagcagcaccctgaccaccagaaagatcatccacaccggcgagaagttctgcaagtgcgaggagtggggcaaggccttcagcagactgagccacctgaccacccacaagagaatccacagcggcgagaagccctacaagtgcgaggagtgcggcaaggccttcaagcagagcagcaccctgaccacccacaagagaatccacagcggcgagaagttctacaagtgcgaggtgtgcagcaaggccttcagcagattcagccacctgaccacccacaagagaatccacagcggcgagaagccctacaagtgcgaggagtgcggcaaggccttcaacctgagcagccacctgaccacccacaagatcatccacaccggcgagaagccctacaagtgcgaggagtgcggcaaggccttcaacctgagcagccacctgaccacccacaagatcatccacaccggcgagaagccctacaagtgcgaggagtgcggcaaggccttcaaccagagcagcaccctgagcaagcacaaggtgatccacaccggcgagaagccctacaagtgcggcgagtgcggcaaggccttcaaccagagcagccacctgaccacccacaagatcatccacaccggcgagaagccctacaagtgcgaggagtgcggcaaggccttcaacaacagcagcatcctgaacagacacaagatgatccacaccggcgagaagttctacaagcccgagagctag

SEQ ID NO: 26270 - DNA, 1239 bp, Artificial Sequence
  Description of Artificial Sequence: Synthetic coding sequence
atgaccttcaccttccagagcgaggacctgaagagagactgcggcaagaagatgagccaccagcacgtgttcagcctggccatggaggaggacgtgaagaccgccgacaccaagaaggccagcagaatcctggaccacgagaaggagaacaccagaagcatctgcctgctggagcagaagagaaaggtggtgagcagcaacatcgacgtgccccccgccagaaagagcagcgaggagctggacatggacaaggtgaccgccgccatggtgctgaccagcctgagcaccagccccctggtgagaagcccccccgtgagacccaacgagagcctgagcggcagctggaaggagggcggctgcgtgcccagcagcaccagcagcagcggctactggagctggagcgcccccagcgaccagagcaaccccagcacccccagcccccccctgagcgccgacagcttcaagcccttcagaagccccgcccagcccgacgacggcatcgacgaggccgaggccagcaacctgctgttcgacgagcccatccccagaaagagaaagaacagcatgaaggtgatgttcaagtgcctgtggaagaactgcggcaaggtgctgagcaccgccgccggcatccagaagcacatcagaaccatccacctgggcagagtgggcgacagcgactacagcgacggcgaggaggacttctactacaccgagatcaagctgaacaccgacagcgtggccgacggcctgagcagcctggcccccgtgagccccagccagagcctggccagcccccccaccttccccatccccgacagcagcagaaccgagaccccctgcgccaagaccgagaccaagctgatgacccccctgagcagaagcgcccccaccaccctgtacctggtgcacaccgaccacgcctaccaggccaccccccccgtgaccatccccggcagcgccaagttcacccccaacggcagcagcttcagcatcagctggcagagcccccccgtgaccttcaccggcatccccgtgagccccacccaccaccccgtgggcaccggcgagcagagacagcacgcccacaccgtgctgagcagcccccccagaggcaccgtgagcctgagaaagcccagaggcgagggcaagaagtgcagaaaggtgtacggcatggagaacagagacatgtggtgcaccgcctgcagatggaagaaggcctgccagagattcctggactag

SEQ ID NO: 26271 - DNA, 570 bp, Artificial Sequence
  Description of Artificial Sequence: Synthetic coding sequence
atgaccttcaccttccagagcgaggacctgaagagagactgcggcaagaagatgagccaccagcacgtgttcagcctggccatggaggaggacgtgaagaccgccgacaccaagaaggccagcagaatcctggaccacgagaaggagaacaccagaagcatctgcctgctggagcagaagagaaaggtggtgagcagcaacatcgacgtgccccccgccagaaagagcagcgaggagctggacatggacaaggtgaccgccgccatggtgctgaccagcctgagcaccagccccctggtgagaagcccccccgtgagacccaacgagagcctgagcggcagctggaaggagggcggctgcgtgcccagcagcaccagcagcagcggctactggagctggagcgcccccagcgaccagagcaaccccagcacccccagcccccccctgagcgccgacagcttcaagcccttcagaagccccgcccagcccgacgacggcatcgacgaggccgaggccagcaacctgctgttcgacgagcccatccccagaaagagaaagaacagcatgtag

SEQ ID NO: 26272 - DNA, 903 bp, Artificial Sequence
  Description of Artificial Sequence: Synthetic coding sequence
atgcacagcctggagaaggtgaccttcgaggacgtggccatcgacttcacccaggaggagtgggacatgatggacaccagcaagagaaagctgtacagagacgtgatgctggagaacatcagccacctggtgagcctgggctaccagatcagcaagagctacatcatcctgcagctggagcagggcaaggagctgtggtgggagggcagagtgttcctgcaggaccagaaccccgacagagagagcgccctgaagaagaagcacatgatcagcatgcaccccatcatcagaaaggacaccagcaccagcatgaccatggagaacagcctgatcctggaggaccccttcgagtacaacgacagcggcgaggactgcacccacagcagcaccatcacccagtgcctgctgacccacagcggcaagaagccctgcgtgagcaagcagtgcggcaagagcctgagaaacctgctgagccccaagcccagaaagcagatccacaccaagggcaagagctaccagtgcaacctgtgcgagaaggcctacaccaactgcttctacctgagaagacacaagatgacccacaccggcgagagaccctacgcctgccacctgtgcggcaaggccttcacccagtgcagccacctgagaagacacgagaagacccacaccggcgagagaccctacaagtgccaccagtgcggcaaggccttcatccagagcttcaacctgagaagacacgagagaacccacctgggccagaagtgctacgagtgcgacaagagcggcaaggccttcagccagagcagcggcttcagaggcaacaagatcatccacatcggcgagaagccccccgcctgcctgctgtgcggcaaggccttcagcctgagcagcgacctgagatag

SEQ ID NO: 26273 - DNA, 903 bp, Artificial Sequence; identical to SEQ ID NO: 26272
  Description of Artificial Sequence: Synthetic coding sequence

SEQ ID NO: 26274 - DNA, 903 bp, Artificial Sequence
  Description of Artificial Sequence: Synthetic coding sequence
atgcacagcctgaagaagctgaccttcgaggacgtggccatcgacttcacccaggaggagtgggccatgatggacaccagcaagagaaagctgtacagagacgtgatgctggagaacatcagccacctggtgagcctgggctaccagatcagcaagagctacatcatcctgcagctggagcagggcaaggagctgtggagagagggcagagtgttcctgcaggaccagaaccccaacagagagagcgccctgaagaagacccacatgatcagcatgcaccccatcaccagaaaggacgccagcaccagcatgaccatggagaacagcctgatcctggaggaccccttcgagtgcaacgacagcggcgaggactgcaccagaagcagcaccatcacccagtgcctgctgacccacagcggcaagaagccctacgtgagcaagcagtgcggcaagagcctgagaaacctgctgagcaccgagccccacaagcagatccacaccaagggcaagagctaccagtgcaacctgtgcgagaaggcctacaccaactgcttccacctgagaagacacaagatgacccacaccggcgagagaccctacgcctgccacctgtgcagaaaggccttcacccagtgcagccacctgagaagacacgagaagacccacaccggccagagaccctacaagtgccaccagtacggcaaggtgttcatccagagcttcaacctgcagagacacgagagaacccacctgggcaagaagtgctacgagtgcgacaagagcggcaaggccttcagccagagcagcggcttcagaggcaacaagatcatccacaccggcgagaagccccacgcctgcctgctgtgcggcaaggccttcagcctgagcagcaacctgagatag

SEQ ID NO: 26275 - DNA, 903 bp, Artificial Sequence; identical to SEQ ID NO: 26274
  Description of Artificial Sequence: Synthetic coding sequence

SEQ ID NO: 26276 - DNA, 231 bp, Artificial Sequence
  Description of Artificial Sequence: Synthetic coding sequence
atggccagaggccagcagaagatccagagccagcagaagaacgccaagaagcaggccggccagaagaagaagcagggccacgaccagaaggccgccgccaaggccgccctgatctacacctgcaccgtgtgcagaacccagatgcccgaccccaagaccttcaagcagcacttcgagagcaagcaccccaagacccccctgccccccgagctggccgacgtgcaggcctag

SEQ ID NO: 26277 - DNA, 231 bp, Artificial Sequence; identical to SEQ ID NO: 26276
  Description of Artificial Sequence: Synthetic coding sequence

SEQ ID NO: 26278 - DNA, 231 bp, Artificial Sequence; identical to SEQ ID NO: 26276
  Description of Artificial Sequence: Synthetic coding sequence

SEQ ID NO: 26279 - DNA, 231 bp, Artificial Sequence; identical to SEQ ID NO: 26276
  Description of Artificial Sequence: Synthetic coding sequence

SEQ ID NO: 26280 - DNA, 231 bp, Artificial Sequence; identical to SEQ ID NO: 26276
  Description of Artificial Sequence: Synthetic coding sequence

SEQ ID NO: 26281 - DNA, 27 bp, Artificial Sequence
  Description of Artificial Sequence: Synthetic coding sequence
atggccagaggccagcagaagatctag

SEQ ID NO: 26282 - DNA, 231 bp, Artificial Sequence; identical to SEQ ID NO: 26276
  Description of Artificial Sequence: Synthetic coding sequence

SEQ ID NO: 26283 - DNA, 231 bp, Artificial Sequence; identical to SEQ ID NO: 26276
  Description of Artificial Sequence: Synthetic coding sequence

SEQ ID NO: 26284 - DNA, 129 bp, Artificial Sequence
  Description of Artificial Sequence: Synthetic coding sequence
atggccagaggccagcagaagatccagagccagcagaagaacgccaagaagcaggccggccagaagaagaagcagggccacgaccagaaggccgccgccaaggccgccctgatctacacctgcacctag

SEQ ID NO: 26285 - DNA, 1116 bp, Artificial Sequence
  Description of Artificial Sequence: Synthetic coding sequence
atggacatggcccaggagcccgtgaccttcagagacgtggccatctacttcagcagagaggagtgggcctgcctggagcccagccagagagccctgtacagagacgtgatgctggacaacttcagcagcgtggccgccctgggcttctgcagccccagacccgacctggtgagcagactggagcagtgggaggagccctgggtggaggacagagagagacccgagttccaggccgtgcagagaggccccagacccggcgccagaaagagcgccgaccccaagagaccctgcgaccaccccgcctgggcccacaagaagacccacgtgagaagagagagagccagagagggcagcagcttcagaaagggcttcagactggacaccgacgacggccagctgcccagagccgcccccgagagaaccgacgccaagcccaccgccttcccctgccaggtgctgacccagagatgcggcagaagacccggcagaagagagagaagaaagcagagagccgtggagctgagcttcatctgcggcacctgcggcaaggccctgagctgccacagcagactgctggcccaccagaccgtgcacaccggcaccaaggccttcgagtgccccgagtgcggccagaccttcagatgggccagcaacctgcagagacaccagaagaaccacaccagagagaagcccttctgctgcgaggcctgcggccaggccttcagcctgaaggacagactggcccagcacagaaaggtgcacaccgagcacagaccctacagctgcggcgactgcggcaaggccttcaagcagaagagcaacctgctgagacaccagctggtgcacaccggcgagagacccttctactgcgccgactgcggcaaggccttcagaaccaaggagaacctgagccaccaccagagagtgcacagcggcgagaagccctacacctgcgccgagtgcggcaagagcttcagatggcccaagggcttcagcatccacagaagactgcacctgaccaagagattctacgagtgcggccactgcggcaagggcttcagacacctgggcttcttcaccagacaccagagaacccacagacacggcgaggtgtag

SEQ ID NO: 26286 - DNA, 1116 bp, Artificial Sequence; identical to SEQ ID NO: 26285
  Description of Artificial Sequence: Synthetic coding sequence

SEQ ID NO: 26287 - DNA, 1665 bp, Artificial Sequence
  Description of Artificial Sequence: Synthetic coding sequence
atgaacgtgatgctggagaactacaagaacctggtgttcctggccggcatcgccgtgagcaagcaggaccccatcaccagcctggagcaggagaaggagccctggaacatgaagatctgcgagatggtggacgagagccccgccatgtgcagcagcttcaccagagacctgtggcccgagcaggacatcaaggacagcttccagcaggtgatcctgagaagacacggcaagtgcgagcacgagaacctgcagctgagaaagggcagcgccaacgtggtggagtgcaaggtgtacaagaagggctacgagctgaaccagtgcctgaccaccacccagagcaagatcttcccctgcgacaagtacatcaaggtgttccacaagatcttcaacagcaacagacacaagaccagacacaccggcgagaagcccttcaagtgcaagaagtgcgacgagagcttctgcatgctgctgcacctgcaccagcacaagagaatccacatcagagagaacagctaccagtgcgaggagtgcgacaaggtgttcaagagattcagcaccctgaccagacacaagagagtgcacaccggcgagaagcccttcaagtgcgaggagtgcggcaaggccttcaagcacagcagcaccctgaccacccacaagatgatccacaccggcgagaagccctacagatgcgaggagtgcggcaaggccttctaccacagcagccacctgaccacccacaaggtgatccacaccggcgagaagcccttcaagtgcgaggagtgcggcaaggccttcaaccaccccagcgccctgaccacccacaagttcatccacgtgaaggagaagccctacaagtgcgaggagtgcgacaaggccttcaacagattcagctacctgaccaagcacaagatcatccacagcggcgagaagagctacaagtgcgagcagtgcggcaagggcttcaactggagcagcaccctgaccaagcacaagagaatccacaccggcgagaagccctacaagtgcgaggagtgcggcaaggccttcaacgtgagcagccacctgaccacccacaagatgatccacaccggcgagaagccctacaagtgcgaggagtgcggcaaggccttcaaccacagcagcaagctgaccatccacaagatcatccacaccggcgagaagccctacaagtgcgaggagtgcggcaaggccttcaaccagagcagcaacctgaccaagcacaagatcatccacaccggcgagaagctgtacaagtgcgaggagtgcggcaaggccttcaacagaagcagcaacctgaccacccacaagagaatccacaccggcgagaagccctacaagtgcgaggagtgcggcaaggccttcaacagaagcagcaacctgaccaagcacaacatcatccacaccggcgagaagagctacaagtgcgaggagtgcggcaaggccttcaaccagagcagcaccctgaccaagcacagaaagatccagcagggcatggtggcccacgcctgcaaccccaacaccctgagaggcctgggcgagcagatcgccagaagcggcgtgcaggaccagcccggccagcacggcaagacccccagcctgctgaagatccagaagttcgccggctgcggcggcagaagactgtag

SEQ ID NO: 26288 - DNA, 1572 bp, Artificial Sequence
  Description of Artificial Sequence: Synthetic coding sequence
atgaacgtgatgctggagaactacaagaacctggtgttcctggccggcatcgccgtgagcaagcaggaccccatcaccagcctggagcaggagaaggagccctggaacatgaagatctgcgagatggtggacgagagccccgccatgtgcagcagcttcaccagagacctgtggcccgagcaggacatcaaggacagcttccagcaggtgatcctgagaagacacggcaagtgcgagcacgagaacctgcagctgagaaagggcagcgccaacgtggtggagtgcaaggtgtacaagaagggctacgagctgaaccagtgcctgaccaccacccagagcaagatcttcccctgcgacaagtacatcaaggtgttccacaagatcttcaacagcaacagacacaagaccagacacaccggcgagaagcccttcaagtgcaagaagtgcgacgagagcttctgcatgctgctgcacctgcaccagcacaagagaatccacatcagagagaacagctaccagtgcgaggagtgcgacaaggtgttcaagagattcagcaccctgaccagacacaagagagtgcacaccggcgagaagcccttcaagtgcgaggagtgcggcaaggccttcaagcacagcagcaccctgaccacccacaagatgatccacaccggcgagaagccctacagatgcgaggagtgcggcaaggccttctaccacagcagccacctgaccacccacaaggtgatccacaccggcgagaagcccttcaagtgcgaggagtgcggcaaggccttcaaccaccccagcgccctgaccacccacaagttcatccacgtgaaggagaagccctacaagtgcgaggagtgcgacaaggccttcaacagattcagctacctgaccaagcacaagatcatccacagcggcgagaagagctacaagtgcgagcagtgcggcaagggcttcaactggagcagcaccctgaccaagcacaagagaatccacaccggcgagaagccctacaagtgcgaggagtgcggcaaggccttcaacgtgagcagccacctgaccacccacaagatgatccacaccggcgagaagccctacaagtgcgaggagtgcggcaaggccttcaaccacagcagcaagctgaccatccacaagatcatccacaccggcgagaagccctacaagtgcgaggagtgcggcaaggccttcaaccagagcagcaacctgaccaagcacaagatcatccacaccggcgagaagctgtacaagtgcgaggagtgcggcaaggccttcaacagaagcagcaacctgaccacccacaagagaatccacaccggcgagaagccctacaagtgcgaggagtgcggcaaggccttcaacagaagcagcaacctgaccaagcacaacatcatccacaccggcgagaagagctacaagtgcgaggagtgcggcaaggccttcaaccagagcagcaccctgaccaagcacagaaagatccagcagggcatggtggcccacgcctgcaaccccaacaccctgagaggccagggcagatggatcatgtag

SEQ ID NO: 26289 - DNA, 1665 bp, Artificial Sequence; identical to SEQ ID NO: 26287
  Description of Artificial Sequence: Synthetic coding sequence

SEQ ID NO: 26290 - DNA, 1452 bp, Artificial Sequence
  Description of Artificial Sequence: Synthetic coding sequence
atgggcctgctgaccttcagagacatcgccatcgagttcagcctggccgagtggcagtgcctggaccacgcccagcagaacctgtacagagacgtgatgctggagaactacagaaacctggtgagcctgggcatcgccgtgagcaagcccgacctgatcacctgcctggagcagaacaaggagccccagaacatcaagagaaacgagatggtggccaagcaccccgtgacctgcagccacttcacccaggacctgcagagcgagcagggcatcaaggacagcctgcagaaggtgatcctgagaagatacggcaagtgcggccaggaggacctgcaggtgaagaagtgctgcaagagcgtgggcgagtgcgaggtgcacaagggcggctacaactacgtgaaccagtgcctgagcgccacccagaacaagaccttccagacccacaagtgcgtgaaggtgttcggcaagttcagcaacagcaacagacacaagaccagacacaccggcaagaagcacttcaagtgcaagaacgacggcaagagcttctgcatgctgagcagactgaaccagcaccagatcatccacaccagagagaagagctacaagtgcgaggagtgcggcaagagcttcaactgcagcagcaccctgaccagacacaagagaatccacaccggcgagaagccctacagatgcgaggagtgcggcaaggccttcagctggagcgccagcctgaccaagcacaagagaatccacaccggcgagaagccctacacctgcgaggagagaggcaaggtgttcagcagaagcaccctgaccaactacaagagaatccacaccggcgagaagccctacacctgcgaggagtgcggcaaggccttcagcagaagcagcaccctgaccaaccacaagagaatccacaccggcgagagaccctacaagtgcgaggagtgcggcaaggccttcagcctgagcagcaccctgaagaagcacaagatcgtgcacaccggcgagaagctgtacacctgcgaggagtgcggcaaggccttcaccttcagcagcaccctgaacacccacaagagaatccacaccggcgagaagccctacacctgcgaggagtgcggcaaggccttcagcctgcccagcaccttcacctaccacaagagaacccacaccggcgagaagccctacaagtgcgaggagtgcggcaaggccttcaactgcagcagcaccctgaagaagcacaagatcatccacaccggcgagaagctgtacaagtgcaaggagtgcggcaaggccttcaccttcagcagcaccctgaacacccacaagagaatccacaccggcgagaagccctacaagtgcgaggagtgcgaccagaccttcaagtggcacagcagcctggccaaccacaagaacatgcacaccggcgagaagccctacaagtacgagtag

SEQ ID NO: 26291 - DNA, 1488 bp, Artificial Sequence
  Description of Artificial Sequence: Synthetic coding sequence
atggccaagagacccggcccccccggcagcagagagatgggcctgctgaccttcagagacatcgccatcgagttcagcctggccgagtggcagtgcctggaccacgcccagcagaacctgtacagagacgtgatgctggagaactacagaaacctggtgagcctgggcatcgccgtgagcaagcccgacctgatcacctgcctggagcagaacaaggagccccagaacatcaagagaaacgagatggtggccaagcaccccgtgacctgcagccacttcacccaggacctgcagagcgagcagggcatcaaggacagcctgcagaaggtgatcctgagaagatacggcaagtgcggccaggaggacctgcaggtgaagaagtgctgcaagagcgtgggcgagtgcgaggtgcacaagggcggctacaactacgtgaaccagtgcctgagcgccacccagaacaagaccttccagacccacaagtgcgtgaaggtgttcggcaagttcagcaacagcaacagacacaagaccagacacaccggcaagaagcacttcaagtgcaagaacgacggcaagagcttctgcatgctgagcagactgaaccagcaccagatcatccacaccagagagaagagctacaagtgcgaggagtgcggcaagagcttcaactgcagcagcaccctgaccagacacaagagaatccacaccggcgagaagccctacagatgcgaggagtgcggcaaggccttcagctggagcgccagcctgaccaagcacaagagaatccacaccggcgagaagccctacacctgcgaggagagaggcaaggtgttcagcagaagcaccctgaccaactacaagagaatccacaccggcgagaagccctacacctgcgaggagtgcggcaaggccttcagcagaagcagcaccctgaccaaccacaagagaatccacaccggcgagagaccctacaagtgcgaggagtgcggcaaggccttcagcctgagcagcaccctgaagaagcacaagatcgtgcacaccggcgagaagctgtacacctgcgaggagtgcggcaaggccttcaccttcagcagcaccctgaacacccacaagagaatccacaccggcgagaagccctacacctgcgaggagtgcggcaaggccttcagcctgcccagcaccttcacctaccacaagagaacccacaccggcgagaagccctacaagtgcgaggagtgcggcaaggccttcaactgcagcagcaccctgaagaagcacaagatcatccacaccggcgagaagctgtacaagtgcaaggagtgcggcaaggccttcaccttcagcagcaccctgaacacccacaagagaatccacaccggcgagaagccctacaagtgcgaggagtgcgaccagaccttcaagtggcacagcagcctggccaaccacaagaacatgcacaccggcgagaagccctacaagtacgagtag

SEQ ID NO: 26292 - DNA, 2724 bp, Artificial Sequence
  Description of Artificial Sequence: Synthetic coding sequence
atgctggagacctacaacagcctggtgagcctgcaggagctggtgagcttcgaggaggtggccgtgcacttcacctgggaggagtggcaggacctggacgacgcccagagaaccctgtacagagacgtgatgctggagacctacagcagcctggtgagcctgggccactacatcaccaagcccgagatgatcttcaagctggagcagggcgccgagccctggatcgtggaggagacccccaacctgagactgagcgccgtgcagatcatcgacgacctgatcgagagaagccacgagagccacgacagattcttctggcagatcgtgatcaccaacagcaacaccagcacccaggagagagtggagctgggcaagaccttcaacctgaacagcaaccacgtgctgaacctgatcatcaacaacggcaacagcagcggcatgaagcccggccagttcaacgactgccagaacatgctgttccccatcaagcccggcgagacccagagcggcgagaagccccacgtgtgcgacatcaccagaagaagccacagacaccacgagcacctgacccagcaccacaagatccagaccctgctgcagaccttccagtgcaacgagcagggcaagaccttcaacaccgaggccatgttcttcatccacaagagagtgcacatcgtgcagaccttcggcaagtacaacgagtacgagaaggcctgcaacaacagcgccgtgatcgtgcaggtgatcacccaggtgggccagcccacctgctgcagaaagagcgacttcaccaagcaccagcagacccacaccggcgagaagccctacgagtgcgtggagtgcgagaagcccagcatcagcaagagcgacctgatgctgcagtgcaagatgcccaccgaggagaagccctacgcctgcaactggtgcgagaagctgttcagctacaagagcagcctgatcatccaccagagaatccacaccggcgagaagccctacggctgcaacgagtgcggcaagaccttcagaagaaagagcttcctgaccctgcacgagagaacccacaccggcgacaagccctacaagtgcatcgagtgcggcaagaccttccactgcaagagcctgctgaccctgcaccacagaacccacagcggcgagaagccctaccagtgcagcgagtgcggcaagaccttcagccagaagagctacctgaccatccaccacagaacccacaccggcgagaagccctacgcctgcgaccactgcgaggaggccttcagccacaagagcagactgaccgtgcaccagagaacccacaccggcgagaagccctacgagtgcaacgagtgcggcaagcccttcatcaacaagagcaacctgagactgcaccagagaacccacaccggcgagaagccctacgagtgcaacgagtgcggcaagaccttccacagaaagagcttcctgaccatccaccagtggacccacaccggcgagaagccctacgagtgcaacgagtgcggcaagaccttcagatgcaagagcttcctgaccgtgcaccagagaacccacgccggcgagaagccctacgcctgcaacgagtgcggcaagacctacagccacaagagctacctgaccgtgcaccacagaacccacaccggcgagaagccctacgagtgcaacgagtgcggcaagagcttccactgcaagagcttcctgaccatccaccagagaacccacgccggcaagaagccctacgagtgcaacgagtgcgagaagaccttcatcaacaagctgaacctgggcatccacaagagaacccacaccggcgagagaccctacgagtgcaacgagtgcggcaagaccttcagacagaagagcaacctgagcacccaccagggcacccacaccggcgagaagccctacgtgtgcaacgagtgcggcaagaccttccacagaaagagcttcctgaccatccaccagagaacccacaccggcaagaacagaatggacgtgatgaacgtggagaagctgttcgtgagaaaccacaccctgctgtacatcagagagctgacccccggcaagagccccatgaacgtgatgaacgtggagaaccccttcatcagaagacagatcttcagaagcatcaaggtgttcaccagaggcagaaaccccatgaacgtggccaacgtggagaagccctgccagaagagcgtgctgaccgtgcaccacagaacccacaccggcgagaagccctacgagtgcaacgagtgcggcaagaccttctgccacaagagcaacctgagcacccaccagggcacccacagcggcgagaagccctacgagtgcgacgagtgcagaaagaccttctacgacaagaccgtgctgaccatccaccagagaacccacaccggcgagaagcccttcgagtgcaaggagtgcagaaagaccttcagccagaagagcaagctgttcgtgcaccacagaacccacaccggcgagaagcccttcagatgcaacgagtgcagaaagaccttcagccagaagagcggcctgagcatccaccagagaacccacaccggcgagaagccctacgagtgcaaggagtgcggcaagaccttctgccagaagagccacctgagcagacaccagcagacccacatcggcgagaagagcgacgtggccgaggccggctacgtgttcccccagaaccacagcttcttcccctag

SEQ ID NO: 26293 - DNA, 2745 bp, Artificial Sequence
  Description of Artificial Sequence: Synthetic coding sequence
atgttccccgtgttcagcggctgcttccaggagctgcaggagaagaacaagagcctggagctggtgagcttcgaggaggtggccgtgcacttcacctgggaggagtggcaggacctggacgacgcccagagaaccctgtacagagacgtgatgctggagacctacagcagcctggtgagcctgggccactacatcaccaagcccgagatgatcttcaagctggagcagggcgccgagccctggatcgtggaggagacccccaacctgagactgagcgccgtgcagatcatcgacgacctgatcgagagaagccacgagagccacgacagattcttctggcagatcgtgatcaccaacagcaacaccagcacccaggagagagtggagctgggcaagaccttcaacctgaacagcaaccacgtgctgaacctgatcatcaacaacggcaacagcagcggcatgaagcccggccagttcaacgactgccagaacatgctgttccccatcaagcccggcgagacccagagcggcgagaagccccacgtgtgcgacatcaccagaagaagccacagacaccacgagcacctgacccagcaccacaagatccagaccctgctgcagaccttccagtgcaacgagcagggcaagaccttcaacaccgaggccatgttcttcatccacaagagagtgcacatcgtgcagaccttcggcaagtacaacgagtacgagaaggcctgcaacaacagcgccgtgatcgtgcaggtgatcacccaggtgggccagcccacctgctgcagaaagagcgacttcaccaagcaccagcagacccacaccggcgagaagccctacgagtgcgtggagtgcgagaagcccagcatcagcaagagcgacctgatgctgcagtgcaagatgcccaccgaggagaagccctacgcctgcaactggtgcgagaagctgttcagctacaagagcagcctgatcatccaccagagaatccacaccggcgagaagccctacggctgcaacgagtgcggcaagaccttcagaagaaagagcttcctgaccctgcacgagagaacccacaccggcgacaagccctacaagtgcatcgagtgcggcaagaccttccactgcaagagcctgctgaccctgcaccacagaacccacagcggcgagaagccctaccagtgcagcgagtgcggcaagaccttcagccagaagagctacctgaccatccaccacagaacccacaccggcgagaagccctacgcctgcgaccactgcgaggaggccttcagccacaagagcagactgaccgtgcaccagagaacccacaccggcgagaagccctacgagtgcaacgagtgcggcaagcccttcatcaacaagagcaacctgagactgcaccagagaacccacaccggcgagaagccctacgagtgcaacgagtgcggcaagaccttccacagaaagagcttcctgaccatccaccagtggacccacaccggcgagaagccctacgagtgcaacgagtgcggcaagaccttcagatgcaagagcttcctgaccgtgcaccagagaacccacgccggcgagaagccctacgcctgcaacgagtgcggcaagacctacagccacaagagctacctgaccgtgcaccacagaacccacaccggcgagaagccctacgagtgcaacgagtgcggcaagagcttccactgcaagagcttcctgaccatccaccagagaacccacgccggcaagaagccctacgagtgcaacgagtgcgagaagaccttcatcaacaagctgaacctgggcatccacaagagaacccacaccggcgagagaccctacgagtgcaacgagtgcggcaagaccttcagacagaagagcaacctgagcacccaccagggcacccacaccggcgagaagccctacgtgtgcaacgagtgcggcaagaccttccacagaaagagcttcctgaccatccaccagagaacccacaccggcaagaacagaatggacgtgatgaacgtggagaagctgttcgtgagaaaccacaccctgctgtacatcagagagctgacccccggcaagagccccatgaacgtgatgaacgtggagaaccccttcatcagaagacagatcttcagaagcatcaaggtgttcaccagaggcagaaaccccatgaacgtggccaacgtggagaagccctgccagaagagcgtgctgaccgtgcaccacagaacccacaccggcgagaagccctacgagtgcaacgagtgcggcaagaccttctgccacaagagcaacctgagcacccaccagggcacccacagcggcgagaagccctacgagtgcgacgagtgcagaaagaccttctacgacaagaccgtgctgaccatccaccagagaacccacaccggcgagaagcccttcgagtgcaaggagtgcagaaagaccttcagccagaagagcaagctgttcgtgcaccacagaacccacaccggcgagaagcccttcagatgcaacgagtgcagaaagaccttcagccagaagagcggcctgagcatccaccagagaacccacaccggcgagaagccctacgagtgcaaggagtgcggcaagaccttctgccagaagagccacctgagcagacaccagcagacccacatcggcgagaagagcgacgtggccgaggccggctacgtgttcccccagaaccacagcttcttcccctag

SEQ ID NO: 26294 - DNA, 381 bp, Artificial Sequence
  Description of Artificial Sequence: Synthetic coding sequence
atgggcctgctgaccttcagagacgtggccatcgagttcagcagagaggagtgggagcacctggacagcgaccagaagctgctgtacggcgacgtgatgctggagaactacggcaacctggtgagcctgggcctggccgtgagcaagcccgacctgatcaccttcctggagcagagaaaggagccctggaacgtgaagagcgccgagaccgtggccatccagcccgacatcttcagccacgacacccagggcctgctgagaaagaagctgatcgaggccagcttccagaaggtgatcctggacggctacggcagctgcggcccccagaacctgaacctgagaaaggagtgggagagcgagggcaagatcatcctgtggtag

SEQ ID NO: 26295 - DNA, 537 bp, Artificial Sequence
  Description of Artificial Sequence: Synthetic coding sequence
atggtgaacgtgcccgacatcttcagccacgacacccagggcctgctgagaaagaagctgatcgaggccagcttccagaaggtgatcctggacggctacggcagctgcggcccccagaacctgaacctgagaaaggagtgggagagcgagggcaagtgcgagggccacaacggctactacgacggccacaccaagtgcaagaccaccacctacaacaagaacctgaccgtgaccggcggccagaagcacgagaagacccagttcatgagcgtggccttcagcaagccctgcgtgagcgtgagcaagtgccagcaccagttcctgaagctgaccttcagcttcaagggcaacctggacaaccccaacagcgacctggtgcacgtgagcaacaaccacctgaaccagctgaagtacagaaccggcgtgaacgtgcagagcaacatcagcgagaaggagagattcaagaacgaggaggtgatcagcaagtacgaccagttcgacggcagcctgctgaaggtgtgcttcaccaacaagtag

SEQ ID NO: 26296 - DNA, 1428 bp, Artificial Sequence
  Description of Artificial Sequence: Synthetic coding sequence
atgagcctggccaccgtggacaccctgtacatcttcagccacgacacccagggcctgctgagaaagaagctgatcgaggccagcttccagaaggtgatcctggacggctacggcagctgcggcccccagaacctgaacctgagaaaggagtgggagagcgaggagaagaaccagtacaacaagagcgacaccaccctgagccagggcatcagccccagaagacaccagaagacccacttcctgcacaaccactgcaagagaaagaagtgcgagaaggccttccacgagtgcaccaaccacgtgcaccagagcatcttcatccaggagaagagcgccaagtgcaacaagtgcatcgagaccttcatccagagcagcaagcacacccagccccagagaatccacatcggcgagaagagccacagatgcaacaacggcgagaagatcctgagcaagctgagcagcctgagaaagcacaagatcatccacaacgaggagaagccctacaagtgcaaggagtgcgacaaggccttcaaccacagaagccacctgacccagcaccagatcatccacaccggcgagaagccctacaagtgcaaggagtgcggcaaggccttcaacagcagcagctacttcaccagacaccagagaatccacaccggcgagaagctgtacaagtgcaaggcctgcagcaagtgcttcacccacagcagcaacctgctggtgcaccagagaatccacaccggcgagaagccctacaagtgcaaggagtgcggcaagagcttcaaggtgagcagcgccctgacccagcacgagagaatccacaccggcgagaagccctacaagtgcaaggagtgcagcaaggccttcaactgcagaagctacctgaccaagcaccagagaatccacaccggcgagaagctgtacaagtgcaagagctgcagcaagagcttcagcagaagcagcagcctgatcgtgcaccagagaatccacaccggcgagaagccctacaagtgcaaggagtgcggcaaggccttcaactgcagcagcagactgacccagcaccagagaatccacaccggcgagaagccctacatctgcaaggagtgcggcaaggccttcaactgcagcagcagcctgaccaagcaccagagaatccacaccggcgtgaagctgtacaagtgcaaggcctgcagcaagagcttcagccacagcagctgcctgagcgtgcaccagatcacccacaccggcatgaagccctacatctgcaaggactgcggcatcagcttcaacagaagcagcaacctgagaagacaccagatgatccacaccggcgagaagccctacaagtgcaaggagtgcggcaagctgttcaacagatgcagcaccctgaccagacacaagagcatccacaccagagagttcctgtag

SEQ ID NO: 26297 - DNA, 1860 bp, Artificial Sequence
  Description of Artificial Sequence: Synthetic coding sequence
atgggccccctgaccttcatggacgtggccatcgagttcagcgtggaggagtggcagtgcctggacaccgcccagcagaacctgtacagaaacgtgatgctggagaactacagaaacctggtgttcctgggcatcgccgtgagcaagcccgacctgatcacctgcctggagcagggcaaggagccctggaacatggagagacacgagatggtggccaagccccccggcatgtgctgctacttcgcccaggacctgagacccgagcagagcatcaaggccagcctgcagagaatcatcctgagaaagtacgagaagtgcggccaccacaacctgcagctgaagaagggctacaagagcgtggacgagtacaaggtgcacaagggcagctacaacggcttcaaccagtgcctgaccaccacccagagcaagatcttccagtgcgacaagtacgtgaaggacttccacaagttcagcaacagcaacagacacaagaccgagaagaaccccttcaagtgcaaggagtgcggcaagagcttctgcgtgctgagccacctgacccagcacaagagaatccacaccaccgtgaacagctacaagctggaggagtgcggcaaggccttcaacgtgagcagcaccctgagccagcacaagagaatccacaccggccagaagcactacaagtgcgaggagtgcggcatcgccttcaacaagagcagccacctgaacacccacaagatcatccacaccggcgagaagagctacaagagagaggagtgcggcaaggccttcaacatcagcagccacctgaccacccacaagatcatccacaccggcgagaacgcctacaagtgcaaggagtgcggcaaggccttcaaccagagcagcaccctgaccagacacaagatcatccacgccggcgagaagccctacatctgcgagcactgcggcagagccttcaaccagagcagcaacctgaccaagcacaagagaatccacaccggcgacaagccctacaagtgcgaggagtgcggcaaggccttcaacgtgagcagcaccctgacccagcacaagagaatccacaccggcgagaagccctacaagtgcgaggagtgcggcaaggccttcaacgtgagcagcaccctgacccagcacaagagaatccacaccggcgagaagccctacaagtgcgaggagtgcggcaaggccttcaacaccagcagccacctgaccacccacaagagaatccacaccggcgagaagccctacaagtgcgaggagtgcggcaaggccttcaaccagttcagccagctgaccacccacaagatcatccacaccggcgagaagccctacaagtgcaaggagtgcggcaaggccttcaagagaagcagcaacctgaccgagcacagaatcatccacaccggcgagaagccctacaagtgcgaggagtgcggcaaggccttcaacctgagcagccacctgaccacccacaagaagatccacaccggcgagaagccctacaagtgcaaggagtgcggcaaggccttcaaccagagcagcaccctggccagacacaagatcatccacgccggcgagaagccctacaagtgcgaggagtgcggcaaggccttctaccagtacagcaacctgacccagcacaagatcatccacaccggcgagaagccctacaagtgcgaggagtgcggcaaggccttcaactggagcagcaccctgaccaagcacaaggtgatccacaccggcgagaagccctacaagtgcaaggagtgcggcaaggccttcaaccagtgcagcaacctgaccacccacaagaagatccacgccgtggagaagagcgacaagtag

SEQ ID NO: 26298 - DNA, 1500 bp, Artificial Sequence
  Description of Artificial Sequence: Synthetic coding sequence
atgagagtgctgaccttcagagacgtggccgtggagttcagccccgaggagtgggagtgcctggacagcgcccagcagagactgtacagagacgtgatgctggagaactacggcaacctgttcagcctgggcctggccatcttcaagcccgacctgatcacctacctggagcagagaaaggagccctggaacgccagaagacagaagaccgtggccaagcaccccgccggcagcctgcacttcaccgccgagatcctgctggagcacgacatcaacgacagcttccagaaggtgatcctgagaaagagcggcagctgcgacctgaacaccctgagactgaagaaggactaccagagagtgggcaactgcaagggccagaagagcagctacaacggcatccaccagtgcctgagcgccaccagaagcaagacctgccagtacaacaagtgcggcaaggccttcggcctgtgcagcatcttcaccgagcacaagaagatcttcagcagagagaagtgctacaagtgcgaggagtgcggcaaggactgcagactgagcgacttcaccatccagaagagaatccacaccgccgacagaagctacaagtgcgaggagtgcggcaaggcctgcaagaagttcagcaacctgaccgagcacaacagagtgcacaccggcaagaagccctacaagtgcgaggagtgcggcaagaccttcacctgcagcagcgccctgaccaagcacaagagaaaccacaccggcgacagaccctacaagtgcgaggagtgccacaaggccttcagatgctgcagcgacctgaccaagcacaagagaatccacaccggcgagaagccctacaagtgcaaggagtgccacaaggccttcagatgctgcagcgacctgaccaagcacaagagaatccacaccggcgagaagccctacaagtgcaacgagtgcggcaaggccttcatgtggatcagcgccctgagccagcacaacagaatccacaccggcgagaagccctacatctgcgaggagtgcggcaaggccttcacctacagcagcaccctgatcagccacaagagaatccacatggagctgagaccctacaagtgcgaggagtgcggcaagaccttcaagtggttcagcgacctgaccaaccacaagagaatccacaccggcgagaagccctacaagtgcgaggagtgcggcaagagcttcacctgcagcagcaacctgatcaagcacaagagaatccacatggaggtgagaccctacaagtgcgaggagtgcggcaagaccttcaagtggttccccgacctgaccaaccacaagagaatccacaccggcgagaagccctacaagtgcgaggagtgcggcaagaccttcacctgcagcagcagcctgatcaagcacaagagaagccacaccggcgacagacccaccagcgccaagaacgtggccaagcccctgggcggcagccagaccctgctgaacatcagatag

SEQ ID NO: 26299 - DNA, 1869 bp, Artificial Sequence
  Description of Artificial Sequence: Synthetic coding sequence
atgggcagcctgaccttcagagacgtggccatccagttcagcctggaggagtggcagtgcctggacaccgcccagcagaacctgtacagaaacgtgatgctggagaactacagaaacctggtgttcctgggcatcgccgcccccaagcccgacctgatcatcttcctggagcagggcaaggagccctggaacatgaagagacacgagctggtgaaggagccccccgtgatctgcagccacttcgcccaggacctgtggcccgagcagggcagagaggacagcttccagaaggtgatcctgagaagatacgagaagtgcggccacgagaacctgcagctgaagatcggctgcaccaacgtggacgagtgcaaggtgcacaagaagggctacaacaagctgaaccagagcctgaccaccacccagagcaaggtgttccagtgcggcaagtacgccaacatcttccacaagtgcagcaacagcaagagacacaagatcagacacaccggcaagaagctgctgaagtgcaaggagtacgtgagaagcttctgcatgctgagccacctgagccagcacaagagaatctacaccagagagaacagctacaagagcgaggagcacggcaaggccttcaactggagcagcgccctgacctacaagagaatccacaccggcgagaagccctgcaagtgcgaggagtgcggcaaggccttcagcaagttcagcatcctgaccaagcacaaggtgatccacaccggcgagaagcactacaagtgcgaggagtgcggcaaggccttcaccagaagcagcagcctgatcgagcacaagagaagccacgccggcgagaagccctacaagtgcgaggagtgcggcaaggccttcagcaaggccagcaccctgaccgcccacaagaccatccacgccggcgagaagccctacaagtgcgaggagtgcggcaaggccttcaacagaagcagcaacctgatggagcacaagagaatccacaccggcgagaagccctgcaagtgcgaggagtgcggcaaggccttcggcaacttcagcaccctgaccaagcacaaggtgatccacaccggcgagaagccctacaagtgcgaggagtgcggcaaggccttcagctggcccagcagcctgaccgagcacaagagaatccacgccggcgacaagccctacaagtgcgaggagtgcggcaagaccttcaagtggagcagcaccctgaccaagcacaagatcatccacaccggcgagaagccctacaagtgcgaggagtgcggcaaggccttcaccaccttcagcagcctgaccaagcacaaggtgatccacaccggcgagaagcactacaagtgcgaggagtgcggcaaggtgttcagctggagcagcagcctgaccacccacaaggccatccacgccggcgagaagctgtacaagtgcgaggagtgcggcaaggccttcaagtggagcagcaacctgatggagcacaagagaatccacaccggcgagaagccctacaagtgcgaggagtgcggcaaggccttcagcaaggtggccaacctgaccaagcacaaggtgatccacaccggcgagaagcagtacaagtgcgaggagtgcggcaaggccttcatctggagcagcagactgagcgagcacaagagaatccacaccggcgagaagccctacaagtgcgaggagtgcggcaaggccttcagctgggtgagcgtgctgaacaagcacaagaagatccacgccggcaagaagttctacaagtgcgaggagtgcggcaaggacttcaaccagagcagccacctgaccacccacaagagaatccacaccggcggcaagaccctgcagatgtag

SEQ ID NO: 26300 - DNA, 3522 bp, Artificial Sequence
  Description of Artificial Sequence: Synthetic coding sequence
atgcccggcgcccccggcagcctggagatgggccccctgaccttcagagacgtgaccatcgagttcagcctggaggagtggcagtgcctggacaccgtgcagcagaacctgtacagagacgtgatgctggagaactacagaaacctggtgttcctgggcatggccgtgttcaagcccgacctgatcacctgcctgaagcagggcaaggagccctggaacatgaagagacacgagatggtgaccaagccccccgtgatgagaagccacttcacccaggacctgtggcccgaccagagcaccaaggacagcttccaggaggtgatcctgagaacctacgccagatgcggccacaagaacctgagactgagaaaggactgcaagagcgccaacgagggcaagatgcacaaggagggctacaacaagctgaaccagtgcagaaccgccacccagagaaagatcttccagtgcaacaagcacatgaaggtgttccacaagtacagcaacagaaacaaggtgagacacaccaagaagaagaccttcaagtgcatcaagtgcagcaagagcttcttcatgctgagctgcctgatcagacacaagagaatccacatcagacagaacatctacaagtgcgaggagagaggcaaggccttcaagagcttcagcaccctgaccaagcacaagatcatccacaccgaggacaagccctacaagtacaagaagtgcggcaacgccttcaagttcagcagcaccttcaccaagcacaagagaatccacaccggcgagacccccttcagatgcgaggagtgcggcaaggccttcaaccagagcagcaacctgaccgaccacaagagaatccacaccggcgagaagacctacaagtgcgaggagtgcggcaaggccttcaagggcagcagcaacttcaacgcccacaaggtgatccacaccgccgagaagccctacaagtgcgaggactgcggcaagaccttcaaccacttcagcgccctgagaaagcacaagatcatccacaccggcaagaagccctacaagagagaggagtgcggcaaggccttcagccagagcagcaccctgagaaagcacgagatcatccacaccggcgagaagccctacaagtgcgaggagtgcggcaaggccttcaagtggagcagcaagctgaccgtgcacaaggtggtgcacaccggcgagaagccctacaagtgcgaggagtgcggcaaggccttcagccagttcagcaccctgaagaagcacaagatcatccacaccggcaagaagccctacaagtgcgaggagtgcggcaaggccttcaacagcagcagcaccctgatgaagcacaagatcatccacaccggcgagaagccctacaagtgcgaggagtgcggcaaggccttcagacagagcagccacctgaccagacacaaggccatccacaccggcgagaagccctacaagtgcgaggagtgcggcaaggccttcaaccacttcagcgacctgagaagacacaagatcatccacaccggcaagaagccctacaagtgcgaggagtgcggcaaggccttcagccagagcagcaccctgagaaaccaccagatcatccacaccggcgagaagccctacaagtgcgaggagtgcggcaaggccttcaagtggagcagcaagctgaccgtgcacaaggtgatccacaccggcgagaagccctgcaagtgcgaggagtgcggcaaggccttcaagcacttcagcgccctgagaaagcacaaggtgatccacaccagagagaagctgtacaagtgcgaggagtgcggcaaggccttcaacaacagcagcatcctggccaagcacaagatcatccacaccggcaagaagccctacaagtgcgaggagtgcggcaaggccttcagacagagcagccacctgaccagacacaaggccatccacaccggcgagaagccctacaagtgcgaggagtgcggcaaggccttcagccacttcagcgccctgagaagacacaagatcatccacaccggcaagaagccctacaagtgcgaggagtgcggcaaggccttcagccacttcagcgccctgagaagacacaagatcatccacaccggcgagaagccctacaagtgcgaggagtgcggcaaggccttcaagtggagcagcaagctgaccgtgcacaaggtgatccacaccgccgagaagccctgcaagtgcgaggagtgcggcaagagcttcaagcacttcagcgccctgagaaagcacaaggtgatccacaccagagagaagctgtacaagtgcgaggagtgcgtgaaggccttcaacagcttcagcgccctgatgaagcacaaggtgatccacaccggcgagaagccctacaagtgcgaggagtgcggcaaggccttcaagtggagcagcaagctgaccgtgcacaaggtgatccacaccggcgagaagccctgcaagtgcgaggagtgcggcaaggccttcaagcacttcagcgccctgagaaagcacaaggtgatccacaccggcaagaagccctacaagtgcgaggagtgcggcaaggccttcagccagagcagcagcctgagaaagcacgagatcatccacagcggcgagaagccctacaagtgcgaggagtgcggcaaggccttcaagtggctgagcaagctgaccgtgcacaagatcatccacaccggcaagaagccctacaagtgcgaggagtgcggcaaggccttcaacgacagcagcaccctgatgaagcacaagatcatccacaccggcaagaagccctacaagtgcgccgagtgcggcaaggccttcaagcagagcagccacctgaccagacacaaggccatccacaccggcgagaagccctacaagtgcgaggagtgcggcaaggacttcaacaacagcagcaccctgaagaagcacaagctgatccacaccagagagaagctgtacaagtgcgaggagtgcgtgaaggccttcaacaacttcagcgccctgatgaagcacaagatcatccacaccggcgagaagccctacaagtgcgaggagtgcggcaaggccttcaagtggagcagcaagctgaccgagcacaaggtgatccacaccggcgagaagccctgcaagtgcgaggagtgcgacaaggccttcaagcacttcagcgccctgagaaagcacaaggtgatccacaccggcaagaagccctaccagtgcgacgagtgcggcaaggccttcaacaacagcagcaccctgaccaagcacaagatcatccacaccggcgagaagccctacaagtgcgaggagtgcggcaaggccttcagccagagcagcatcctgaccaagcacaagatcatccacagcgtggagaagccctacaagtgcgaggagtgcggcaaggccttcaaccagagcagccacctgaccagacacaagaccatccacaccggcgagaagccctacaagtacaagaccatccacaccggcgagaagccctacaagtag

SEQ ID NO: 26301 - DNA, 3759 bp, Artificial Sequence
  Description of Artificial Sequence: Synthetic coding sequence
atgcccggcgcccccggcagcctggagatgggccccctgaccttcagagacgtgaccatcgagttcagcctggaggagtggcagtgcctggacaccgtgcagcagaacctgtacagagacgtgatgctggagaactacagaaacctggtgttcctgggcatggccgtgttcaagcccgacctgatcacctgcctgaagcagggcaaggagccctggaacatgaagagacacgagatggtgaccaagccccccgtgatgagaagccacttcacccaggacctgtggcccgaccagagcaccaaggacagcttccaggaggtgatcctgagaacctacgccagatgcggccacaagaacctgagactgagaaaggactgcaagagcgccaacgagggcaagatgcacaaggagggctacaacaagctgaaccagtgcagaaccgccacccagagaaagatcttccagtgcaacaagcacatgaaggtgttccacaagtacagcaacagaaacaaggtgagacacaccaagaagaagaccttcaagtgcatcaagtgcagcaagagcttcttcatgctgagctgcctgatcagacacaagagaatccacatcagacagaacatctacaagtgcgaggagagaggcaaggccttcaagagcttcagcaccctgaccaagcacaagatcatccacaccgaggacaagccctacaagtacaagaagtgcggcaacgccttcaagttcagcagcaccttcaccaagcacaagagaatccacaccggcgagacccccttcagatgcgaggagtgcggcaaggccttcaaccagagcagcaacctgaccgaccacaagagaatccacaccggcgagaagacctacaagtgcgaggagtgcggcaaggccttcaagggcagcagcaacttcaacgcccacaaggtgatccacaccgccgagaagccctacaagtgcgaggactgcggcaagaccttcaaccacttcagcgccctgagaaagcacaagatcatccacaccggcaagaagccctacaagagagaggagtgcggcaaggccttcagccagagcagcaccctgagaaagcacgagatcatccacaccggcgagaagccctacaagtgcgaggagtgcggcaaggccttcaagtggagcagcaagctgaccgtgcacaaggtggtgcacaccggcgagaagccctacaagtgcgaggagtgcggcaaggccttcagccagttcagcaccctgaagaagcacaagatcatccacaccggcaagaagccctacaagtgcgaggagtgcggcaaggccttcaacagcagcagcaccctgatgaagcacaagatcatccacaccggcgagaagccctacaagtgcgaggagtgcggcaaggccttcagacagagcagccacctgaccagacacaaggccatccacaccggcgagaagccctacaagtgcgaggagtgcggcaaggccttcaaccacttcagcgacctgagaagacacaagatcatccacaccggcaagaagccctacaagtgcgaggagtgcggcaaggccttcagccagagcagcaccctgagaaaccaccagatcatccacaccggcgagaagccctacaagtgcgaggagtgcggcaaggccttcaagtggagcagcaagctgaccgtgcacaaggtgatccacaccggcgagaagccctgcaagtgcgaggagtgcggcaaggccttcaagcacttcagcgccctgagaaagcacaaggtgatccacaccagagagaagctgtacaagtgcgaggagtgcggcaaggccttcaacaacagcagcatcctggccaagcacaagatcatccacaccggcaagaagccctacaagtgcgaggagtgcggcaaggccttcagacagagcagccacctgaccagacacaaggccatccacaccggcgagaagccctacaagtgcgaggagtgcggcaaggccttcagccacttcagcgccctgagaagacacaagatcatccacaccggcaagaagccctacaagtgcgaggagtgcggcaaggccttcagccacttcagcgccctgagaagacacaagatcatccacaccggcgagaagccctacaagtgcgaggagtgcggcaaggccttcaagtggagcagcaagctgaccgtgcacaaggtgatccacaccgccgagaagccctgcaagtgcgaggagtgcggcaagagcttcaagcacttcagcgccctgagaaagcacaaggtgatccacaccagagagaagctgtacaagtgcgaggagtgcgtgaaggccttcaacagcttcagcgccctgatgaagcacaaggtgatccacaccggcgagaagccctacaagtgcgaggagtgcggcaaggccttcaagtggagcagcaagctgaccgtgcacaaggtgatccacaccggcgagaagccctgcaagtgcgaggagtgcggcaaggccttcaagcacttcagcgccctgagaaagcacaaggtgatccacaccggcaagaagccctacaagtgcgaggagtgcggcaaggccttcagccagagcagcagcctgagaaagcacgagatcatccacagcggcgagaagccctacaagtgcgaggagtgcggcaaggccttcaagtggctgagcaagctgaccgtgcacaaggtgatccacaccgccgagaagccctgcaagtgcgaggagtgcggcaaggccttcaagcacttcagcgccctgagaaagcacaagatcatccacaccggcaagaagccctacaagtgcgaggagtgcggcaaggccttcaacgacagcagcaccctgatgaagcacaagatcatccacaccggcaagaagccctacaagtgcgccgagtgcggcaaggccttcaagcagagcagccacctgaccagacacaaggccatccacaccggcgagaagccctacaagtgcgaggagtgcggcaaggacttcaacaacagcagcaccctgaagaagcacaagctgatccacaccagagagaagctgtacaagtgcgaggagtgcgtgaaggccttcaacaacttcagcgccctgatgaagcacaagatcatccacaccggcgagaagccctacaagtgcgaggagtgcggcaaggccttcaagtggagcagcaagctgaccgagcacaaggtgatccacaccggcgagaagccctgcaagtgcgaggagtgcgacaaggccttcaagcacttcagcgccctgagaaagcacaaggtgatccacaccggcaagaagccctaccagtgcgacgagtgcggcaaggccttcaacaacagcagcaccctgaccaagcacaagatcatccacaccggcgagaagccctacaagtgcgaggagtgcggcaaggccttcagccagagcagcatcctgaccaagcacaagatcatccacagcgtggagaagccctacaagtgcgaggagtgcggcaaggccttcaaccagagcagccacctgaccagacacaagaccatccacaccggcgagaagccctacaagtgcgaggagtgcggcaaggccttcatccagtgcagctacctgatcagacacaagaccatccacaccagagagaagcccaccaacgtgaagaaggtgcccaagctgctgagcaacccccacaccctgctggacaagaccatccacaccggcgagaagccctacaagtgcgaggagtgcgccaaggccttctag

SEQ ID NO: 26302 - DNA, 576 bp, Artificial Sequence
  Description of Artificial Sequence: Synthetic coding sequence
atgaccgaccccagcctgggcctgaccgtgcccatggccccccccctggcccccctgccccccagagaccccaacggcgccggcagcgagtggagaaagcccggcgccgtgagcttcgccgacgtggccgtgtacttcagcagagaggagtggggctgcctgagacccgcccagagagccctgtacagagacgtgatgagagagacctacggccacctgggcgccctgggcgagagccccacctgcctgcccggcccctgcgccagcaccggccccgccgcccccctgggcgccgcctgcggcgtgggcggccccggcgccggccaggccgccagcagccagagaggcgtgtgcgtgctgctgccccaggagagcgaggccgccagcagaagaagcagccccggctggagaagaagacccaactgcggcatcagactgcccagaatcagaagatggagaagcgtgagacagaagagaacccagcagatccccgagaccagaaagagaaaggacaagggcaagggcagagagccctggagaagccccaccctgtggccccccggcctgctgggctag

SEQ ID NO: 26303 - DNA, 573 bp, Artificial Sequence
  Description of Artificial Sequence: Synthetic coding sequence
atgaccgaccccagcctgggcctgaccgtgcccatggccccccccctggcccccctgccccccagagaccccaacggcgccggcagcgagtggagaaagcccggcgccgtgagcttcgccgacgtggccgtgtacttcagcagagaggagtggggctgcctgagacccgcccagagagccctgtacagagacgtgatgagagagacctacggccacctgggcgccctgggcgagagccccacctgcctgcccggcccctgcgccagcaccggccccgccgcccccctgggcgccgcctgcggcgtgggcggccccggcgccggccaggccgccagcagccagagaggcgtgtgcgtgctgctgccccaggagagcgaggccgccagcagaagaagcagccccggctggagaagaagacccaactgcggcatcagactgcccagaatcagaagatggagaagcgtgagacagaagagaacccagatccccgagaccagaaagagaaaggacaagggcaagggcagagagccctggagaagccccaccctgtggccccccggcctgctgggctag

SEQ ID NO: 26304 - DNA, 993 bp, Artificial Sequence
  Description of Artificial Sequence: Synthetic coding sequence
atgaccgaccccagcctgggcctgaccgtgcccatggccccccccctggcccccctgccccccagagaccccaacggcgccggcagcgagtggagaaagcccggcgccgtgagcttcgccgacgtggccgtgtacttcagcagagaggagtggggctgcctgagacccgcccagagagccctgtacagagacgtgatgagagagacctacggccacctgggcgccctgggcgtgggcggcagcaagcccgccctgatcagctgggtggaggagaaggccgagctgtgggaccccgccgcccaggaccccgaggtggccaagtgccccaccgaggccgaccccgacagcagaaacaaggaggaggagagacagagagagggcaccggcgccctggagaagcccgaccccgtggccgccggcagccccggcctgaaggccccccaggcccccttcgccggcctggagcagctgagcaaggccagaagaagaagcagacccagattcttcgcccacccccccgtgcccagagccgaccagagacacggctgctacgtgtgcggcaagagcttcgcctggagaagcaccctggtggagcacatctacagccacagaggcgagaagcccttccactgcgccgactgcggcaagggcttcggccacgccagcagcctgagcaagcacagagccatccacagaggcgagagaccccacagatgccccgagtgcggcagagccttcatgagaagaaccgccctgaccagccacctgagagtgcacaccggcgagaagccctacagatgcccccagtgcggcagatgcttcggcctgaagaccggcatggccaagcaccagtgggtgcacagacccggcggcgagggcagaagaggcagaagacccggcggcctgagcgtgaccctgacccccgtgagaggcgacctggacccccccgtgggcttccagctgtaccccgagatcttccaggagtgcggctag

SEQ ID NO: 26305 - DNA, 2496 bp, Artificial Sequence
  Description of Artificial Sequence: Synthetic coding sequence
atggagaaccagagaagcagccccctgagcttccccagcgtgccccaggaggagaccctgagacaggcccccgccggcctgcccagagagaccctgttccagagcagagtgctgccccccaaggagatccccagcctgagccccaccatccccagacagggcagcctgccccagaccagcagcgcccccaagcaggagaccagcggcagaatgccccacgtgctgcagaagggccccagcctgctgtgcagcgccgccagcgagcaggagaccagcctgcagggccccctggccagccaggagggcacccagtaccccccccccgccgccgccgagcaggaggtgagcctgctgagccacagcccccaccaccaggaggcccccgtgcacagccccgaggcccccgagaaggaccccctgaccctgagccccaccgtgcccgagaccgacatggaccccctgctgcagagccccgtgagccagaaggacacccccttccagatcagcagcgccgtgcagaaggagcagcccctgcccaccgccgagatcaccagactggccgtgtgggccgccgtgcaggccgtggagagaaagctggaggcccaggccatgagactgctgaccctggagggcagaaccggcaccaacgagaagaagatcgccgactgcgagaagaccgccgtggagttcgccaaccacctggagagcaagtgggtggtgctgggcaccctgctgcaggagtacggcctgctgcagagaagactggagaacatggagaacctgctgaagaacagaaacttctggatcctgagactgccccccggcagcaacggcgaggtgcccaaggtgcccgtgaccttcgacgacgtggccgtgcacttcagcgagcaggagtggggcaacctgagcgagtggcagaaggagctgtacaagaacgtgatgagaggcaactacgagagcctggtgagcatggactacgccatcagcaagcccgacctgatgagccagatggagagaggcgagagacccaccatgcaggagcaggaggacagcgaggagggcgagacccccaccgaccccagcgccgcccacgacggcatcgtgatcaagatcgaggtgcagaccaacgacgagggcagcgagagcctggagacccccgagcccctgatgggccaggtggaggagcacggcttccaggacagcgagctgggcgacccctgcggcgagcagcccgacctggacatgcaggagcccgagaacaccctggaggagagcaccgagggcagcagcgagttcagcgagctgaagcagatgctggtgcagcagagaaactgcaccgagggcatcgtgatcaagaccgaggagcaggacgaggaggaggaggaggaggaggaggacgagctgccccagcacctgcagagcctgggccagctgagcggcagatacgaggccagcatgtaccagacccccctgcccggcgagatgagccccgagggcgaggagagccccccccccctgcagctgggcaaccccgccgtgaagagactggcccccagcgtgcacggcgagagacacctgagcgagaacagaggcgccagcagccagcagcagagaaacagaagaggcgagagacccttcacctgcatggagtgcggcaagagcttcagactgaagatcaacctgatcatccaccagagaaaccacatcaaggagggcccctacgagtgcgccgagtgcgagatcagcttcagacacaagcagcagctgaccctgcaccagagaatccacagagtgagaggcggctgcgtgagccccgagagaggccccaccttcaaccccaagcacgccctgaagcccagacccaagagccccagcagcggcagcggcggcggcggccccaagccctacaagtgccccgagtgcgacagcagcttcagccacaagagcagcctgaccaagcaccagatcacccacaccggcgagagaccctacacctgccccgagtgcaagaagagcttcagactgcacatcagcctggtgatccaccagagagtgcacgccggcaagcacgaggtgagcttcatctgcagcctgtgcggcaagagcttcagcagacccagccacctgctgagacaccagagaacccacaccggcgagagacccttcaagtgccccgagtgcgagaagagcttcagcgagaagagcaagctgaccaaccactgcagagtgcacagcagagagagaccccacgcctgccccgagtgcggcaagagcttcatcagaaagcaccacctgctggagcacagaagaatccacaccggcgagagaccctaccactgcgccgagtgcggcaagagattcacccagaagcaccacctgctggagcaccagagagcccacaccggcgagagaccctacccctgcacccactgcgccaagtgcttcagatacaagcagagcctgaagtaccacctgagaacccacaccggcgagtag

SEQ ID NO: 26306 - DNA, 1575 bp, Artificial Sequence
  Description of Artificial Sequence: Synthetic coding sequence
atggagaacctgctgaagaacagaaacttctggatcctgagactgccccccggcagcaacggcgaggtgcccaaggtgcccgtgaccttcgacgacgtggccgtgcacttcagcgagcaggagtggggcaacctgagcgagtggcagaaggagctgtacaagaacgtgatgagaggcaactacgagagcctggtgagcatggactacgccatcagcaagcccgacctgatgagccagatggagagaggcgagagacccaccatgcaggagcaggaggacagcgaggagggcgagacccccaccgaccccagcgccgcccacgacggcatcgtgatcaagatcgaggtgcagaccaacgacgagggcagcgagagcctggagacccccgagcccctgatgggccaggtggaggagcacggcttccaggacagcgagctgggcgacccctgcggcgagcagcccgacctggacatgcaggagcccgagaacaccctggaggagagcaccgagggcagcagcgagttcagcgagctgaagcagatgctggtgcagcagagaaactgcaccgagggcatcgtgatcaagaccgaggagcaggacgaggaggaggaggaggaggaggaggacgagctgccccagcacctgcagagcctgggccagctgagcggcagatacgaggccagcatgtaccagacccccctgcccggcgagatgagccccgagggcgaggagagccccccccccctgcagctgggcaaccccgccgtgaagagactggcccccagcgtgcacggcgagagacacctgagcgagaacagaggcgccagcagccagcagcagagaaacagaagaggcgagagacccttcacctgcatggagtgcggcaagagcttcagactgaagatcaacctgatcatccaccagagaaaccacatcaaggagggcccctacgagtgcgccgagtgcgagatcagcttcagacacaagcagcagctgaccctgcaccagagaatccacagagtgagaggcggctgcgtgagccccgagagaggccccaccttcaaccccaagcacgccctgaagcccagacccaagagccccagcagcggcagcggcggcggcggccccaagccctacaagtgccccgagtgcgacagcagcttcagccacaagagcagcctgaccaagcaccagatcacccacaccggcgagagaccctacacctgccccgacgccgccgccagacccggcgccagagccgtgccccccctgggccacagacaggccagagcccagagagccggcagaggcgccccccagcccctgtgcagagagctgcccctgagcagcagacccagcagccagggccacggcggcagcgagaccagaagcctggccgccgccttccccagaggcccccagggcggcggcagaggccccggcgagcccttcagagccgtgaacttcctggacaacaagatggacgagaccaaccagcacggcggcagagacctggccgccggccacagcgagggcagatgcagagcccacctggtgggcgacagaaccctgtag

SEQ ID NO: 26307 - DNA, 984 bp, Artificial Sequence
  Description of Artificial Sequence: Synthetic coding sequence
atgcagagaaacgccatgtacctgaagaacgtggccgagaccgcctgcaacttccagctgacccagtaccagatcagccacgccaaccagaagccctacgagtgccagatctgcggcaagcccttcagaaagagagcccacctgacccagcacaacagaatccacaccggcggcaagccctacgagtgcaaggagtgcggcaaggtgttcatctgctgcagcaccctgatccagcacaagagaacccacaccagcgagaagccctacgagtgcctggagtgcagaaagaccttcagaagaagcgcccacctgatcagacaccagagaatccacaccggcgagaagccctacaagtgcaagcagtgctggaaggccttcgccagcgtgagcgacctgatcgacatcggcaagttcaccctgatgagagacttcaccaacgtgcagaacgtgggcagacacctgaccatcgcccagctgctgttcagcatcagagagttcaccctggtgagaagccccctgaacgtgagaaacgtggccaagcacagcatcatcgcccagcacctgctgaacaccagagagctgatcctgatgagaaacctgatgaacgtgagaaacgtgaagagactgctgggcaaggtgcacatcctgctgaacatcaaggagttcatcctggtgagaaaccacatgagcgtgagcaacgtgggcagactgagcctggtgttcctgatcctgatcgacatcagagagttcaccctggtgaagaaccccatgaacgtgaagaacgtggtggagctgctgaccatcgtgcagctgctgttcaacaccagagagttcaccctggtgagaagactgatgaacatcagcagcgtgggcagattcctgagccccgtgcagcacctgttcaacatcagagagcacatcctgatgaagaacctgatgaacgtgagcaacgccagaagacccagcagcatcatgcacatctag

SEQ ID NO: 26308 - DNA, 1062 bp, Artificial Sequence
  Description of Artificial Sequence: Synthetic coding sequence
atgcagagaaacgccatgtacctgaagaacgtggccgagaccgcctgcaacttccagctgacccagtaccagatcagccacgccaaccagaagccctacgagtgccagatctgcggcaagcccttcagaaagagagcccacctgacccagcacaacagaatccacaccggcggcaagccctacgagtgcaaggagtgcggcaaggtgttcatctgctgcagcaccctgatccagcacaagagaacccacaccagcgagaagccctacgagtgcctggagtgcagaaagaccttcagaagaagcgcccacctgatcagacaccagagaatccacaccggcgagaagccctacaagtgcaagcagtgctggaaggccttcgccagcgtgagcgacctgatcgacatcggcaagttcaccctgatgagagacttcaccaacgtgcagaacgtgggcagacacctgaccatcgcccagctgctgttcagcatcagagagttcaccctggtgagaagccccctgaacgtgagaaacgtggccaagcacagcatcatcgcccagcacctgctgaacaccagagagctgatcctgatgagaaacctgatgaacgtgagaaacgtgaagagactgctgggcaaggtgcacatcctgctgaacatcaaggagttcatcctggtgagaaaccacatgagcgtgagcaacgtgggcagactgagcctggtgttcctgatcctgatcgacatcagagagttcaccctggtgaagaaccccatgaacgtgaagaacgtggtggagctgctgaccatcgtgcagctgctgttcaacaccagagagttcaccctggtgagaagactgatgaacatcagcagcgtgggcagattcctgagccccgtgcagcacctgttcaacatcagagagcacatcctgatgaagaacctgatgaacgtgagcaacgccagaagacccagcagcatcatgcacatcgacatcagagagttcaccgtgggcagaaaccccatgaacgtgatgaacgtgggcatgcccagcttcgtgttcctgatctag

SEQ ID NO: 26309 - DNA, 1122 bp, Artificial Sequence
  Description of Artificial Sequence: Synthetic coding sequence
ctggagtaccagatccccgtgagcttcaaggacgtggtggtgggcttcacccaggaggagtggcacagactgagccccgcccagagagccctgtacagagacgtgatgctggagacctacagcaacctggtgagcgtgggctacgagggcaccaagcccgacgtgatcctgagactggagcaggaggaggccccctggatcggcgaggccgcctgccccggctgccactgctgggaggacatctggagagtgaacatccagagaaagagaagacaggacatgctgctgagacccggcgccgccatcagcaagaagaccctgcccaaggagaagagctgcgagtacaacaagttcggcaagatcagcctgctgagcaccgacctgttcagcagcatccagagccccagcaactggaacccctgcggcaagaacctgaaccacaacctggacctgatcggcttcaagagaaactgcgccaagaagcaggacgagtgctacgcctacggcaagctgctgcagagaatcaaccacggcagaagacccaacggcgagaagcccagaggctgcagccactgcgagaaggccttcacccagaaccccgccctgatgtacaagcccgccgtgagcgacagcctgctgtacaagagaaagagagtgccccccaccgagaagccccacgtgtgcagcgagtgcggcaaggccttctgctacaagagcgagttcatcagacaccagagaagccacaccggcgagaagccctacggctgcaccgactgcggcaaggccttcagccacaagagcaccctgatcaagcaccagagaatccacaccggcgtgagacccttcgagtgcttcttctgcggcaaggccttcacccagaagagccacagaaccgagcaccagagaacccacaccggcgagagacccttcgtgtgcagcgagtgcggcaagagcttcggcgagaagagctacctgaacgtgcacagaaagatgcacaccggcgagagaccctacagatgcagagagtgcggcaagagcttcagccagaagagctgcctgaacaagcactggagaacccacttcggcgagagcagcctgagaagcaagagcagcaacacctag

SEQ ID NO: 26310 - DNA, 1125 bp, Artificial Sequence
  Description of Artificial Sequence: Synthetic coding sequence
atgatcgagtaccagatccccgtgagcttcaaggacgtggtggtgggcttcacccaggaggagtggcacagactgagccccgcccagagagccctgtacagagacgtgatgctggagacctacagcaacctggtgagcgtgggctacgagggcaccaagcccgacgtgatcctgagactggagcaggaggaggccccctggatcggcgaggccgcctgccccggctgccactgctgggaggacatctggagagtgaacatccagagaaagagaagacaggacatgctgctgagacccggcgccgccatcagcaagaagaccctgcccaaggagaagagctgcgagtacaacaagttcggcaagatcagcctgctgagcaccgacctgttcagcagcatccagagccccagcaactggaacccctgcggcaagaacctgaaccacaacctggacctgatcggcttcaagagaaactgcgccaagaagcaggacgagtgctacgcctacggcaagctgctgcagagaatcaaccacggcagaagacccaacggcgagaagcccagaggctgcagccactgcgagaaggccttcacccagaaccccgccctgatgtacaagcccgccgtgagcgacagcctgctgtacaagagaaagagagtgccccccaccgagaagccccacgtgtgcagcgagtgcggcaaggccttctgctacaagagcgagttcatcagacaccagagaagccacaccggcgagaagccctacggctgcaccgactgcggcaaggccttcagccacaagagcaccctgatcaagcaccagagaatccacaccggcgtgagacccttcgagtgcttcttctgcggcaaggccttcacccagaagagccacagaaccgagcaccagagaacccacaccggcgagagacccttcgtgtgcagcgagtgcggcaagagcttcggcgagaagagctacctgaacgtgcacagaaagatgcacaccggcgagagaccctacagatgcagagagtgcggcaagagcttcagccagaagagctgcctgaacaagcactggagaacccacaccggcgagagcctggagcccagaagacagagactgcagtag

SEQ ID NO: 26311 - DNA, 1221 bp, Artificial Sequence
  Description of Artificial Sequence: Synthetic coding sequence
atgatcgagtaccagatccccgtgagcttcaaggacgtggtggtgggcttcacccaggaggagtggcacagactgagccccgcccagagagccctgtacagagacgtgatgctggagacctacagcaacctggtgagcgtgggctacgagggcaccaagcccgacgtgatcctgagactggagcaggaggaggccccctggatcggcgaggccgcctgccccggctgccactgctgggaggacatctggagagtgaacatccagagaaagagaagacaggacatgctgctgagacccggcgccgccatcagcaagaagaccctgcccaaggagaagagctgcgagtacaacaagttcggcaagatcagcctgctgagcaccgacctgttcagcagcatccagagccccagcaactggaacccctgcggcaagaacctgaaccacaacctggacctgatcggcttcaagagaaactgcgccaagaagcaggacgagtgctacgcctacggcaagctgctgcagagaatcaaccacggcagaagacccaacggcgagaagcccagaggctgcagccactgcgagaaggccttcacccagaaccccgccctgatgtacaagcccgccgtgagcgacagcctgctgtacaagagaaagagagtgccccccaccgagaagccccacgtgtgcagcgagtgcggcaaggccttctgctacaagagcgagttcatcagacaccagagaagccacaccggcgagaagccctacggctgcaccgactgcggcaaggccttcagccacaagagcaccctgatcaagcaccagagaatccacaccggcgtgagacccttcgagtgcttcttctgcggcaaggccttcacccagaagagccacagaaccgagcaccagagaacccacaccggcgagagacccttcgtgtgcagcgagtgcggcaagagcttcggcgagaagagctacctgaacgtgcacagaaagatgcacaccggcgagagaccctacagatgcagagagtgcggcaagagcttcagccagaagagctgcctgaacaagcactggagaacccacaccggcgagaagccctacggctgcaacgagtgcggcaaggccttctaccagaagcccaacctgagcagacaccagaagatccacgccagaaagaacgcctacagaaacgagaacctgatcatcgtgggcaacacctag

SEQ ID NO: 26312 - DNA, 1221 bp, Artificial Sequence; identical to SEQ ID NO: 26311
  Description of Artificial Sequence: Synthetic coding sequence

SEQ ID NO: 26313 - DNA, 4050 bp, Artificial Sequence
  Description of Artificial Sequence: Synthetic coding sequence
atggcctgctacctggtgatcagcagcagacacctgagcaacggccactacagaggcatcaagggcgtgttcagaggccccctgtgcaagaacggcagccccagccccgacttcgccgagaagaagagcaccgccaaggccctggaggacgtgaaggccaacttctactgcgagctgtgcgacaagcagtaccacaagcaccaggagttcgacaaccacatcaacagctacgaccacgcccacaagcagagactgaaggagctgaagcagagagagttcgccagaaacgtggccagcaagagctggaaggacgagaagaagcaggagaaggccctgaagagactgcaccagctggccgagctgagacagcagagcgagtgcgtgagcggcaacggccccgcctacaaggcccccagagtggccatcgagaagcagctgcagcagggcatcttccccatcaagaacggcagaaaggtgagctgcatgaagagcgccctgctgctgaagggcaagaacctgcccagaatcatcagcgacaagcagagaagcaccatgcccaacagacaccagctgcagagcgacagaagatgcctgttcggcaaccaggtgctgcagaccagcagcgacctgagcaacgccaaccacagaaccggcgtgagcttcaccttcagcaagaaggtgcacctgaagctggagagcagcgccagcgtgttcagcgagaacaccgaggagacccacgactgcaacaagagccccatctacaagaccaagcagaccgccgacaagtgcaagtgctgcagattcgccaacaaggacacccacctgaccaaggagaaggaggtgaacatcagccccagccacctggagagcgtgctgcacaacaccatcagcatcaacagcaagatcctgcaggacaagcacgacagcatcgacgagaccctggaggacagcatcggcatccacgccagcttcagcaagagcaacatccacctgagcgacgtggacttcacccccaccagcagagagaaggagaccagaaacaccctgaagaacaccctggagaactgcgtgaaccacccctgccaggccaacgccagcttcagcccccccaacatctacaaccacagcgacgccagaatcagcgagtgcctggacgagttcagcagcctggagcccagcgagcagaagagcaccgtgcacctgaaccccaacagcagaatcgagaacagagagaagagcctggacaagaccgagagagtgagcaagaacgtgcagagactggtgaaggaggcctgcacccacaacgtggccagcaagcccctgcccttcctgcacgtgcagagcaaggacggccacaccaccctgcagtggcccaccgagctgctgctgttcaccaagaccgagccctgcatcagctacggctgcaaccccctgtacttcgacttcaagctgagcagaaacaccaaggaggaccacaacctggaggacctgaagaccgagctgggcaagaagcccctggagctgaagaccaagagagagagccaggtgagcggcctgaccgaggaccagcagaagctgatccaggaggactaccagtaccccaagcccaagaccatgatcgccaaccccgactgggagaagttccagagaaagtacaacctggactacagcgacagcgagcccaacaagagcgagtacaccttcagcgccaacgacctggagatgaagaaccccaaggtgcccctgtacctgaacaccagcctgaaggactgcgccggcaagaacaacagcagcgagaacaagctgaaggaggccagcagagcccactggcagggctgcagaaaggccgtgctgaacgacatcgacgaggacctgagcttccccagctacatcagcagattcaagaagcacaagctgatcccctgcagcccccacctggagttcgaggacgagagacagttcaactgcaagagcagcccctgcaccgtgggcggccacagcgaccacggcaaggacttcagcgtgatcctgaagagcaaccacatcagcatgaccagcaaggtgagcggctgcggcaaccagagatacaagagatacagcccccagagctgcctgagcagatacagcagcagcctggacaccagccccagcagcatgagcagcctgagaagcacctgcagcagccacagattcaacggcaacagcagaggcaacctgctgtgcttccacaagagagagcaccacagcgtggagagacacaagagaaagtgcctgaagcacaactgcttctacctgagcgacgacatcaccaagagcagccagatgcagagcgagccccagaaggagagaaactgcaagctgtgggagagcttcaagaacgagaagtacagcaagagaagatactgccactgcagagagagacagaagctgggcaagaaccagcagcagttcagcggcctgaagagcaccagaatcatctactgcgacagcaacagccagatcagctgcaccggcagcagcaagaagccccccaactgccagggcacccagcacgacagactggacagctacagcatcgagaagatgtactacctgaacaagagcaagagaaaccaggagagcctgggcagcccccacatctgcgacctgggcaaggtgagacccatgaagtgcaacagcggcaacatcagctgcctgctgaagaactgcagcagcggccccagcgagaccaccgagagcaacaccgccgagggcgagagaacccccctgaccgccaagatcctgctggagagagtgcaggccaagaagtgccaggagcagagcagcaacgtggagatcagcagcaacagctgcaagagcgagctggaggcccccagccaggtgccctgcaccatccagctggcccccagcggctgcaacagacaggccctgcccctgagcgagaagatccagtacgccagcgagagcagaaacgaccaggacagcgccatccccagaaccaccgagaaggacaagagcaagagcagccacaccaacaacttcaccatcctggccgacaccgactgcgacaaccacctgagcaagggcatcatccacctggtgaccgagagccagagcctgaacatcaagagagacgccaccaccaaggagcagagcaagcccctgatcagcgagatccagcccttcatccagagctgcgaccccgtgcccaacgagttccccggcgccttccccagcaacaagtacaccggcgtgaccgacagcaccgagacccaggaggaccagatcaacctggacctgcaggacgtgagcatgcacatcaaccacgtggagggcaacatcaacagctactacgacagaaccatgcagaagcccgacaaggtggaggacggcctggagatgtgccacaagagcatcagcccccccctgatccagcagcccatcaccttcagccccgacgagatcgacaagtacaagatcctgcagctgcaggcccagcagcacatgcagaagcagctgctgagcaagcacctgagagtgctgcccgccgccggccccaccgccttcagccccgccagcaccgtgcagaccgtgcccgtgcaccagcacaccagcatcaccaccatccaccacaccttcctgcagcacttcgccgtgagcgccagcctgagcagccacagcagccacctgcccatcgcccacctgcaccccctgagccaggcccacttcagccccatcagcttcagcaccctgacccccaccatcatccccgcccaccccaccttcctggccggccaccccctgcacctggtggccgccacccccttccaccccagccacatcaccctgcagcccctgccccccaccgccttcatccccaccctgttcggcccccacctgaaccccgccaccaccagcatcatccacctgaaccccctgatccagcccgtgttccagggccaggacttctgccaccacagctgcagcagccagatgcagcagctgaacgaggtgaaggaggccctgaacgtgagcacccacctgaactag

SEQ ID NO: 26314 - DNA, 1986 bp, Artificial Sequence
  Description of Artificial Sequence: Synthetic coding sequence
atgcccgccaacgaggacgccccccagcccggcgagcacggcagcgcctgcgaggtgagcgtgagcttcgaggacgtgaccgtggacttcagcagagaggagtggcagcagctggacagcacccagagaagactgtaccaggacgtgatgctggagaactacagccacctgctgagcgtgggcttcgaggtgcccaagcccgaggtgatcttcaagctggagcagggcgagggcccctggaccctggagggcgaggccccccaccagagctgcagcgacggcaagttcggcatcaagcccagccagagaagaatcagcggcaagagcaccttccacagcgagatggagggcgaggacaccagagacgacagcctgtacagcatcctggaggagctgtggcaggacgccgagcagatcaagagatgccaggagaagcacaacaagctgctgagcagaaccaccttcctgaacaagaagatcctgaacaccgagtgggactacgagtacaaggacttcggcaagttcgtgcaccccagccccaacctgatcctgagccagaagagaccccacaagagagacagcttcggcaagagcttcaagcacaacctggacctgcacatccacaacaagagcaacgccgccaagaacctggacaagaccatcggccacggccaggtgttcacccagaacagcagctacagccaccacgagaacacccacaccggcgtgaagttctgcgagagaaaccagtgcggcaaggtgctgagcctgaagcacagcctgagccagaacgtgaagttccccatcggcgagaaggccaacacctgcaccgagttcggcaagatcttcacccagagaagccacttcttcgccccccagaagatccacaccgtggagaagccccacgagctgagcaagtgcgtgaacgtgttcacccagaagcccctgctgagcatctacctgagagtgcacagagacgagaagctgtacatctgcaccaagtgcggcaaggccttcatccagaacagcgagctgatcatgcacgagaagacccacaccagagagaagccctacaagtgcaacgagtgcggcaagagcttcttccaggtgagcagcctgctgagacaccagaccacccacaccggcgagaagctgttcgagtgcagcgagtgcggcaagggcttcagcctgaacagcgccctgaacatccaccagaagatccacaccggcgagagacaccacaagtgcagcgagtgcggcaaggccttcacccagaagagcaccctgagaatgcaccagagaatccacaccggcgagagaagctacatctgcacccagtgcggccaggccttcatccagaaggcccacctgatcgcccaccagagaatccacaccggcgagaagccctacgagtgcagcgactgcggcaagagcttccccagcaagagccagctgcagatgcacaagagaatccacaccggcgagaagccctacatctgcaccgagtgcggcaaggccttcaccaacagaagcaacctgaacacccaccagaagagccacaccggcgagaagagctacatctgcgccgagtgcggcaaggccttcaccgacagaagcaacttcaacaagcaccagaccatccacaccggcgagaagccctacgtgtgcgccgactgcggcagagccttcatccagaagagcgagctgatcacccaccagagaatccacaccaccgagaagccctacaagtgccccgactgcgagaagagcttcagcaagaagccccacctgaaggtgcaccagagaatccacaccggcgagaagccctacatctgcgccgagtgcggcaaggccttcaccgacagaagcaacttcaacaagcaccagaccatccacaccggcgacaagccctacaagtgcagcgactgcggcaagggcttcacccagaagagcgtgctgagcatgcacagaaacatccacacctag

SEQ ID NO: 26315 - DNA, 1365 bp, Artificial Sequence
  Description of Artificial Sequence: Synthetic coding sequence
atggccgtgaccgacctgagccacggcttcttccccagagagcccatctgccccttcgaggagaagaccaagatcggcaccatggtggaggactacctggccaacagctaccaggacagcgtgaccttcgacgacgtggccgtggagttcacccccgaggagtgggccctgctggacaccaccgagaagtgcctgtacagagacgtgatgctggagaactacgtgaacctggccagcgtggaggccaccgtggacggcaacagcgagaactgcggcgaggtgttcagcgagtggttctgcctgaagacccacatgagagcccagaacggcggcaacatcttcgagggcaactgctacggcaaggacatcctgagcgtgcacaaggaggccagcatcggccaggagctgagcaagttcaacccctgcggcaaggtgttcaccctgacccccgacctggccgcccacctgggcatcctgaacgccagacagccctacaagtgcaaggagtgcagaaagggcttcaagtacttcgccagcctggacaaccacatgggcatccacatcggcgagaagttctgcgagttccaggagtgcagaagagccatcacccacagcagccacctgaagcagtgcgtgaccgtgcacaccggcaagaagagcaagaagaccaagaagcacggcaagagcttcaccaacttcagccagctgagcgcccacgtgaagatccacaagggcgagaagagcttcgagtgcaaggagtgcggcagaagcttcagaaacagcagcagcttcaacgtgcacatccagatccacaccggcatcaagccccacaagtacaccgagtgcggcaaggccttcaccagaagcacccacctgacccagcacgtgagaacccacaccggcatcaagccctacgagtgcaaggagtgcggccaggccttcacccagtacaccggcctggccatccacatcagaaaccacaccggcgagaagcactaccagtgcaaggagtgcggcaaggccttcaacggcagcagcaccctgacccagcacaagatcatccacaccggcgagaagccctacggctgcgtggagtgcggcaagaccttcatcaccagcagctacagaagcaagcacctgaagacccaccacgaggagagacccttcgtgtgcaagatctgcggcaaggccttcctgtacagcagccccctgaacgtgcacctgcagacccacaccagagagaaggccctgatctgcaaggagtgcggcaaggccttcgccgtgagcagccacctgagcagacacgagagaatccacaccggcgaggagccctacgagtacaagggcatgaacgtgaccatctag

SEQ ID NO: 26316 - DNA, 1734 bp, Artificial Sequence
  Description of Artificial Sequence: Synthetic coding sequence
atggccgccgccgccaccctgagactgagcgcccagggcaccgtgaccttcgaggacgtggccgtgaacttcacctgggaggagtggaacctgctgagcgaggcccagagatgcctgtacagagacgtgaccctggagaacctggccctgatcagcagcctgggctgctggtgcggcgtggaggacgaggccgcccccagcaagcagagcatctacatccagagagagacccaggtgagaacccccatggccggcgtgagccccaagaaggcccacccctgcgagatgtgcggccccatcctgggcgacatcctgcacgtggccgaccaccagggcacccaccacaagcagaagctgcacagatgcgaggcctggggcaacaagctgtacgacagcggcaacttccaccagcaccagaacgagcacatcggcgagaagccctacagaggcagcgtggaggaggccctgttcgccaagagatgcaagctgcacgtgagcggcgagagcagcgtgttcagcgagagcggcaaggacttcctgcccagaagcggcctgctgcagcaggaggccagccacaccggcgagaagagcaacagcaagaccgagtgcgtgagccccatccagtgcggcggcgcccactacagctgcggcgagagcatgaagcacttcagcaccaagcacatcctgagccagcaccagagactgctgaccagagaggagtgctacgtgtgctgcgagtgcggcaagagcttcagcaagtacgccagcttcagcaaccaccagagagtgcacaccgacaagaagcactacgagtgcggcgagtgcggcaagagcttcagccagaagagcagcctgatccagcaccagagattccacaccggcgagaagccctacggctgcgaggagtgcggcaagagcttcagccacaagagaagcctggtgcaccaccagagagtgcacagcggcgagagaccctaccagtgcggcgagtgcggcaagagcttcagccagaagggcaacctggtgctgcaccagagagtgcacaccggcgccagaccctacgagtgcggcgagtgcggcaagagcttcagccacaagagaagcctggtgcaccaccagagaatgcacaccggcgagagaccctacaagtgcggcgactgcggcaagagcttcaacgagaagggccacctgagaaaccaccagagagtgcacaccaccgagagacccttcaagtgcggcgagtgcggcaagtgcttcagccacaagggcaacctgatcctgcaccagcacggccacaccggcgagagaccctacgtgtgcagagagtgcggcaagctgttcaagaagaagagccacctgctggtgcaccagagaatccacaacggcgagaagccctacgcctgcgaggcctgccagaagttcttcagaaacaacagcaccttctgcgtgcacaagagaatccacaccggcgagaagccctacgagtgcagcgagtgcggcaagagcttcgccgagagcagcagcttcaccaagcacaagagagtgcacaccggcgagaagccctacgagtgcagcgagtgcggcaagagcttcgccgagagcagcagcctgaccaagcacaagagagtgcacaccggcgagaagccctacaagtgcgagaagtgcggcaagctgttcaacaagaagagccacctgctggtgcaccagagcagccactggagaaaggccatctag

SEQ ID NO: 26317 - DNA, 2568 bp, Artificial Sequence
  Description of Artificial Sequence: Synthetic coding sequence
atggccgccgccgccaccctgagactgagcgcccagggcaccgtgaccttcgaggacgtggccgtgaacttcacctgggaggagtggaacctgctgagcgaggcccagagatgcctgtacagagacgtgaccctggagaacctggccctgatcagcagcctgggctgctggtgcggcgtggaggacgaggccgcccccagcaagcagagcatctacatccagagagagacccaggtgagaacccccatggccggcgtgagccccaagaaggcccacccctgcgagatgtgcggccccatcctgggcgacatcctgcacgtggccgaccaccagggcacccaccacaagcagaagctgcacagatgcgaggcctggggcaacaagctgtacgacagcggcaacttccaccagcaccagaacgagcacatcggcgagaagccctacagaggcagcgtggaggaggccctgttcgccaagagatgcaagctgcacgtgagcggcgagagcagcgtgttcagcgagagcggcaaggacttcctgcccagaagcggcctgctgcagcaggaggccagccacaccggcgagaagagcaacagcaagaccgagtgcgtgagccccatccagtgcggcggcgcccactacagctgcggcgagagcatgaagcacttcagcaccaagcacatcctgagccagcaccagagactgctgaccagagaggagtgctacgtgtgctgcgagtgcggcaagagcttcagcaagtacgccagcctgagcaaccaccagagagtgcacaccgagaagaagcacgagtgcggcgagtgcggcaagagcttcagcaagtacgtgagcttcagcaaccaccagagagtgcacaccgagaagaagcacgagtgcggcgagtgcggcaagagcttcagcaagtacgtgagcttcagcaaccaccagagagtgcacaccggcaagagaccctacgagtgcggcgagtgcggcaagagcttcagcaagtacgccagcttcagcaaccaccagagagtgcacaccgagaagaagcactacgagtgcggcgagtgcggcaagagcttcagcaagtacgtgagcttcagcaaccaccagagagtgcacaccggcaagagaccctacgagtgcggcgagtgcggcaagagcttcagcaagtacgccagcttcagcaaccaccagagagtgcacaccgacaagaagcactacgagtgcggcgagtgcggcaagagcttcagccagaagagcagcctgatccagcaccagagattccacaccggcgagaagccctacggctgcgaggagtgcggcaagagcttcagcagcgagggccacctgagaagccaccagagagtgcacgccggcgagagacccttcaagtgcggcgagtgcgtgaagagcttcagccacaagagaagcctggtgcaccaccagagagtgcacagcggcgagagaccctaccagtgcggcgagtgcggcaagagcttcagccagaagggcaacctggtgctgcaccagagagtgcacaccggcgccagaccctacgagtgcggcgagtgcggcaagagcttcagcagcaagggccacctgagaaaccaccagcagatccacaccggcgacagactgtacgagtgcggcgagtgcggcaagagcttcagccacaagggcaccctgatcctgcaccagagagtgcaccccagagagagaagctacggctgcggcgagtgcggcaagagcttcagcagcatcggccacctgagaagccaccagagagtgcacaccggcgagagaccctacgagtgcggcgagtgcggcaagagcttcagccacaagagaagcctggtgcaccaccagagaatgcacaccggcgagagaccctacaagtgcggcgactgcggcaagagcttcaacgagaagggccacctgagaaaccaccagagagtgcacaccaccgagagacccttcaagtgcggcgagtgcggcaagtgcttcagccacaagggcaacctgatcctgcaccagcacggccacaccggcgagagaccctacgtgtgcagagagtgcggcaagctgttcaagaagaagagccacctgctggtgcaccagagaatccacaacggcgagaagccctacgcctgcgaggcctgccagaagttcttcagaaacaagtaccagctgatcgcccaccagagagtgcacaccggcgagagaccctacgagtgcaacgactgcggcaagagcttcacccacagcagcaccttctgcgtgcacaagagaatccacaccggcgagaagccctacgagtgcagcgagtgcggcaagagcttcgccgagagcagcagcttcaccaagcacaagagagtgcacaccggcgagaagccctacgagtgcagcgagtgcggcaagagcttcgccgagagcagcagcctgaccaagcacaagagagtgcacaccggcgagaagccctacaagtgcgagaagtgcggcaagctgttcaacaagaagagccacctgctggtgcaccagagcagccactggagaaaggccatctag

SEQ ID NO: 26318 - DNA, 1113 bp, Artificial Sequence
  Description of Artificial Sequence: Synthetic coding sequence
atgagcagaagaaagcagaccaaccccaacaaggtgcactgcgacagcgagggcgacgaggaggagaccacccaggacgaggtgagcagccacaccagcgaggaggacggcggcgtggtgaaggtggagaaggagctggagaacaccgagcagcccgtgggcggcaacgaggtggtggagcacgaggtgaccggcaacctgaacagcgaccccctgctggagctgtgccagtgccccctgtgccagctggactgcggcagcagagagcagctgatcgcccacgtgtaccagcacaccgccgccgtggtgagcgccaagagctacatgtgccccgtgtgcggcagagccctgagcagccccggcagcctgggcagacacctgctgatccacagcgaggaccagagaagcaactgcgccgtgtgcggcgccagattcaccagccacgccaccttcaacagcgagaagctgcccgaggtgctgaacatggagagcctgcccaccgtgcacaacgagggccccagcagcgccgagggcaaggacatcgccttcagcccccccgtgtaccccgccggcatcctgctggtgtgcaacaactgcgccgcctacagaaagctgctggaggcccagacccccagcgtgagaaagtgggccctgagaagacagaacgagcccctggaggtgagactgcagagactggagagagagagaaccgccaagaagagcagaagagacaacgagacccccgaggagagagaggtgagaagaatgagagacagagaggccaagagactgcagagaatgcaggagaccgacgagcagagagccagaagactgcagagagacagagaggccatgagactgaagagagccaacgagacccccgagaagagacaggccagactgatcagagagagagaggccaagagactgaagagaagactggagaagatggacatgatgctgagagcccagttcggccaggaccccagcgccatggccgccctggccgccgagatgaacttcttccagctgcccgtgagcggcgtggagctggacagccagctgctgggcaagatggccttcgaggagcagaacagcagcagcctgcactag

SEQ ID NO: 26319 - DNA, 1239 bp, Artificial Sequence
  Description of Artificial Sequence: Synthetic coding sequence
atgagcagaagaaagcagaccaaccccaacaaggtgcactgggaccaggtgttcgccggcctggaggagcaggccagacaggccatgatgaagaccgacttccccggcgacctgggcagccagagacaggccatccagcagctgagagaccaggacagcagcagcagcgacagcgagggcgacgaggaggagaccacccaggacgaggtgagcagccacaccagcgaggaggacggcggcgtggtgaaggtggagaaggagctggagaacaccgagcagcccgtgggcggcaacgaggtggtggagcacgaggtgaccggcaacctgaacagcgaccccctgctggagctgtgccagtgccccctgtgccagctggactgcggcagcagagagcagctgatcgcccacgtgtaccagcacaccgccgccgtggtgagcgccaagagctacatgtgccccgtgtgcggcagagccctgagcagccccggcagcctgggcagacacctgctgatccacagcgaggaccagagaagcaactgcgccgtgtgcggcgccagattcaccagccacgccaccttcaacagcgagaagctgcccgaggtgctgaacatggagagcctgcccaccgtgcacaacgagggccccagcagcgccgagggcaaggacatcgccttcagcccccccgtgtaccccgccggcatcctgctggtgtgcaacaactgcgccgcctacagaaagctgctggaggcccagacccccagcgtgagaaagtgggccctgagaagacagaacgagcccctggaggtgagactgcagagactggagagagagagaaccgccaagaagagcagaagagacaacgagacccccgaggagagagaggtgagaagaatgagagacagagaggccaagagactgcagagaatgcaggagaccgacgagcagagagccagaagactgcagagagacagagaggccatgagactgaagagagccaacgagacccccgagaagagacaggccagactgatcagagagagagaggccaagagactgaagagaagactggagaagatggacatgatgctgagagcccagttcggccaggaccccagcgccatggccgccctggccgccgagatgaacttcttccagctgcccgtgagcggcgtggagctggacagccagctgctgggcaagatggccttcgaggagcagaacagcagcagcctgcactag

SEQ ID NO: 26320 - DNA, 1113 bp, Artificial Sequence; identical to SEQ ID NO: 26318
  Description of Artificial Sequence: Synthetic coding sequence

SEQ ID NO: 26321 - DNA, 417 bp, Artificial Sequence
  Description of Artificial Sequence: Synthetic coding sequence
atgagcagaagaaagcagaccaaccccaacaaggtgcactgggaccaggtgttcgccggcctggaggagcaggccagacaggccatgatgaagaccgacttccccggcgacctgggcagccagagacaggccatccagcagctgagagaccaggacagcagcagcagcgacagcgagggcgacgaggaggagaccacccaggacgaggtgagcagccacaccagcgaggaggacggcggcgtggtgaaggtggagaaggagctggagaacaccgagcagcccgtgggcggcaacgaggtggtggagcacgaggccagaaacctgaacagcgaccccctgctggagctgtgccagtgccccctgtgccagctggactgcggcagcagagagcagctgatcgcccacgtgtaccagtag

SEQ ID NO: 26322 - DNA, 1239 bp, Artificial Sequence; identical to SEQ ID NO: 26319
  Description of Artificial Sequence: Synthetic coding sequence

SEQ ID NO: 26323 - DNA, 1680 bp, Artificial Sequence
  Description of Artificial Sequence: Synthetic coding sequence
gtgcccggcagccagtgcgaccccgagaagagatgcgagatcaagaccgccgcccagggcagcagaatggagggcctgctgagcgtggccctgcagggcgccgagctggagggcaactggaagcacgagggccaggtggaggacctgcaggagaaccaggagagctgccccgagcccgaggccgtggcctgcaagggcgaccccgccggcgacagcatgcaggagagagacgagttcagcagaatccccagaaccatcagcagccccgccgccacccaggccagcgtgcccgacgacagcagcagcagaagatgcagcgcccccggcgagagccccaaggagagacaccccgacagcagacagagagagagaggcggcggccccaagaagccctggaagtgcggcgactgcggcaaggccttcagctactgcagcgccttcatcctgcaccagagaatccacaccggcgagaagcccttcgcctgccccgagtgcggcaaggccttcagccagagcgtgcacctgaccctgcaccagagaacccacaccggcgagaagccctacgcctgccacgagtgcggcaaggccttcagccagggcagctacctggccagccactggagaacccacaccggcgagaagccccacagatgcgccgactgcggcaaggccttcaccagagtgacccacctgacccagcacagaagagtgcacaccggcgagagaccctacgcctgcgcccagtgcgccaaggccttcagaaacagaagcagcctgatcgagcaccagagaatccacaccggcgagaagccctacgagtgcagcgcctgcgccaaggccttcagattcagcagcgccctgatcagacaccagagaatccacaccgaggagaagccctacagatgcggccagtgcgccaaggccttcgcccagatcgcccacctgacccagcacagaagagtgcacaccggcgagaagccctacacctgccaggactgcggcgccctgttcagccagagcgccagcctggccgagcacagaagaatccacaccggcgagaagccctacgcctgcggccagtgcgccaaggccttcacccaggtgagccacctgacccagcaccagagaacccacaccggcgagagaccctacccctgccacgactgcggcaagagattcagcaacagaagccacctgctgcagcacagactggtgcacaccggcgagagaccctacagatgcctgcagtgcggcgccgccttcagccacgtgagcagcctgatcgagcaccagaagatccacaccggcgagagaccctacaagtgcggcgagtgcggcaaggccttcagccagggcagcagcctggccctgcaccagagaacccacaccggcgagagaccctacacctgccccgagtgcggcaaggccttcagcaacagaagctacctgatccagcaccacatcgtgcacaccggcgagaagccctacgagtgcagcggctgcggcaaggccttcagcttcagcagcgccctgatcagacaccagagaacccacgccgacagcagcggcagactgtgccccgcccccacccccgacagcacccccggcctgagccagggcggcgagacctgccagcagggctgccccggcagaaaccccagaggccccgccgaggactag

SEQ ID NO: 26324 - DNA, 1614 bp, Artificial Sequence
  Description of Artificial Sequence: Synthetic coding sequence
atggagggcctgctgagcgtggccctgcagggcgccgagctggagggcaactggaagcacgagggccaggtggaggacctgcaggagaaccaggagagctgccccgagcccgaggccgtggcctgcaagggcgaccccgccggcgacagcatgcaggagagagacgagttcagcagaatccccagaaccatcagcagccccgccgccacccaggccagcgtgcccgacgacagcagcagcagaagatgcagcgcccccggcgagagccccaaggagagacaccccgacagcagacagagagagagaggcggcggccccaagaagccctggaagtgcggcgactgcggcaaggccttcagctactgcagcgccttcatcctgcaccagagaatccacaccggcgagaagcccttcgcctgccccgagtgcggcaaggccttcagccagagcgtgcacctgaccctgcaccagagaacccacaccggcgagaagccctacgcctgccacgagtgcggcaaggccttcagccagggcagctacctggccagccactggagaacccacaccggcgagaagccccacagatgcgccgactgcggcaaggccttcaccagagtgacccacctgacccagcacagaagagtgcacaccggcgagagaccctacgcctgcgcccagtgcgccaaggccttcagaaacagaagcagcctgatcgagcaccagagaatccacaccggcgagaagccctacgagtgcagcgcctgcgccaaggccttcagattcagcagcgccctgatcagacaccagagaatccacaccgaggagaagccctacagatgcggccagtgcgccaaggccttcgcccagatcgcccacctgacccagcacagaagagtgcacaccggcgagaagccctacacctgccaggactgcggcgccctgttcagccagagcgccagcctggccgagcacagaagaatccacaccggcgagaagccctacgcctgcggccagtgcgccaaggccttcacccaggtgagccacctgacccagcaccagagaacccacaccggcgagagaccctacccctgccacgactgcggcaagagattcagcaacagaagccacctgctgcagcacagactggtgcacaccggcgagagaccctacagatgcctgcagtgcggcgccgccttcagccacgtgagcagcctgatcgagcaccagaagatccacaccggcgagagaccctacaagtgcggcgagtgcggcaaggccttcagccagggcagcagcctggccctgcaccagagaacccacaccggcgagagaccctacacctgccccgagtgcggcaaggccttcagcaacagaagctacctgatccagcaccacatcgtgcacaccggcgagaagccctacgagtgcagcggctgcggcaaggccttcagcttcagcagcgccctgatcagacaccagagaacccacgccgacagcagcggcagactgtgccccgcccccacccccgacagcacccccggcctgagccagggcggcgagacctgccagcagggctgccccggcagaaaccccagaggccccgccgaggactag

SEQ ID NO: 26325 - DNA, 2442 bp, Artificial Sequence
  Description of Artificial Sequence: Synthetic coding sequence
atgctgctgcccaccaccatccagccccagaccgccagaaagagccagctgcccagaggcaacagctgcctggtgggcctgcacatcgccagcccccagctgctgagagtgcagcccctggtgagaaccgagccccagagctgcttcctgagcgacctgtgccagccccccgcccagggcttcgtgcagagacccctgcccgccctgcaggtggtgcccgccaagagagtgcccgcccccaaggcccccgacgagcagggcagcatgctgacccccctgagcgccagcgaccccctggccgtgaccagcctgagcagcagcagcgcccaccccttcatcagcaacctgcacaccagacacaccgagaagctgaagaagagcctgaaggtgaagaccagaagcggcagagtgagcagaccccccaagtacaaggccaaggactacaagttcatcaagaccgaggacctggccgacggccacctgagcgacagcgacgactacagcgagctgtgcgtggaggaggacgaggaccagagagagagacacgccctgttcgacctgagcagctgcagcctgagacccaagagcttcaagtgccagacctgcgagaagagctacatcggcaagggcggcctggccagacacttcaagctgaaccccggccacggccagctggaccccgagatggtgctgagcgagaaggccagcggcagcaccctgagaggctgcaccgaggagagaaccctgagcctgaccagcctgggcctgagcatgcccgccgacccctgcgagggcggcgccagaagctgcctggtgaccgagagcgccagaggcggcctgcagaacggccagagcgtggacgtggaggagaccctgcccagcgagcccgagaacggcgccctgctgagaagcgagagataccagggccccagaagaagagcctgcagcgagaccctggccgagagcagaaccgccgtgctgcagcagagaagagccgcccagctgcccggcggccccgccgccgccggcgagcagagagccagccccagcaaggccagactgaaggagttcctgcagcagtgcgacagagaggacctggtggagctggccctgccccagctggcccaggtggtgaccgtgtacgagttcctgctgatgaaggtggagaaggaccacctggccaagcccttcttccccgccatctacaaggagttcgaggagctgcacaagatggtgaagaagatgtgccaggactacctgagcagcagcggcctgtgcagccaggagaccctggagatcaacaacgacaaggtggccgagagcctgggcatcaccgagttcctgagaaagaaggagatccaccccgacaacctgggccccaagcacctgagcagagacatggacggcgagcagctggagggcgccagcagcgagaagagagagagagaggccgccgaggagggcctggccagcgtgaagagacccagaagagaggccctgagcaacgacaccaccgagagcctggccgccaacagcagaggcagagagaagcccagacccctgcacgccctggccgccggcgagggcttcagcccccccgtgaacgtgaccgtgagccccagaagcgaggagagccacaccaccaccgtgagcggcggcaacggcagcgtgttccaggccggcccccagctgcaggccctggccaacctggaggccagaagaggcagcatcggcgccgccctgagcagcagagacgtgagcggcctgcccgtgtacgcccagagcggcgagcccagaagactgacccaggcccaggtggccgccttccccggcgagaacgccctggagcacagcagcgaccaggacacctgggacagcctgagaagccccggcttctgcagccccctgagcagcggcggcggcgccgagagcctgccccccggcggccccggccacgccgaggccggccacctgggcaaggtgtgcgacttccacctgaaccaccagcagcccagccccaccagcgtgctgcccaccgaggtggccgccccccccctggagaagatcctgagcgtggacagcgtggccgtggactgcgcctacagaaccgtgcccaagcccggcccccagcccggcccccacggcagcctgctgaccgagggctgcctgagaagcctgagcggcgacctgaacagattcccctgcggcatggaggtgcacagcggccagagagagctggagagcgtggtggccgtgggcgaggccatggccttcgagatcagcaacggcagccacgagctgctgagccagggccagaagcagatcttcatccagaccagcgacggcctgatcctgagcccccccggcaccatcgtgagccaggaggaggacatcgtgaccgtgaccgacgccgagggcagagcctgcggctgggccagatag

SEQ ID NO: 26326 - DNA, 1368 bp, Artificial Sequence
  Description of Artificial Sequence: Synthetic coding sequence
atgcccgccgacccctgcgagggcggcgccagaagctgcctggtgaccgagagcgccagaggcggcctgcagttcctgcagcagtgcgacagagaggacctggtggagctggccctgccccagctggcccaggtggtgaccgtgtacgagttcctgctgatgaaggtggagaaggaccacctggccaagcccttcttccccgccatctacaaggagttcgaggagctgcacaagatggtgaagaagatgtgccaggactacctgagcagcagcggcctgtgcagccaggagaccctggagatcaacaacgacaaggtggccgagagcctgggcatcaccgagttcctgagaaagaaggagatccaccccgacaacctgggccccaagcacctgagcagagacatggacggcgagcagctggagggcgccagcagcgagaagagagagagagaggccgccgaggagggcctggccagcgtgaagagacccagaagagaggccctgagcaacgacaccaccgagagcctggccgccaacagcagaggcagagagaagcccagacccctgcacgccctggccgccggcttcagcccccccgtgaacgtgaccgtgagccccagaagcgaggagagccacaccaccaccgtgagcggcggcaacggcagcgtgttccaggccggcccccagctgcaggccctggccaacctggaggccagaagaggcagcatcggcgccgccctgagcagcagagacgtgagcggcctgcccgtgtacgcccagagcggcgagcccagaagactgacccaggcccaggtggccgccttccccggcgagaacgccctggagcacagcagcgaccaggacacctgggacagcctgagaagccccggcttctgcagccccctgagcagcggcggcggcgccgagagcctgccccccggcggccccggccacgccgaggccggccacctgggcaaggtgtgcgacttccacctgaaccaccagcagcccagccccaccagcgtgctgcccaccgaggtggccgccccccccctggagaagatcctgagcgtggacagcgtggccgtggactgcgcctacagaaccgtgcccaagcccggcccccagcccggcccccacggcagcctgctgaccgagggctgcctgagaagcctgagcggcgacctgaacagattcccctgcggcatggaggtgcacagcggccagagagagctggagagcgtggtggccgtgggcgaggccatgctgaagttccccatgggcgccatgagctactgcctgagagacagaagcagattcctgttcagactgcccatgggcctgagctgccccctgcaggtgcagtag

SEQ ID NO: 26327 - DNA, 2784 bp, Artificial Sequence
  Description of Artificial Sequence: Synthetic coding sequence
atggccgacgccgagcccgaggccggcggcggcagcgaggacggcggcggcggcggcggccccgccccccccggccagagcggcagcgtggccagagtggcccccctgggccccgagcagctgagacaggtgctggagcaggtgaccaaggcccagcccccccccccccccccccccttcgtgctgagagacgccgccagaagactgagagacgccgcccagcaggccgccctgcagagaggcagaggcaccgagccccccagactgcccagactgctgcccccccagcagctggaggccatctgcgtgaaggtgaccagcggcgagaccaagggccaggagagacccatgctgctgcccaccaccatccagccccagaccgccagaaagagccagctgcccagaggcaacagctgcctggtgggcctgcacatcgccagcccccagctgctgagagtgcagcccctggtgagaaccgagccccagagctgcttcctgagcgacctgtgccagccccccgcccagggcttcgtgcagagacccctgcccgccctgcaggtggtgcccgccaagagagtgcccgcccccaaggcccccgacgagcagggcagcatgctgacccccctgagcgccagcgaccccctggccgtgaccagcctgagcagcagcagcgcccaccccttcatcagcaacctgcacaccagacacaccgagaagctgaagaagagcctgaaggtgaagaccagaagcggcagagtgagcagaccccccaagtacaaggccaaggactacaagttcatcaagaccgaggacctggccgacggccacctgagcgacagcgacgactacagcgagctgtgcgtggaggaggacgaggaccagagagagagacacgccctgttcgacctgagcagctgcagcctgagacccaagagcttcaagtgccagacctgcgagaagagctacatcggcaagggcggcctggccagacacttcaagctgaaccccggccacggccagctggaccccgagatggtgctgagcgagaaggccagcggcagcaccctgagaggctgcaccgaggagagaaccctgagcctgaccagcctgggcctgagcatgcccgccgacccctgcgagggcggcgccagaagctgcctggtgaccgagagcgccagaggcggcctgcagaacggccagagcgtggacgtggaggagaccctgcccagcgagcccgagaacggcgccctgctgagaagcgagagataccagggccccagaagaagagcctgcagcgagaccctggccgagagcagaaccgccgtgctgcagcagagaagagccgcccagctgcccggcggccccgccgccgccggcgagcagagagccagccccagcaaggccagactgaaggagttcctgcagcagtgcgacagagaggacctggtggagctggccctgccccagctggcccaggtggtgaccgtgtacgagttcctgctgatgaaggtggagaaggaccacctggccaagcccttcttccccgccatctacaaggagttcgaggagctgcacaagatggtgaagaagatgtgccaggactacctgagcagcagcggcctgtgcagccaggagaccctggagatcaacaacgacaaggtggccgagagcctgggcatcaccgagttcctgagaaagaaggagatccaccccgacaacctgggccccaagcacctgagcagagacatggacggcgagcagctggagggcgccagcagcgagaagagagagagagaggccgccgaggagggcctggccagcgtgaagagacccagaagagaggccctgagcaacgacaccaccgagagcctggccgccaacagcagaggcagagagaagcccagacccctgcacgccctggccgccggcttcagcccccccgtgaacgtgaccgtgagccccagaagcgaggagagccacaccaccaccgtgagcggcggcaacggcagcgtgttccaggccggcccccagctgcaggccctggccaacctggaggccagaagaggcagcatcggcgccgccctgagcagcagagacgtgagcggcctgcccgtgtacgcccagagcggcgagcccagaagactgacccaggcccaggtggccgccttccccggcgagaacgccctggagcacagcagcgaccaggacacctgggacagcctgagaagccccggcttctgcagccccctgagcagcggcggcggcgccgagagcctgccccccggcggccccggccacgccgaggccggccacctgggcaaggtgtgcgacttccacctgaaccaccagcagcccagccccaccagcgtgctgcccaccgaggtggccgccccccccctggagaagatcctgagcgtggacagcgtggccgtggactgcgcctacagaaccgtgcccaagcccggcccccagcccggcccccacggcagcctgctgaccgagggctgcctgagaagcctgagcggcgacctgaacagattcccctgcggcatggaggtgcacagcggccagagagagctggagagcgtggtggccgtgggcgaggccatggccttcgagatcagcaacggcagccacgagctgctgagccagggccagaagcagatcttcatccagaccagcgacggcctgatcctgagcccccccggcaccatcgtgagccaggaggaggacatcgtgaccgtgaccgacgccgagggcagagcctgcggctgggccagatag

SEQ ID NO: 26328 - DNA, 2436 bp, Artificial Sequence
  Description of Artificial Sequence: Synthetic coding sequence
atgctgctgcccaccaccatccagccccagaccgccagaaagagccagctgcccagaggcaacagctgcctggtgggcctgcacatcgccagcccccagctgctgagagtgcagcccctggtgagaaccgagccccagagctgcttcctgagcgacctgtgccagccccccgcccagggcttcgtgcagagacccctgcccgccctgcaggtggtgcccgccaagagagtgcccgcccccaaggcccccgacgagcagggcagcatgctgacccccctgagcgccagcgaccccctggccgtgaccagcctgagcagcagcagcgcccaccccttcatcagcaacctgcacaccagacacaccgagaagctgaagaagagcctgaaggtgaagaccagaagcggcagagtgagcagaccccccaagtacaaggccaaggactacaagttcatcaagaccgaggacctggccgacggccacctgagcgacagcgacgactacagcgagctgtgcgtggaggaggacgaggaccagagagagagacacgccctgttcgacctgagcagctgcagcctgagacccaagagcttcaagtgccagacctgcgagaagagctacatcggcaagggcggcctggccagacacttcaagctgaaccccggccacggccagctggaccccgagatggtgctgagcgagaaggccagcggcagcaccctgagaggctgcaccgaggagagaaccctgagcctgaccagcctgggcctgagcatgcccgccgacccctgcgagggcggcgccagaagctgcctggtgaccgagagcgccagaggcggcctgcagaacggccagagcgtggacgtggaggagaccctgcccagcgagcccgagaacggcgccctgctgagaagcgagagataccagggccccagaagaagagcctgcagcgagaccctggccgagagcagaaccgccgtgctgcagcagagaagagccgcccagctgcccggcggccccgccgccgccggcgagcagagagccagccccagcaaggccagactgaaggagttcctgcagcagtgcgacagagaggacctggtggagctggccctgccccagctggcccaggtggtgaccgtgtacgagttcctgctgatgaaggtggagaaggaccacctggccaagcccttcttccccgccatctacaaggagttcgaggagctgcacaagatggtgaagaagatgtgccaggactacctgagcagcagcggcctgtgcagccaggagaccctggagatcaacaacgacaaggtggccgagagcctgggcatcaccgagttcctgagaaagaaggagatccaccccgacaacctgggccccaagcacctgagcagagacatggacggcgagcagctggagggcgccagcagcgagaagagagagagagaggccgccgaggagggcctggccagcgtgaagagacccagaagagaggccctgagcaacgacaccaccgagagcctggccgccaacagcagaggcagagagaagcccagacccctgcacgccctggccgccggcttcagcccccccgtgaacgtgaccgtgagccccagaagcgaggagagccacaccaccaccgtgagcggcggcaacggcagcgtgttccaggccggcccccagctgcaggccctggccaacctggaggccagaagaggcagcatcggcgccgccctgagcagcagagacgtgagcggcctgcccgtgtacgcccagagcggcgagcccagaagactgacccaggcccaggtggccgccttccccggcgagaacgccctggagcacagcagcgaccaggacacctgggacagcctgagaagccccggcttctgcagccccctgagcagcggcggcggcgccgagagcctgccccccggcggccccggccacgccgaggccggccacctgggcaaggtgtgcgacttccacctgaaccaccagcagcccagccccaccagcgtgctgcccaccgaggtggccgccccccccctggagaagatcctgagcgtggacagcgtggccgtggactgcgcctacagaaccgtgcccaagcccggcccccagcccggcccccacggcagcctgctgaccgagggctgcctgagaagcctgagcggcgacctgaacagattcccctgcggcatggaggtgcacagcggccagagagagctggagagcgtggtggccgtgggcgaggccatggccttcgagatcagcaacggcagccacgagctgctgagccagggccagaagcagatcttcatccagaccagcgacggcctgatcctgagcccccccggcaccatcgtgagccaggaggaggacatcgtgaccgtgaccgacgccgagggcagagcctgcggctgggccagatag

SEQ ID NO: 26329 - DNA, 2436 bp, Artificial Sequence; identical to SEQ ID NO: 26328
  Description of Artificial Sequence: Synthetic coding sequence

SEQ ID NO: 26330 - DNA, 1047 bp, Artificial Sequence
  Description of Artificial Sequence: Synthetic coding sequence
atgagaagcctgcccttcgccctgaccgtggagagcgtgagcgccagagcccccacctgctgcagcaccggcagattcacccagggcagacagccctgcaagtgcaaggcctgcggcagaggcttcacccagagcgccagcctgctgcagcactggagagtgcacagcgactggagagagaccctgagcctgagccccgtgagacaggacctgctgtggcccctgcagccccaccaggcccccgccagccccctgggcagaagccacagcagcgccggcgtgagacagggcttcagcggccagctgtgctgctggctgaccaaggagcacaccctggccgaggccctgagactgagccccgtgcccgccggcttctggggccccgtggaggccgacagaccccccgccaacagccacagaagagtgtgccccttctgctgctgcagctgcggcgacagcgtgaacgagaagaccagcctgagccagagagtgctgccccaccccggcgagaagacctgcagaggcggcagcgtggagagcgtgagcctggcccccagcagcgtggcccccgacagcaccagcggcctgagaccctgcggcagccccggcagcttcctgcagcacctgccccccagcaccctgctgcccagaccccccttcctgtaccccggcccccccctgagcctgcagcccctggtgcccagcggcctgcccgccgtgcccgccgtgcccctgggcggcctggaggtggcccaggtgccccccgccacccagcccgccgcccagcaggagggcgccatgggccccagaagctgcgccagcgccggcagagacagcagagaggccgtgcaggcccccggctaccccgagcccgccagaaaggccagccagcacagagccgccggccccctgggcgaggccagagccagactgcagagacagtgcagagccccccccccccccagcaacccccactggagaggcgccctgcccgtgttccccgtgtggaaggccagcagcagaagaagcaacctggccagacactag

SEQ ID NO: 26331 - DNA, 1788 bp, Artificial Sequence
  Description of Artificial Sequence: Synthetic coding sequence
atgggccccctgaccttcagagacgtggccatcgagttcagcctgaaggagtggcagtgcctggacaccgcccagagaaacctgtacagaaacgtgatgctggagaactacagaaacctggtgttcctgggcatcaccgtgagcaagcccgacctgatcacctgcctggagcagggcaaggaggcctggagcatgaagagacacgagatcatggtggccaagcccaccgtgatgtgcagccacttcgcccaggacctgtggcccgagcagaacatcaaggacagcttccagaaggtgaccctgaagagatacggcaagtgcagacacgagaacctgcccctgagaaagggctgcgagagcatggacgagtgcaagatgcacaagggcggctgcaacggcctgaaccagtgcctgaccgccacccagagcaagatcttccagtgcgacaagtacgtgaaggtggcccacaagttcagcaacagcaacagacacgagatcagacacaccaagaagaagcccttcaagtgcaccaagtgcggcaagagcttcggcatgatcagctgcctgaccgagcacagcagaatccacaccagagtgaacttctacaagtgcgaggagtgcggcaaggccttcaactggagcagcaccctgaccaagcacaagagaatccacaccggcgagaagccctacaagtgcgaggagtgcggcaaggccttcaaccagagcagcaacctgatcaagcacaagaagatccacaccggcgagaagccctacaagtgcgaggagtgcggcaagaccttcaacagattcagcaccctgaccacccacaagatcatccacaccggcgagaagccctacaagtgcaaggagtgcggcaaggccttcaacagaagcagcaccctgaccacccacagaaagatccacaccggcgagaagccctacaagtgcgaggagtgcggcaaggccttcaagcagagcagcaacctgaccacccacaagatcatccacaccggcgagaagccctacaagtgcaagaagtgcggcaaggccttcaaccagagcgcccacctgaccacccacgaggtgatccacaccggcgagaagccctacaagtgcgagaagtgcggcaaggccttcaaccacttcagccacctgaccacccacaagatcatccacaccggcgagaagccctacaagtgcaaggagtgcggcaaggccttcaagcacagcagcaccctgaccaagcacaagatcatccacaccggcgagaagccctacaagtgcaaggagtgcgagaaggccttcaaccagagcagcaagctgaccgagcacaagaagatccacaccggcgagaagccctacgagtgcgagaagtgcggcaaggccttcaaccagagcagcaacctgaccagacacaagaagagccacaccgaggagaagccctacaagtgcgaggagtgcggcaagggcttcaagtggcccagcaccctgaccatccacaagatcatccacaccggcgagaagccctacaagtgcgaggagtgcggcaaggccttcaaccagagcagcaagctgaccaagcacaagaagatccacaccggcgagaagccctacacctgcgaggagtgcggcaaggccttcaaccagagcagcaacctgaccaagcacaagagaatccacaccggcgagaagccctacaagtgcgaggagtgcgacaaggccttcaagtggagcagcgtgctgaccaagcacaagatcatccacaccggcgagaagctgcagatctag

SEQ ID NO: 26332 - DNA, 3273 bp, Artificial Sequence
  Description of Artificial Sequence: Synthetic coding sequence
atgaacatggagggcctggtgatgttccaggacctgagcatcgacttcagccaggaggagtgggagtgcctggacgccgcccagaaggacctgtacagagacgtgatgatggagaactacagcagcctggtgagcctgggcctgagcatccccaagcccgacgtgatcagcctgctggagcagggcaaggagccctggatggtgagcagagacgtgctgggcggctggtgcagagacagcgagttcagatgcaagaccaaggacagctgcctgcccaaggagatctacgaggtgaccagcagccagtgggtgagaatggagaagtgccacagcctggtgggcagcagcgtgagagacgactgggagtgcaagggccagttccagcaccaggacatcaaccaggagagatacctggagaaggccatcatgacctacgagaccacccccaccttctgcctgcagaccagcctgaccctgcaccacagaatccaccccggcgagaagctgtacaagagcaccgagtgcatggccttcaagtacggcagcgagctgacccagcagcaggagacccacaccggcgagaagctgtacaagtgcaaggagtgcggcaaggccttccaccacttcagctacctggtgaagcaccagagaatccacaccggcgagaagccctgcgcctgcaaggagtacggcaaggccttcatcagcggcagccacctgatccagcaccagaagatgtacaccgacgagagaccccacgagtgccaggagagcgtgaaggccttcagacccagcgcccacctgatccagcactggagaatccacaccggcgacaagccctacgagtgcaaggagtgcggcaagagcttcaccagcggcagcaccctgaaccagcaccagcagatccacaccggcgagaagccctaccactgcaagcagtgcggcaagagcttcaccgtgggcagcaccctgatcagacaccagcagatccacaccggcgagaagccctacgactgcaaggagtgcggcaagagcttcgccagcggcagcgccctgatcagacaccagagaatccacaccggcgagaagccctacgactgcaaggagtgcggcaagagcttcaccttccacagcgccctgatcagacaccagagaatccacaccggcgagaagccctacgactgcaaggagtgcggcaagagcttcaccttcagaagcggcctgatcggccaccaggccatccacaccggcgagaagccctacgactgcaaggagtgcggcaagagcttcaccgccggcagcaccctgatccagcaccagagaatccacaccggcgagaagccctacgactgcaaggagtgcggcaagagcttcgccagcggcagcgccctgctgcagcaccagagaatccacaccggcgagaagccctactgctgcaaggagtgcggcaagagcttcaccttcagaagcaccagaaacagacaccagagaatccacaccggcgagaagccctacaactgcaaggagtgcggcaagagcttcgccagcggcagcgccctgctgcagcaccagagaatccacaccggcgagaagccctaccactgcaaggagtgcggcaagagcttcaccttcagaagcggcctgatcggccaccaggccgtgcacaccggcgagaagccctacgactgcaaggagtgcggcaagagcttcaccagcagaagcgccctgatccagcaccagagaatccacaccggcgagaagccctaccactgcaaggagtgcggcaagagcttcaccgtgggcagcaccctgctgcagcaccagcagatccacaccggcgagaagccctacgactgcaaggagtgcggcaaggccttcagactgagactgagactgacccagcaccagcagatccacaccggcgagaagccctaccagtgccaggagtgcggcaaggccttcgtgagcgtgagcggcctgacccagcaccacagaatccacaccggcgagaagccctacgagtgccccgactgcggcaaggccttcagacagagaacctacctgaaccagcacagaagaatccacaccggcgagaagccctacgagtgcaaggagtgcggcaagagcttcaccttctgcagcggcctgatccagcaccagcagaaccacaccgacgagaagccctacgacggcaaggagtgcggcaagagcttcaccagccacagcaccctgatccagcaccagcagatccacaccggcgagaagccctacgactgcaaggagtgcggcaagagcttcaccagccacagcaccctgatccagcaccagcagatccacaccggcgagaagctgtacgactgcaaggagtgcggcaagagcttcaccagccacagcaccctgatccagcaccagcccctgcacaccggcgagaagccctaccactgcaaggagtgcggcaagagcttcaccctgagaagcgccctgatccagcacagacccgtgcacaccggcgagaagagatacagctgcaaggagtgcggcaagagcttcaccagcagaagcaccctgatcgagcaccagagaatccacaccggcgagaagccctaccactgcaaggagtgcggcaagagcttcgccttcagaagcgccatcatccagcacagaagaatccacaccggcgagaagccctacgactgcaaggagtgcggcaaggccttcagaagaagaagcaagctgacccagcaccagagaatccacaccggcgagaagccctacagatgccacgagtgcggcaaggccttcgtgagattcagcggcctgaccaagcaccacagcatccacaccggcgagaagccctacgagtgcaagacctgcggcaagagcttcagacagagaacccacctgaccctgcaccagagaatccacaccggcgacagaccctacgagtgcaaggagtgcggcaagagcttcacctgcggcagcgagctgatcagacaccagagaacccacaccggcgagaagccctacgactgcaaggagtgcggcaaggccttcagatgccccagccagctgagccagcacaagagaatccacaccggcgagaagacctaccagtgccccgagtgcggcaaggccttcttctacgccagcggcctgagcagacaccagagcgtgcacaccggcgagaagccctacgagtgcaagacctgcggcaaggccttcaagcagctgacccagctgaccagacaccagagaatccacgacctgacctag

SEQ ID NO: 26333 - DNA, 1593 bp, Artificial Sequence
  Description of Artificial Sequence: Synthetic coding sequence
atggtgagaccccaggacaccgtggcctacgaggacctgagcgaggactacacccagaagaagtggaagggcctggccctgagccagagagccctgcactggaacatgatgctggagaacgacagaagcatggccagcctgggcagaaacatgatggagagcagcgagctgacccccaagcaggagatcttcaagggcagcgagagcagcaacagcaccagcggcggcctgttcggcgtggtgcccggcggcaccgagaccggcgacgtgtgcgaggacaccttcaaggagctggagggccagcccagcaacgaggagggcagcagactggagagcgacttcctggagatcatcgacgaggacaagaagaagagcaccaaggacagatacgaggagtacaaggaggtggaggagcacccccccctgagcagcagccccgtggagcacgagggcgtgctgaagggccagaagagctacagatgcgacgagtgcggcaaggccttctactggagcagccacctgatcggccacagaagaatccacaccggcgagaagccctacgagtgcaacgagtgcggcaagaccttcagacagaccagccagctgatcgtgcacctgagaacccacaccggcgagaagccctacgagtgcagcgagtgcggcaaggcctacagacacagcagccacctgatccagcaccagagactgcacaacggcgagaagccctacaagtgcaacgagtgcgccaaggccttcaaccagagcagcaagctgttcgaccaccagagaacccacaccggcgagaagccctacgagtgcaaggagtgcggcgccgccttcagcagaagcaagaacctggtgagacaccagttcctgcacaccggcaagaagccctacaagtgcaacgagtgcggcagagccttctgcagcaacagaaacctgatcgaccaccagagaacccacaccggcgagaagccctacaagtgcaacgagtgcggcaaggccttcagcagaagcaagtgcctgatcagacaccagagcctgcacaccggcgagaagccctacaagtgcagcgagtgcggcaaggccttcaaccagatcagccagctggtggagcacgagagaatccacaccggcgagaagcccttcaagtgcagcgagtgcggcaaggccttcggcctgagcaagtgcctgatcagacaccagagactgcacaccagcgagaagccctacaagtgcaacgagtgcggcaagagcttcaaccagaacagctacctgatcatccaccagagaatccacaccggcgagaagccctacgagtgcaacgagtgcggcaaggtgttcagctacaacagcagcctgatggtgcaccagagaacccacaccggcgagaagccctacaagtgcaacagctgcggcaaggccttcagcgacagcagccagctgaccgtgcaccagagagtgcacaccggcgagaagccctacgagtgcatcgagtgcggcaaggccttcagccagagaagcaccttcaaccaccaccagagaacccacgccggcgagaagcccagcggcctggccagaagcagcagctag

SEQ ID NO: 26334 - DNA, 1632 bp, Artificial Sequence
  Description of Artificial Sequence: Synthetic coding sequence
atggtgagaccccaggacaccgtggcctacgaggacctgagcgaggactacacccagaagaagtggaagggcctggccctgagccagagagccctgcactggaacatgatgctggagaacgacagaagcatggccagcctgggcagaaacatgatggagagcagcgagctgacccccaagcaggagatcttcaagggcagcgagagcagcaacagcaccagcggcggcctgttcggcgtggtgcccggcggcaccgagaccggcgacgtgtgcgaggacaccttcaaggagctggagggccagcccagcaacgaggagggcagcagactggagagcgacttcctggagatcatcgacgaggacaagaagaagagcaccaaggacagatacgaggagtacaaggaggtggaggagcacccccccctgagcagcagccccgtggagcacgagggcgtgctgaagggccagaagagctacagatgcgacgagtgcggcaaggccttctactggagcagccacctgatcggccacagaagaatccacaccggcgagaagccctacgagtgcaacgagtgcggcaagaccttcagacagaccagccagctgatcgtgcacctgagaacccacaccggcgagaagccctacgagtgcagcgagtgcggcaaggcctacagacacagcagccacctgatccagcaccagagactgcacaacggcgagaagccctacaagtgcaacgagtgcgccaaggccttcaaccagagcagcaagctgttcgaccaccagagaacccacaccggcgagaagccctacgagtgcaaggagtgcggcgccgccttcagcagaagcaagaacctggtgagacaccagttcctgcacaccggcaagaagccctacaagtgcaacgagtgcggcagagccttctgcagcaacagaaacctgatcgaccaccagagaacccacaccggcgagaagccctacaagtgcaacgagtgcggcaaggccttcagcagaagcaagtgcctgatcagacaccagagcctgcacaccggcgagaagccctacaagtgcagcgagtgcggcaaggccttcaaccagatcagccagctggtggagcacgagagaatccacaccggcgagaagcccttcaagtgcagcgagtgcggcaaggccttcggcctgagcaagtgcctgatcagacaccagagactgcacaccagcgagaagccctacaagtgcaacgagtgcggcaagagcttcaaccagaacagctacctgatcatccaccagagaatccacaccggcgagaagccctacgagtgcaacgagtgcggcaaggtgttcagctacaacagcagcctgatggtgcaccagagaacccacaccggcgagaagccctacaagtgcaacagctgcggcaaggccttcagcgacagcagccagctgaccgtgcaccagagagtgcacaccggcgagaagaacctgatgaacgtgctgagcgtgggcaagcccctggtgagcgtgcccctgctgatcaccaccagcgagctgatgctggagagaagcccccaggtgtggctgggccacctgctgaaggcctggttcagcgagaccgacagcaaggacctgtag

SEQ ID NO: 26335 - DNA, 1980 bp, Artificial Sequence
  Description of Artificial Sequence: Synthetic coding sequence
atgctgcaccagcccacccccggcaacagaggcctgaccgccagaatggaggtgggccccgccaccgagaccttcgtgctggagctgcagtgcctggaggacggcggccccggccccgacaccctgagcggcggcagcggcggcagcgagagccaggaggaggaggagccccaggagagaaacagcagcccccagagacccgccgtgagcgcccccgtgggcgccagcgagatcgccgaggagaccagacccggccagagagagctgcagctgcagcagctggagcagcagcccgagccccagcagcagccccagcacgagcagctgcagcagccccagccccacctggagctgcagcagcagccccagcaggacggccagcagcagctgagccagctgcagcaggagaagcaccagagcgtgcaccaccaggagctgaagcccgagctgcagctgatgcaccagcagcagcagctgcagccccagcaggtgcaggagcagcagagactgcagcagcagcaggagcagctgcagacccagcaggcccaggagcagcaggtgctgcagcagcaggagcagctgcagcagcaggtgcaggagcagcagctgctgcagcagcagcaggagcagctgcagcagcagcagctgctgcagcagcaggagcagctgcagcagcagcagttccagcagcagcaggagcagctgcagcagcagcagcagctgctgctgctgcagcagcagggccagctgcagcagcagctgctgcagcagcagcaggcccagctgcagcagcagctgctggagcagcagcaggcccagctgcagcagcagctgctgctgcagcagcaggagcagctgcagcagcagcagcagcagcagctgctgcagcagcagcaggagcagctgcagcagcagcagctgcagcccccccccctggagcccgaggaggaggaggaggtggagctggagctgatgcccgtggacctgggcagcgagcaggagctggagcagcagagacaggagctggagagacagcaggagctggagagacagcaggagcagagacagctgcagctgaagctgcaggaggagctgcagcagctggagcagcagctggagcagcagcagcagcagctggagcagcaggaggtgcagctggagctgacccccgtggagctgggcgcccagcagcaggaggtgcagctggagctgacccccgtgcagcccgagctgcagctggagctggtgcccgccgccggcggcggcggcgccgccgtgcccggcgcccccgccgccgtggtggtggccccccccggctacgtggtggtgcaggagctgatggtgctgcccgccgtggccgcccccgccgtggtggccatccccggccccgccggcagcgccgccctgacccccgccagacagagaagaagaagaagagccagagacagacccaccatctgcggcgagtgcggcaagggcttcagcagaagcaccgacctggtgagacaccaggccacccacaccggcgagagaccccacagatgcggcgagtgcggcaagggcttcagccagcacagcaacctggtgacccaccagagaatccacaccggcgagaagccctacgcctgcagctactgcgccaagagattcagcgagagcagcgccctggtgcagcaccagagaacccacaccggcgagagaccctacgcctgcggcgactgcggcaagagattcagcgtgagcagcaacctgctgagacacagaagaacccacagcggcgagagaccctacgtgtgcgaggactgcggcgagagattcagacacaaggtgcagatcagaagacacgagagacagctgcacggcgccggcagaagcagaggcctgggcctgctgagagccagcagacccgccgccctgggcggccccgccagagccgagcaggccgccaccgccaccgcccccgccgacaaggccctgtag

SEQ ID NO: 26336 - DNA, 3180 bp, Artificial Sequence
  Description of Artificial Sequence: Synthetic coding sequence
atggaggccaaccccgccggcagcggcgccggcggcggcggcagcagcggcatcggcggcgaggacggcgtgcacttccagagctaccccttcgacttcctggagttcctgaaccaccagagattcgagcccatggagctgtacggcgagcacgccaaggccgtggccgccctgccctgcgcccccggcccccccccccagccccccccccagcccccccccccccagtacgactaccccccccagagcaccttcaagcccaaggccgaggtgcccagcagcagcagcagcagcagcagcagcagcagcagcagcagcagcagcagcagcagcagcagcagcagcagcagccaggccaagaagcccgacccccccctgccccccgccttcggcgccccccccccccccctgttcgacgccgccttccccaccccccagtggggcatcgtggacctgagcggccaccagcacctgttcggcaacctgaagagaggcggccccgccagcggccccggcgtgacccccggcctgggcgcccccgccggcgcccccggccccctgcccgcccccagccagaccccccccggcccccccgccgccgccgcctgcgaccccaccaaggacgacaagggctacttcagaagactgaagtacctgatggagagaagattcccctgcggcgtgtgccagaagagcttcaagcagagcagccacctggtgcagcacatgctggtgcacagcggcgagagaccctacgagtgcggcgtgtgcggcagaacctacaaccacgtgagcagcctgatcagacacagaagatgccacaaggacgtgccccccgccgccggcggccccccccagcccggcccccacctgccccccctgggcctgcccgcccccgccgccagcgccgccaccgccgccgcccccagcaccgtgagcagcggcccccccgccacccccgtggcccccgcccccagcgccgacggcagcgccgcccccgccggcgtgggcgtgcccccccccgccaccggcggcggcgacggccccttcgcctgccccctgtgctggaaggtgttcaagaagcccagccacctgcaccagcaccagatcatccacaccggcgagaagcccttcagctgcagcgtgtgcagcaagagcttcaacagaagagagagcctgaagagacacgtgaagacccacagcgccgacctgctgagactgccctgcggcatctgcggcaaggccttcagagacgccagctacctgctgaagcaccaggccgcccacgccggcgccggcgccggcggccccagacccgtgtacccctgcgacctgtgcggcaagagctacagcgccccccagagcctgctgagacacaaggccgcccacgccccccccgccgccgccgccgaggcccccaaggacggcgccgccagcgccccccagcccccccccaccttcccccccggcccctacctgctgccccccgacccccccaccaccgacagcgagaaggccgccgccgccgccgccgccgtggtgtacggcgccgtgcccgtgcccctgctgggcgcccaccccctgctgctgggcggcgccggcaccagcggcgccggcggcagcggcgccagcgtgcccggcaagaccttctgctgcggcatctgcggcagaggcttcggcagaagagagaccctgaagagacacgagagaatccacaccggcgagaagccccaccagtgccccgtgtgcggcaagagattcagagagagcttccacctgagcaagcaccacgtggtgcacaccagagagagaccctacaagtgcgagctgtgcggcaaggtgttcggctacccccagagcctgaccagacacagacaggtgcacagactgcagctgccctgcgccctggccggcgccgccggcctgcccagcacccagggcacccccggcgcctgcggccccggcgccagcggcaccagcgccggccccaccgacggcctgagctacgcctgcagcgactgcggcgagcacttccccgacctgttccacgtgatgagccacaaggaggtgcacatggccgagaagccctacggctgcgacgcctgcggcaagaccttcggcttcatcgagaacctgatgtggcacaagctggtgcaccaggccgcccccgagagactgctgccccccgcccccggcggcctgcagccccccgacggcagcagcggcaccgacgccgccagcgtgctggacaacggcctggccggcgaggtgggcgccgccgtggccgccctggccggcgtgagcggcggcgaggacgccggcggcgccgccgtggccggcgccggcggcggcgccagcagcggccccgagagattcagctgcgccacctgcggccagagcttcaagcacttcctgggcctggtgacccacaagtacgtgcacctggtgagaagaaccctgggctgcggcctgtgcggccagagcttcgccggcgcctacgacctgctgctgcacagaagaagccacagacagaagagaggcttcagatgccccgtgtgcggcaagagattctgggaggccgccctgctgatgagacaccagagatgccacaccgagcagagaccctacagatgcggcgtgtgcggcagaggcttcctgagaagctggtacctgagacagcacagagtggtgcacaccggcgagagagccttcaagtgcggcgtgtgcgccaagagattcgcccagagcagcagcctggccgagcacagaagactgcacgccgtggccagaccccagagatgcagcgcctgcggcaagaccttcagatacagaagcaacctgctggagcaccagagactgcacctgggcgagagagcctacagatgcgagcactgcggcaagggcttcttctacctgagcagcgtgctgagacaccagagagcccacgagccccccagacccgagctgagatgccccgcctgcctgaaggccttcaaggaccccggctacttcagaaagcacctggccgcccaccagggcggcagacccttcagatgcagcagctgcggcgagggcttcgccaacacctacggcctgaagaagcacagactggcccacaaggccgagaacctgggcggccccggcgccggcgccggcaccctggccggcaaggacgcctag

SEQ ID NO: 26337 - DNA, 1596 bp, Artificial Sequence
  Description of Artificial Sequence: Synthetic coding sequence
atggacagcgtggccttcgaggacgtggccgtgaacttcacccaggaggagtgggccctgctggaccccagccagaagaacctgtacagagaggtgatgcaggagaccctgagaaacctgaccagcatcggcaagaagtggaacaaccagtacatcgaggacgagcaccagaaccccagaagaaacctgagaagactgatcggcgagagactgagcgagagcaaggagagccaccagcacggcgaggtgctgacccaggtgcccgacgacaccctgaagaagaagacccccggcgtgcagagctacgagagcagcgtgtgcggcgagatcggcatcggcctgagcagcctgaacagacacctgagagccttcagctacagcagcagcctggccatccacggcagaacccacaccggcgagaagccctacgagtgcaaggagtgcggcaaggccttcagattccccagcagcgtgagaagacacgagagaatccacagcgccaagaagccctacgagtgcaagcagtgcggcaaggccttcagcttccccagcagcgtgagaagacacgagagaatccacagcgccaagaagccctacgagtgcaagcagtgcggcaaggccctgagctacctggtgagcttccagacccacatgagaatgcacaccggcgagagaccccacaagtgcaacatctgcggcaaggccttcttcagccccagcagcctgaagagacacgagaagagccacaccggcgagaagagatacaagtgcaagcagtgcgacaaggccttcaactgccccagcagcttccagtaccacgagagaacccacagcggcgagaagccctacgagtgcacccagtgcagaaaggccttcagaagcgtgaagtacctgagagtgcacgagagaaagcacaccggcgagaagccctacgagtgcaagctgtgcggcaagggcttcatcagcagcaccagcttcagataccacgagaagacccacaccggcgagaagccctacgagtgcaagaagtgcgtgaaggccttcagcttcgtgaaggacctgagaatccacgagagaacccacaccggcgagaagcccttcgagtgcaagcagtgcggcaagaccttcaccagcagcaacagcttccactaccacgagagaacccacaccggcgagaagccctacgagtgcaagcagtgcggcaaggccttcagaagcgccagcgtgctgcagaagcacatcagaacccacaccggcgagaagccctacggctgcaagcagtgcggcaaggtgttcagagtggccagccagctgaagatgcacgagagaacccacaccggcgagaagccctacgagtgcaagcagtgcggcaaggccttcatcagcagcaacagcatcagataccacaagagaacccacaccggcgagaagccctacaagtgcaagcagtgcggcaaggccttcatcagcagcaacagcttcctgtaccacgagagaatccacaccggcgagaagccctacgagtgcaagcagtgcggcaaggccttcagaagcgccagcatcctgcagaagcacgtgagaacccacgccggctag

SEQ ID NO: 26338 - DNA, 297 bp, Artificial Sequence
  Description of Artificial Sequence: Synthetic coding sequence
atgctgagaagaggccacctggccttcagagacgtggccatcgagttcccccaggaggagtggaagtgcctggaccccgcccagagaaccctgtacagagaggtgatggtggagaactacagaaacctggtgttcctgggcatctgcctgcccgacctgagcgtgatcagcatgctggagcagagaagagaccccagaaacctgcagagcgaggtgaagatcgccaacaaccccggcagctgcagcgtgacccaggccgtggtggagtggcagagcagcgtggccatcgtggcctag

SEQ ID NO: 26339 - DNA, 1734 bp, Artificial Sequence
  Description of Artificial Sequence: Synthetic coding sequence
atgctgagaagaggccacctggccttcagagacgtggccatcgagttcccccaggaggagtggaagtgcctggaccccgcccagagaaccctgtacagagaggtgatggtggagaactacagaaacctggtgttcctgggcatctgcctgcccgacctgagcgtgatcagcatgctggagcagagaagagaccccagaaacctgcagagcgaggtgaagatcgccaacaaccccggcggcagagagtgcatcaagggcgtgaacgccgagagcagcagcaagctgggcagcaacgccggcaacaagagcctgaagaaccagctgggcctgaccttccagctgcacctgagcgagctgcagctgttccaggccgagagaaacatcagcggctgcaagcacgtggagaagcccatcaacaacagcctggtgagccccctgcagaagatctacagcagcgtgaagagccacatcctgaacaagtacagaaacgacttcgacgacagccccttcctgccccaggagcagaaggcccagatcagagagaagccctgcgagtgcaacgagcacggcaaggccttcagagtgagcagcagactggccaacaaccaggtgatccacaccgccgacaacccctacaagtgcaacgagtgcgacaaggtgttcagcaacagcagcaacctggtgcagcaccagagaatccacaccggcgagaagccctacaagtgccacgagtgcggcaagctgttcaacagaatcagcctgctggccagacaccagagaatccacaccggcgagaagccctacaagtgccacgagtgcggcaaggtgttcacccagaacagccacctggccaaccaccacagaatccacaccggcgagaagccctacaagtgcaacgagtgcggcaaggtgttcaacagaaacgcccacctggccagacaccagaagatccacagcggcgagaagccctacaagtgcaaggagtgcggcaaggccttcagcggcggcagcggcctgaccgcccacctggtgatccacaccggcgagaagctgtacaagtgcaacaagtgcggcaaggtgttcaacagaaacgcccacctgaccagacaccagagaatccacaccggcgagaagccctacgagtgcaaggagtgcggcaaggtgttcagacacaagttctgcctgaccaaccaccacagaatgcacaccggcgagcagccctacaagtgcaacgagtgcggcaaggccttcagagactgcagcggcctgaccgcccacctgctgatccacaccggcgagaagccctacaagtgcaaggagtgcgccaaggtgttcagacacagactgagcctgagcaaccaccagagattccacaccggcgagaagccctacagatgcgacgagtgcggcaaggacttcaccagaaacagcaacctggccaaccaccacagaatccacaccggcgagaagccctacaagtgcagcgagtgccacaaggtgttcagccacaacagccacctggccagacacagacagatccacaccggcgagaagagctacaagtgcaacgagtgcggcaaggtgttcagccacaagctgtacctgaagaagcacgagagaatccacaccggcgagaagccctacagatgccacgagtgcggcaaggacttcaccagaaacagcaacctggccaaccaccacagaatccacaccggcgagaagccctacagatag

SEQ ID NO: 26340 - DNA, 1635 bp, Artificial Sequence
  Description of Artificial Sequence: Synthetic coding sequence
atggccgtgatggacctgagcagcccctgggccctgaccaagcaggacagcgcctgcttccacctgagaaacgccgaggaggagagaatgatcgccgtgttcctgaccacctggctgcaggagcccatgaccttcaaggacgtggccgtggagttcacccaggaggagtggatgatgctggacagcgcccagagaagcctgtacagagacgtgatgctggagaactacagaaacctgaccagcgtggagtaccagctgtacagactgaccgtgatcagccccctggaccaggaggagatcagaaacatgaagaagagaatcccccaggccatctgccccgaccagaagatccagcccaagaccaaggagagcaccgtgcagaagatcctgtgggaggagcccagcaacgccgtgaagatgatcaagctgaccatgcacaactggagcagcaccctgagagaggactgggagtgccacaagatcagaaagcagcacaagatccccggcggccactggagacagatgatctacgcccccaagaagaccgtgccccaggagctgttcagagactaccacgagctggaggagaacagcaagctgggcagcaagctgatcttcagccagagcatcttcaccagcaagcactgccagaagtgctacagcgagatcggctgcctgaagcacaacagcatcatcaacaactacgtgaagaacagcatcagcgagaagctgtacgagagccacgagtgcgacaccaccctgtggcacttccagagaaaccagaccgtgcagaaggagtacacctacagcaagcacggcatgcacttcacccacaacatgttccccgtgcccaacaacctgcacatggcccagaacgcctgcgagtgcaacaaggacgagaccctgtgccaccagagcagcctgaagaagcagggccagacccacaccgagaagaagcacgagtgcaaccagtgcggcaaggccttcaagagaatcagcaacctgaccctgtacaagaagagccacatgggcgagaagcagtacgagtgcaaggagtgcggcaaggtgttcaacgacagcagcaccctgagaagacacgtgagaacccacaccggcgagaagccctacgagtgcaaccagtgcggcaaggccttcagccagaagaccagcctgaaggcccacatgagaacccacaccggcgagaagccctacgagtgcaaccagtgcggcaagagcttcggcaccagcagctacctgatcgtgcacaagagaatccacaccggcgagaagctgtacgagtgcagcgagtgcggcaaggccttcaacaccagcagccacctgaaggtgcacaagaagatccacaccggcgagaacgtgtacgagtgcagcgactgcggcaaggtgttcagcggcgtgagcagcctgagaatgcacatcagaacccacaccggcgagaagccctacgagtgcaaggagtgcagaaaggccttcagcgtgagcagcagcctgagaagacacgtgagaatccacaccggcgagaagccctacgagtgcatccagtgcggcaaggccttcagccagagcagcagcctgatcatccacaagagaatccacaccgagagagagaccctgtag

SEQ ID NO: 26341 - DNA, 2820 bp, Artificial Sequence
  Description of Artificial Sequence: Synthetic coding sequence
atggccaccagccagtacttcgacttcgcccagggcggcggcccccagtacagcgcccagccccccaccctgcccctgcccaccgtgggcgccagctacaccgcccagcccacccccggcatggaccccgccgtgaaccccgccttcccccccgccgcccccgccggctacggcggctaccagccccacagcggccaggacttcgcctacggcagcagaccccaggagcccgtgcccaccgccaccaccatggccacctaccaggacagctacagctacggccagagcgccgccgccagaagctacgaggacagaccctacttccagagcgccgccctgcagagcggcagaatgaccgccgccgacagcggccagcccggcacccaggaggcctgcggccagcccagcccccacggcagccacagccacgcccagcccccccagcaggcccccatcgtggagagcggccagcccgccagcaccctgagcagcggctacacctaccccaccgccaccggcgtgcagcccgagagcagcgccagcatcgtgaccagctaccccccccccagctacaaccccacctgcaccgcctacaccgcccccagctaccccaactacgacgccagcgtgtacagcgccgccagccccttctacccccccgcccagcccccccccccccccggccccccccagcagctgccccccccccccgcccccgccggcagcggcagcagccccagagccgacagcaagccccccctgcccagcaagctgcccagacccaaggccggccccagacagctgcagctgcactactgcgacatctgcaagatcagctgcgccggcccccagacctacagagagcacctgggcggccagaagcacagaaagaaggaggccgcccagaagaccggcgtgcagcccaacggcagccccagaggcgtgcaggcccagctgcactgcgacctgtgcgccgtgagctgcaccggcgccgacgcctacgccgcccacatcagaggcagcaagcaccagaaggtgttcaagctgcacgccaagctgggcaagcccatccccaccctggagcccgccctggccaccgagagcccccccggcgccgaggccaagcccaccagccccaccggccccagcgtgtgcgccagcagcagacccgccctggccaagagacccgtggccagcaaggccctgtgcgagggcccccccgagccccaggccgccggctgcagaccccagtggggcaagcccgcccagcccaagctggagggccccggcgcccccacccagggcggcagcaaggaggcccccgccggctgcagcgacgcccagcccgtgggccccgagtacgtggaggaggtgttcagcgacgagggcagagtgctgagattccactgcaagctgtgcgagtgcagcttcaacgacctgaacgccaaggacctgcacgtgagaggcagaagacacagactgcagtacagaaagaaggtgaaccccgacctgcccatcgccaccgagcccagcagcagagccagaaaggtgctggaggagagaatgagaaagcagagacacctggccgaggagagactggagcagctgagaagatggcacgccgagagaagaagactggaggaggagcccccccaggacgtgcccccccacgccccccccgactgggcccagcccctgctgatgggcagacccgagagccccgccagcgcccccctgcagcccggcagaagacccgccagcagcgacgacagacacgtgatgtgcaagcacgccaccatctaccccaccgagcaggagctgctggccgtgcagagagccgtgagccacgccgagagagccctgaagctggtgagcgacaccctggccgaggaggacagaggcagaagagaggaggagggcgacaagagaagcagcgtggccccccagaccagagtgctgaagggcgtgatgagagtgggcatcctggccaagggcctgctgctgagaggcgacagaaacgtgagactggccctgctgtgcagcgagaagcccacccacagcctgctgagaagaatcgcccagcagctgcccagacagctgcagatggtgaccgaggacgagtacgaggtgagcagcgaccccgaggccaacatcgtgatcagcagctgcgaggagcccagaatgcaggtgaccatcagcgtgaccagccccctgatgagagaggaccccagcaccgaccccggcgtggaggagccccaggccgacgccggcgacgtgctgagccccaagaagtgcctggagagcctggccgccctgagacacgccagatggttccaggccagagccagcggcctgcagccctgcgtgatcgtgatcagagtgctgagagacctgtgcagaagagtgcccacctggggcgccctgcccgcctgggccatggagctgctggtggagaaggccgtgagcagcgccgccggccccctgggccccggcgacgccgtgagaagagtgctggagtgcgtggccaccggcaccctgctgaccgacggccccggcctgcaggacccctgcgagagagaccagaccgacgccctggagcccatgaccctgcaggagagagaggacgtgaccgccagcgcccagcacgccctgagaatgctggccttcagacagacccacaaggtgctgggcatggacctgctgccccccagacacagactgggcgccagattcagaaagagacagagaggccccggcgagggcgaggagggcgccggcgagaagaagagaggcagaagaggcggcgagggcctggtgtag

SEQ ID NO: 26342 - DNA, 1101 bp, Artificial Sequence
  Description of Artificial Sequence: Synthetic coding sequence
atggccaccagccagtacttcgacttcgcccagggcggcggcccccagtacagcgcccagccccccaccctgcccctgcccaccgtgggcgccagctacaccgcccagcccacccccggcatggaccccgccgtgaaccccgccttcccccccgccgcccccgccggctacggcggctaccagccccacagcggccaggacttcgcctacggcagcagaccccaggagcccgtgcccaccgccaccaccatggccacctaccaggacagctacagctacggccagagcgccgccgccagaagctacgaggacagaccctacttccagagcgccgccctgcagagcggcagaatgaccgccgccgacagcggccagcccggcacccaggaggcctgcggccagcccagcccccacggcagccacagccacgcccagcccccccagcaggcccccatcgtggagagcggccagcccgccagcaccctgagcagcggctacacctaccccaccgccaccggcgtgcagcccgagagcagcgccagcatcgtgaccagctaccccccccccagctacaaccccacctgcaccgcctacaccgcccccagctaccccaactacgacgccagcgtgtacagcgccgccagccccttctacccccccgcccagcccccccccccccccggccccccccagcagctgccccccccccccgcccccgccggcagcggcagcagccccagagccgacagcaagccccccctgcccagcaagctgcccagacccaaggccggccccagacagctgcagctgcactactgcgacatctgcaagatcagctgcgccggcccccagacctacagagagcacctgggcggccagaagcacagaaagaaggaggccgcccagaagaccggcgtgcagcccaacggcagccccagaggcgtgcaggcccagctgcactgcgacctgtgcgccgtgagctgcaccggcgccgacgcctacgccgcccacatcagaggcagcaagcaccagaagggcctgctgagccacagacagcaggccgccgaccccagcggcggcaaccagcccaacctgaactag

SEQ ID NO: 26343 - DNA, 213 bp, Artificial Sequence
  Description of Artificial Sequence: Synthetic coding sequence
atggccaccagccagtacttcgacttcgcccagggcggcggcccccagtacagccccgaggtggagaccaccccccccgccctggccagcggcctgccctgcgccctgccctggaccgtgggctgcagcggcagcgacgccgtgaccgccctgtgccccagcctgagaggcctggcctgcatctgcagcatcctgtgggaccccgcctggtag

SEQ ID NO: 26344 - DNA, 843 bp, Artificial Sequence
  Description of Artificial Sequence: Synthetic coding sequence
atgctgagctgcaacatctgcggcgagaccgtgaccagcgagcccgacatgaaggcccacctgatcgtgcacatggagagcgagatcatctgccccttctgcaagctgagcggcgtgaactacgacgagatgtgcttccacatcgagaccgcccacttcgagcagaacaccctggagagaaacttcgagagaatcaacaccgtgcagtacggcaccagcgacaacaagaaggacaacaccctgcagtgcggcatggaggtgaacagcagcatcctgagcggctgcgccagcaaccaccccaagaacagcgcccagaacctgaccaaggacagcaccctgaagcacgagggcttctacagcgagaacctgaccgagagcagaaagttcctgaagagcagagagaagcagagcagcctgaccgagatcaagggcagcgtgtacgagaccacctacagcccccccgagtgccccttctgcggcaagatcgaggagcacagcgaggacatggagacccacgtgaagaccaagcacgccaacctgctggacatccccctggaggactgcgaccagcccctgtacgactgccccatgtgcggcctgatctgcaccaactaccacatcctgcaggagcacgtggacctgcacctggaggagaacagcttccagcagggcatggacagagtgcagtgcagcggcgacctgcagctggcccaccagctgcagcaggaggaggacagaaagagaagaagcgaggagagcagacaggagatcgaggagttccagaagctgcaggagctgctgaagcacttcatcggcatcatcagaatgctgccccagatgtag

SEQ ID NO: 26345 - DNA, 1737 bp, Artificial Sequence
  Description of Artificial Sequence: Synthetic coding sequence
atgctgagctgcaacatctgcggcgagaccgtgaccagcgagcccgacatgaaggcccacctgatcgtgcacatggagagcgagatcatctgccccttctgcaagctgagcggcgtgaactacgacgagatgtgcttccacatcgagaccgcccacttcgagcagaacaccctggagagaaacttcgagagaatcaacaccgtgcagtacggcaccagcgacaacaagaaggacaacaccctgcagtgcggcatggaggtgaacagcagcatcctgagcggctgcgccagcaaccaccccaagaacagcgcccagaacctgaccaaggacagcaccctgaagcacgagggcttctacagcgagaacctgaccgagagcagaaagttcctgaagagcagagagaagcagagcagcctgaccgagatcaagggcagcgtgtacgagaccacctacagcccccccgagtgccccttctgcggcaagatcgaggagcacagcgaggacatggagacccacgtgaagaccaagcacgccaacctgctggacatccccctggaggactgcgaccagcccctgtacgactgccccatgtgcggcctgatctgcaccaactaccacatcctgcaggagcacgtggacctgcacctggaggagaacagcttccagcagggcatggacagagtgcagtgcagcggcgacctgcagctggcccaccagctgcagcaggaggaggacagaaagagaagaagcgaggagagcagacaggagatcgaggagttccagaagctgcagagacagtacggcctggacaacagcggcggctacaagcagcagcagctgagaaacatggagatcgaggtgaacagaggcagaatgccccccagcgagttccacagaagaaaggccgacatgatggagagcctggccctgggcttcgacgacggcaagaccaagaccagcggcatcatcgaggccctgcacagatactaccagaacgccgccaccgacgtgagaagagtgtggctgagcagcgtggtggaccacttccacagcagcctgggcgacaagggctggggctgcggctacagaaacttccagatgctgctgagcagcctgctgcagaacgacgcctacaacgactgcctgaagggcatgctgatcccctgcatccccaagatccagagcatgatcgaggacgcctggaaggagggcttcgacccccagggcgccagccagctgaacaacagactgcagggcaccaaggcctggatcggcgcctgcgaggtgtacatcctgctgaccagcctgagagtgaagtgccacatcgtggacttccacaagagcaccggccccctgggcacccaccccagactgttcgagtggatcctgaactactacagcagcgagggcgagggcagccccaaggtggtgtgcaccagcaagccccccatctacctgcagcaccagggccacagcagaaccgtgatcggcatcgaggagaagaagaacagaaccctgtgcctgctgatcctggaccccggctgccccagcagagagatgcagaagctgctgaagcaggacatcgaggccagcagcctgaagcagctgagaaagagcatgggcaacctgaagcacaagcagtaccagatcctggccgtggagggcgccctgagcctggaggagaagctggccagaagacaggccagccaggtgttcaccgccgagaagatcccctag

SEQ ID NO: 26346 - DNA, 1260 bp, Artificial Sequence
  Description of Artificial Sequence: Synthetic coding sequence
atgcccggcagaggcagatgccccgactgcggcagcaccgagctggtggaggacagccactacagccagagccagctggtgtgcagcgactgcggctgcgtggtgaccgagggcgtgctgaccaccaccttcagcgacgagggcaacctgagagaggtgacctacagcagaagcaccggcgagaacgagcaggtgagcagaagccagcagagaggcctgagaagagtgagagacctgtgcagagtgctgcagctgccccccaccttcgaggacaccgccgtggcctactaccagcaggcctacagacacagcggcatcagagccgccagactgcagaagaaggaggtgctggtgggctgctgcgtgctgatcacctgcagacagcacaactggcccctgaccatgggcgccatctgcaccctgctgtacgccgacctggacgtgttcagcagcacctacatgcagatcgtgaagctgctgggcctggacgtgcccagcctgtgcctggccgagctggtgaagacctactgcagcagcttcaagctgttccaggccagccccagcgtgcccgccaagtacgtggaggacaaggagaagatgctgagcagaaccatgcagctggtggagctggccaacgagacctggctggtgaccggcagacaccccctgcccgtgatcaccgccgccaccttcctggcctggcagagcctgcagcccgccgacagactgagctgcagcctggccagattctgcaagctggccaacgtggacctgccctaccccgccagcagcagactgcaggagctgctggccgtgctgctgagaatggccgagcagctggcctggctgagagtgctgagactggacaagagaagcgtggtgaagcacatcggcgacctgctgcagcacagacagagcctggtgagaagcgccttcagagacggcaccgccgaggtggagaccagagagaaggagccccccggctggggccagggccagggcgagggcgaggtgggcaacaacagcctgggcctgccccagggcaagagacccgccagccccgccctgctgctgcccccctgcatgctgaagagccccaagagaatctgccccgtgccccccgtgagcaccgtgaccggcgacgagaacatcagcgacagcgagatcgagcagtacctgagaaccccccaggaggtgagagacttccagagagcccaggccgccagacaggccgccaccagcgtgcccaaccccccctag

SEQ ID NO: 26347 - DNA, 162 bp, Artificial Sequence
  Description of Artificial Sequence: Synthetic coding sequence
atggccgccacccagaagctggtgaaggacatcatcgacagcaagaccggcgagaccgccagcaagagatggaagggcgccaagaacagcgagaccgccgccaaggtggccctgatgaagctgaagatgcacgccgacggcgacaagagcctgccccagtag

SEQ ID NO: 26348 - DNA, 132 bp, Artificial Sequence
  Description of Artificial Sequence: Synthetic coding sequence
atggccgccacccagaagctggtgaaggacatcatcgacagcaagaccggcgagaccgccagcaagagatggaagggcgccaagaacagcgagaccgccgccaaggtggccctgatgaagctgaagatgtag

SEQ ID NO: 26349 - DNA, 129 bp, Artificial Sequence
  Description of Artificial Sequence: Synthetic coding sequence
atggccgccacccagaagctggtgaaggacatcatcgacagcaagaccggcgagaccgccagcaagagatggaagggcgccaagaacagcgagaccgccgccaaggtggccctgatgaagctgaagtag

SEQ ID NO: 26350 - DNA, 294 bp, Artificial Sequence
  Description of Artificial Sequence: Synthetic coding sequence
atggccgccacccagaagctggtgaaggacatcatcgacagcaagaccggcgagaccgccagcaagagatggaagggcgccaagaacagcgagaccgccgccaaggtggccctgatgaagctgaagatgcacgccgacggcgacaagagcctgccccagaccgagagaatctacttccaggtgttcctgcccaagggcagcaaggagaagagcaagcccatgttcttctgccacagatggagcatcggcaaggccatcgacttcgccgccagcctggccagactgaagaactag

SEQ ID NO: 26351 - DNA, 360 bp, Artificial Sequence
  Description of Artificial Sequence: Synthetic coding sequence
atggccgccacccagaagctggtgaaggacatcatcgacagcaagaccggcgagaccgccagcaagagatggaagggcgccaagaacagcgagaccgccgccaaggtggccctgatgaagctgaagatgcacgccgacggcgacaagagcctgccccagaccgagagaatctacttccaggtgttcctgcccaagggcagcaaggagaagagcaagcccatgttcttctgccacagatggagcatcggcaaggccatcgacttcgccgccagcctggccagactgaagaacgacaacaacaagttcaccgccaagaagctgagactgtgccacatcaccagcggcgaggccctgccctag

SEQ ID NO: 26352 - DNA, 486 bp, Artificial Sequence
  Description of Artificial Sequence: Synthetic coding sequence
atggccgccacccagaagctggtgaaggacatcatcgacagcaagaccggcgagaccgccagcaagagatggaagggcgccaagaacagcgagaccgccgccaaggtggccctgatgaagctgaagatgcacgccgacggcgacaagagcctgccccagaccgagagaatctacttccaggtgttcctgcccaagggcagcaaggagaagagcaagcccatgttcttctgccacagatggagcatcggcaaggccatcgacttcgccgccagcctggccagactgaagaacgacaacaacaagttcaccgccaagaagctgagactgtgccacatcaccagcggcgaggccctgcccctggaccacaccctggagacctggatcgccaaggaggactgccccctgtacaacggcggcaacatcatcctggagtacctgaacgacgaggagcagttctgcaagaacgtggagagctacctggagtag

SEQ ID NO: 26353 - DNA, 162 bp, Artificial Sequence; identical to SEQ ID NO: 26347
  Description of Artificial Sequence: Synthetic coding sequence

SEQ ID NO: 26354 - DNA, 486 bp, Artificial Sequence; identical to SEQ ID NO: 26352
  Description of Artificial Sequence: Synthetic coding sequence

SEQ ID NO: 26355 - DNA, 186 bp, Artificial Sequence
  Description of Artificial Sequence: Synthetic coding sequence
atggccgccacccagaagctggtgaaggacatcatcgacagcaagaccggcgagaccgccagcaagagatggaagggcgccaagaacagcgagaccgccgccaaggtggccctgatgaagctgaagatgcacgccgacggcgacaagagcctgccccagaccgagagaatctacttccaggtgtag

SEQ ID NO: 26356 - DNA, 348 bp, Artificial Sequence
  Description of Artificial Sequence: Synthetic coding sequence
atggacaacagaaaggagccccccttcttcaacgacgacaacatgggccccttctactacagactgcacttctgcgacaccatggagctgttcatcgagaccctgaccggcacctgcttcgagctgagagtgagccccttcgagaccgtgatcagcgtgaaggccaagatcagaagactggagggcatccccatctgcagacagcacctgatctggaacaacatggagctggagaacgactactgcctgaacgactacaacatcagcgagggctgcaccctgaagctggtgctggccatgagaggcggccccatcaacaccagaagagacctgcagatccccagatag

SEQ ID NO: 26357 - DNA, 2184 bp, Artificial Sequence
  Description of Artificial Sequence: Synthetic coding sequence
atggacaacagaaaggagccccccttcttcaacgacgacaacatgggccccttctactacagactgcacttctgcgacaccatggagctgttcatcgagaccctgaccggcacctgcttcgagctgagagtgagccccttcgagaccgtgatcagcgtgaaggccaagatcagaagactggagggcatccccatctgcagacagcacctgatctggaacaacatggagctggagaacgactactgcctgaacgactacaacatcagcgagggctgcaccctgaagctggtgctggccatgagaggcggccccatcaacaccagaagagtgcccaccgacgaccccctgagaaagatggccgagtacctggacagcagcagagtggaggtgtgggagaagaccagctgcagcaagcaggtgaccttcctggtgtaccaggagggcgaccagctgaacttcttccccgccgtggacagaggcgacggcaccctgacccccctgagcgacagcagcaagaagatcgacttccacctgcacgtgctgagaagaaagggcgagcacagaatgagcggcggcagcatgtacaacagcgacaccgacgaggacgaggagaccgagcccagcagcagcggccagcagatcatcgagaacagcatcaccatgaacaagatgaagctgctgaaggccaagatgaagaacatgaacctgagcaagaagcccaagaaggccgtgaagatcaagccccacccccccgtggcccccagacccagcagcggcagcaccgcccccagcagacacagactgctgagagtgctgcccaacatcggccagagctgcagccccgccttcggcaacgcctacccccccgagatcagcagaaacggcatcagcagcctggccacccagctgagcgccgagagatacatcagcagcatcaccggcgagttcctgaaggaggacaacagctgggagaacaacaccctgagccacttcagcagcaacgtgaagctgcccccccagatcccccacctggagctgggcaacgaccaggagctggccgacagcgtgctgcacctgggcagcagcctgcccagacagaccaagcacttcctgggcaacctgcccagcagcaacggcaacatcgtgctgcccagcgaggagtgcgtgaccgagcagagcctgctgcccaaggtgggcagcctggccagcttcgccgagggcaacgccgacgagcagagcagcggcctggagggcgcctgcaaggtgaacctggagctgctgctgaccaacgccgacaagggcctgaaggcccccgagcagcacctgaagcacgtggccggcgtgctgaacggcgagagcgtggagaccagcgtgctgaactacagagagctgagcccccacaagaacagactgctgagccccctgagatgcagcgcccccatgagcctgcacaacagcctggtgaagcccgagagacagagcaagtgcttcgagttcggcaagctgcagcccagcagcagccagagcctggacgtgcagaacatcaccgacagcagcttcagcagaaccacctgcttccagggcgtgaaggtggacagcctgggcaagagaagcgacgtgatcagcaaggtggaggccagagacatcaccgagatgaccaacaaggccagcaaggagcccgtgggctgcgtgaacaacatcagcttcctggccagcctggccggcagcaccagcagaaacagactgcagagcaccagaggcgccggcagactgcagaacagcggcaccggcctgagcaccaacctgcagcacttccaggaggagaacttcagaaagagcagcccccagctggagcacaccggcgtgttcctgagcacccacggcgtgggcatgaacggcaacaacgccgccgccggcaagagcgtgggcgagtgcaccacccaccacctgccccccgtgaaggcccccctgcagaccaagaagaagaccaccaaccactgcttcctgtgcggcaagaagaccggcctggccagcagctacgagtgcagatgcggcaacaacttctgcgccagccacagatacgccgagacccacggctgcacctacgactacaagagcgccggcagaagatacctgcacgaggccaaccccgtggtgaacgcccccaagctgcccaagatctag

SEQ ID NO: 26358 - DNA, 1962 bp, Artificial Sequence
  Description of Artificial Sequence: Synthetic coding sequence
atggagctggagaacgactactgcctgaacgactacaacatcagcgagggctgcaccctgaagctggtgctggccatgagaggcggccccatcaacaccagaagagtgcccaccgacgaccccctgagaaagatggccgagtacctggacagcagcagagtggaggtgtgggagaagaccagctgcagcaagcaggtgaccttcctggtgtaccaggagggcgaccagctgaacttcttccccgccgtggacagaggcgacggcaccctgacccccctgagcgacagcagcaagaagatcgacttccacctgcacgtgctgagaagaaagggcgagcacagaatgagcggcggcagcatgtacaacagcgacaccgacgaggacgaggagaccgagcccagcagcagcggccagcagatcatcgagaacagcatcaccatgaacaagatgaagctgctgaaggccaagatgaagaacatgaacctgagcaagaagcccaagaaggccgtgaagatcaagccccacccccccgtggcccccagacccagcagcggcagcaccgcccccagcagacacagactgctgagagtgctgcccaacatcggccagagctgcagccccgccttcggcaacgcctacccccccgagatcagcagaaacggcatcagcagcctggccacccagctgagcgccgagagatacatcagcagcatcaccggcgagttcctgaaggaggacaacagctgggagaacaacaccctgagccacttcagcagcaacgtgaagctgcccccccagatcccccacctggagctgggcaacgaccaggagctggccgacagcgtgctgcacctgggcagcagcctgcccagacagaccaagcacttcctgggcaacctgcccagcagcaacggcaacatcgtgctgcccagcgaggagtgcgtgaccgagcagagcctgctgcccaaggtgggcagcctggccagcttcgccgagggcaacgccgacgagcagagcagcggcctggagggcgcctgcaaggtgaacctggagctgctgctgaccaacgccgacaagggcctgaaggcccccgagcagcacctgaagcacgtggccggcgtgctgaacggcgagagcgtggagaccagcgtgctgaactacagagagctgagcccccacaagaacagactgctgagccccctgagatgcagcgcccccatgagcctgcacaacagcctggtgaagcccgagagacagagcaagtgcttcgagttcggcaagctgcagcccagcagcagccagagcctggacgtgcagaacatcaccgacagcagcttcagcagaaccacctgcttccagggcgtgaaggtggacagcctgggcaagagaagcgacgtgatcagcaaggtggaggccagagacatcaccgagatgaccaacaaggccagcaaggagcccgtgggctgcgtgaacaacatcagcttcctggccagcctggccggcagcaccagcagaaacagactgcagagcaccagaggcgccggcagactgcagaacagcggcaccggcctgagcaccaacctgcagcacttccaggaggagaacttcagaaagagcagcccccagctggagcacaccggcgtgttcctgagcacccacggcgtgggcatgaacggcaacaacgccgccgccggcaagagcgtgggcgagtgcaccacccaccacctgccccccgtgaaggcccccctgcagaccaagaagaagaccaccaaccactgcttcctgtgcggcaagaagaccggcctggccagcagctacgagtgcagatgcggcaacaacttctgcgccagccacagatacgccgagacccacggctgcacctacgactacaagagcgccggcagaagatacctgcacgaggccaaccccgtggtgaacgcccccaagctgcccaagatctag

SEQ ID NO: 26359 - DNA, 1830 bp, Artificial Sequence
  Description of Artificial Sequence: Synthetic coding sequence
atggccgagtacctggacagcagcagagtggaggtgtgggagaagaccagctgcagcaagcaggtgaccttcctggtgtaccaggagggcgaccagctgaacttcttccccgccgtggacagaggcgacggcaccctgacccccctgagcgacagcagcaagaagatcgacttccacctgcacgtgctgagaagaaagggcgagcacagaatgagcggcggcagcatgtacaacagcgacaccgacgaggacgaggagaccgagcccagcagcagcggccagcagatcatcgagaacagcatcaccatgaacaagatgaagctgctgaaggccaagatgaagaacatgaacctgagcaagaagcccaagaaggccgtgaagatcaagccccacccccccgtggcccccagacccagcagcggcagcaccgcccccagcagacacagactgctgagagtgctgcccaacatcggccagagctgcagccccgccttcggcaacgcctacccccccgagatcagcagaaacggcatcagcagcctggccacccagctgagcgccgagagatacatcagcagcatcaccggcgagttcctgaaggaggacaacagctgggagaacaacaccctgagccacttcagcagcaacgtgaagctgcccccccagatcccccacctggagctgggcaacgaccaggagctggccgacagcgtgctgcacctgggcagcagcctgcccagacagaccaagcacttcctgggcaacctgcccagcagcaacggcaacatcgtgctgcccagcgaggagtgcgtgaccgagcagagcctgctgcccaaggtgggcagcctggccagcttcgccgagggcaacgccgacgagcagagcagcggcctggagggcgcctgcaaggtgaacctggagctgctgctgaccaacgccgacaagggcctgaaggcccccgagcagcacctgaagcacgtggccggcgtgctgaacggcgagagcgtggagaccagcgtgctgaactacagagagctgagcccccacaagaacagactgctgagccccctgagatgcagcgcccccatgagcctgcacaacagcctggtgaagcccgagagacagagcaagtgcttcgagttcggcaagctgcagcccagcagcagccagagcctggacgtgcagaacatcaccgacagcagcttcagcagaaccacctgcttccagggcgtgaaggtggacagcctgggcaagagaagcgacgtgatcagcaaggtggaggccagagacatcaccgagatgaccaacaaggccagcaaggagcccgtgggctgcgtgaacaacatcagcttcctggccagcctggccggcagcaccagcagaaacagactgcagagcaccagaggcgccggcagactgcagaacagcggcaccggcctgagcaccaacctgcagcacttccaggaggagaacttcagaaagagcagcccccagctggagcacaccggcgtgttcctgagcacccacggcgtgggcatgaacggcaacaacgccgccgccggcaagagcgtgggcgagtgcaccacccaccacctgccccccgtgaaggcccccctgcagaccaagaagaagaccaccaaccactgcttcctgtgcggcaagaagaccggcctggccagcagctacgagtgcagatgcggcaacaacttctgcgccagccacagatacgccgagacccacggctgcacctacgactacaagagcgccggcagaagatacctgcacgaggccaaccccgtggtgaacgcccccaagctgcccaagatctag

SEQ ID NO: 26360 - DNA, 675 bp, Artificial Sequence
  Description of Artificial Sequence: Synthetic coding sequence
atggacaacagaaaggagccccccttcttcaacgacgacaacatgggccccttctactacagactgcacttctgcgacaccatggagctgttcatcgagaccctgaccggcacctgcttcgagctgagagtgagccccttcgagaccgtgatcagcgtgaaggccaagatcagaagactggagggcatccccatctgcagacagcacctgatctggaacaacatggagctggagaacgactactgcctgaacgactacaacatcagcgagggctgcaccctgaagctggtgctggccatgagaggcggccccatcaacaccagaagagtgcccaccgacgaccccctgagaaagatggccgagtacctggacagcagcagagtggaggtgtgggagaagaccagctgcagcaagcaggtgaccttcctggtgtaccaggagggcgaccagctgaacttcttccccgccgtggacagaggcgacggcaccctgacccccctgagcgacagcagcaagaagatcgacttccacctgcacgtgctgagaagaaagggcgagcacagaatgagaagaatgtactacagcagcccccccacctgcgagagccccagcagcgacaaggaggagaacaacaagagcctgttcagcctgtggaaggagaacagaaccggctag

SEQ ID NO: 26361 - DNA, 675 bp, Artificial Sequence; identical to SEQ ID NO: 26360
  Description of Artificial Sequence: Synthetic coding sequence

SEQ ID NO: 26362 - DNA, 627 bp, Artificial Sequence
  Description of Artificial Sequence: Synthetic coding sequence
atggcccaggagaccaaccacagccaggtgcccatgctgtgcagcaccggctgcggcttctacggcaaccccagaaccaacggcatgtgcagcgtgtgctacaaggagcacctgcagagacagaacagcagcaacggcagaatcagcccccccgccaccagcgtgagcagcctgagcgagagcctgcccgtgcagtgcaccgacggcagcgtgcccgaggcccagagcgccctggacagcaccagcagcagcatgcagcccagccccgtgagcaaccagagcctgctgagcgagagcgtggccagcagccagctggacagcaccagcgtggacaaggccgtgcccgagaccgaggacgtgcaggccagcgtgagcgacaccgcccagcagcccagcgaggagcagagcaagagcctggagaagcccaagcagaagaagaacagatgcttcatgtgcagaaagaaggtgggcctgaccggcttcgagtgcagatgcggcaacgtgtactgcggcgtgcacagatacagcgacgtgcacaactgcagctacaactacaaggccgacgccgccgagaagatcagaaaggagaaccccgtggtggtgggcgagaagatccagaagatctag

SEQ ID NO: 26363 - DNA, 2520 bp, Artificial Sequence
  Description of Artificial Sequence: Synthetic coding sequence
atgaacagaaaggacttcgtggtgctgccctggggcaagcccggcaacagcgtgaagctgaagtacagaaacgcccaggagctgagaatggagaaggtgcagctggagttcgagaaccaggagatggagaagaagctgcaggagttcagaagcaccagaaacaaggagaaggaggacagagagagcagcgagtactactggaagagcggcaaggtgggcaagctggtgaaccagagctacatgatgagccagaacaagggcaacgtggtgaagttcagcgccggcaaggtgaagctgaagctgctgaaggagcagatccaggagcccgtgaagcccaccgtgaactacaagatggccaacagcagcgagtgcgagaagcccaagatcaacggcaaggtgtgcggccagtgcgagaacaaggccgccctgctggtgtgcctggagtgcggcgaggactactgcagcggctgcttcgccaaggtgcaccagaagggcgccctgaagctgcacagaaccaccctgctgcaggccaagagccagatcctgttcaacgtgctggacgtggcccaccagttcatcaaggacgtgaaccccgacgagcccaaggaggagaacaacagcaccaaggagaccagcaagatccagcacaagcccaagagcgtgctgctgcagagaagcagcagcgaggtggagatcaccaccatgaagagagcccagagaaccaagcccagaaagagcctgctgtgcgagggcagcttcgacgaggaggccagcgcccagagcttccaggaggtgctgagccagtggagaaccggcaaccacgacgacaacaagaagcagaacctgcacgccgccgtgaaggacagcctggaggagtgcgaggtgcagaccaacctgaagatctggagagagcccctgaacatcgagctgaaggaggacatcctgagctacatggagaagctgtggctgaagaagcacagaagaaccccccaggagcagctgttcaagatgctgcccgacaccttcccccacccccacgagaccaccggcgacgcccagtgcagccagaacgagaacgacgaggacagcgacggcgaggagaccaaggtgcagcacaccgccctgctgctgcccgtggagaccctgaacatcgagagacccgagcccagcctgaagatcgtggagctggacgacacctacgaggaggagttcgaggaggccgagaacatcgtgccctacaaggtgaagctggccgacgccgacagccagagaagctgcgccttccacgactgccagaagaacagcttcccctacgagaacggcatccaccagcaccacgtgttcgacaagggcaagagagacttcctgaacctgtgcctgagaaacagcagcacctactacaaggacaacagcaaggccgagaccagcaacaccgacttcgacaacatcgtggaccccgacgtgtacagcagcgacatcgagaagatcgaggagagcaccagcttcgagagaaacctgaaggagaagaacatcggcctggagagcaaccagaagagcgacgacagctgcgtgagcctggagagcaaggacaccctgctgggcagagacctggagaaggcccccatcgaggagaagctgagccaggacatcaaggagagcctggagctgagcaacctgtacaagagacccagcttcgaggagagcaagaccaccaagagcagcctgctgctgcaggagatcgcctgcagaagcaagcccatcaccaagcagtaccagggcctggagagattcttcatcttcgacaccaacgagagactgaacctgctgcccagccacagactggagtgcaacaacagcagcaccagaatcaccctggccgaggacagagagtggatccccgaccacagcctgagcgagtacgccgacaacgccatcgtgctgggcgtgctgcagggcgcccagagccccagcagcagcagaaagcagcagaagatgggccagaagagccagagacccagcaccgccaacttccccctgagcaacagcgtgaaggagagcagcagctgcctgagcagcagccaccccagaagcagaagcgccgccgcccagagcagcagcagagccgccagcgagatcagcgagatcgagtacatcgacatcaccgaccagaacgagctgagcctggacgacaccaccgaccagcacaccctggacaacctggagaaggagctgcaggtgctgagaagcctggccgacaccagcgagaagctgtacagcctgaccagcgaggagttccccgacttcagcagccagagcctgaacatcagccagatcagcaccgacttcctgaagaccagccacgtgagaggcccctgcggcgtggaggagctgagctgcagcggcagagacaccaagatccagagcctgctgagcctgagcgagagcagcaccgacgaggaggaggaggacttcctgaacaagcagcacgtgatcaccctgccctggagcaagagcacctag

SEQ ID NO: 26364 - DNA, 2403 bp, Artificial Sequence
  Description of Artificial Sequence: Synthetic coding sequence
atgaacagaaaggacttcgtggtgctgccctggggcaagcccggcaacagcgtgaagctgaagtacagaaacgcccaggagctgagaatggagaaggtgcagctggagttcgagaaccaggagatggagaagaagctgcaggagttcagaagcaccagaaacaaggagaaggaggacagagagagcagcgagtactactggaagagcggcaaggtgggcaagctggtgaaccagagctacatgatgagccagaacaagggcaacgtggtgaagttcagcgccggcaaggtgaagctgaagctgctgaaggagcagatccaggagcccgtgaagcccaccgtgaactacaagatggccaacagcagcgagtgcgagaagcccaagatcaacggcaaggtgtgcggccagtgcgagaacaaggccgccctgctggtgtgcctggagtgcggcgaggactactgcagcggctgcttcgccaaggtgcaccagaagggcgccctgaagctgcacagaaccaccctgctgcaggccaagagccagatcctgttcaacgtgctggacgtggcccaccagttcatcaaggacgtgaaccccgacgagcccaaggaggagaacaacagcaccaaggagaccagcaagatccagcacaagcccaagagcgtgctgctgcagagaagcagcagcgaggtggagatcaccaccatgaagagagcccagagaaccaagcccagaaagagcctgctgtgcgagggcagcttcgacgaggaggccagcgcccagagcttccaggaggtgctgagccagtggagaaccggcaaccacgacgacaacaagaagcagaacctgcacgccgccgtgaaggacagcctggaggagtgcgaggtgcagaccaacctgaagatctggagagagcccctgaacatcgagctgaaggaggacatcctgagctacatggagaagctgtggctgaagaagcacagaagaaccccccaggagcagctgttcaagatgctgcccgacaccttcccccacccccacgagaccaccggcgacgcccagtgcagccagaacgagaacgacgaggacagcgacggcgaggagaccaaggtgcagcacaccgccctgctgctgcccgtggagaccctgaacatcgagagacccgagcccagcctgaagatcgtggagctggacgacacctacgaggaggagttcgaggaggccgagaacatcgtgccctacaaggtgaagctggccgacgccgacagccagagaagctgcgccttccacgactgccagaagaacagcttcccctacgagaacggcatccaccagcaccacgtgttcgacaagggcaagagagacttcctgaacctgtgcctgagaaacagcagcacctactacaaggacaacagcaaggccgagaccagcaacaccgacttcgacaacatcgtggaccccgacgtgtacagcagcgacatcgagaagatcgaggagagcaccagcttcgagagaaacctgaaggagaagaacatcggcctggagagcaaccagaagagcgacgacagctgcgtgagcctggagagcaaggacaccctgctgggcagagacctggagaaggcccccatcgaggagaagctgagccaggacatcaaggagagcctggagctgagcaacctgtacaagagacccagcttcgaggagagcaagaccaccaagagcagcctgctgctgcaggagatcgcctgcagaagcaagcccatcaccaagcagtaccagggcctggagagattcttcatcttcgacaccaacgagagactgaacctgctgcccagccacagactggagtgcaacaacagcagcaccagaatcaccctggccggccagaagagccagagacccagcaccgccaacttccccctgagcaacagcgtgaaggagagcagcagctgcctgagcagcagccaccccagaagcagaagcgccgccgcccagagcagcagcagagccgccagcgagatcagcgagatcgagtacatcgacatcaccgaccagaacgagctgagcctggacgacaccaccgaccagcacaccctggacaacctggagaaggagctgcaggtgctgagaagcctggccgacaccagcgagaagctgtacagcctgaccagcgaggagttccccgacttcagcagccagagcctgaacatcagccagatcagcaccgacttcctgaagaccagccacgtgagaggcccctgcggcgtggaggagctgagctgcagcggcagagacaccaagatccagagcctgctgagcctgagcgagagcagcaccgacgaggaggaggaggacttcctgaacaagcagcacgtgatcaccctgccctggagcaagagcacctag

SEQ ID NO: 26365 - DNA, 2403 bp, Artificial Sequence; identical to SEQ ID NO: 26364
  Description of Artificial Sequence: Synthetic coding sequence

SEQ ID NO: 26366 - DNA, 2520 bp, Artificial Sequence; identical to SEQ ID NO: 26363
  Description of Artificial Sequence: Synthetic coding sequence

SEQ ID NO: 26367 - DNA, 492 bp, Artificial Sequence
  Description of Artificial Sequence: Synthetic coding sequence
atgaacagaaaggacttcgtggtgctgccctggggcaagcccggcaacagcgtgaagctgaagtacagaaacgcccaggagctgagaatggagaaggtgcagctggagttcgagaaccaggagatggagaagaagctgcaggagttcagaagcaccagaaacaaggagaaggaggacagagagagcagcgagtactactggaagagcggcaaggtgggcaagctggtgaaccagagctacatgatgagccagaacaagggcaacgtggtgaagttcagcgccggcaaggtgaagctgaagctgctgaaggagcagatccaggagcccgtgaagcccaccgtgaactacaagatggccaacagcagcgagtgcgagaagcccaagatcaacggcaaggtgtgcggccagtgcgagaacaaggccgccctgctggtgtgcctggagtgcggcgaggactactgcagcggctgcttcgccaaggtgcaccagtag

SEQ ID NO: 26368 - DNA, 657 bp, Artificial Sequence
  Description of Artificial Sequence: Synthetic coding sequence
atgatgagaagagaggacgaggaggaggagggcaccatgatgaaggccaagggcgacctggagatgaaggaggaggaggagatcagcgagaccggcgagctggtgggccccttcgtgagcgccatgcccacccccatgccccacaacaagggcaccagattcagcgaggcctgggagtacttccacctggcccccgccagagccggccaccaccccaaccagtacgccacctgcagactgtgcggcagacaggtgagcagaggccccggcgtgaacgtgggcaccaccgccctgtggaagcacctgaagagcatgcacagagaggagctggagaagagcggccacggccaggccggccagagacaggaccccagaccccacggcccccagctgcccaccggcatcgagggcaactggggcagactgctggagcaggtgggcaccatggccctgtgggccagccagagagagaaggaggtgctgagaagagagagagccgtggagtggagagagagagccgtggagaagagagagagagccctggaggaggtggagagagccatcctggagatgaagtggaaggtgagagccgagaaggaggcctgccagagagagaaggagctgcccgccgccgtgcaccccttccacttcgtgtag

SEQ ID NO: 26369 - DNA, 705 bp, Artificial Sequence
  Description of Artificial Sequence: Synthetic coding sequence
atgagaagcggcgagcccgcctgcaccatggaccaggccagaggcctggacgacgccgccgccagaggcggccagtgccccggcctgggccccgcccccacccccaccccccccggcagactgggcgccccctacagcgaggcctggggctacttccacctggcccccggcagacccggccaccccagcggccactgggccacctgcagactgtgcggcgagcaggtgggcagaggccccggcttccacgccggcaccagcgccctgtggagacacctgagaagcgcccacagaagagagctggagagcagcggcgccggcagcagcccccccgccgccccctgcccccccccccccggccccgccgccgcccccgagggcgactgggccagactgctggagcagatgggcgccctggccgtgagaggcagcagaagagagagagagctggagagaagagagctggccgtggagcagggcgagagagccctggagagaagaagaagagccctgcaggaggaggagagagccgccgcccaggccagaagagagctgcaggccgagagagaggccctgcaggccagactgagagacgtgagcagaagagagggcgccctgggctgggcccccgccgcccccccccccctgaaggacgaccccgagggcgacagagacggctgcgtgatcaccaaggtgctgctgtag

SEQ ID NO: 26370 - DNA, 453 bp, Artificial Sequence
  Description of Artificial Sequence: Synthetic coding sequence
atgagaagcggcgagcccgcctgcaccatggaccaggccagaggcctggacgacgccgccgccagaggcggccagtgccccggcctgggccccgcccccacccccaccccccccggcagactgggcgccccctacagcgaggcctggggctacttccacctggcccccggcagacccggccaccccagcggccactgggccacctgcagactgtgcggcgagcaggtgggcagaggccccggcttccacgccggcaccagcgccctgtggagacacctgagaagcgcccacagaagagagctggagagcagcggcgccggcagcagcccccccgccgccccctgcccccccccccccggccccgccgccgcccccgagggcgactgggccagactgctggagcagatgggcgccctggccgtgagaggcagcagaagagagagagagctgtag

SEQ ID NO: 26371 - DNA, 5970 bp, Artificial Sequence
  Description of Artificial Sequence: Synthetic coding sequence
atggccaccgccgacacccccgcccccgccagcagcggcctgagccccaaggaggagggcgagctggaggacggcgagatcagcgacgacgacaacaacagccagatcagaagcagaagcagcagcagcagcagcggcggcggcctgctgccctaccccagaagaagacccccccacagcgccagaggcggcggcagcggcggcggcggcggcagcagcagcagcagcagcagcagccagcagcagctgagaaacttcagcagaagcagacacgccagcgagagaggccacctgagaggccccagcagctacagacccaaggagcccttcagaagccacccccccagcgtgagaatgcccagcagcagcctgagcgagagcagccccagacccagcttctgggagagaagccacctggccctggacagattcagattcagaggcagaccctacagaggcggcagcagatggagcagaggcagaggcgtgggcgagagaggcggcaagcccggctgcagaccccccctgggcggcggcgccggcagcggcttcagcagcagccagagctggagagagcccagcccccccagaaagagcagcaagagcttcggcagaagccccagcagaaagcagaactacagcagcaagaacgagaactgcgtggaggagaccttcgaggacctgctgctgaagtacaagcagatccagctggagctggagtgcatcaacaaggacgagaagctggccctgagcagcaaggaggagaacgtgcaggaggaccccaagaccctgaacttcgaggaccagaccagcaccgacaacgtgagcatcaccaaggacagcagcaaggaggtggcccccgaggagaagacccaggtgaagaccttccaggccttcgagctgaagcccctgagacagaagctgaccctgcccggcgacaagaacagactgaagaaggtgaaggacggcgccaagcccctgagcctgaagagcgacaccaccgacagcagccagggcctgcaggacaaggagcagaacctgaccagaagaatcagcaccagcgacatcctgagcgagaagaagctgggcgaggacgaggaggagctgagcgagctgcagctgagactgctggccctgcagagcgccagcaagaagtggcagcagaaggagcagcaggtgatgaaggagagcaaggagaagctgaccaagaccaagaccgtgcagcagaaggtgaagaccagcaccaagacccacagcgccaagaaggtgagcaccaccgccaagcaggccctgagaaagcagcagaccaaggcctggaagaagctgcagcagcagaaggagcaggagagacagaaggaggaggaccagagaaagcaggccgaggaggaggagagaagaaagagagaggaggagatcagaaagatcagagacctgagcaaccaggaggagcagtacaacagattcatgaagctggtgggcggcaagagaagaagcagaagcaagagcagcgaccccgacctgagaagaagcctggacaagcagcccaccgacagcggcggcggcatctaccagtacgacaactacgaggaggtggccatggacaccgacagcgagaccagcagccccgcccccagccccgtgcagccccccttcttcagcgagtgcagcctgggctacttcagccccgcccccagcctgagcctgcccccccccccccaggtgagcagcctgccccccctgagccagccctacgtggagggcctgtgcgtgagcctggagcccctgccccccctgccccccctgccccccctgccccccgaggaccccgagcagccccccaagccccccttcgccgacgaggaggaggaggaggagatgctgctgagagaggagctgctgaagagcctggccaacaagagagccttcaagcccgaggagaccagcagcaacagcgacccccccagcccccccgtgctgaacaacagccaccccgtgcccagaagcaacctgagcatcgtgagcatcaacaccgtgagccagcccagaatccagaaccccaagttccacagaggccccagactgcccagaaccgtgatcagcctgcccaagcacaagagcgtggtggtgaccctgaacgacagcgacgacagcgagagcgacggcgaggccagcaagagcaccaacagcgtgttcggcggcctggagagcatgatcaaggaggccagaagaaccgccgagcaggccagcaagcccaaggtgccccccaagagcgagaaggagaacgaccccctgagaacccccgaggccctgcccgaggagaagaagatcgagtacagactgctgaaggaggagatcgccaacagagagaagcagagactgatcaagagcgaccagctgaagaccagcagcagcagccccgccaacagcgacgtggagatcgacggcatcggcagaatcgccatggtgaccaagcaggtgaccgacgccgagagcaagctgaagaagcacagaatcctgctgatgaaggacgagagcgtgctgaagaacctggtgcagcaggaggccaagaagaaggagagcgtgagaaacgccgaggccaagatcaccaagctgaccgagcagctgcaggccaccgagaagatcctgaacgtgaacagaatgttcctgaagaagctgcaggagcagatccacagagtgcagcagagagtgaccatcaagaaggccctgaccctgaagtacggcgaggagctggccagagccaaggccgtggccagcaaggagatcggcaagagaaagctggagcaggacagattcggccccaacaagatgatgagactggacagcagccccgtgagcagccccagaaagcacagcgccgagctgatcgccatggagaagagaagactgcagaagctggagtacgagtacgccctgaagatccagaagctgaaggaggccagagccctgaaggccaaggagcagcagaacatcagccccgtggtggaggaggagcccgagttcagcctgccccagcccagcctgcacgacctgacccaggacaagctgaccctggacaccgaggagaacgacgtggacgacgagatcctgagcggcagcagcagagagagaagaagaagcttcctggagagcaactacttcaccaagcccaacctgaagcacaccgacaccgccaacaaggagtgcatcaacaagctgaacaagaacaccgtggagaagcccgagctgttcctgggcctgaagatcggcgagctgcagaagctgtacagcaaggccgacagcctgaagcagctgatcctgaagaccaccaccggcatcaccgagaaggtgctgcacggccaggagatcagcgtggacgtggacttcgtgaccgcccagagcaagaccatggaggtgaagccctgccccttcagaccctaccacagccccctgctggtgttcaagagctacagattcagcccctactacagaaccaaggagaagctgcccctgagcagcgtgagctacagcaacatgatcgagcccgaccagtgcttctgcagattcgacctgaccggcacctgcaacgacgacgactgccagtggcagcacatccaggactacaccctgagcagaaagcagctgttccaggacatcctgagctacaacctgagcctgatcggctgcgccgagaccagcaccaacgaggagatcaccgccagcgccgagaagtacgtggagaagctgttcggcgtgaacaaggacagaatgagcatggaccagatggccgtgctgctggtgagcaacatcaacgagagcaagggccacaccccccccttcaccacctacaaggacaagagaaagtggaagcccaagttctggagaaagcccatcagcgacaacagcttcagcagcgacgaggagcagagcaccggccccatcaagtacgccttccagcccgagaaccagatcaacgtgcccgccctggacaccgtggtgacccccgacgacgtgagatacttcaccaacgagaccgacgacatcgccaacctggaggccagcgtgctggagaaccccagccacgtgcagctgtggctgaagctggcctacaagtacctgaaccagaacgagggcgagtgcagcgagagcctggacagcgccctgaacgtgctggccagagccctggagaacaacaaggacaaccccgagatctggtgccactacctgagactgttcagcaagagaggcaccaaggacgaggtgcaggagatgtgcgagaccgccgtggagtacgcccccgactaccagagcttctggaccttcctgcacctggagagcaccttcgaggagaaggactacgtgtgcgagagaatgctggagttcctgatgggcgccgccaagcaggagaccagcaacatcctgagcttccagctgctggaggccctgctgttcagagtgcagctgcacatcttcaccggcagatgccagagcgccctggccatcctgcagaacgccctgaagagcgccaacgacggcatcgtggccgagtacctgaagaccagcgacagatgcctggcctggctggcctacatccacctgatcgagttcaacatcctgcccagcaagttctacgaccccagcaacgacaaccccagcagaatcgtgaacaccgagagcttcgtgatgccctggcaggccgtgcaggacgtgaagaccaaccccgacatgctgctggccgtgttcgaggacgccgtgaaggcctgcaccgacgagagcctggccgtggaggagagaatcgaggcctgcctgcccctgtacaccaacatgatcgccctgcaccagctgctggagagatacgaggccgccatggagctgtgcaagagcctgctggagagctgccccatcaactgccagctgctggaggccctggtggccctgtacctgcagaccaaccagcacgacaaggccagagccgtgtggctgaccgccttcgagaagaacccccagaacgccgaggtgttctaccacatgtgcaagttcttcatcctgcagaacagaggcgacaacctgctgcccttcctgagaaagttcatcgccagcttcttcaagcccggcttcgagaagtacaacaacctggacctgttcagatacctgctgaacatccccggccccatcgacatccccagcagactgtgcaagggcaacttcgacgacgacatgttcaaccaccaggtgccctacctgtggctgatctactgcctgtgccaccccctgcagagcagcatcaaggagaccgtggaggcctacgaggccgccctgggcgtggccatgagatgcgacatcgtgcagaagatctggatggactacctggtgttcgccaacaacagagccgccggcagcagaaacaaggtgcaggagttcaagttcttcaccgacctggtgaacagatgcctggtgaccgtgcccgccagataccccatccccttcagcagcgccgactactggagcaactacgagttccacaacagagtgatcttcttctacctgagctgcgtgcccaagacccagcacagcaagaccctggagagattctgcagcgtgatgcccgccaacagcggcctggccctgagactgctgcagcacgagtgggaggagagcaacgtgcagatcctgaagctgcaggccaagatgttcacctacaacatccccacctgcctggccacctggaagatcgccatcgccgccgagatcgtgctgaagggccagagagaggtgcacagactgtaccagagagccctgcagaagctgcccctgtgcgccagcctgtggaaggaccagctgctgttcgaggccagcgagggcggcaagaccgacaacctgagaaagctggtgagcaagtgccaggagatcggcgtgagcctgaacgagctgctgaacctgaacagcaacaagaccgagagcaagaaccactag

SEQ ID NO: 26372 - DNA, 1041 bp, Artificial Sequence
  Description of Artificial Sequence: Synthetic coding sequence
atggccaccgccgacacccccgcccccgccagcagcggcctgagccccaaggaggagggcgagctggaggacggcgagatcagcgacgacgacaacaacagccagatcagaagcagaagcagcagcagcagcagcggcggcggcctgctgccctaccccagaagaagacccccccacagcgccagaggcggcggcagcggcggcggcggcggcagcagcagcagcagcagcagcagccagcagcagctgagaaacttcagcagaagcagacacgccagcgagagaggccacctgagaggccccagcagctacagacccaaggagcccttcagaagccacccccccagcgtgagaatgcccagcagcagcctgagcgagagcagccccagacccagcttctgggagagaagccacctggccctggacagattcagattcagaggcagaccctacagaggcggcagcagatggagcagaggcagaggcgtgggcgagagaggcggcaagcccggctgcagaccccccctgggcggcggcgccggcagcggcttcagcagcagccagagctggagagagcccagcccccccagaaagagcagcaagagcttcggcagaagccccagcagaaagcagaactacagcagcaagaacgagaactgcgtggaggagaccttcgaggacctgctgctgaagtacaagcagatccagctggagctggagtgcatcaacaaggacgagaagctggccctgagcagcaaggaggagaacgtgcaggaggaccccaagaccctgaacttcgaggaccagaccagcaccgacaacgtgagcatcaccaaggacagcagcaaggaggtggcccccgaggagaagacccaggtgaagaccttccaggccttcgagctgaagcccctgagacagaagctgaccctgcccggcgacaagaacagactgaagaaggtgaaggacggcgccaagcccctgagcctgaagagcgacaccaccgacagcagccagggcaacggcatcaagtacttcagctag

SEQ ID NO: 26373 - DNA, 606 bp, Artificial Sequence
  Description of Artificial Sequence: Synthetic coding sequence
atggagaagatcaaggccagactgaaggccgagttcgaggccctggagagcgaggagagacacctgaaggagtacaagcaggagatggacctgctgctgcaggagaagatggcccacgtggaggagctgagactgatccacgccgacatcaacgtgatggagaacaccatcaagcagagcgagaacgacctgaacaagctgctggagagcaccagaagactgcacgacgagtacaagcccctgaaggagcacgtggacgccctgagaatgaccctgggcctgcagagactgcccgacctgtgcgaggaggaggagaagctgagcctggactacttcgagaagcagaaggccgagtggcagaccgagccccaggagccccccatccccgagagcctggccgccgccgccgccgccgcccagcagctgcaggtggccagaaagcaggacaccagacagaccgccaccttcagacagcagcccccccccatgaaggcctgcctgagctgccaccagcagatccacagaaacgcccccatctgccccctgtgcaaggccaagagcagaagcagaaaccccaagaagcccaagagaaagcaggacgagtag

SEQ ID NO: 26374 - DNA, 675 bp, Artificial Sequence
  Description of Artificial Sequence: Synthetic coding sequence
atggccgacgagcaggagatcatgtgcaagctggagagcatcaaggagatcagaaacaagaccctgcagatggagaagatcaaggccagactgaaggccgagttcgaggccctggagagcgaggagagacacctgaaggagtacaagcaggagatggacctgctgctgcaggagaagatggcccacgtggaggagctgagactgatccacgccgacatcaacgtgatggagaacaccatcaagcagagcgagaacgacctgaacaagctgctggagagcaccagaagactgcacgacgagtacaagcccctgaaggagcacgtggacgccctgagaatgaccctgggcctgcagagactgcccgacctgtgcgaggaggaggagaagctgagcctggactacttcgagaagcagaaggccgagtggcagaccgagccccaggagccccccatccccgagagcctggccgccgccgccgccgccgcccagcagctgcaggtggccagaaagcaggacaccagacagaccgccaccttcagacagcagcccccccccatgaaggcctgcctgagctgccaccagcagatccacagaaacgcccccatctgccccctgtgcaaggccaagagcagaagcagaaaccccaagaagcccaagagaaagcaggacgagtag

SEQ ID NO: 26375 - DNA, 531 bp, Artificial Sequence
  Description of Artificial Sequence: Synthetic coding sequence
atggccgacgagcaggagatcatgtgcaagctggagagcatcaaggagatcagaaacaagaccctgcagatggagaagatcaaggccagactgaaggccgagttcgaggccctggagagcgaggagagacacctgaaggagtacaagcaggagatggacctgctgctgcaggagaagatggcccacgtggaggagctgagactgatccacgccgacatcaacgtgatggagaacaccatcaagcagagcgagaacgacctgaacaagctgctggagagcaccagaagactgcacgacgagtacaagcccctgaaggagcacgtggacgccctgagaatgaccctgggcctgcagagactgcccgacctgtgcgaggaggaggagaagctgagcctggagcccgcctgccacgtgaccagcaagttcaccggcatgcacctgtacgccctgttcgccagacccagagtgggccccggcacccccaagagcagaaacggcagcagaatgaacaaggagagagagagcacctag

SEQ ID NO: 26376 - DNA, 660 bp, Artificial Sequence
  Description of Artificial Sequence: Synthetic coding sequence
atgatccacttccacctgatcttcctgtacgtggccagaaacaagaccctgcagatggagaagatcaaggccagactgaaggccgagttcgaggccctggagagcgaggagagacacctgaaggagtacaagcaggagatggacctgctgctgcaggagaagatggcccacgtggaggagctgagactgatccacgccgacatcaacgtgatggagaacaccatcaagcagagcgagaacgacctgaacaagctgctggagagcaccagaagactgcacgacgagtacaagcccctgaaggagcacgtggacgccctgagaatgaccctgggcctgcagagactgcccgacctgtgcgaggaggaggagaagctgagcctggactacttcgagaagcagaaggccgagtggcagaccgagccccaggagccccccatccccgagagcctggccgccgccgccgccgccgcccagcagctgcaggtggccagaaagcaggacaccagacagaccgccaccttcagacagcagcccccccccatgaaggcctgcctgagctgccaccagcagatccacagaaacgcccccatctgccccctgtgcaaggccaagagcagaagcagaaaccccaagaagcccaagagaaagcaggacgagtag

SEQ ID NO: 26377 - DNA, 513 bp, Artificial Sequence
  Description of Artificial Sequence: Synthetic coding sequence
atggccacccccatgcacagactgatcgccagaagacaggccgaggccaacaagcagcacgtgagatgccagaagtgcctggagttcggccactggacctacgagtgcaccggcaagagaaagtacctgcacagacccagcagaaccgccgagctgaagaaggccctgaaggagaaggagaacagactgctgctgcagcagagcatcggcgagaccaacgtggagagaaaggccaagaagaagagaagcaagagcgtgaccagcagcagcagcagcagcagcgacagcagcgccagcgacagcagcagcgagagcgaggagaccagcaccagcagcagcagcgaggacagcgacaccgacgagagcagcagcagcagcagcagcagcgccagcagcaccaccagcagcagcagcagcgacagcgacagcgacagcagcagcagcagcagcagcagcaccagcaccgacagcagcagcgacgacgagccccccaagaagaagaagaagaagtag

SEQ ID NO: 26378 - DNA, 501 bp, Artificial Sequence
  Description of Artificial Sequence: Synthetic coding sequence
atgagcagcaaggacttcttcgcctgcggccacagcggccactgggccagaggctgccccagaggcggcgccggcggcagaagaggcggcggccacggcagaggcagccagtgcggcagcaccaccctgagctacacctgctactgctgcggcgagagcggcagaaacgccaagaactgcgtgctgctgggcaacatctgctacaactgcggcagaagcggccacatcgccaaggactgcaaggaccccaagagagagagaagacagcactgctacacctgcggcagactgggccacctggccagagactgcgacagacagaaggagcagaagtgctacagctgcggcaagctgggccacatccagaaggactgcgcccaggtgaagtgctacagatgcggcgagatcggccacgtggccatcaactgcagcaaggccagacccggccagctgctgcccctgagacagatccccaccagcagccagggcatgagccagtag

SEQ ID NO: 26379 - DNA, 2850 bp, Artificial Sequence
  Description of Artificial Sequence: Synthetic coding sequence
atggccagcaaccaccccgccttcagcttccaccagaagcaggtgctgagacaggagctgacccagatccagagcagcctgaacggcggcggcggccacggcggcaagggcgcccccggccccggcggcgccctgcccacctgccccgcctgccacaagatcacccccagaaccgaggcccccgtgagcagcgtgagcaacagcctggagaacgccctgcacaccagcgcccacagcaccgaggagagcctgcccaagagacccctgggcaagcacagcaaggtgagcgtggagaagatcgacctgaagggcctgagccacaccaagaacgacagaaacgtggagtgcagcttcgaggtgctgtggagcgacagcagcatcaccagcgtgaccaagagcagcagcgaggtgaccgagttcatcagcaagctgtgccagctgtaccccgaggagaacctggagaagctgatcccctgcctggccggccccgacgccttctacgtggagagaaaccacgtggacctggacagcggcctgagatacctggccagcctgcccagccacgtgctgaagaacgaccacgtgagaagattcctgagcaccagcagccccccccagcagctgcagagccccagccccggcaaccccagcctgagcaaggtgggcaccgtgatgggcgtgagcggcagacccgtgtgcggcgtggccggcatccccagcagccagagcggcgcccagcaccacggccagcaccccgccggcagcgccgcccccctgccccactgcagccacgccggcagcgccggcagcgccctggcctacagaacccagatggacaccagccccgccatcctgatgcccagcagcctgcagaccccccagacccaggagcagaacggcatcctggactggctgagaaagctgagactgcacaagtactaccccgtgttcaagcagctgagcatggagaagttcctgagcctgaccgaggaggacctgaacaagttcgagagcctgaccatgggcgccaagaagaagctgaagacccagctggagctggagaaggagaagagcgagagaagatgcctgaaccccagcgccccccccctggtgaccagcagcggcgtggccagagtgccccccaccagccacgtgggccccgtgcagagcggcagaggcagccacgccgccgagctgagagtggaggtggagcagccccaccaccagctgcccagagagggcagcagcagcgagtacagcagcagcagcagcagccccatgggcgtgcaggccagagaggagagcagcgacagcgccgaggagaacgacagaagagtggagatccacctggagagcagcgacaaggagaagcccgtgatgctgctgaaccacttcaccagcagcagcgccagacccaccgcccaggtgctgcccgtgcagaacgaggccagcagcaaccccagcggccaccaccccctgcccccccagatgctgagcgccgccagccacatcacccccatcagaatgctgaacagcgtgcacaagcccgagagaggcagcgccgacatgaagctgctgagcagcagcgtgcacagcctgctgagcctggaggagagaaacaagggcagcggccccagaagcagcatgaaggtggacaagagcttcggcagcgccatgatggacgtgctgcccgccagcgccccccaccagcccgtgcaggtgctgagcggcctgagcgagagcagcagcatgagccccaccgtgagcttcggccccagaaccaaggtggtgcacgccagcaccctggacagagtgctgaagaccgcccagcagcccgccctggtggtggagaccagcaccgccgccaccggcacccccagcaccgtgctgcacgccgccagaccccccatcaagctgctgctgagcagcagcgtgcccgccgacagcgccatcagcggccagaccagctgccccaacaacgtgcagatcagcgtgccccccgccatcatcaaccccagaaccgccctgtacaccgccaacaccaaggtggccttcagcgccatgagcagcatgcccgtgggccccctgcagggcggcttctgcgccaacagcaacaccgccagccccagcagccaccccagcaccagcttcgccaacatggccaccctgcccagctgccccgcccccagcagcagccccgccctgagcagcgtgcccgagagcagcttctacagcagcagcggcggcggcggcagcaccggcaacatccccgccagcaaccccaaccaccaccaccaccaccaccaccagcagccccccgcccccccccagcccgccccccccccccccggctgcatcgtgtgcaccagctgcggctgcagcggcagctgcggcagcagcggcctgaccgtgagctacgccaactacttccagcaccccttcagcggccccagcgtgttcaccttccccttcctgcccttcagccccatgtgcagcagcggctacgtgagcgcccagcagtacggcggcggcagcaccttccccgtggtgcacgccccctacagcagcagcggcacccccgaccccgtgctgagcggccagagcaccttcgccgtgccccccatgcagaacttcatggccggcaccgccggcgtgtaccagacccagggcctggtgggcagcagcaacggcagcagccacaagaagagcggcaacctgagctgctacaactgcggcgccaccggccacagagcccaggactgcaagcagcccagcatggacttcaacagacccggcaccttcagactgaagtacgccccccccgccgagagcctggacagcaccgactag

SEQ ID NO: 26380 - DNA, 933 bp, Artificial Sequence
  Description of Artificial Sequence: Synthetic coding sequence
atggagaagtgcaccaagagcagcagcaccatgcaggtggagcccagcttcctgcaggccgagaacctgatcctgagactgcagatgcagcaccccaccaccgagaacaccgccaagagaggccaggtgatgcccgccctggccaccaccgtgatgcccgtgccctacagcctggagcacctgacccagttccacggcgaccccgccaactgcagcgagttcctgacccaggtgaccacctacctgaccgccctgcagatcagcaaccccgccaacgacgcccagatcaagctgttcttcgactacctgagccagcagctggagagctgcggcatcatcagcggccccgacaagagcaccctgctgaagcagtacgagaacctgatcctggagttccagcagagcttcggcaagcccaccaagcaggagatcaaccccctgatgaacgccaagttcgacaagggcgacaacagcagccagcaggaccccgccaccttccacctgctggcccagaacctgatctgcaacgagaccaaccagagcggccagttcgagaaggccctggccgaccccaaccaggacgaggagagcgtgaccgacatgatggacaacctgcccgacctgatcacccagtgcatccagctggacaagaagcacagcgacagacccgagctgctgcagagcgagacccagctgcccctgctggccagcctgatccagcaccaggccctgttcagccccaccgaccccccccccaagaagggccccatccagctgagagagggccagctgcccctgacccccgccaagagagccagacagcaggagacccagctgtgcctgtactgcagccagagcggccacttcaccagagactgcctggccaagagaagcagagcccccgccaccaccaacaacaccgcccaccagtag

SEQ ID NO: 26381 - DNA, 687 bp, Artificial Sequence
  Description of Artificial Sequence: Synthetic coding sequence
atgcaggaggtgtgcagcggcgaggacacccacggcggccacttccccagcagacccggccacaccggcgccgagcagcagtgcgtgcagggcagactgaccctgtggctgccccagcagcacagaagatggccccagctgccccacagagccctgctgagacccgacccccacctgagaggcagccaggcccagcaggccgcccccacccagctgcccgtgccccccgtgctgcagcagagaaccctgcaccagggcctgccccccggcaccccccagagaagaggccccgacagcatccccggccagaaggccctgctgagaagagtgcaggtgagccaggtgcaggagaagatggacgagagagagctgctgggccagcacggcgccggcgtgcaccaggtgccccaccagagagtgagcacccaggccgagacccccggcgaggccagaagacccggcagagtgagacccgagcagggcgcccccgccgcccccctgagagaggtgcagggccccggcctgctgctgcccagcagagccgtgaccggctgcccccccgcccccagagccacccccagacagcccgaggagaccctgctgccctgcgccacccccagaggctgcgtgagcccctgcgcctggggcgccctggccggcctgagaggctgggccggcggcagctag

SEQ ID NO: 26382 - DNA, 726 bp, Artificial Sequence
  Description of Artificial Sequence: Synthetic coding sequence
atgagcctgctgagcgccatcgacaccagcgccgccagcgtgtaccagcccgcccagctgctgaactgggtgtacctgagcctgcaggacacccaccaggccagcgccttcgacgccttcagacccgagcccaccgccggcgccgccccccccgagctggccttcggcaagggcagacccgagcagctgggcagccccctgcacagcagctacctgaacagcttcttccagctgcagagaggcgaggccctgagcaacagcgtgtacaagggcgccagcccctacggcagcctgaacaacatcgccgacggcctgagcagcctgaccgagcacttcagcgacctgaccctgaccagcgaggccagaaagcccagcaagagacccccccccaactacctgtgccacctgtgcttcaacaagggccactacatcaaggactgcccccaggccagacccaagggcgagggcctgaccccctaccagggcaagaagagatgcttcggcgagtacaagtgccccaagtgcaagagaaagtggatgagcggcaacagctgggccaacatgggccaggagtgcatcaagtgccacatcaacgtgtacccccacaagcagagacccctggagaagcccgacggcctggacgtgagcgaccagagcaaggagcacccccagcacctgtgcgagaagtgcaaggtgctgggctactactgcagaagagtgcagtag

SEQ ID NO: 26383 - DNA, 1215 bp, Artificial Sequence
  Description of Artificial Sequence: Synthetic coding sequence
atggccaccggcggcggcgccgaggaggagagaaagagaggcagaccccagctgctgccccccgccagacccgccgccagaggcgaggaggccgacggcggcagagagaagatgggctgggcccaggtggtgaagaacctggccgagaagaagggcgagttcagagagcccagaccccccagaagagaggaggagagcggcggcggcggcggcagcgccggcctgggcggccccgccggcctggccgcccccgacctgggcgacttcccccccgccggcagaggcgaccccaagggcagaagaagagaccccgccggcgaggccgtggaccccagaaagaagaagggcgccgccgaggccggcagaagaaagaaggccgaggccgccgccgccgccatggccacccccgccagacccggcgaggccgaggacgccgccgagagacccctgcaggacgagcccgccgccgccgccgccggccccggcaagggcagattcctggtgagaatctgcttccagggcgacgagggcgcctgccccaccagagacttcgtggtgggcgccctgatcctgagaagcatcggcatggaccccagcgacatctacgccgtgatccagatccccggcagcagagagttcgacgtgagcttcagaagcgccgagaagctggccctgttcctgagagtgtacgaggagaagagagagcaggaggactgctgggagaacttcgtggtgctgggcagaagcaagagcagcctgaagaccctgttcatcctgttcagaaacgagaccgtggacgtggaggacatcgtgacctggctgaagagacactgcgacgtgctggccgtgcccgtgaaggtgaccgacagattcggcatctggaccggcgagtacaagtgcgagatcgagctgagacagggcgagggcggcgtgagacacctgcccggcgccttcttcctgggcgccgagagaggctacagctggtacaagggccagcccaagacctgcttcaagtgcggcagcagaacccacatgagcggcagctgcacccaggacagatgcttcagatgcggcgaggagggccacctgagcccctactgcagaaagggcatcgtgtgcaacctgtgcggcaagagaggccacgccttcgcccagtgccccaaggccgtgcacaacagcgtggccgcccagctgaccggcgtggccggccactag

SEQ ID NO: 26384 - DNA, 1428 bp, Artificial Sequence
  Description of Artificial Sequence: Synthetic coding sequence
atggtggaggacctggccgccagctacatcgtgctgaagctggagaacgagatcagacaggcccaggtgcagtggctgatggaggagaacgccgccctgcaggcccagatccccgagctgcagaagagccaggccgccaaggagtacgacctgctgagaaagagcagcgaggccaaggagccccagaagctgcccgagcacatgaacccccccgccgcctgggaggcccagaagacccccgagttcaaggagccccagaagccccccgagccccaggacctgctgccctgggagccccccgccgcctgggagctgcaggaggcccccgccgcccccgagagcctggccccccccgccaccagagagagccagaagccccccatggcccacgagatccccaccgtgctggagggccagggccccgccaacacccaggacgccaccatcgcccaggagcccaagaacagcgagccccaggacccccccaacatcgagaagccccaggaggcccccgagtaccaggagaccgccgcccagctggagttcctggagctgccccccccccaggagcccctggagcccagcaacgcccaggagttcctggagctgagcgccgcccaggagagcctggagggcctgatcgtggtggagaccagcgccgccagcgagttcccccaggcccccatcggcctggaggccaccgacttccccctgcagtacaccctgaccttcagcggcgacagccagaagctgcccgagttcctggtgcagctgtacagctacatgagagtgagaggccacctgtaccccaccgaggccgccctggtgagcttcgtgggcaactgcttcagcggcagagccggctggtggttccagctgctgctggacatccagagccccctgctggagcagtgcgagagcttcatccccgtgctgcaggacaccttcgacaaccccgagaacatgaaggacgccaaccagtgcatccaccagctgtgccagggcgagggccacgtggccacccacttccacctgatcgcccaggagctgaactgggacgagagcaccctgtggatccagttccaggagggcctggccagcagcatccaggacgagctgagccacaccagccccgccaccaacctgagcgacctgatcacccagtgcatcagcctggaggagaagcccgaccccaaccccctgggcaagagcagcagcgccgagggcgacggccccgagagcccccccgccgagaaccagcccatgcaggccgccatcaactgcccccacatcagcgaggccgagtgggtgagatggcacaagggcagactgtgcctgtactgcggctaccccggccacttcgccagagactgccccgtgaagccccaccaggccctgcaggccggcaacatccaggcctgccagtag

SEQ ID NO: 26385 - DNA, 2355 bp, Artificial Sequence
  Description of Artificial Sequence: Synthetic coding sequence
atgggcaacgagcacatcagcgtgcaccccgagaacagcgactgcatccaggccgacgtgaacagcgacgactacaagggcgacaaggtgtaccaccccgagaccggcagaaagaacgagaaggagaaggtgggcagaaagggcaagcacctgctgaccgtggaccagaagagaggcgagcacgtggtgtgcggcagcaccagaaacaacgagagcgagagcaccctggacctggagggcttccagaaccccaccgccaaggagtgcgagggcctggccaccctggacaacaaggccgacctggacggcgagagcaccgagggcaccgaggagctggaggacagcctgaaccacttcacccacagcgtgcagggccagaccagcgagatgatccccagcgacgaggaggaggaggacgacgaggaggaggaggaggaggaggagcccagactgaccatcaaccagagagaggacgaggacggcatggccaacgaggacgagctggacaacacctacaccggcagcggcgacgaggacgccctgagcgaggaggacgacgagctgggcgaggccgccaagtacgaggacgtgaaggagtgcggcaagcacgtggagagagccctgctggtggagctgaacaagatcagcctgaaggaggagaacgtgtgcgaggagaagaacagccccgtggaccagagcgacttcttctacgagttcagcaagctgatcttcaccaagggcaagagccccaccgtggtgtgcagcctgtgcaagagagagggccacctgaagaaggactgccccgaggacttcaagagaatccagctggagcccctgccccccctgacccccaagttcctgaacatcctggaccaggtgtgcatccagtgctacaaggacttcagccccaccatcatcgaggaccaggccagagagcacatcagacagaacctggagagcttcatcagacaggacttccccggcaccaagctgagcctgttcggcagcagcaagaacggcttcggcttcaagcagagcgacctggacgtgtgcatgaccatcaacggcctggagaccgccgagggcctggactgcgtgagaaccatcgaggagctggccagagtgctgagaaagcacagcggcctgagaaacatcctgcccatcaccaccgccaaggtgcccatcgtgaagttcttccacctgagaagcggcctggaggtggacatcagcctgtacaacaccctggccctgcacaacaccagactgctgagcgcctacagcgccatcgaccccagagtgaagtacctgtgctacaccatgaaggtgttcaccaagatgtgcgacatcggcgacgccagcagaggcagcctgagcagctacgcctacaccctgatggtgctgtacttcctgcagcagagaaacccccccgtgatccccgtgctgcaggagatctacaagggcgagaagaagcccgagatcttcgtggacggctggaacatctacttcttcgaccagatcgacgagctgcccacctactggagcgagtgcggcaagaacaccgagagcgtgggccagctgtggctgggcctgctgagattctacaccgaggagttcgacttcaaggagcacgtgatcagcatcagaagaaagagcctgctgaccaccttcaagaagcagtggaccagcaagtacatcgtgatcgaggaccccttcgacctgaaccacaacctgggcgccggcctgagcagaaagatgaccaacttcatcatgaaggccttcatcaacggcagaagagtgttcggcatccccgtgaagggcttccccaaggactaccccagcaagatggagtacttcttcgaccccgacgtgctgaccgagggcgagctggcccccaacgacagatgctgcagaatctgcggcaagatcggccacttcatgaaggactgccccatgagaagaaaggtgagaagaagaagagaccaggaggacgccctgaaccagagataccccgagaacaaggagaagagaagcaaggaggacaaggagatccacaacaagtacaccgagagagaggtgagcaccaaggaggacaagcccatccagtgcaccccccagaaggccaagcccatgagagccgccgccgacctgggcagagagaagatcctgagaccccccgtggagaagtggaagagacaggacgacaaggacctgagagagaagagatgcttcatctgcggcagagagggccacatcaagaaggagtgcccccagttcaagggcagcagcggcagcctgagcagcaagtacatgacccagggcaaggccagcgccaagagaacccagcaggagagctag

SEQ ID NO: 26386 - DNA, 507 bp, Artificial Sequence
  Description of Artificial Sequence: Synthetic coding sequence
atggaggccggcagccccgagaacaagaagcagagaagcagacccagaaagcccagaaagaccagaaacgaggagaacgagcaggacggcgacctggagggccccgtgatcgacgagagcgtgctgagcaccaaggagctgctgggcctgcagcaggccgaggagagactgaagagagactgcatcgacagactgaagagaagacccagaaactaccccaccgccaagtacacctgcagactgtgcgacgtgctgatcgagagcatcgccttcgcccacaagcacatcaaggagaagagacacaagaagaacatcaaggagaagcaggaggaggagctgctgaccaccctgcccccccccacccccagccagatcaacgccgtgggcatcgccatcgacaaggtggtgcaggagttcggcctgcacaacgagaacctggagcagagactggagatcaagagaatcatggagaacgtgttccagcacaagctgcccggcatcttctag

SEQ ID NO: 26387 - DNA, 375 bp, Artificial Sequence
  Description of Artificial Sequence: Synthetic coding sequence
atgagccagcccgacgtgctgctgctggtgcaggagtgcctgaagaacagcgacagcttcatcgacgtggacgccgacttccacgccagagtgcccgtggtggtgtgcagagagaagcagagcggcctgctgtgcaaggtgagcgccggcaacgagaacgcctgcctgaccaccaagcacctgaccgccctgggcaagctggagcccaagctggtgcccctggtgatcgccttcagatactgggccaagctgtgcagcatcgacagacccgaggagggcggcctgcccccctacgtgttcgccctgatggccatcttcttcctgcagcagagaaaggagcccctgctgcccgtgtacctgggcagctgggtgtag

SEQ ID NO: 26388 - DNA, 1188 bp, Artificial Sequence
  Description of Artificial Sequence: Synthetic coding sequence
atgaccatcaacggcctggagaccgccgagggcctggactgcgtgagaaccatcgaggagctggccagagtgctgagaaagcacagcggcctgagaaacatcctgcccatcaccaccgccaaggtgcccatcgtgaagttcttccacctgagaagcggcctggaggtggacatcagcctgtacaacaccctggccctgcacaacaccagactgctgagcgcctacagcgccatcgaccccagagtgaagtacctgtgctacaccatgaaggtgttcaccaagatctacaagggcgagaagaagcccgagatcttcgtggacggctggaacatctacttcttcgaccagatcgacgagctgcccacctactggagcgagtgcggcaagaacaccgagagcgtgggccagctgtggctgggcctgctgagattctacaccgaggagttcgacttcaaggagcacgtgatcagcatcagaagaaagagcctgctgaccaccttcaagaagcagtggaccagcaagtacatcgtgatcgaggaccccttcgacctgaaccacaacctgggcgccggcctgagcagaaagatgaccaacttcatcatgaaggccttcatcaacggcagaagagtgttcggcatccccgtgaagggcttccccaaggactaccccagcaagatggagtacttcttcgaccccgacgtgctgaccgagggcgagctggcccccaacgacagatgctgcagaatctgcggcaagatcggccacttcatgaaggactgccccatgagaagaaaggtgagaagaagaagagaccaggaggacgccctgaaccagagataccccgagaacaaggagaagagaagcaaggaggacaaggagatccacaacaagtacaccgagagagaggtgagcaccaaggaggacaagcccatccagtgcaccccccagaaggccaagcccatgagagccgccgccgacctgggcagagagaagatcctgagaccccccgtggagaagtggaagagacaggacgacaaggacctgagagagaagagatgcttcatctgcggcagagagggccacatcaagaaggagtgcccccagttcaagggcagcagcggcagcctgagcagcaagtacatgacccagggcaaggccagcgccaagagaacccagcaggagagctag

SEQ ID NO: 26389 - DNA, 3780 bp, Artificial Sequence
  Description of Artificial Sequence: Synthetic coding sequence
atgggcgacaccgccaagccctacttcgtgaagagaaccaaggacagaggcaccatggacgacgacgacttcagaagaggccacccccagcaggactacctgatcatcgacgaccacgccaagggccacggcagcaagatggagaagggcctgcagaagaagaagatcacccccggcaactacggcaacacccccagaaagggcccctgcgccgtgagcagcaacccctacgccttcaagaaccccatctacagccagcccgcctggatgaacgacagccacaaggaccagagcaagagatggctgagcgacgagcacaccggcaacagcgacaactggagagagttcaagcccggccccagaatccccgtgatcaacagacagagaaaggacagcttccaggagaacgaggacggctacagatggcaggacaccagaggctgcagaaccgtgagaagactgttccacaaggacctgaccagcctggagaccaccagcgagatggaggccggcagccccgagaacaagaagcagagaagcagacccagaaagcccagaaagaccagaaacgaggagaacgagcaggacggcgacctggagggccccgtgatcgacgagagcgtgctgagcaccaaggagctgctgggcctgcagcaggccgaggagagactgaagagagactgcatcgacagactgaagagaagacccagaaactaccccaccgccaagtacacctgcagactgtgcgacgtgctgatcgagagcatcgccttcgcccacaagcacatcaaggagaagagacacaagaagaacatcaaggagaagcaggaggaggagctgctgaccaccctgcccccccccacccccagccagatcaacgccgtgggcatcgccatcgacaaggtggtgcaggagttcggcctgcacaacgagaacctggagcagagactggagatcaagagaatcatggagaacgtgttccagcacaagctgcccgactgcagcctgagactgtacggcagcagctgcagcagactgggcttcaagaacagcgacgtgaacatcgacatccagttccccgccatcatcgagggcttcagcctgagcaagctgggcaacttcaacctgcaggacatcgagaaggacgtggtgatctgggagcacaccgacagcgccgccggcgacaccggcatcaccaaggaggaggcccccagagagacccccatcaagagaggccaggtgagcctgatcctggacgtgaagcaccagcccagcgtgcccgtgggccagctgtgggtggagctgctgagattctacgccctggagttcaacctggccgacctggtgatcagcatcagagtgaaggagctggtgagcagagagctgaaggactggcccaagaagagaatcgccatcgaggacccctacagcgtgaagagaaacgtggccagaaccctgaacagccagcccgtgttcgagtacatcctgcactgcctgagaaccacctacaagtacttcgccctgccccacaagatcaccaagagcagcctgctgaagcccctgaacgccatcacctgcatcagcgagcacagcaaggaggtgatcaaccaccaccccgacgtgcagaccaaggacgacaagctgaagaacagcgtgctggcccagggccccggcgccaccagcagcgccgccaacacctgcaaggtgcagcccctgaccctgaaggagaccgccgagagcttcggcagcccccccaaggaggagatgggcaacgagcacatcagcgtgcaccccgagaacagcgactgcatccaggccgacgtgaacagcgacgactacaagggcgacaaggtgtaccaccccgagaccggcagaaagaacgagaaggagaaggtgggcagaaagggcaagcacctgctgaccgtggaccagaagagaggcgagcacgtggtgtgcggcagcaccagaaacaacgagagcgagagcaccctggacctggagggcttccagaaccccaccgccaaggagtgcgagggcctggccaccctggacaacaaggccgacctggacggcgagagcaccgagggcaccgaggagctggaggacagcctgaaccacttcacccacagcgtgcagggccagaccagcgagatgatccccagcgacgaggaggaggaggacgacgaggaggaggaggaggaggaggagcccagactgaccatcaaccagagagaggacgaggacggcatggccaacgaggacgagctggacaacacctacaccggcagcggcgacgaggacgccctgagcgaggaggacgacgagctgggcgaggccgccaagtacgaggacgtgaaggagtgcggcaagcacgtggagagagccctgctggtggagctgaacaagatcagcctgaaggaggagaacgtgtgcgaggagaagaacagccccgtggaccagagcgacttcttctacgagttcagcaagctgatcttcaccaagggcaagggcctggactgcgtgagaaccatcgaggagctggccagagtgctgagaaagcacagcggcctgagaaacatcctgcccatcaccaccgccaaggtgcccatcgtgaagttcttccacctgagaagcggcctggaggtggacatcagcctgtacaacaccctggccctgcacaacaccagactgctgagcgcctacagcgccatcgaccccagagtgaagtacctgtgctacaccatgaaggtgttcaccaagatgtgcgacatcggcgacgccagcagaggcagcctgagcagctacgcctacaccctgatggtgctgtacttcctgcagcagagaaacccccccgtgatccccgtgctgcaggagatctacaagggcgagaagaagcccgagatcttcgtggacggctggaacatctacttcttcgaccagatcgacgagctgcccacctactggagcgagtgcggcaagaacaccgagagcgtgggccagctgtggctgggcctgctgagattctacaccgaggagttcgacttcaaggagcacgtgatcagcatcagaagaaagagcctgctgaccaccttcaagaagcagtggaccagcaagtacatcgtgatcgaggaccccttcgacctgaaccacaacctgggcgccggcctgagcagaaagatgaccaacttcatcatgaaggccttcatcaacggcagaagagtgttcggcatccccgtgaagggcttccccaaggactaccccagcaagatggagtacttcttcgaccccgacgtgctgaccgagggcgagctggcccccaacgacagatgctgcagaatctgcggcaagatcggccacttcatgaaggactgccccatgagaagaaaggtgagaagaagaagagaccaggaggacgccctgaaccagagataccccgagaacaaggagaagagaagcaaggaggacaaggagatccacaacaagtacaccgagagagaggtgagcaccaaggaggacaagcccatccagtgcaccccccagaaggccaagcccatgagagccgccgccgacctgggcagagagaagatcctgagaccccccgtggagaagtggaagagacaggacgacaaggacctgagagagaagagatgcttcatctgcggcagagagggccacatcaagaaggagtgcccccagttcaagggcagcagcggcagcctgagcagcaagtacatgacccagggcaaggccagcgccaagagaacccagcaggagagctag

SEQ ID NO: 26390 - DNA, 4374 bp, Artificial Sequence
  Description of Artificial Sequence: Synthetic coding sequence
atgggcgacaccgccaagccctacttcgtgaagagaaccaaggacagaggcaccatggacgacgacgacttcagaagaggccacccccagcaggactacctgatcatcgacgaccacgccaagggccacggcagcaagatggagaagggcctgcagaagaagaagatcacccccggcaactacggcaacacccccagaaagggcccctgcgccgtgagcagcaacccctacgccttcaagaaccccatctacagccagcccgcctggatgaacgacagccacaaggaccagagcaagagatggctgagcgacgagcacaccggcaacagcgacaactggagagagttcaagcccggccccagaatccccgtgatcaacagacagagaaaggacagcttccaggagaacgaggacggctacagatggcaggacaccagaggctgcagaaccgtgagaagactgttccacaaggacctgaccagcctggagaccaccagcgagatggaggccggcagccccgagaacaagaagcagagaagcagacccagaaagcccagaaagaccagaaacgaggagaacgagcaggacggcgacctggagggccccgtgatcgacgagagcgtgctgagcaccaaggagctgctgggcctgcagcaggccgaggagagactgaagagagactgcatcgacagactgaagagaagacccagaaactaccccaccgccaagtacacctgcagactgtgcgacgtgctgatcgagagcatcgccttcgcccacaagcacatcaaggagaagagacacaagaagaacatcaaggagaagcaggaggaggagctgctgaccaccctgcccccccccacccccagccagatcaacgccgtgggcatcgccatcgacaaggtggtgcaggagttcggcctgcacaacgagaacctggagcagagactggagatcaagagaatcatggagaacgtgttccagcacaagctgcccgactgcagcctgagactgtacggcagcagctgcagcagactgggcttcaagaacagcgacgtgaacatcgacatccagttccccgccatcatgagccagcccgacgtgctgctgctggtgcaggagtgcctgaagaacagcgacagcttcatcgacgtggacgccgacttccacgccagagtgcccgtggtggtgtgcagagagaagcagagcggcctgctgtgcaaggtgagcgccggcaacgagaacgcctgcctgaccaccaagcacctgaccgccctgggcaagctggagcccaagctggtgcccctggtgatcgccttcagatactgggccaagctgtgcagcatcgacagacccgaggagggcggcctgcccccctacgtgttcgccctgatggccatcttcttcctgcagcagagaaaggagcccctgctgcccgtgtacctgggcagctggatcgagggcttcagcctgagcaagctgggcaacttcaacctgcaggacatcgagaaggacgtggtgatctgggagcacaccgacagcgccgccggcgacaccggcatcaccaaggaggaggcccccagagagacccccatcaagagaggccaggtgagcctgatcctggacgtgaagcaccagcccagcgtgcccgtgggccagctgtgggtggagctgctgagattctacgccctggagttcaacctggccgacctggtgatcagcatcagagtgaaggagctggtgagcagagagctgaaggactggcccaagaagagaatcgccatcgaggacccctacagcgtgaagagaaacgtggccagaaccctgaacagccagcccgtgttcgagtacatcctgcactgcctgagaaccacctacaagtacttcgccctgccccacaagatcaccaagagcagcctgctgaagcccctgaacgccatcacctgcatcagcgagcacagcaaggaggtgatcaaccaccaccccgacgtgcagaccaaggacgacaagctgaagaacagcgtgctggcccagggccccggcgccaccagcagcgccgccaacacctgcaaggtgcagcccctgaccctgaaggagaccgccgagagcttcggcagcccccccaaggaggagatgggcaacgagcacatcagcgtgcaccccgagaacagcgactgcatccaggccgacgtgaacagcgacgactacaagggcgacaaggtgtaccaccccgagaccggcagaaagaacgagaaggagaaggtgggcagaaagggcaagcacctgctgaccgtggaccagaagagaggcgagcacgtggtgtgcggcagcaccagaaacaacgagagcgagagcaccctggacctggagggcttccagaaccccaccgccaaggagtgcgagggcctggccaccctggacaacaaggccgacctggacggcgagagcaccgagggcaccgaggagctggaggacagcctgaaccacttcacccacagcgtgcagggccagaccagcgagatgatccccagcgacgaggaggaggaggacgacgaggaggaggaggaggaggaggagcccagactgaccatcaaccagagagaggacgaggacggcatggccaacgaggacgagctggacaacacctacaccggcagcggcgacgaggacgccctgagcgaggaggacgacgagctgggcgaggccgccaagtacgaggacgtgaaggagtgcggcaagcacgtggagagagccctgctggtggagctgaacaagatcagcctgaaggaggagaacgtgtgcgaggagaagaacagccccgtggaccagagcgacttcttctacgagttcagcaagctgatcttcaccaagggcaagagccccaccgtggtgtgcagcctgtgcaagagagagggccacctgaagaaggactgccccgaggacttcaagagaatccagctggagcccctgccccccctgacccccaagttcctgaacatcctggaccaggtgtgcatccagtgctacaaggacttcagccccaccatcatcgaggaccaggccagagagcacatcagacagaacctggagagcttcatcagacaggacttccccggcaccaagctgagcctgttcggcagcagcaagaacggcttcggcttcaagcagagcgacctggacgtgtgcatgaccatcaacggcctggagaccgccgagggcctggactgcgtgagaaccatcgaggagctggccagagtgctgagaaagcacagcggcctgagaaacatcctgcccatcaccaccgccaaggtgcccatcgtgaagttcttccacctgagaagcggcctggaggtggacatcagcctgtacaacaccctggccctgcacaacaccagactgctgagcgcctacagcgccatcgaccccagagtgaagtacctgtgctacaccatgaaggtgttcaccaagatctacaagggcgagaagaagcccgagatcttcgtggacggctggaacatctacttcttcgaccagatcgacgagctgcccacctactggagcgagtgcggcaagaacaccgagagcgtgggccagctgtggctgggcctgctgagattctacaccgaggagttcgacttcaaggagcacgtgatcagcatcagaagaaagagcctgctgaccaccttcaagaagcagtggaccagcaagtacatcgtgatcgaggaccccttcgacctgaaccacaacctgggcgccggcctgagcagaaagatgaccaacttcatcatgaaggccttcatcaacggcagaagagtgttcggcatccccgtgaagggcttccccaaggactaccccagcaagatggagtacttcttcgaccccgacgtgctgaccgagggcgagctggcccccaacgacagatgctgcagaatctgcggcaagatcggccacttcatgaaggactgccccatgagaagaaaggtgagaagaagaagagaccaggaggacgccctgaaccagagataccccgagaacaaggagaagagaagcaaggaggacaaggagatccacaacaagtacaccgagagagaggtgagcaccaaggaggacaagcccatccagtgcaccccccagaaggccaagcccatgagagccgccgccgacctgggcagagagaagatcctgagaccccccgtggagaagtggaagagacaggacgacaaggacctgagagagaagagatgcttcatctgcggcagagagggccacatcaagaaggagtgcccccagttcaagggcagcagcggcagcctgagcagcaagtacatgacccagggcaaggccagcgccaagagaacccagcaggagagctag

SEQ ID NO: 26391 - DNA, 4488 bp, Artificial Sequence
  Description of Artificial Sequence: Synthetic coding sequence
atgggcgacaccgccaagccctacttcgtgaagagaaccaaggacagaggcaccatggacgacgacgacttcagaagaggccacccccagcaggactacctgatcatcgacgaccacgccaagggccacggcagcaagatggagaagggcctgcagaagaagaagatcacccccggcaactacggcaacacccccagaaagggcccctgcgccgtgagcagcaacccctacgccttcaagaaccccatctacagccagcccgcctggatgaacgacagccacaaggaccagagcaagagatggctgagcgacgagcacaccggcaacagcgacaactggagagagttcaagcccggccccagaatccccgtgatcaacagacagagaaaggacagcttccaggagaacgaggacggctacagatggcaggacaccagaggctgcagaaccgtgagaagactgttccacaaggacctgaccagcctggagaccaccagcgagatggaggccggcagccccgagaacaagaagcagagaagcagacccagaaagcccagaaagaccagaaacgaggagaacgagcaggacggcgacctggagggccccgtgatcgacgagagcgtgctgagcaccaaggagctgctgggcctgcagcaggccgaggagagactgaagagagactgcatcgacagactgaagagaagacccagaaactaccccaccgccaagtacacctgcagactgtgcgacgtgctgatcgagagcatcgccttcgcccacaagcacatcaaggagaagagacacaagaagaacatcaaggagaagcaggaggaggagctgctgaccaccctgcccccccccacccccagccagatcaacgccgtgggcatcgccatcgacaaggtggtgcaggagttcggcctgcacaacgagaacctggagcagagactggagatcaagagaatcatggagaacgtgttccagcacaagctgcccgactgcagcctgagactgtacggcagcagctgcagcagactgggcttcaagaacagcgacgtgaacatcgacatccagttccccgccatcatgagccagcccgacgtgctgctgctggtgcaggagtgcctgaagaacagcgacagcttcatcgacgtggacgccgacttccacgccagagtgcccgtggtggtgtgcagagagaagcagagcggcctgctgtgcaaggtgagcgccggcaacgagaacgcctgcctgaccaccaagcacctgaccgccctgggcaagctggagcccaagctggtgcccctggtgatcgccttcagatactgggccaagctgtgcagcatcgacagacccgaggagggcggcctgcccccctacgtgttcgccctgatggccatcttcttcctgcagcagagaaaggagcccctgctgcccgtgtacctgggcagctggatcgagggcttcagcctgagcaagctgggcaacttcaacctgcaggacatcgagaaggacgtggtgatctgggagcacaccgacagcgccgccggcgacaccggcatcaccaaggaggaggcccccagagagacccccatcaagagaggccaggtgagcctgatcctggacgtgaagcaccagcccagcgtgcccgtgggccagctgtgggtggagctgctgagattctacgccctggagttcaacctggccgacctggtgatcagcatcagagtgaaggagctggtgagcagagagctgaaggactggcccaagaagagaatcgccatcgaggacccctacagcgtgaagagaaacgtggccagaaccctgaacagccagcccgtgttcgagtacatcctgcactgcctgagaaccacctacaagtacttcgccctgccccacaagatcaccaagagcagcctgctgaagcccctgaacgccatcacctgcatcagcgagcacagcaaggaggtgatcaaccaccaccccgacgtgcagaccaaggacgacaagctgaagaacagcgtgctggcccagggccccggcgccaccagcagcgccgccaacacctgcaaggtgcagcccctgaccctgaaggagaccgccgagagcttcggcagcccccccaaggaggagatgggcaacgagcacatcagcgtgcaccccgagaacagcgactgcatccaggccgacgtgaacagcgacgactacaagggcgacaaggtgtaccaccccgagaccggcagaaagaacgagaaggagaaggtgggcagaaagggcaagcacctgctgaccgtggaccagaagagaggcgagcacgtggtgtgcggcagcaccagaaacaacgagagcgagagcaccctggacctggagggcttccagaaccccaccgccaaggagtgcgagggcctggccaccctggacaacaaggccgacctggacggcgagagcaccgagggcaccgaggagctggaggacagcctgaaccacttcacccacagcgtgcagggccagaccagcgagatgatccccagcgacgaggaggaggaggacgacgaggaggaggaggaggaggaggagcccagactgaccatcaaccagagagaggacgaggacggcatggccaacgaggacgagctggacaacacctacaccggcagcggcgacgaggacgccctgagcgaggaggacgacgagctgggcgaggccgccaagtacgaggacgtgaaggagtgcggcaagcacgtggagagagccctgctggtggagctgaacaagatcagcctgaaggaggagaacgtgtgcgaggagaagaacagccccgtggaccagagcgacttcttctacgagttcagcaagctgatcttcaccaagggcaagagccccaccgtggtgtgcagcctgtgcaagagagagggccacctgaagaaggactgccccgaggacttcaagagaatccagctggagcccctgccccccctgacccccaagttcctgaacatcctggaccaggtgtgcatccagtgctacaaggacttcagccccaccatcatcgaggaccaggccagagagcacatcagacagaacctggagagcttcatcagacaggacttccccggcaccaagctgagcctgttcggcagcagcaagaacggcttcggcttcaagcagagcgacctggacgtgtgcatgaccatcaacggcctggagaccgccgagggcctggactgcgtgagaaccatcgaggagctggccagagtgctgagaaagcacagcggcctgagaaacatcctgcccatcaccaccgccaaggtgcccatcgtgaagttcttccacctgagaagcggcctggaggtggacatcagcctgtacaacaccctggccctgcacaacaccagactgctgagcgcctacagcgccatcgaccccagagtgaagtacctgtgctacaccatgaaggtgttcaccaagatgtgcgacatcggcgacgccagcagaggcagcctgagcagctacgcctacaccctgatggtgctgtacttcctgcagcagagaaacccccccgtgatccccgtgctgcaggagatctacaagggcgagaagaagcccgagatcttcgtggacggctggaacatctacttcttcgaccagatcgacgagctgcccacctactggagcgagtgcggcaagaacaccgagagcgtgggccagctgtggctgggcctgctgagattctacaccgaggagttcgacttcaaggagcacgtgatcagcatcagaagaaagagcctgctgaccaccttcaagaagcagtggaccagcaagtacatcgtgatcgaggaccccttcgacctgaaccacaacctgggcgccggcctgagcagaaagatgaccaacttcatcatgaaggccttcatcaacggcagaagagtgttcggcatccccgtgaagggcttccccaaggactaccccagcaagatggagtacttcttcgaccccgacgtgctgaccgagggcgagctggcccccaacgacagatgctgcagaatctgcggcaagatcggccacttcatgaaggactgccccatgagaagaaaggtgagaagaagaagagaccaggaggacgccctgaaccagagataccccgagaacaaggagaagagaagcaaggaggacaaggagatccacaacaagtacaccgagagagaggtgagcaccaaggaggacaagcccatccagtgcaccccccagaaggccaagcccatgagagccgccgccgacctgggcagagagaagatcctgagaccccccgtggagaagtggaagagacaggacgacaaggacctgagagagaagagatgcttcatctgcggcagagagggccacatcaagaaggagtgcccccagttcaagggcagcagcggcagcctgagcagcaagtacatgacccagggcaaggccagcgccaagagaacccagcaggagagctag

SEQ ID NO: 26392 - DNA, 498 bp, Artificial Sequence
  Description of Artificial Sequence: Synthetic coding sequence
atggaggccggcagccccgagaacaagaagcagagaagcagacccagaaagcccagaaagaccagaaacgaggagaacgagcaggacggcgacctggagggccccgtgatcgacgagagcgtgctgagcaccaaggagctgctgggcctgcagcaggccgaggagagactgaagagagactgcatcgacagactgaagagaagacccagaaactaccccaccgccaagtacacctgcagactgtgcgacgtgctgatcgagagcatcgccttcgcccacaagcacatcaaggagaagagacacaagaagaacatcaaggagaagcaggaggaggagctgctgaccaccctgcccccccccacccccagccagatcaacgccgtgggcatcgccatcgacaaggtggtgcaggagttcggcctgcacaacgagaacctggagcagagactggagatcaagagaatcatggagaacgtgttccagcacaagctgccctag

SEQ ID NO: 26393 - DNA, 618 bp, Artificial Sequence
  Description of Artificial Sequence: Synthetic coding sequence
atgttcggcggctacgagaccatcgaggcctacgaggacgacctgtacagagacgagagcagcagcgagctgagcgtggacagcgaggtggagttccagctgtacagccagatccactacgcccaggacctggacgacgtgatcagagaggaggagcacgaggagaagaacagcggcaacagcgagagcagcagcagcaagcccaaccagaagaagctgatcgtgctgagcgacagcgaggtgatccagctgagcgacggcagcgaggtgatcaccctgagcgacgaggacagcatctacagatgcaagggcaagaacgtgagagtgcaggcccaggagaacgcccacggcctgagcagcagcctgcagagcaacgagctggtggacaagaagtgcaagagcgacatcgagaagcccaagagcgaggagagaagcggcgtgatcagagaggtgatgatcatcgaggtgagcagcagcgaggaggaggagagcaccatcagcgagggcgacaacgtggagagctggatgctgctgggctgcgaggtggacgacaaggacgacgacatcctgctgaacctggtgggctgcgagaacagcgtgaccgagggccaggagtag

SEQ ID NO: 26394 - DNA, 1632 bp, Artificial Sequence
  Description of Artificial Sequence: Synthetic coding sequence
atgatgttcggcggctacgagaccatcgaggcctacgaggacgacctgtacagagacgagagcagcagcgagctgagcgtggacagcgaggtggagttccagctgtacagccagatccactacgcccaggacctggacgacgtgatcagagaggaggagcacgaggagaagaacagcggcaacagcgagagcagcagcagcaagcccaaccagaagaagctgatcgtgctgagcgacagcgaggtgatccagctgagcgacggcagcgaggtgatcaccctgagcgacgaggacagcatctacagatgcaagggcaagaacgtgagagtgcaggcccaggagaacgcccacggcctgagcagcagcctgcagagcaacgagctggtggacaagaagtgcaagagcgacatcgagaagcccaagagcgaggagagaagcggcgtgatcagagaggtgatgatcatcgaggtgagcagcagcgaggaggaggagagcaccatcagcgagggcgacaacgtggagagctggatgctgctgggctgcgaggtggacgacaaggacgacgacatcctgctgaacctggtgggctgcgagaacagcgtgaccgagggcgaggacggcatcaactggagcatcagcgacaaggacatcgaggcccagatcgccaacaacagaacccccggcagatggacccagagatactacagcgccaacaagaacatcatctgcagaaactgcgacaagagaggccacctgagcaagaactgccccctgcccagaaaggtgagaagatgcttcctgtgcagcagaagaggccacctgctgtacagctgccccgcccccctgtgcgagtactgccccgtgcccaagatgctggaccacagctgcctgttcagacacagctgggacaagcagtgcgacagatgccacatgctgggccactacaccgacgcctgcaccgagatctggagacagtaccacctgaccaccaagcccggcccccccaagaagcccaagacccccagcagacccagcgccctggcctactgctaccactgcgcccagaagggccactacggccacgagtgccccgagagagaggtgtacgaccccagccccgtgagccccttcatctgctactacgacgacaagtacgagatccaggagagagagaagagactgaagcagaagatcaaggtgctgaagaagaacggcgtgatccccgagcccagcaagctgccctacatcaaggccgccaacgagaacccccaccacgacatcagaaagggcagagccagctggaagagcaacagatggccccaggagaacaaggagacccagaaggagatgaagaacaagaacagaaactgggagaagcacagaaaggccgacagacacagagaggtggacgaggacttccccagaggccccaagacctacagcagccccggcagcttcaagacccagaagcccagcaagcccttccacagaagcagccactaccacaccagcagagaggacaagagccccaaggagggcaagagaggcaagcagaagaagaaggagagatgctgggaggacgacgacaacgacaacctgttcctgatcaagcagagaaagaagaagagctag

SEQ ID NO: 26395 - DNA, 762 bp, Artificial Sequence
  Description of Artificial Sequence: Synthetic coding sequence
atgctggaccacagctgcctgttcagacacagctgggacaagcagtgcgacagatgccacatgctgggccactacaccgacgcctgcaccgagatctggagacagtaccacctgaccaccaagcccggcccccccaagaagcccaagacccccagcagacccagcgccctggcctactgctaccactgcgcccagaagggccactacggccacgagtgccccgagagagaggtgtacgaccccagccccgtgagccccttcatctgctactacgacgacaagtacgagatccaggagagagagaagagactgaagcagaagatcaaggtgctgaagaagaacggcgtgatccccgagcccagcaagctgccctacatcaaggccgccaacgagaacccccaccacgacatcagaaagggcagagccagctggaagagcaacagatggccccaggagaacaaggagacccagaaggagatgaagaacaagaacagaaactgggagaagcacagaaaggccgacagacacagagaggtggacgaggacttccccagaggccccaagacctacagcagccccggcagcttcaagacccagaagcccagcaagcccttccacagaagcagccactaccacaccagcagagaggacaagagccccaaggagggcaagagaggcaagcagaagaagaaggagagatgctgggaggacgacgacaacgacaacctgttcctgatcaagcagagaaagaagaagagctag

SEQ ID NO: 26396 - DNA, 2124 bp, Artificial Sequence
  Description of Artificial Sequence: Synthetic coding sequence
atggccgccgaggtgtacttcggcgacctggagctgttcgagcccttcgaccaccccgaggagagcatccccaagcccgtgcacaccagattcaaggacgacgacggcgacgaggaggacgagaacggcgtgggcgacgccgagctgagagagagactgagacagtgcgaggagaccatcgagcagctgagagccgagaaccaggagctgaagagaaagctgaacatcctgaccagacccagcggcatcctggtgaacgacaccaagctggacggccccatcctgcagatcctgttcatgaacaacgccatcagcaagcagtaccaccaggagatcgaggagttcgtgagcaacctggtgaagagattcgaggagcagcagaagaacgacgtggagaagaccagcttcaacctgctgccccagcccagcagcatcgtgctggaggaggaccacaaggtggaggagagctgcgccatcaagaacaacaaggaggccttcagcgtggtgggcagcgtgctgtacttcaccaacttctgcctggacaagctgggccagcccctgctgaacgagaacccccagctgagcgagggctgggagatccccaagtaccaccaggtgttcagccacatcgtgagcctggagggccaggagatccaggtgaaggccaagagacccaagccccactgcttcaactgcggcagcgaggagcaccagatgaaggactgccccatgcccagaaacgccgccagaatcagcgagaagagaaaggagtacatggacgcctgcggcgaggccaacaaccagaacttccagcagagataccacgccgaggaggtggaggagagattcggcagattcaagcccggcgtgatcagcgaggagctgcaggacgccctgggcgtgaccgacaagagcctgccccccttcatctacagaatgagacagctgggctacccccccggctggctgaaggaggccgagctggagaacagcggcctggccctgtacgacggcaaggacggcaccgacggcgagaccgaggtgggcgagatccagcagaacaagagcgtgacctacgacctgagcaagctggtgaactaccccggcttcaacatcagcacccccagaggcatccccgacgagtggagaatcttcggcagcatccccatgcaggcctgccagcagaaggacgtgttcgccaactacctgaccagcaacttccaggcccccggcgtgaagagcggcaacaagagaagcagcagccacagcagccccggcagccccaagaagcagaagaacgagagcaacagcgccggcagccccgccgacatggagctggacagcgacatggaggtgccccacggcagccagagcagcgagagcttccagttccagccccccctgccccccgacaccccccccctgcccagaggcacccccccccccgtgttcaccccccccctgcccaagggcaccccccccctgacccccagcgacagcccccagaccagaaccgccagcggcgccgtggacgaggacgccctgaccctggaggagctggaggagcagcagagaagaatctgggccgccctggagcaggccgagagcgtgaacagcgacagcgacgtgcccgtggacacccccctgaccggcaacagcgtggccagcagcccctgccccaacgagctggacctgcccgtgcccgagggcaagaccagcgagaagcagaccctggacgagcccgaggtgcccgagatcttcaccaagaagagcgaggccggccacgccagcagccccgacagcgaggtgaccagcctgtgccagaaggagaaggccgagctggcccccgtgaacaccgagggcgccctgctggacaacggcagcgtggtgcccaactgcgacatcagcaacggcggcagccagaagctgttccccgccgacaccagccccagcaccgccaccaagatccacagccccatccccgacatgagcaagttcgccaccggcatcacccccttcgagttcgagaacatggccgagagcaccggcatgtacctgagaatcagaagcctgctgaagaacagccccagaaaccagcagaagaacaagaaggccagcgagtag

SEQ ID NO: 26397 - DNA, 1410 bp, Artificial Sequence
  Description of Artificial Sequence: Synthetic coding sequence
atgaaggactgccccatgcccagaaacgccgccagaatcagcgagaagagaaaggagtacatggacgcctgcggcgaggccaacaaccagaacttccagcagagataccacgccgaggaggtggaggagagattcggcagattcaagcccggcgtgatcagcgaggagctgcaggacgccctgggcgtgaccgacaagagcctgccccccttcatctacagaatgagacagctgggctacccccccggctggctgaaggaggccgagctggagaacagcggcctggccctgtacgacggcaaggacggcaccgacggcgagaccgaggtgggcgagatccagcagaacaagagcgtgacctacgacctgagcaagctggtgaactaccccggcttcaacatcagcacccccagaggcatccccgacgagtggagaatcttcggcagcatccccatgcaggcctgccagcagaaggacgtgttcgccaactacctgaccagcaacttccaggcccccggcgtgaagagcggcaacaagagaagcagcagccacagcagccccggcagccccaagaagcagaagaacgagagcaacagcgccggcagccccgccgacatggagctggacagcgacatggaggtgccccacggcagccagagcagcgagagcttccagttccagccccccctgccccccgacaccccccccctgcccagaggcacccccccccccgtgttcaccccccccctgcccaagggcaccccccccctgacccccagcgacagcccccagaccagaaccgccagcggcgccgtggacgaggacgccctgaccctggaggagctggaggagcagcagagaagaatctgggccgccctggagcaggccgagagcgtgaacagcgacagcgacgtgcccgtggacacccccctgaccggcaacagcgtggccagcagcccctgccccaacgagctggacctgcccgtgcccgagggcaagaccagcgagaagcagaccctggacgagcccgaggtgcccgagatcttcaccaagaagagcgaggccggccacgccagcagccccgacagcgaggtgaccagcctgtgccagaaggagaaggccgagctggcccccgtgaacaccgagggcgccctgctggacaacggcagcgtggtgcccaactgcgacatcagcaacggcggcagccagaagctgttccccgccgacaccagccccagcaccgccaccaagatccacagccccatccccgacatgagcaagttcgccaccggcatcacccccttcgagttcgagaacatggccgagagcaccggcatgtacctgagaatcagaagcctgctgaagaacagccccagaaaccagcagaagaacaagaaggccagcgagtag

SEQ ID NO: 26398 - DNA, 117 bp, Artificial Sequence
  Description of Artificial Sequence: Synthetic coding sequence
atgaaggactgccccatgcccagaaacgccgccagaatcagcgagaagagaaaggagtacatggacgcctgcggcgaggccaacaaccagaacttccagcagagataccacgcctag

SEQ ID NO: 26399 - DNA, 1410 bp, Artificial Sequence; identical to SEQ ID NO: 26397
  Description of Artificial Sequence: Synthetic coding sequence

SEQ ID NO: 26400 - DNA, 816 bp, Artificial Sequence
  Description of Artificial Sequence: Synthetic coding sequence
atgaccagatgggccagagtgagcaccacctacaacaagagacccctgcccgccaccagctgggaggacatgaagaagggcagcttcgagggcaccagccagaacctgcccaagagaaagcagctggaggccaacagactgagcctgaagaacgacgccccccaggccaagcacaagaagaacaagaagaagaaggagtacctgaacgaggacgtgaacggcttcatggagtacctgagacagaacagccagatggtgcacaacggccagatcatcgccaccgacagcgaggaggtgagagaggagatcgccgtggccctgaagaaggacagcagaagagagggcagaagactgaagagacaggccgccaagaagaacgccatggtgtgcttccactgcagaaagcccggccacggcatcgccgactgccccgccgccctggagaaccaggacatgggcaccggcatctgctacagatgcggcagcaccgagcacgagatcaccaagtgcaaggccaaggtggaccccgccctgggcgagttccccttcgccaagtgcttcgtgtgcggcgagatgggccacctgagcagaagctgccccgacaaccccaagggcctgtacgccgacggcggcggctgcaagctgtgcggcagcgtggagcacctgaagaaggactgccccgagagccagaacagcgagagaatggtgaccgtgggcagatgggccaagggcatgagcgccgactacgaggagatcctggacgtgcccaagccccagaagcccaagaccaagatccccaaggtggtgaacttctag

SEQ ID NO: 26401 - DNA, 816 bp, Artificial Sequence; identical to SEQ ID NO: 26400
  Description of Artificial Sequence: Synthetic coding sequence

SEQ ID NO: 26402 - DNA, 816 bp, Artificial Sequence; identical to SEQ ID NO: 26400
  Description of Artificial Sequence: Synthetic coding sequence

SEQ ID NO: 26403 - DNA, 816 bp, Artificial Sequence; identical to SEQ ID NO: 26400
  Description of Artificial Sequence: Synthetic coding sequence

SEQ ID NO: 26404 - DNA, 1434 bp, Artificial Sequence
  Description of Artificial Sequence: Synthetic coding sequence
atgggcagcggcctggacttcgccgagaccagctgcgcccagcccgtggtgagcacccagagcgacaaggagcccggcatcaccgccagcgccaccgacaccgacaacgccaacggcgaggaggtgccccacacccaggagatcagcgtgagctgggagggcgaggccgcccccgagatcagaaccagcaagctgggccagcccgaccccgcccccagcaagaagaagagcaacagactgaccctgagcaagagaaagaaggaggcccaggacgagaaggtggagaagacccagggcggccacgagcacagacaggaggacagactgaagaagaccgtgcaggaccacagccagatcagagaccagcagaagggcgagatcagcggcttcggccagtgcctggtgtgggtgcagtgcagcttccccaactgcggcaagtggagaagactgtgcggcaacatcgaccccagcgtgctgcccgacaactggagctgcgaccagaacaccgacgtgcagtacaacagatgcgacatccccgaggagacctggaccggcctggagagcgacgtggcctacgccagctacatccccggcagcatcatctgggccaagcagtacggctacccctggtggcccggcatgatcgagagcgaccccgacctgggcgagtacttcctgttcaccagccacctggacagcctgcccagcaagtaccacgtgaccttcttcggcgagaccgtgagcagagcctggatccccgtgaacatgctgaagaacttccaggagctgagcctggagctgagcgtgatgaagaagagaagaaacgactgcagccagaagctgggcgtggccctgatgatggcccaggaggccgagcagatcagcatccaggagagagtgaacctgttcggcttctggagcagattcaacggcagcaacagcaacggcgagagaaaggacctgcagctgagcggcctgaacagccccggcagctgcctggagaagaaggagaaggaggaggagctggagaaggaggagggcgagaagaccgaccccatcctgcccatcagaaagagagtgaagatccagacccagaagaccaagcccagaggccccaagaagaagttcaaggccccccagagcaaggccctggccgccagcttcagcgagggcaaggaggtgagaaccgtgcccaagaacctgggcctgagcgcctgcaagggcgcctgccccagcagcgccaaggaggagcccagacacagagagcccctgacccaggaggccggcagcgtgcccctggaggacgaggccagcagcgacctggacctggagcagctgatggaggacgtgggcagagagctgggccagagcggcgagctgcagcacagcaacagcgacggcgaggacttccccgtggccctgttcggcaagtag

SEQ ID NO: 26405 - DNA, 1410 bp, Artificial Sequence
  Description of Artificial Sequence: Synthetic coding sequence
atgatgaccaccctgcagaacaaggaggagtgcggcaagggccccaagagaatcttcgccccccccgcccagaagagctacagcctgctgccctgcagccccaacagccccaaggaggagacccccggcatcagcagccccgagaccgaggccagaatcagcctgcccaaggccagcctgaagaagaaggaggagaaggccaccatgaagaacgtgcccagcagagagcaggagaagaagagaaaggcccagatcaacaagcaggccgagaagaaggagaaggagaagagcagcctgaccaacgccgagttcgaggagatcgtgcagatcgtgctgcagaagagcctgcaggagtgcctgggcggcatgggcagcggcctggacttcgccgagaccagctgcgcccagcccgtggtgagcacccagagcgacaaggagcccggcatcaccgccagcgccaccgacaccgacaacgccaacggcgaggaggtgccccacacccaggagatcagcgtgagctgggagggcgaggccgcccccgagatcagaaccagcaagctgggccagcccgaccccgcccccagcaagaagaagagcaacagactgaccctgagcaagagaaagaaggaggcccaggacgagaaggtggagaagacccagggcggccacgagcacagacaggaggacagactgaagaagaccgtgcaggaccacagccagatcagagaccagcagaagggcgagatcagcggcttcggccagtgcctggtgtgggtgcagtgcagcttccccaactgcggcaagtggagaagactgtgcggcaacatcgaccccagcgtgctgcccgacaactggagctgcgaccagaacaccgccgacgtgcagtacaacagatgcgacatccccgaggagacctggaccggcctggagagcgacgtggcctacgccagctacatccccggcagcatcatctgggccaagcagtacggctacccctggtggcccggcatgatcgagagcgaccccgacctgggcgagtacttcctgttcaccagccacctggacagcctgcccagcaagtaccacgtgaccttcttcggcgagaccgtgagcagagcctggatccccgtgaacatgctgaagaacttccaggagctgagcctggagctgagcgtgatgaagaagagaagaaacgactgcagccagaagctgggcgtggccctgatgatggcccaggaggccgagcagatcagcatccaggagagagtgaacctgttcggcttctggagcagattcaacggcagcaacagcaacggcgagagaaaggacctgcagctgagcggcctgaacagccccggcagctgcctggagaacggcaaggagagaagacccagagagttcagattctag

SEQ ID NO: 26406 - DNA, 1947 bp, Artificial Sequence
  Description of Artificial Sequence: Synthetic coding sequence
atgatgaccaccctgcagaacaaggaggagtgcggcaagggccccaagagaatcttcgccccccccgcccagaagagctacagcctgctgccctgcagccccaacagccccaaggaggagacccccggcatcagcagccccgagaccgaggccagaatcagcctgcccaaggccagcctgaagaagaaggaggagaaggccaccatgaagaacgtgcccagcagagagcaggagaagaagagaaaggcccagatcaacaagcaggccgagaagaaggagaaggagaagagcagcctgaccaacgccgagttcgaggagatcgtgcagatcgtgctgcagaagagcctgcaggagtgcctgggcatgggcagcggcctggacttcgccgagaccagctgcgcccagcccgtggtgagcacccagagcgacaaggagcccggcatcaccgccagcgccaccgacaccgacaacgccaacggcgaggaggtgccccacacccaggagatcagcgtgagctgggagggcgaggccgcccccgagatcagaaccagcaagctgggccagcccgaccccgcccccagcaagaagaagagcaacagactgaccctgagcaagagaaagaaggaggcccacgagaaggtggagaagacccagggcggccacgagcacagacaggaggacagactgaagaagaccgtgcaggaccacagccagatcagagaccagcagaagggcgagatcagcggcttcggccagtgcctggtgtgggtgcagtgcagcttccccaactgcggcaagtggagaagactgtgcggcaacatcgaccccagcgtgctgcccgacaactggagctgcgaccagaacaccgacgtgcagtacaacagatgcgacatccccgaggagacctggaccggcctggagagcgacgtggcctacgccagctacatccccggcagcatcatctgggccaagcagtacggctacccctggtggcccggcatgatcgagagcgaccccgacctgggcgagtacttcctgttcaccagccacctggacagcctgcccagcaagtaccacgtgaccttcttcggcgagaccgtgagcagagcctggatccccgtgaacatgctgaagaacttccaggagctgagcctggagctgagcgtgatgaagaagagaagaaacgactgcagccagaagctgggcgtggccctgatgatggcccaggaggccgagcagatcagcatccaggagagagtgaacctgttcggcttctggagcagattcaacggcagcaacagcaacggcgagagaaaggacctgcagctgagcggcctgaacagccccggcagctgcctggagaagaaggagaaggaggaggagctggagaaggaggagggcgagaagaccgaccccatcctgcccatcagaaagagagtgaagatccagacccagaagaccaagcccagaggcctgggcggcgacgccggcaccgccgacggcagaggcagaaccctgcagagaaagatcatgaagagaagcctgggcagaaagagcaccgccccccccgcccccagaatgggcagaaaggagggccagggcaacagcgacagcgaccagcccggccccaagaagaagttcaaggccccccagagcaaggccctggccgccagcttcagcgagggcaaggaggtgagaaccgtgcccaagaacctgggcctgagcgcctgcaagggcgcctgccccagcagcgccaaggaggagcccagacacagagagcccctgacccaggaggccggcagcgtgcccctggaggacgaggccagcagcgacctggacctggagcagctgatggaggacgtgggcagagagctgggccagagcggcgagctgcagcacagcaacagcgacggcgaggacttccccgtggccctgttcggcaagtag

SEQ ID NO: 26407 - DNA, 1071 bp, Artificial Sequence
  Description of Artificial Sequence: Synthetic coding sequence
atggacaaggagaagctggacgtgaagatcgagtactgcaactacgccatggacagcagcgtggagaacatgtacgtgaacaaggtgtgggtgcagtgcgagaacgagaactgcctgaagtggagactgctgagcagcgaggacagcgccaaggtggaccacgacgagccctggtactgcttcatgaacaccgacagcagatacaacaactgcagcatcagcgaggaggacttccccgaggagagccagctgcaccagtgcggcttcaagatcgtgtacagccagctgcccctgggcagcctggtgctggtgaagctgcagaactggcccagctggcccggcatcctgtgccccgacagattcaagggcaagtacgtgacctacgaccccgacggcaacgtggaggagtaccacatcgagttcctgggcgacccccacagcagaagctggatcaaggccaccttcgtgggccactacagcatcaccctgaagcccgagaagtgcaagaacaagaagaagtggtacaagagcgccctgcaggaggcctgcctgctgtacggctacagccacgagcagagactggagatgtgctgcctgagcaagctgcaggacaagagcgagacccacgacaaggtggccgccctggtgaagaagagaaagcagaccagcaagaacaacatcgagaagaagaagcccaagttcagaaagagaaagagaaaggccatcctgaagtgcagcttcgagaacgtgtacagcgacgacgccctgagcaaggagaacagagtggtgtgcgagaccgaggtgctgctgaaggagctggagcagatgctgcagcaggccctgcagcccaccgccacccccgacgagagcgaggagggccacggcgaggagatcaacatgggcgagaagctgagcaagtgcagccccgaggcccccgccggcagcctgttcgagaaccactacgaggaggactacctggtgatcgacggcatcaagctgaaggccggcgagtgcatcgaggacatcaccaacaagttcaaggagatcgacgccctgatgagcgagttctag

SEQ ID NO: 26408 - DNA, 384 bp, Artificial Sequence
  Description of Artificial Sequence: Synthetic coding sequence
atggacaaggagaagctggacgtgaagatcgagtactgcaactacgccatggacagcagcgtggagaacatgtacgtgaacaaggtgtgggtgcagtgcgagaacgagaactgcctgaagtggagactgctgagcagcgaggacagcgccaaggtggaccacgacgagccctggtactgcttcatgaacaccgacagcagatacaacaactgcagcatcagcgaggaggacttccccgaggagagccagctgcaccagtgcggcttcaagatcgtgtacagccagctgcccctgggcagcctggtgctggtgaagctgcagaactggcccagctggcccggcatcctgtgccccgacagattcaagggcaagtacgtgacctag

SEQ ID NO: 26409 - DNA, 1071 bp, Artificial Sequence; identical to SEQ ID NO: 26407
  Description of Artificial Sequence: Synthetic coding sequence

SEQ ID NO: 26410 - DNA, 7065 bp, Artificial Sequence
  Description of Artificial Sequence: Synthetic coding sequence
atgcagaagagacagggctactgcagctactgcagagtgcagtacaacaacctggagcagcacctgttcagcgcccagcacagaagcctgaccagacagagcagaagacagatctgcaccagcagcctgatggagagattcctgcaggacgtgctgcagcaccacccctaccactgccaggagagcagcagcacccaggacgagacccacgtgaacaccggcagcagcagcgaggtggtgcacctggacgacgccttcagcgaggaggaggaggaggacgaggacaaggtggaggacgaggacgccaccgaggagagacccagcgaggtgagcgagcccatcgaggagctgcacagcagaccccacaagagccaggagggcacccaggaggtgagcgtgagacccagcgtgatccagaagctggagaagggccagcagcagcccctggagttcgtgcacaagatcggcgccagcgtgagaaagtgcaacctggtggacatcggccaggccaccaacaacagaagcaacctggtgagaccccccgtgatctgcaacgcccccgccagctgcctgcccgagagcagcaacgacagacccgtgaccgccaacaccaccagcctgccccccgccgcccacctggacagcgtgagcaagtgcgaccccaacaaggtggagaagtacctggagcagcccgacggcgccagcagaaaccccgtgcccagcagccacgtggagaccaccagcttcagctaccagaagcacaaggagagcaacagaaagagcctgagaatgaacagcgacaagctggtgctgtggaaggacgtgaagagccagggcaagaccctgagcgccggcctgaagttccacgagagaatgggcaccaagggcagcctgagagtgaagagccccagcaagctggccgtgaaccccaacaagaccgacatgcccagcaacaagggcatcttcgaggacaccatcgccaagaaccacgaggagttcttcagcaacatggactgcacccaggaggagaagcacctggtgttcaacaagaccgccttctgggagcagaagtgcagcgtgagcagcgagatgaagttcgactgcatcagcctgcagagcgccagcgaccagccccaggagaccgcccaggacctgagcctgtggaaggaggagcagatcgaccaggaggacaactacgagagcagaggcagcgagatgagcttcgactgcagcagcagcttccacagcctgaccgaccagagcaaggtgagcgccaaggaggtgaacctgagcaaggaggtgagaaccgacgtgcagtacaagaacaacaagagctacgtgagcaagatcagcagcgactgcgacgacatcctgcacctggtgaccaaccagagccagatgatcgtgaaggagatcagcctgcagaacgccagacacatcagcctggtggaccagagctacgagagcagcagcagcgagaccaacttcgactgcgacgccagcccccagagcaccagcgactacccccagcagagcgtgaccgaggtgaacctgcccaaggaggtgcacatcggcctggtggacaagaactacggcagcagcagcagcgaggtgagcgccgacagcgtgttccccctgcagagcgtggtggacagaccccccgtggccgtgaccgagaccaagctgagaaagaaggcccacaccagcctggtggacaactacggcagcagctgcagcgagaccagcttcgactgcgacgtgagcctggagagcgtggtggaccacccccagctgaccgtgaagggcagaaacctgaagggcagacaggtgcacctgaagcacaagaagagaaagcccagcagcgccaaggcccacctggactgcgacgtgagcctgggcaccgtggccgacgagagccagagagccgtggagaagatcaacctgctgaaggagaagaacgccgacctgatggacatgaactgcgagagccacggccccgagatgggcttccaggccgacgcccagctggccgaccagagccaggtggccgagatcgagagacagaaggtggacgtggacctggagaacaagagcgtgcagagcagcagaagcagcctgagcagcgacagccccgccagcctgtaccacagcgcccacgacgagccccaggaggccctggacgaggtgaacctgaaggagctgaacatcgacatggaggtgagaagctacgactgcagcagcagcgagctgaccttcgacagcgacccccccctgctgagcgtgaccgagcagagccacctggacgccgagggcaaggagagacacatcgacctggaggacgagagctgcgagagcgacagcagcgagatcaccttcgacagcgacatccccctgtacagcgtgatcgaccagcccgaggtggccgtgtacgaggaggagaccgtggacctggagagcaagagcaacgagagctgcgtgagcgagatcaccttcgacagcgacatccccctgcacagcggcaacgaccaccccgaggtggccgtgaaggaggtgatccagaaggaggagtacatccacctggagagaaagaacgacgagcccagcggcagcgagatcagcagcgacagccacgcccccctgcacagcgtgaccaacagccccgaggtggccgtgaagaagctgaacccccagaaggaggagcaggtgcacctggagaacaaggagaacgagcccatcgacagcgaggtgagcctggactacaacatcatcttccacagcgtgaccggcagaagcgaggaccccatcaaggagatcagcctgcacaccaaggagcacatgtacctggagaacaagagcgtgttcgagaccagcctggacagcgacgtgcccctgcaggccgccacccacaagcccgaggtgatcgtgaaggagacctggctgcagagagagaagcacgccgagttccagggcagaagcaccgagttcagcggcagcaagaccagcctggacagcggcgtgccccactacagcgtgaccgagccccaggtggccgtgaacaagatcaacagaaagaagcagtacgtgctggagaacaagaacgacaagtgcagcggcagcgagatcatcctggacagcaacgtgcccccccagagcatgaccgaccagccccagctggccttcctgaaggagaagcacgtgaacctgaaggacaagaacagcaagagcggcgacagcaagatcaccttcgacagcgagcagctgcaggaggccgtgaagaagatcgaccagtggaaggaggaggtgatcggcctgaagaacaagatcaacgagcccagcacctacaagctgatccaccaccccgacgtgagcgtgcagagcgtggccgaccagcccaaggtggccatcaagcacgtgaacctgggcaacgagaaccacatgtacctggaggtgaagaacagccagtacagctgcagcgagatgaacctggacagcggcttcctgggccagagcatcgtgaacagaccccagatcaccatcctggagcaggagcacatcgagctggagggcaagcacaaccagtgctgcggcagcgaggtgagcttcgacagcgacgaccccctgcagagcgtggccgacagactgagagagaccgtgaaggagatcagcctgtggaaggacgaggaggtggacaccgaggacagaagaaacgaggccaagggcttcgagatcatgtacgacagcgacgtgctgcagcccgtggccggccagcccgaggaggtggtgaaggaggtgagcctgtggaaggagcacgtggacctggagaacaagatcgtgaagcccaccgacagcagaatcaacttcgacagccacgagcccctgcagagcgtgaccaacaagatccccggcgccaacaaggagatcaacctgctgagagaggagcacgtgtgcctggacgacaagggctacgtgcccagcgacagcgagatcatctacgtgagcaacatccccctgcagagcgtgatcaagcagccccacatcctggaggaggagcacgccagcctggaggacaagagcagcaacagctacagccccgaggagagcagcgacagcaacgacagcttccaggccgccgccgacgagctgcagaagcccgtgaaggagatcaacctgtggaaggaggaccacatctacctggaggacaagagctacaagctgggcgacttcgacgtgagctacgccagccacatccccgtgcagttcgtgaccgaccagagcagcgtgcccgtgaaggagatcaacctgcagaagaaggaccacaacgacctggagaacaagaactgcgaggtgtgcggcagcgagatcaagtgccacagctgcgtgcacctgcagagcgaggtggaccagccccaggtgagctacaaggaggccgacctgcagaaggaggagcacgtggtgatggaggagaagaccgaccagcccagcgacagcgagatgatgtacgacagcgacgtgcccttccagatcgtggtgaaccagttccccggcagcgtgaaggagacccacctgcccaaggtggtgctggtggacctggtgcccggcgacagcgactacgaggtgatcagcgacgacatccccctgcagctggtgaccgaccccccccagctgaccgtgaaggacatcagctgcatcaacaccgagtgcatcgacatcgaggacaagagctgcgacttcttcggcagcgaggtgagatgcaactgcaaggccagcacccccagcatgaccaaccagtgcaaggagaccttcaagatcatcaacagaaagaaggactacatcatcctgggcgagcccagctgccagagctgcggcagcgagatgaacttcaacgtggacgccagcgaccagagcatgacctacgagagccagggccccgacgagaagatggtgaagtacatcgacagcgaggacaagagctgcggctacaacggcagcaagggcaagttcaacctggaggacaccagccacagaaccacccacagactgcagaaggcccacaaggaggccagcctgagaaaggaccccagaaacgccggcctgaagggcaagagctgccagagcagcgccagcgccgtggacttcggcgccagcagcaagagcgccctgcacagaagagccgacaagaagaagagaagcaagctgaagcacagagacctggaggtgagctgcgagcccgacggcttcgagatgaacttccagtgcgccccccccctgcccagcgacaccgaccagccccaggagaccgtgaagaagagacacccctgcaagaaggtgagcagcgacctgaaggagaagaaccacgacagccagagcagcagcgtgctgaaggtggacagcgtgagaaacctgaagaaggccaaggacgtgatcgaggacaaccccgacgagcccgtgctggaggccctgccccacgtgccccccagcttcgtgggcaagacctggagccagatcatgagagaggacgacatcaagatcaacgccctggtgaaggagttcagagagggcagattccactgctacttcgacgacgactgcgagaccaagaaggtgagcagcaagggcaagaagaaggtgacctgggccgacctgcagggcaaggaggacaccgcccccacccaggccgtgagcgagagcgacgacatcgtgtgcggcatcagcgacatcgacgacctgagcgtggccctggacaagccctgccacagacacccccccgccgagagaccccccaagcagaagggcagagtggccagccagtgccagaccgccaagatcagccacagcacccagaccagctgcaagaactaccccgtgatgaagagaaagatcatcagacaggaggaggacccccccaagagcaagtgcagcagactgcaggacgacagaaagaccaagaagaaggtgaagatcggcaccgtggagttccccgccagctgcaccaaggtgctgaagcccatgcagcccaaggccctggtgtgcgtgctgagcagcctgaacatcaagctgaaggagggcgagggcctgcccttccccaagatgagacaccacagctgggacaacgacatcagattcatctgcaagtacaagagaaacatcttcgactactacgagcccctgatcaagcagatcgtgatcagcccccccctgagcgtgatcgtgcccgagttcgagagaagaaactgggtgaagatccacttcaacagaagcaaccagaacagcagcgccggcgacaacgacgccgacggccagggcagcgccagcgcccccctgatggccgtgcccgccagatacggcttcaacagccaccagggcaccagcgacagcagcctgttcctggaggagagcaaggtgctgcacgccagagagctgcccaagaagagaaacttccagctgaccttcctgaaccacgacgtggtgaagatcagccccaagagcgtgagaaacaagctgctggagagccagagcaagaagaagatccacggcaagagagtgaccaccagcagcaacaagctgggcttccccaagaaggtgtacaagcccatcatcctgcagcagaagcccagaaaggccagcgagaagcagagcatctggatcagaaccaagcccagcgacatcatcagaaagtacatcagcaagtacagcgtgttcctgagacacagataccagagcagaagcgccttcctgggcagatacctgaagaagaagaagagcgtggtgagcagactgaagaaggccaagagaaccgccaaggtgctgctgaacagcagcgtgccccccgccggcgccgaggagctgagcagcgccatggccaaccccccccccaagagacccgtgagagccagctgcagagtggccagaagaagaaagaagaccgacgagagctaccacggcagacagaagggccccagcacccccgtgagagcctacgacctgagaagcagcagctgcctgcagcagagagagagaatgatgaccagactggccaacaagctgagaggcaacgaggtgaagtag

SEQ ID NO: 26411 - DNA, 1116 bp, Artificial Sequence
  Description of Artificial Sequence: Synthetic coding sequence
atggacaccagaagcggcagccagtgcagcgtgacccccgaggccatcagaaacaacgaggagctggtgctgccccccagaatcagcagagtgaacggctggagcctgcccctgcactacttcagagtggtgacctgggccgtgttcgtgggcctgagcctggccaccttcagaatcttcatccccctgctgccccacagctggaagtacatcgcctacgtggtgaccggcggcatcttcagcttccacctggtggtgcacctgatcgccagctgcatcgaccccgccgacagcaacgtgagactgatgaagaactacagccagcccatgcccctgttcgacagaagcaagcacgcccacgtgatccagaaccagttctgccacctgtgcaaggtgaccgtgaacaagaagaccaagcactgcatcagctgcaacaagtgcgtgagcggcttcgaccaccactgcaagtggatcaacaactgcgtgggcagcagaaactactggttcttcttcagcaccgtggccagcgccaccgccggcatgctgtgcctgatcgccatcctgctgtacgtgctggtgcagtacctggtgaaccccagagtgctgagaaccgaccccagatacgaggacgtgaagaacatgaacacctggctgctgttcctgcccctgttccccgtgcaggtgcagaccctgatcgtggtgatcatcagaatgctggtgctgctgctggacctgctgggcctggtgcagctgggccagctgctgatcttccacatctacctgaaggccaagaagatgaccaccttcgagtacctgatcaacaccagaaaggaggagagcagcaagcaccaggccgtgagaaaggacccctacgtgcagatggacaagggcttcctgcagcagggcgccggcgccctgggcagcagcgcccagggcgtgaaggccaagagcagcctgctgatctacaagtgcccctgccacttctgcaccagcgtgaaccaggacggcgacagcaaggcccaggaggccgacgacgcccccagcaccagcaccctgggcctgcagcaggagaccaccgagcccatgaagaccgacagcgccgagagcgaggactag

SEQ ID NO: 26412 - DNA, 1212 bp, Artificial Sequence
  Description of Artificial Sequence: Synthetic coding sequence
atgaactacgacagccagcagccccccctgccccccctgccctacgccggctgcagaagagccagcggcttccccgccctgggcagaggcggcaccgtgcccgtgggcgtgtggggcggcgccggccagggcagagagggcagaagctggggcgagggccccagaggccccggcctgggcagaagagacctgagcagcgccgaccccgccgtgctgggcgccaccatggagagcagatgctacggctgcgccgtgaagttcaccctgttcaagaaggagtacggctgcaagaactgcggcagagccttctgcagcggctgcctgagcttcagcgccgccgtgcccagaaccggcaacacccagcagaaggtgtgcaagcagtgccacgaggtgctgaccagaggcagcagcgccaacgccagcaagtggagccccccccagaactacaagaagagagtggccgccctggaggccaagcagaagcccagcaccagccagagccagggcctgaccagacaggaccagatgatcgccgagagactggccagactgagacaggagaacaagcccaagctggtgcccagccaggccgagatcgaggccagactggccgccctgaaggacgagagacagggcagcatccccagcacccaggagatggaggccagactggccgccctgcagggcagagtgctgcccagccagaccccccagcccgcccaccacacccccgacaccagaacccaggcccagcagacccaggacctgctgacccagctggccgccgaggtggccatcgacgagagctggaagggcggcggccccgtgaccctgcaggactacagactgcccgacagcgacgacgacgaggacgaggagaccgccatccagagagtgctgcagcagctgaccgaggaggccagcctggacgaggccagcggcttcaacatccccgccgagcaggccagcagaccctggacccagcccagaggcgccgagcccgaggcccaggacgtggaccccagacccgaggccgaggaggaggagctgccctggtgctgcatctgcaacgaggacgccaccctgagatgcgccggctgcgacggcgacctgttctgcgccagatgcttcagagagggccacgacgccttcgagctgaaggagcaccagaccagcgcctacagcccccccagagccggccaggagcactag

SEQ ID NO: 26413 - DNA, 1386 bp, Artificial Sequence
  Description of Artificial Sequence: Synthetic coding sequence
atgcccgccgtggccgaggccctgggccaggagggcccccccgacctgagcagaagcgccttcctggccaccgtgctgaccagcctgagcgccgccttcagcagcatgcccagcagcgcctacagcctgcccttcagcagaagcctggagctggactaccacaccagcagctgcttcagaggcaccatggtgaaggccgactgccccgtgcccatcaccgacctgcccgacagcagcggcaagctgcagtacggctgcaagaactgcggcagagccttctgcagcggctgcctgagcttcagcgccgccgtgcccagaaccggcaacacccagcagaaggtgtgcaagcagtgccacgaggtgctgaccagaggcagcagcgccaacgccagcaagtggagccccccccagaactacaagaagagagtggccgccctggaggccaagcagaagcccagcaccagccagagccagggcctgaccagacaggaccagatgatcgccgagagactggccagactgagacaggagaacaagcccaagctggtgcccagccaggccgagatcgaggccagactggccgccctgaaggacgagagacagggcagcatccccagcacccaggagatggaggccagactggccgccctgcagggcagagtgctgcccagccagaccccccagcccgcccaccacacccccgacaccagaacccaggcccagcagacccaggacctgctgacccagctggccgccgaggtggccatcgacgagagctggaagggcggcggccccgccgccagcctgcagaacgacctgaaccagggcggccccggcagcaccaacagcaagagacaggccaactggagcctggaggaggagaagagcagactgctggccgaggccgccctggagctgagagaggagaacaccagacaggagagaatcctggccctggccaagagactggccatgctgagaggccaggaccccgagagagtgaccctgcaggactacagactgcccgacagcgacgacgacgaggacgaggagaccgccatccagagagtgctgcagcagctgaccgaggaggccagcctggacgaggccagcggcttcaacatccccgccgagcaggccagcagaccctggacccagcccagaggcgccgagcccgaggcccaggacgtggaccccagacccgaggccgaggaggaggagctgccctggtgctgcatctgcaacgaggacgccaccctgagatgcgccggctgcgacggcgacctgttctgcgccagatgcttcagagagggccacgacgccttcgagctgaaggagcaccagaccagcgcctacagcccccccagagccggccaggagcactag

SEQ ID NO: 26414 - DNA, 1416 bp, Artificial Sequence
  Description of Artificial Sequence: Synthetic coding sequence
atgaactacgacagccagcagccccccctgccccccctgccctacgccggctgcagaagagccagcggcttccccgccctgggcagaggcggcaccgtgcccgtgggcgtgtggggcggcgccggccagggcagagagggcagaagctggggcgagggccccagaggccccggcctgggcagaagagacctgagcagcgccgaccccgccgtgctgggcgccaccatggagagcagatgctacggctgcgccgtgaagttcaccctgttcaagaaggagtacggctgcaagaactgcggcagagccttctgcagcggctgcctgagcttcagcgccgccgtgcccagaaccggcaacacccagcagaaggtgtgcaagcagtgccacgaggtgctgaccagaggcagcagcgccaacgccagcaagtggagccccccccagaactacaagaagagagtggccgccctggaggccaagcagaagcccagcaccagccagagccagggcctgaccagacaggaccagatgatcgccgagagactggccagactgagacaggagaacaagcccaagctggtgcccagccaggccgagatcgaggccagactggccgccctgaaggacgagagacagggcagcatccccagcacccaggagatggaggccagactggccgccctgcagggcagagtgctgcccagccagaccccccagcccgcccaccacacccccgacaccagaacccaggcccagcagacccaggacctgctgacccagctggccgccgaggtggccatcgacgagagctggaagggcggcggccccgccgccagcctgcagaacgacctgaaccagggcggccccggcagcaccaacagcaagagacaggccaactggagcctggaggaggagaagagcagactgctggccgaggccgccctggagctgagagaggagaacaccagacaggagagaatcctggccctggccaagagactggccatgctgagaggccaggaccccgagagagtgaccctgcaggactacagactgcccgacagcgacgacgacgaggacgaggagaccgccatccagagagtgctgcagcagctgaccgaggaggccagcctggacgaggccagcggcttcaacatccccgccgagcaggccagcagaccctggacccagcccagaggcgccgagcccgaggcccaggacgtggaccccagacccgaggccgaggaggaggagctgccctggtgctgcatctgcaacgaggacgccaccctgagatgcgccggctgcgacggcgacctgttctgcgccagatgcttcagagagggccacgacgccttcgagctgaaggagcaccagaccagcgcctacagcccccccagagccggccaggagcactag

SEQ ID NO: 26415 - DNA, 465 bp, Artificial Sequence
  Description of Artificial Sequence: Synthetic coding sequence
atggtggagaagaagaccagcgtgagaagccaggaccccggccagagaagagtgctggacagagccgccagacagagaagaatcaacagacagctggaggccctggagaacgacaacttccaggacgacccccacgccggcctgccccagctgggcaagagactgccccagttcgacgacgacgccgacaccggcaagaagaagaagaagaccagaggcgaccacttcaagctgagattcagaaagaacttccaggccctgctggaggagcagaacctgagcgtggccgagggccccaactacctgaccgcctgcgccggcccccccagcagaccccagagacccttctgcgccgtgtgcggcttccccagcccctacacctgcgtgagctgcggcgccagatactgcaccgtgagatgcctgggcacccaccaggagaccagatgcctgaagtggaccgtgtag

SEQ ID NO: 26416 - DNA, 1413 bp, Artificial Sequence
  Description of Artificial Sequence: Synthetic coding sequence
atggagttcgccgccgagaacgagggcaagagcggcggcggcctgcacagcgtggccgagggcgtgagactgagccccgagcccggcagagagggcgtgagagacctggccggcgccgaggagttcggcggcggcgaggagggcaccggcctgaccggcatcaaggagatcggcgacggcgaggagggcagcggccagagacccgaggagatccccatggacctgaccgtggtgaagcaggagatcatcgactggcccggcaccgagggcagactggccggccagtgggtggagcaggaggtggaggacagacccgaggtgaaggacgagaacgccggcgtgctggaggtgaagcaggagaccgacagcagcctggtggtgaaggaggccaaggtgggcgagcccgaggtgaaggaggagaaggtgaaggaggaggtgatggactggagcgaggtgaaggaggagaaggacaacctggagatcaagcaggaggagaagttcgtgggccagtgcatcaaggaggagctgatgcacggcgagtgcgtgaaggaggagaaggacttcctgaagaaggagatcgtggacgacaccaaggtgaaggaggagccccccatcaaccaccccgtgggctgcaagagaaagctggccatgagcagatgcgagacctgcggcaccgaggaggccaagtacagatgccccagatgcatgagatacagctgcagcctgccctgcgtgaagaagcacaaggccgagctgacctgcaacggcgtgagagacaagaccgcctacatcagcatccagcagttcaccgagatgaacctgctgagcgactacagattcctggaggacgtggccagaaccgccgaccacatcagcagagacgccttcctgaagagacccatcagcaacaagtacatgtacttcatgaagaacagagccagaagacagggcatcaacctgaagctgctgcccaacggcttcaccaagagaaaggagaacagcaccttcttcgacaagaagaagcagcagttctgctggcacgtgaagctgcagttcccccagagccaggccgagtacatcgagaagagagtgcccgacgacaagaccatcaacgagatcctgaagccctacatcgaccccgagaagagcgaccccgtgatcagacagagactgaaggcctacatcagaagccagaccggcgtgcagatcctgatgaagatcgagtacatgcagcagaacctggtgagatactacgagctggacccctacaagagcctgctggacaacctgagaaacaaggtgatcatcgagtaccccaccctgcacgtggtgctgaagggcagcaacaacgacatgaaggtgctgcaccaggtgaagagcgagagcaccaagaacgtgggcaacgagaactag

SEQ ID NO: 26417 - DNA, 1296 bp, Artificial Sequence
  Description of Artificial Sequence: Synthetic coding sequence
atggagttcgccgccgagaacgagggcaagagcggcggcggcctgcacagcgtggccgagggcgtgagactgagccccgagcccggcagagagggcgtgagagacctggccggcgccgaggagttcggcggcggcgaggagggcaccggcctgaccggcatcaaggagatcggcgacggcgaggagggcagcggccagagacccgaggagatccccatggacctgaccgtggtgaagcaggagaccgacagcagcctggtggtgaaggaggccaaggtgggcgagcccgaggtgaaggaggagaaggtgaaggaggaggtgatggactggagcgaggtgaaggaggagaaggacaacctggagatcaagcaggaggagaagttcgtgggccagtgcatcaaggaggagctgatgcacggcgagtgcgtgaaggaggagaaggacttcctgaagaaggagatcgtggacgacaccaaggtgaaggaggagccccccatcaaccaccccgtgggctgcaagagaaagctggccatgagcagatgcgagacctgcggcaccgaggaggccaagtacagatgccccagatgcatgagatacagctgcagcctgccctgcgtgaagaagcacaaggccgagctgacctgcaacggcgtgagagacaagaccgcctacatcagcatccagcagttcaccgagatgaacctgctgagcgactacagattcctggaggacgtggccagaaccgccgaccacatcagcagagacgccttcctgaagagacccatcagcaacaagtacatgtacttcatgaagaacagagccagaagacagggcatcaacctgaagctgctgcccaacggcttcaccaagagaaaggagaacagcaccttcttcgacaagaagaagcagcagttctgctggcacgtgaagctgcagttcccccagagccaggccgagtacatcgagaagagagtgcccgacgacaagaccatcaacgagatcctgaagccctacatcgaccccgagaagagcgaccccgtgatcagacagagactgaaggcctacatcagaagccagaccggcgtgcagatcctgatgaagatcgagtacatgcagcagaacctggtgagatactacgagctggacccctacaagagcctgctggacaacctgagaaacaaggtgatcatcgagtaccccaccctgcacgtggtgctgaagggcagcaacaacgacatgaaggtgctgcaccaggtgaagagcgagagcaccaagaacgtgggcaacgagaactag

SEQ ID NO: 26418 - DNA, 4647 bp, Artificial Sequence
  Description of Artificial Sequence: Synthetic coding sequence
atggccgagagagaggtggagagcggccccagaaagagattcgagcagaagagcggcgccgtgttcgacgagatcgtggagaactgcggcggcatcatggacaccgagatgagcgaggacatcgaccacaacctgacccccaccctggacagcatgagctacggcatgcccaaccagaccggcagcgagaacagcctgctggacgaggacgactacttcctgaacagcggcgacctggccggcatccccgtggtgggcagcgacaacgaggacgagcaggacttcagcagcaaggacaacctggtgagcagcatccacaccgacgacagcctggaggtggagagaagagtgacccagcacgagagcgacaacgagaacgagatccagatccagaacaagctgaagaaggacttccccaagcagttcgaccaggtgagcgtgttcaagagcatcagaaaggacttcagcctggtgagagagaacagcaaggagaccttcagcggcaaggagaagaacagagacctgacctacgagagagagaagagactggacaagccccacaaggacctggacagcagactgaagagcagcttcttcgacaaggccgccaaccaggtggaggagaccctgcacacccacctgccccagacccccgagaccaacttcagagacagcagctaccccttcgccaacaaggagagcatcggcagcgagctgggcaacagcttcgccagcaacatcagaatcaaggaggagcccctggacgacgagtacgacaaggccatggccccccagcagggcctgctggacaagatcaaggacgagcccgacaacgcccaggagtacagccacggccagcagcagaagacccaggagggcgagctgaagatcagcgccgtgttcagcgtgagcggcagccccctggccccccagctgaccaccggcttccagcccagcctggccagcagcggcatgaacaagatgctgcccagcgtgcccgccaccgccgtgagagtgagctgcagcggctgcaagaagatcctgcagaagggccagaccgcctaccagagaaagggcagcacccagctgttctgcagcaccctgtgcctgaccggctacaccgtgccccccgccagaccccccccccccctgaccaagaagacctgcagcagctgcagcaaggacatcctgaaccccaaggacgtgatcagcgcccagttcgagaacaccaccaccagcaaggacttctgcagccagagctgcctgagcacctacgagctgaagaagaagcccatcgtgaccatcaacaccaacagcatcagcaccaagtgcagcatgtgccagaagaacgccgtgatcagacacgaggtgaactaccagaacgtggtgcacaagctgtgcagcgacgcctgcttcagcaagttcagaagcgccaacaacctgaccatgaactgctgcgagaactgcggcggctactgctacagcggcagcggccagtgccacatgctgcagatcgagggccagagcaagaagttctgcagcagcagctgcatcaccgcctacaagcagaagagcgccaagatcaccccctgcgccctgtgcaagagcctgagaagcagcgccgagatgatcgagaacaccaacagcctgggcaagaccgagctgttctgcagcgtgaactgcctgagcgcctacagagtgaagatggtgaccagcgccggcgtgcaggtgcagtgcaacagctgcaagaccagcgccatcccccagtaccacctggccatgagcgacggcagcatcagaaacttctgcagctacagctgcgtggtggccttccagaacctgttcaacaagcccaccggcatgaacagcagcgtggtgcccctgagccagggccaggtgatcgtgagcatccccaccggcagcaccgtgagcgccggcggcggcagcaccagcgccgtgagccccaccagcatcagcagcagcgccgccgccggcctgcagagactggccgcccagagccagcacgtgggcttcgccagaagcgtggtgaagctgaagtgccagcactgcaacagactgttcgccaccaagcccgagctgctggactacaagggcaagatgttccagttctgcggcaagaactgcagcgacgagtacaagaagatcaacaacgtgatggccatgtgcgagtactgcaagatcgagaagatcgtgaaggagaccgtgagattcagcggcgccgacaagagcttctgcagcgagggctgcaagctgctgtacaagcacgacctggccaagagatggggcaaccactgcaagatgtgcagctactgcctgcagaccagccccaagctggtgcagaacaacctgggcggcaaggtggaggagttctgctgcgaggagtgcatgagcaagtacaccgtgctgttctaccagatggccaagtgcgacgcctgcaagagacagggcaagctgagcgagagcctgaagtggagaggcgagatgaagcacttctgcaacctgctgtgcatcctgatgttctgcaaccagcagagcgtgtgcgacccccccagccagaacaacgccgccaacatcagcatggtgcaggccgccagcgccggcccccccagcctgagaaaggacagcacccccgtgatcgccaacgtggtgagcctggccagcgcccccgccgcccagcccaccgtgaacagcaacagcgtgctgcagggcgccgtgcccaccgtgaccgccaagatcatcggcgacgccagcacccagaccgacgccctgaagctgccccccagccagccccccagactgctgaagaacaaggccctgctgtgcaagcccatcacccagaccaaggccaccagctgcaagccccacacccagaacaaggagtgccagaccgaggacacccccagccagccccagatcatcgtggtgcccgtgcccgtgcccgtgttcgtgcccatccccctgcacctgtacacccagtacgcccccgtgcccttcggcatccccgtgcccatgcccgtgcccatgctgatccccagcagcatggacagcgaggacaaggtgaccgagagcatcgaggacatcaaggagaagctgcccacccaccccttcgaggccgacctgctggagatggccgagatgatcgccgaggacgaggagaagaagaccctgagccagggcgagagccagaccagcgagcacgagctgttcctggacaccaagatcttcgagaaggaccagggcagcacctacagcggcgacctggagagcgaggccgtgagcaccccccacagctgggaggaggagctgaaccactacgccctgaagagcaacgccgtgcaggaggccgacagcgagctgaagcagttcagcaagggcgagaccgagcaggacctggaggccgacttccccagcgacagcttcgaccccctgaacaagggccagggcatccaggccagaagcagaaccagaagaagacacagagacggcttcccccagcccagaagaagaggcagaaagaagagcatcgtggccgtggagcccagaagcctgatccagggcgccttccagggctgcagcgtgagcggcatgaccctgaagtacatgtacggcgtgaacgcctggaagaactgggtgcagtggaagaacgccaaggaggagcagggcgacctgaagtgcggcggcgtggagcaggccagcagcagccccagaagcgaccccctgggcagcacccaggaccacgccctgagccaggagagcagcgagcccggctgcagagtgagaagcatcaagctgaaggaggacatcctgagctgcaccttcgccgagctgagcctgggcctgtgccagttcatccaggaggtgagaagacccaacggcgagaagtacgaccccgacagcatcctgtacctgtgcctgggcatccagcagtacctgttcgagaacggcagaatcgacaacatcttcaccgagccctacagcagattcatgatcgagctgaccaagctgctgaagatctgggagcccaccatcctgcccaacggctacatgttcagcagaatcgaggaggagcacctgtgggagtgcaagcagctgggcgcctacagccccatcgtgctgctgaacaccctgctgttcttcaacaccaagtacttccagctgaagaacgtgaccgagcacctgaagctgagcttcgcccacgtgatgagaagaaccagaaccctgaagtacagcaccaagatgacctacctgagattcttcccccccctgcagaagcaggagagcgagcccgacaagctgaccgtgggcaagagaaagagaaacgaggacgacgaggtgcccgtgggcgtggagatggccgagaacaccgacaaccccctgagatgccccgtgagactgtacgagttctacctgagcaagtgcagcgagagcgtgaagcagagaaacgacgtgttctacctgcagcccgagagaagctgcgtgcccaacagccccatgtggtacagcaccttccccatcgaccccggcaccctggacaccatgctgaccagaatcctgatggtgagagaggtgcacgaggagctggccaaggccaagagcgaggacagcgacgtggagctgagcgactag

SEQ ID NO: 26419 - DNA, 4380 bp, Artificial Sequence
  Description of Artificial Sequence: Synthetic coding sequence
atggccgagagagaggtggagagcggccccagaaagagattcgagcagaagagcggcgccgtgttcgacgagatcgtggagaactgcggcggcatcatggacaccgagatgagcgaggacatcgaccacaacctgacccccaccctggacagcatgagctacggcatgcccaaccagaccggcagcgagaacagcctgctggacgaggacgactacttcctgaacagcggcgacctggccggcatccccgtggtgggcagcgacaacgaggacgagcaggacttcagcagcaaggacaacctggtgagcagcatccacaccgacgacagcctggaggtggagagaagagtgacccagcacgagagcgacaacgagaacgagatccagatccagaacaagctgaagaaggacttccccaagcagttcgaccaggtgagcgtgttcaagagcatcagaaaggacttcagcctggtgagagagaacagcaaggagaccttcagcggcaaggagaagaacagagacctgacctacgagagagagaagagactggacaagccccacaaggacctggacagcagactgaagagcagcttcttcgacaaggccgccaaccaggtggaggagaccctgcacacccacctgccccagacccccgagaccaacttcagagacagcagctaccccttcgccaacaaggagagcatcggcagcgagctgggcaacagcttcgccagcaacatcagaatcaaggaggagcccctggacgacgagtacgacaaggccatggccccccagcagggcctgctggacaagatcaaggacgagcccgacaacgcccaggagtacagccacggccagcagcagaagacccaggagggcgagctgaagatcagcgccgtgttcagcgtgagcggcagccccctggccccccagctgaccaccggcttccagcccagcctggccagcagcggcatgaacaagatgctgcccagcgtgcccgccaccgccgtgagagtgagctgcagcggctgcaagaagatcctgcagaagggccagaccgcctaccagagaaagggcagcacccagctgttctgcagcaccctgtgcctgaccggctacaccgtgccccccgccagaccccccccccccctgaccaagaagacctgcagcagctgcagcaaggacatcctgaaccccaaggacgtgatcagcgcccagttcgagaacaccaccaccagcaaggacttctgcagccagagctgcctgagcacctacgagctgaagaagaagcccatcgtgaccatcaacaccaacagcatcagcaccaagtgcagcatgtgccagaagaacgccgtgatcagacacgaggtgaactaccagaacgtggtgcacaagctgtgcagcgacgcctgcttcagcaagttcagaagcgccaacaacctgaccatgaactgctgcgagaactgcggcggctactgctacagcggcagcggccagtgccacatgctgcagatcgagggccagagcaagaagttctgcagcagcagctgcatcaccgcctacaagcagaacctgttcaacaagcccaccggcatgaacagcagcgtggtgcccctgagccagggccaggtgatcgtgagcatccccaccggcagcaccgtgagcgccggcggcggcagcaccagcgccgtgagccccaccagcatcagcagcagcgccgccgccggcctgcagagactggccgcccagagccagcacgtgggcttcgccagaagcgtggtgaagctgaagtgccagcactgcaacagactgttcgccaccaagcccgagctgctggactacaagggcaagatgttccagttctgcggcaagaactgcagcgacgagtacaagaagatcaacaacgtgatggccatgtgcgagtactgcaagatcgagaagatcgtgaaggagaccgtgagattcagcggcgccgacaagagcttctgcagcgagggctgcaagctgctgtacaagcacgacctggccaagagatggggcaaccactgcaagatgtgcagctactgcctgcagaccagccccaagctggtgcagaacaacctgggcggcaaggtggaggagttctgctgcgaggagtgcatgagcaagtacaccgtgctgttctaccagatggccaagtgcgacgcctgcaagagacagggcaagctgagcgagagcctgaagtggagaggcgagatgaagcacttctgcaacctgctgtgcatcctgatgttctgcaaccagcagagcgtgtgcgacccccccagccagaacaacgccgccaacatcagcatggtgcaggccgccagcgccggcccccccagcctgagaaaggacagcacccccgtgatcgccaacgtggtgagcctggccagcgcccccgccgcccagcccaccgtgaacagcaacagcgtgctgcagggcgccgtgcccaccgtgaccgccaagatcatcggcgacgccagcacccagaccgacgccctgaagctgccccccagccagccccccagactgctgaagaacaaggccctgctgtgcaagcccatcacccagaccaaggccaccagctgcaagccccacacccagaacaaggagtgccagaccgaggacacccccagccagccccagatcatcgtggtgcccgtgcccgtgcccgtgttcgtgcccatccccctgcacctgtacacccagtacgcccccgtgcccttcggcatccccgtgcccatgcccgtgcccatgctgatccccagcagcatggacagcgaggacaaggtgaccgagagcatcgaggacatcaaggagaagctgcccacccaccccttcgaggccgacctgctggagatggccgagatgatcgccgaggacgaggagaagaagaccctgagccagggcgagagccagaccagcgagcacgagctgttcctggacaccaagatcttcgagaaggaccagggcagcacctacagcggcgacctggagagcgaggccgtgagcaccccccacagctgggaggaggagctgaaccactacgccctgaagagcaacgccgtgcaggaggccgacagcgagctgaagcagttcagcaagggcgagaccgagcaggacctggaggccgacttccccagcgacagcttcgaccccctgaacaagggccagggcatccaggccagaagcagaaccagaagaagacacagagacggcttcccccagcccagaagaagaggcagaaagaagagcatcgtggccgtggagcccagaagcctgatccagggcgccttccagggctgcagcgtgagcggcatgaccctgaagtacatgtacggcgtgaacgcctggaagaactgggtgcagtggaagaacgccaaggaggagcagggcgacctgaagtgcggcggcgtggagcaggccagcagcagccccagaagcgaccccctgggcagcacccaggaccacgccctgagccaggagagcagcgagcccggctgcagagtgagaagcatcaagctgaaggaggacatcctgagctgcaccttcgccgagctgagcctgggcctgtgccagttcatccaggaggtgagaagacccaacggcgagaagtacgaccccgacagcatcctgtacctgtgcctgggcatccagcagtacctgttcgagaacggcagaatcgacaacatcttcaccgagccctacagcagattcatgatcgagctgaccaagctgctgaagatctgggagcccaccatcctgcccaacggctacatgttcagcagaatcgaggaggagcacctgtgggagtgcaagcagctgggcgcctacagccccatcgtgctgctgaacaccctgctgttcttcaacaccaagtacttccagctgaagaacgtgaccgagcacctgaagctgagcttcgcccacgtgatgagaagaaccagaaccctgaagtacagcaccaagatgacctacctgagattcttcccccccctgcagaagcaggagagcgagcccgacaagctgaccgtgggcaagagaaagagaaacgaggacgacgaggtgcccgtgggcgtggagatggccgagaacaccgacaaccccctgagatgccccgtgagactgtacgagttctacctgagcaagtgcagcgagagcgtgaagcagagaaacgacgtgttctacctgcagcccgagagaagctgcgtgcccaacagccccatgtggtacagcaccttccccatcgaccccggcaccctggacaccatgctgaccagaatcctgatggtgagagaggtgcacgaggagctggccaaggccaagagcgaggacagcgacgtggagctgagcgactag

SEQ ID NO: 26420 - DNA, 297 bp, Artificial Sequence
  Description of Artificial Sequence: Synthetic coding sequence
atggacaccgagatgagcgaggacatcgaccacaacctgacccccaccctggacagcatgagctacggcatgcccaaccagaccggcagcgagaacagcctgctggacgaggacgactacttcctgaacagcggcgacctggccggcatccccgtggtgggcagcgacaacgaggacgagcaggacttcagcagcaaggacaacctggtgagcagcatccacaccgacgacagcctggaggtggagagaagagtgacccagcacgagagcgacaacgagaacgagatccagatctag

SEQ ID NO: 26421 - DNA, 3624 bp, Artificial Sequence
  Description of Artificial Sequence: Synthetic coding sequence
tgacccctggacgacgagtacgacaaggccatggccccccagcagggcctgctggacaagatcaaggacgagcccgacaacgcccaggagtacagccacggccagcagcagaagacccaggagggcgagctgaagatcagcgccgtgttcagcgtgagcggcagccccctggccccccagctgaccaccggcttccagcccagcctggccagcagcggcatgaacaagatgctgcccagcgtgcccgccaccgccgtgagagtgagctgcagcggctgcaagaagatcctgcagaagggccagaccgcctaccagagaaagggcagcacccagctgttctgcagcaccctgtgcctgaccggctacaccgtgccccccgccagaccccccccccccctgaccaagaagacctgcagcagctgcagcaaggacatcctgaaccccaaggacgtgatcagcgcccagttcgagaacaccaccaccagcaaggacttctgcagccagagctgcctgagcacctacgagctgaagaagaagcccatcgtgaccatcaacaccaacagcatcagcaccaagtgcagcatgtgccagaagaacgccgtgatcagacacgaggtgaactaccagaacgtggtgcacaagctgtgcagcgacgcctgcttcagcaagttcagaagcgccaacaacctgaccatgaactgctgcgagaactgcggcggctactgctacagcggcagcggccagtgccacatgctgcagatcgagggccagagcaagaagttctgcagcagcagctgcatcaccgcctacaagcagaacctgttcaacaagcccaccggcatgaacagcagcgtggtgcccctgagccagggccaggtgatcgtgagcatccccaccggcagcaccgtgagcgccggcggcggcagcaccagcgccgtgagccccaccagcatcagcagcagcgccgccgccggcctgcagagactggccgcccagagccagcacgtgggcttcgccagaagcgtggtgaagctgaagtgccagcactgcaacagactgttcgccaccaagcccgagctgctggactacaagggcaagatgttccagttctgcggcaagaactgcagcgacgagtacaagaagatcaacaacgtgatggccatgtgcgagtactgcaagatcgagaagatcgtgaaggagaccgtgagattcagcggcgccgacaagagcttctgcagcgagggctgcaagctgctgtacaagcacgacctggccaagagatggggcaaccactgcaagatgtgcagctactgcctgcagaccagccccaagctggtgcagaacaacctgggcggcaaggtggaggagttctgctgcgaggagtgcatgagcaagtacaccgtgctgttctaccagatggccaagtgcgacgcctgcaagagacagggcaagctgagcgagagcctgaagtggagaggcgagatgaagcacttctgcaacctgctgtgcatcctgatgttctgcaaccagcagagcgtgtgcgacccccccagccagaacaacgccgccaacatcagcatggtgcaggccgccagcgccggcccccccagcctgagaaaggacagcacccccgtgatcgccaacgtggtgagcctggccagcgcccccgccgcccagcccaccgtgaacagcaacagcgtgctgcagggcgccgtgcccaccgtgaccgccaagatcatcggcgacgccagcacccagaccgacgccctgaagctgccccccagccagccccccagactgctgaagaacaaggccctgctgtgcaagcccatcacccagaccaaggccaccagctgcaagccccacacccagaacaaggagtgccagaccgacacccccagccagccccagatcatcgtggtgcccgtgcccgtgcccgtgttcgtgcccatccccctgcacctgtacacccagtacgcccccgtgcccttcggcatccccgtgcccatgcccgtgcccatgctgatccccagcagcatggacagcgaggacaaggtgaccgagagcatcgaggacatcaaggagaagctgcccacccaccccttcgaggccgacctgctggagatggccgagatgatcgccgaggacgaggagaagaagaccctgagccagggcgagagccagaccagcgagcacgagctgttcctggacaccaagatcttcgagaaggaccagggcagcacctacagcggcgacctggagagcgaggccgtgagcaccccccacagctgggaggaggagctgaaccactacgccctgaagagcaacgccgtgcaggaggccgacagcgagctgaagcagttcagcaagggcgagaccgagcaggacctggaggccgacttccccagcgacagcttcgaccccctgaacaagggccagggcatccaggccagaagcagaaccagaagaagacacagagacggcttcccccagcccagaagaagaggcagaaagaagagcatcgtggccgtggagcccagaagcctgatccagggcgccttccagggctgcagcgtgagcggcatgaccctgaagtacatgtacggcgtgaacgcctggaagaactgggtgcagtggaagaacgccaaggaggagcagggcgacctgaagtgcggcggcgtggagcaggccagcagcagccccagaagcgaccccctgggcagcacccaggaccacgccctgagccaggagagcagcgagcccggctgcagagtgagaagcatcaagctgaaggaggacatcctgagctgcaccttcgccgagctgagcctgggcctgtgccagttcatccaggaggtgagaagacccaacggcgagaagtacgaccccgacagcatcctgtacctgtgcctgggcatccagcagtacctgttcgagaacggcagaatcgacaacatcttcaccgagccctacagcagattcatgatcgagctgaccaagctgctgaagatctgggagcccaccatcctgcccaacggctacatgttcagcagaatcgaggaggagcacctgtgggagtgcaagcagctgggcgcctacagccccatcgtgctgctgaacaccctgctgttcttcaacaccaagtacttccagctgaagaacgtgaccgagcacctgaagctgagcttcgcccacgtgatgagaagaaccagaaccctgaagtacagcaccaagatgacctacctgagattcttcccccccctgcagaagcaggagagcgagcccgacaagctgaccgtgggcaagagaaagagaaacgaggacgacgaggtgcccgtgggcgtggagatggccgagaacaccgacaaccccctgagatgccccgtgagactgtacgagttctacctgagcaagtgcagcgagagcgtgaagcagagaaacgacgtgttctacctgcagcccgagagaagctgcgtgcccaacagccccatgtggtacagcaccttccccatcgaccccggcaccctggacaccatgctgaccagaatcctgatggtgagagaggtgcacgaggagctggccaaggccaagagcgaggacagcgacgtggagctgagcgactag

SEQ ID NO: 26422 - DNA, 1098 bp, Artificial Sequence
  Description of Artificial Sequence: Synthetic coding sequence
atgaacgtgatctaccccctggccgtgcccaagggcagaagactgtgctgcgaggtgtgcgaggcccccgccgagagagtgtgcgccgcctgcaccgtgacctactactgcggcgtggtgcaccagaaggccgactgggacagcatccacgagaagatctgccagctgctgatccccctgagaaccagcatgcccttctacaacagcgaggaggagagacagcacggcctgcagcagctgcagcagagacagaagtacctgatcgagttctgctacaccatcgcccagaagtacctgttcgagggcaagcacgaggacgccgtgcccgccgccctgcagagcctgagattcagagtgaagctgtacggcctgagcagcgtggagctggtgcccgcctacctgctgctggccgaggccagcctgggcctgggcagaatcgtgcaggccgaggagtacctgttccaggcccagtggaccgtgctgaagagcaccgactgcagcaacgccacccacagcctgctgcacagaaacctgggcctgctgtacatcgccaagaagaactacgaggaggccagataccacctggccaacgacatctacttcgccagctgcgccttcggcaccgaggacatcagaaccagcggcggctacttccacctggccaacatcttctacgacctgaagaagctggacctggccgacaccctgtacaccaaggtgagcgagatctggcacgcctacctgaacaaccactaccaggtgctgagccaggcccacatccagcagatggacctgctgggcaagctgttcgagaacgacaccggcctggacgaggcccaggaggccgaggccatcagaatcctgaccagcatcctgaacatcagagagagcaccagcgacaaggccccccagaagaccatcttcgtgctgaagatcctggtgatgttctactacctgatgatgaacagcagcaaggcccaggagtacggcatgagagccctgagcctggccaaggagcagcagctggacgtgcacgagcagagcaccatccaggagctgctgagcctgatcagcaccgaggaccaccccatcacctag

SEQ ID NO: 26423 - DNA, 768 bp, Artificial Sequence
  Description of Artificial Sequence: Synthetic coding sequence
atgagcgccctggacagcaccgcccacttccacgccctgctgcagttcagaggcagaaccgccgcctggcccgccgccgccgccgccgccgccggcctgggcagaatcgtgcaggccgaggagtacctgttccaggcccagtggaccgtgctgaagagcaccgactgcagcaacgccacccacagcctgctgcacagaaacctgggcctgctgtacatcgccaagaagaactacgaggaggccagataccacctggccaacgacatctacttcgccagctgcgccttcggcaccgaggacatcagaaccagcggcggctacttccacctggccaacatcttctacgacctgaagaagctggacctggccgacaccctgtacaccaaggtgagcgagatctggcacgcctacctgaacaaccactaccaggtgctgagccaggcccacatccagcagatggacctgctgggcaagctgttcgagaacgacaccggcctggacgaggcccaggaggccgaggccatcagaatcctgaccagcatcctgaacatcagagagagcaccagcgacaaggccccccagaagaccatcttcgtgctgaagatcctggtgatgttctactacctgatgatgaacagcagcaaggcccaggagtacggcatgagagccctgagcctggccaaggagcagcagctggacgtgcacgagcagagcaccatccaggagctgctgagcctgatcagcaccgaggaccaccccatcacctag

SEQ ID NO: 26424 - DNA, 1383 bp, Artificial Sequence
  Description of Artificial Sequence: Synthetic coding sequence
atggcccccagaagcagaagaagaagacacaagaagccccccagcagcgtggcccccatcatcatggcccccaccaccatcgtgacccccgtgcccctgacccccagcaagcccggccccagcatcgacaccctgggcttcttcagcctggacgacaacgtgcccggcctgagccagctgatcctgcagaagctgaacatgaagagctacgaggagtacaagctggtggtggacggcggcacccccgtgagcggcttcggcttcagatgcccccaggagatgttccagagaatggaggacaccttcagattctgcgcccactgcagagccctgcccagcggcctgagcgacagcaaggtgctgagacactgcaagagatgcagaaacgtgtactactgcggccccgagtgccagaagagcgactggcccgcccacagaagagtgtgccaggagctgagactggtggccgtggacagactgatggagtggctgctggtgaccggcgacttcgtgctgcccagcggcccctggccctggccccccgaggccgtgcaggactgggacagctggttcagcatgaagggcctgcacctggacgccaccctggacgccgtgctggtgagccacgccgtgaccaccctgtgggccagcgtgggcagacccagacccgaccccgacgtgctgcagggcagcctgaagagactgctgaccgacgtgctgagcagacccctgaccctgggcctgggcctgagagccctgggcatcgacgtgagaagaaccggcggcagcaccgtgcacgtggtgggcgccagccacgtggagaccttcctgaccagacccggcgactacgacgagctgggctacatgttccccggccacctgggcctgagagtggtgatggtgggcgtggacgtggccaccggcttcagccagagcaccagcaccagccccctggagcccggcaccatccagctgagcgcccacagaggcctgtaccacgacttctgggaggagcaggtggagaccggccagacccaccaccccgacctggtggccgccttccaccccggcttccacagcagccccgacctgatggaggcctggctgcccaccctgctgctgctgagagactacaagatccccaccctgatcaccgtgtacagccaccaggagctggtgagcagcctgcagatcctggtggagctggacacccacatcaccgccttcggcagcaaccccttcatgagcctgaagcccgagcaggtgtacagcagccccaacaagcagcccgtgtactgcagcgcctactacatcatgttcctgggcagcagctgccagctggacaacagacagctggaggagaaggtggacggcggcatctag

SEQ ID NO: 26425 - DNA, 1383 bp, Artificial Sequence; identical to SEQ ID NO: 26424
  Description of Artificial Sequence: Synthetic coding sequence

SEQ ID NO: 26426 - DNA, 3240 bp, Artificial Sequence
  Description of Artificial Sequence: Synthetic coding sequence
atgcccagagtgcacaacatcaagaagagcctgaccccccacatcagctgcgtgaccaacgagagcgacaacctgctggacttcctgcccgacagactgagagccaagctgctgcccttccagaaggacggcatcatcttcgccctgaagagaaacggcagatgcatggtggccgacgagatgggcctgggcaagaccatccaggccatcggcatcacctacttctacaaggaggagtggcccctgctgatcgtggtgcccagcagcctgagatacccctggaccgaggagatcgagaagtggatccccgagctgagccccgaggagatcaacgtgatccagaacaagaccgacgtgagaagaatgagcaccagcaaggtgaccgtgctgggctacggcctgctgaccgccgacgccaagaccctgatcgacgccctgaacaaccagaacttcaaggtggtgatcgtggacgagagccactacatgaagagcagaaacgccaccagaagcagaatcctgctgcccatcgtgcagaaggccagaagagccatcctgctgaccggcacccccgccctgggcagacccgaggagctgttcatgcagatcgaggccctgttcccccagaagttcggcagatggaccgactacgccaagagatactgcaacgcccacatcagatacttcggcaagagaccccagtgggactgcagaggcgccagcaacctgaacgagctgcaccagctgctgagcgacatcatgatcagaagactgaagaccgaggtgctgacccagctgccccccaaggtgagacagagaatccccttcgacctgcccagcgccgccgccaaggagctgaacaccagcttcgaggagtgggagaagatcatgagaacccccaacagcggcgccatggagaccgtgatgggcctgatcaccagaatgttcaagcagaccgccatcgccaaggccggcgccgtgaaggactacatcaagatgatgctgcagaacgacagcctgaagttcctggtgttcgcccaccacctgagcatgctgcaggcctgcaccgaggccgtgatcgagaacaagaccagatacatcagaatcgacggcagcgtgagcagcagcgagagaatccacctggtgaaccagttccagaaggaccccgacaccagagtggccatcctgagcatccaggccgccggccagggcctgaccttcaccgccgccagccacgtggtgttcgccgagctgtactgggaccccggccacatcaagcaggccgaggacagagcccacagaatcggccagtgcagcagcgtgaacatccactacctgatcgccaacggcaccctggacaccctgatgtggggcatgctgaacagaaaggcccaggtgaccggcagcaccctgaacggcagaaaggagaagatccaggccgaggagggcgacaaggagaagtgggacttcctgcagttcgccgaggcctggacccccaacgacagcagcgaggagctgagaaaggaggccctgttcacccacttcgagaaggagaagcagcacgacatcagaagcttcttcgtgccccagcccaagaagagacagctgatgaccagctgcgacgagagcaagagattcagagaggagaacaccgtggtgagcagcgaccccaccaagaccgccgccagagacatcatcgactacgagagcgacgtggagcccgagaccaagagactgaagctggccgccagcgaggaccactgcagccccagcgaggagacccccagccagagcaagcagatcagaacccccctggtggagagcgtgcaggaggccaaggcccagctgaccacccccgccttccccgtggagggctggcagtgcagcctgtgcacctacatcaacaacagcgagctgccctactgcgagatgtgcgagaccccccagggcagcgccgtgatgcagatcgacagcctgaaccacatccaggacaagaacgagaaggacgacagccagaaggacaccagcaagaaggtgcagaccatcagcgactgcgagaagcaggccctggcccagagcgagcccggccagctggccgacagcaaggaggagacccccaagatcgagaaggaggacggcctgaccagccagcccggcaacgagcagtggaagagcagcgacaccctgcccgtgtacgacaccctgatgttctgcgccagcagaaacaccgacagaatccacatctacaccaaggacggcaagcagatgagctgcaacttcatccccctggacatcaagctggacctgtgggaggacctgcccgccagcttccagctgaagcagtacagaagcctgatcctgagattcgtgagagagtggagcagcctgaccgccatgaagcagagaatcatcagaaagagcggccagctgttctgcagccccatcctggccctggaggagatcaccaagcagcagaccaagcagaactgcaccaagagatacatcaccaaggaggacgtggccgtggccagcatggacaaggtgaagaacgtgggcggccacgtgagactgatcaccaaggagagcagacccagagaccccttcaccaagaagctgctggaggacggcgcctgcgtgcccttcctgaacccctacaccgtgcaggccgacctgaccgtgaagcccagcaccagcaagggctacctgcaggccgtggacaacgagggcaaccccctgtgcctgagatgccagcagcccacctgccagaccaagcaggcctgcaaggccaacagctgggacagcagattctgcagcctgaagtgccaggaggagttctggatcagaagcaacaacagctacctgagagccaaggtgttcgagaccgagcacggcgtgtgccagctgtgcaacgtgaacgcccaggagctgttcctgagactgagagacgcccccaagagccagagaaagaacctgctgtacgccacctggaccagcaagctgcccctggagcagctgaacgagatgatcagaaaccccggcgagggccacttctggcaggtggaccacatcaagcccgtgtacggcggcggcggccagtgcagcctggacaacctgcagaccctgtgcaccgtgtgccacaaggagagaaccgccagacaggccaaggagagaagccaggtgagaagacagagcctggccagcaagcacggcagcgacatcaccagattcctggtgaagaagtag

SEQ ID NO: 26427 - DNA, 1797 bp, Artificial Sequence
  Description of Artificial Sequence: Synthetic coding sequence
atgaccagctgcgacgagagcaagagattcagagaggagaacaccgtggtgagcagcgaccccaccaagaccgccgccagagacatcatcgactacgagagcgacgtggagcccgagaccaagagactgaagctggccgccagcgaggaccactgcagccccagcgaggagacccccagccagagcaagcagatcagaacccccctggtggagagcgtgcaggaggccaaggcccagctgaccacccccgccttccccgtggagggctggcagtgcagcctgtgcacctacatcaacaacagcgagctgccctactgcgagatgtgcgagaccccccagggcagcgccgtgatgcagatcgacagcctgaaccacatccaggacaagaacgagaaggacgacagccagaaggacaccagcaagaaggtgcagaccatcagcgactgcgagaagcaggccctggcccagagcgagcccggccagctggccgacagcaaggaggagacccccaagatcgagaaggaggacggcctgaccagccagcccgagcagtggaagagcagcgacaccctgcccgtgtacgacaccctgatgttctgcgccagcagaaacaccgacagaatccacatctacaccaaggacggcaagcagatgagctgcaacttcatccccctggacatcaagctggacctgtgggaggacctgcccgccagcttccagctgaagcagtacagaagcctgatcctgagattcgtgagagagtggagcagcctgaccgccatgaagcagagaatcatcagaaagagcggccagctgttctgcagccccatcctggccctggaggagatcaccaagcagcagaccaagcagaactgcaccaagagatacatcaccaaggaggacgtggccgtggccagcatggacaaggtgaagaacgtgggcggccacgtgagactgatcaccaaggagagcagacccagagaccccttcaccaagaagctgctggaggacggcgcctgcgtgcccttcctgaacccctacaccgtgcaggccgacctgaccgtgaagcccagcaccagcaagggctacctgcaggccgtggacaacgagggcaaccccctgtgcctgagatgccagcagcccacctgccagaccaagcaggcctgcaaggccaacagctgggacagcagattctgcagcctgaagtgccaggaggagttctggatcagaagcaacaacagctacctgagagccaaggtgttcgagaccgagcacggcgtgtgccagctgtgcaacgtgaacgcccaggagctgttcctgagactgagagacgcccccaagagccagagaaagaacctgctgtacgccacctggaccagcaagctgcccctggagcagctgaacgagatgatcagaaaccccggcgagggccacttctggcaggtggaccacatcaagcccgtgtacggcggcggcggccagtgcagcctggacaacctgcagaccctgtgcaccgtgtgccacaaggagagaaccgccagacaggccaaggagagaagccaggtgagaagacagagcctggccagcaagcacggcagcgacatcaccagattcctggtgaagaagaagctgcacgagagccacaaggtgaccggcgccgagcagggcctgcaggtgagcggcctgcccgacagcgccgcccccgagggcggcgccgcccacaccaacgaccagagaagatgccagagaatgaagcagcccctgaccgaggtgcagatcctgagccacagcagctag

SEQ ID NO: 26428 - DNA, 1107 bp, Artificial Sequence
  Description of Artificial Sequence: Synthetic coding sequence
atgggcctgggcaagaccatccaggccatcggcatcacctacttctacaaggaggagtggcccctgctgatcgtggtgcccagcagcctgagatacccctggaccgaggagatcgagaagtggatccccgagctgagccccgaggagatcaacgtgatccagaacaagaccgacgtgagaagaatgagcaccagcaaggtgaccgtgctgggctacggcctgctgaccgccgacgccaagaccctgatcgacgccctgaacaaccagaacttcaaggtggtgatcgtggacgagagccactacatgaagagcagaaacgccaccagaagcagaatcctgctgcccatcgtgcagaaggccagaagagccatcctgctgaccggcacccccgccctgggcagacccgaggagctgttcatgcagatcgaggccctgttcccccagaagttcggcagatggaccgactacgccaagagatactgcaacgcccacatcagatacttcggcaagagaccccagtgggactgcagaggcgccagcaacctgaacgagctgcaccagctgctgagcgacatcatgatcagaagactgaagaccgaggtgctgacccagctgccccccaaggtgagacagagaatccccttcgacctgcccagcgccgccgccaaggagctgaacaccagcttcgaggagtgggagaagatcatgagaacccccaacagcggcgccatggagaccgtgatgggcctgatcaccagaatgttcaagcagaccgccatcgccaaggccggcgccgtgaaggactacatcaagatgatgctgcagaacgacagcctgaagttcctggtgttcgcccaccacctgagcatgctgcaggcctgcaccgaggccgtgatcgagaacaagaccagatacatcagaatcgacggcagcgtgagcagcagcgagagaatccacctggtgaaccagttccagaaggaccccgacaccagagtggccatcctgagcatccaggccgccggccaggacctgtacgacaaggtggcctggggcaagagaaccctggtgagcggcctgttcatggagtgcttctgcttcgtgccctag

SEQ ID NO: 26429 - DNA, 3234 bp, Artificial Sequence
  Description of Artificial Sequence: Synthetic coding sequence
atgcccagagtgcacaacatcaagaagagcctgaccccccacatcagctgcgtgaccaacgagagcgacaacctgctggacttcctgcccgacagactgagagccaagctgctgcccttccagaaggacggcatcatcttcgccctgaagagaaacggcagatgcatggtggccgacgagatgggcctgggcaagaccatccaggccatcggcatcacctacttctacaaggaggagtggcccctgctgatcgtggtgcccagcagcctgagatacccctggaccgaggagatcgagaagtggatccccgagctgagccccgaggagatcaacgtgatccagaacaagaccgacgtgagaagaatgagcaccagcaaggtgaccgtgctgggctacggcctgctgaccgccgacgccaagaccctgatcgacgccctgaacaaccagaacttcaaggtggtgatcgtggacgagagccactacatgaagagcagaaacgccaccagaagcagaatcctgctgcccatcgtgcagaaggccagaagagccatcctgctgaccggcacccccgccctgggcagacccgaggagctgttcatgcagatcgaggccctgttcccccagaagttcggcagatggaccgactacgccaagagatactgcaacgcccacatcagatacttcggcaagagaccccagtgggactgcagaggcgccagcaacctgaacgagctgcaccagctgctgagcgacatcatgatcagaagactgaagaccgaggtgctgacccagctgccccccaaggtgagacagagaatccccttcgacctgcccagcgccgccgccaaggagctgaacaccagcttcgaggagtgggagaagatcatgagaacccccaacagcggcgccatggagaccgtgatgggcctgatcaccagaatgttcaagcagaccgccatcgccaaggccggcgccgtgaaggactacatcaagatgatgctgcagaacgacagcctgaagttcctggtgttcgcccaccacctgagcatgctgcaggcctgcaccgaggccgtgatcgagaacaagaccagatacatcagaatcgacggcagcgtgagcagcagcgagagaatccacctggtgaaccagttccagaaggaccccgacaccagagtggccatcctgagcatccaggccgccggccagggcctgaccttcaccgccgccagccacgtggtgttcgccgagctgtactgggaccccggccacatcaagcaggccgaggacagagcccacagaatcggccagtgcagcagcgtgaacatccactacctgatcgccaacggcaccctggacaccctgatgtggggcatgctgaacagaaaggcccaggtgaccggcagcaccctgaacggcagaaaggagaagatccaggccgaggagggcgacaaggagaagtgggacttcctgcagttcgccgaggcctggacccccaacgacagcagcgaggagctgagaaaggaggccctgttcacccacttcgagaaggagaagcagcacgacatcagaagcttcttcgtgccccagcccaagaagagacagctgatgaccagctgcgacgagagcaagagattcagagaggagaacaccgtggtgagcagcgaccccaccaagaccgccgccagagacatcatcgactacgagagcgacgtggagcccgagaccaagagactgaagctggccgccagcgaggaccactgcagccccagcgaggagacccccagccagagcaagcagatcagaacccccctggtggagagcgtgcaggaggccaaggcccagctgaccacccccgccttccccgtggagggctggcagtgcagcctgtgcacctacatcaacaacagcgagctgccctactgcgagatgtgcgagaccccccagggcagcgccgtgatgcagatcgacagcctgaaccacatccaggacaagaacgagaaggacgacagccagaaggacaccagcaagaaggtgcagaccatcagcgactgcgagaagcaggccctggcccagagcgagcccggccagctggccgacagcaaggaggagacccccaagatcgagaaggaggacggcctgaccagccagcccgagcagtggaagagcagcgacaccctgcccgtgtacgacaccctgatgttctgcgccagcagaaacaccgacagaatccacatctacaccaaggacggcaagcagatgagctgcaacttcatccccctggacatcaagctggacctgtgggaggacctgcccgccagcttccagctgaagcagtacagaagcctgatcctgagattcgtgagagagtggagcagcctgaccgccatgaagcagagaatcatcagaaagagcggccagctgttctgcagccccatcctggccctggaggagatcaccaagcagcagaccaagcagaactgcaccaagagatacatcaccaaggaggacgtggccgtggccagcatggacaaggtgaagaacgtgggcggccacgtgagactgatcaccaaggagagcagacccagagaccccttcaccaagaagctgctggaggacggcgcctgcgtgcccttcctgaacccctacaccgtgcaggccgacctgaccgtgaagcccagcaccagcaagggctacctgcaggccgtggacaacgagggcaaccccctgtgcctgagatgccagcagcccacctgccagaccaagcaggcctgcaaggccaacagctgggacagcagattctgcagcctgaagtgccaggaggagttctggatcagaagcaacaacagctacctgagagccaaggtgttcgagaccgagcacggcgtgtgccagctgtgcaacgtgaacgcccaggagctgttcctgagactgagagacgcccccaagagccagagaaagaacctgctgtacgccacctggaccagcaagctgcccctggagcagctgaacgagatgatcagaaaccccggcgagggccacttctggcaggtggaccacatcaagcccgtgtacggcggcggcggccagtgcagcctggacaacctgcagaccctgtgcaccgtgtgccacaaggagagaaccgccagacaggccaaggagagaagccaggtgagaagacagagcctggccagcaagcacggcagcgacatcaccagattcctggtgaagaagtag

SEQ ID NO: 26430 - DNA, 1797 bp, Artificial Sequence
  Description of Artificial Sequence: Synthetic coding sequence
atgaccagctgcgacgagagcaagagattcagagaggagaacaccgtggtgagcagcgaccccaccaagaccgccgccagagacatcatcgactacgagagcgacgtggagcccgagaccaagagactgaagctggccgccagcgaggaccactgcagccccagcgaggagacccccagccagagcaagcagatcagaacccccctggtggagagcgtgcaggaggccaaggcccagctgaccacccccgccttccccgtggagggctggcagtgcagcctgtgcacctacatcaacaacagcgagctgccctactgcgagatgtgcgagaccccccagggcagcgccgtgatgcagatcgacagcctgaaccacatccaggacaagaacgagaaggacgacagccagaaggacaccagcaagaaggtgcagaccatcagcgactgcgagaagcaggccctggcccagagcgagcccggccagctggccgacagcaaggaggagacccccaagatcgagaaggaggacggcctgaccagccagcccgagcagtggaagagcagcgacaccctgcccgtgtacgacaccctgatgttctgcgccagcagaaacaccgacagaatccacatctacaccaaggacggcaagcagatgagctgcaacttcatccccctggacatcaagctggacctgtgggaggacctgcccgccagcttccagctgaagcagtacagaagcctgatcctgagattcgtgagagagtggagcagcctgaccgccatgaagcagagaatcatcagaaagagcggccagctgttctgcagccccatcctggccctggaggagatcaccaagcagcagaccaagcagaactgcaccaagagatacatcaccaaggaggacgtggccgtggccagcatggacaaggtgaagaacgtgggcggccacgtgagactgatcaccaaggagagcagacccagagaccccttcaccaagaagctgctggaggacggcgcctgcgtgcccttcctgaacccctacaccgtgcaggccgacctgaccgtgaagcccagcaccagcaagggctacctgcaggccgtggacaacgagggcaaccccctgtgcctgagatgccagcagcccacctgccagaccaagcaggcctgcaaggccaacagctgggacagcagattctgcagcctgaagtgccaggaggagttctggatcagaagcaacaacagctacctgagagccaaggtgttcgagaccgagcacggcgtgtgccagctgtgcaacgtgaacgcccaggagctgttcctgagactgagagacgcccccaagagccagagaaagaacctgctgtacgccacctggaccagcaagctgcccctggagcagctgaacgagatgatcagaaaccccggcgagggccacttctggcaggtggaccacatcaagcccgtgtacggcggcggcggccagtgcagcctggacaacctgcagaccctgtgcaccgtgtgccacaaggagagaaccgccagacaggccaaggagagaagccaggtgagaagacagagcctggccagcaagcacggcagcgacatcaccagattcctggagaccagcaagctgcacgagagccacaaggtgaccggcgccgagcagggcctgcaggtgagcggcctgcccgacagcgccgcccccgagggcggcgccgcccacaccaacgaccagagaagatgccagagaatgaagcagcccctgaccgaggtgcagatcctgagccacagcagctag

SEQ ID NO: 26431 - DNA, 3234 bp, Artificial Sequence
  Description of Artificial Sequence: Synthetic coding sequence
atgcccagagtgcacaacatcaagaagagcctgaccccccacatcagctgcgtgaccaacgagagcgacaacctgctggacttcctgcccgacagactgagagccaagctgctgcccttccagaaggacggcatcatcttcgccctgaagagaaacggcagcagaatcgactgcgaccagatgggcctgggcaagaccatccaggccatcggcatcacctacttctacaaggaggagtggcccctgctgatcgtggtgcccagcagcctgagatacccctggaccgaggagatcgagaagtggatccccgagctgagccccgaggagatcaacgtgatccagaacaagaccgacgtgagaagaatgagcaccagcaaggtgaccgtgctgggctacggcctgctgaccgccgacgccaagaccctgatcgacgccctgaacaaccagaacttcaaggtggtgatcgtggacgagagccactacatgaagagcagaaacgccaccagaagcagaatcctgctgcccatcgtgcagaaggccagaagagccatcctgctgaccggcacccccgccctgggcagacccgaggagctgttcatgcagatcgaggccctgttcccccagaagttcggcagatggaccgactacgccaagagatactgcaacgcccacatcagatacttcggcaagagaccccagtgggactgcagaggcgccagcaacctgaacgagctgcaccagctgctgagcgacatcatgatcagaagactgaagaccgaggtgctgacccagctgccccccaaggtgagacagagaatccccttcgacctgcccagcgccgccgccaaggagctgaacaccagcttcgaggagtgggagaagatcatgagaacccccaacagcggcgccatggagaccgtgatgggcctgatcaccagaatgttcaagcagaccgccatcgccaaggccggcgccgtgaaggactacatcaagatgatgctgcagaacgacagcctgaagttcctggtgttcgcccaccacctgagcatgctgcaggcctgcaccgaggccgtgatcgagaacaagaccagatacatcagaatcgacggcagcgtgagcagcagcgagagaatccacctggtgaaccagttccagaaggaccccgacaccagagtggccatcctgagcatccaggccgccggccagggcctgaccttcaccgccgccagccacgtggtgttcgccgagctgtactgggaccccggccacatcaagcaggccgaggacagagcccacagaatcggccagtgcagcagcgtgaacatccactacctgatcgccaacggcaccctggacaccctgatgtggggcatgctgaacagaaaggcccaggtgaccggcagcaccctgaacggcagaaaggagaagatccaggccgaggagggcgacaaggagaagtgggacttcctgcagttcgccgaggcctggacccccaacgacagcagcgaggagctgagaaaggaggccctgttcacccacttcgagaaggagaagcagcacgacatcagaagcttcttcgtgccccagcccaagaagagacagctgatgaccagctgcgacgagagcaagagattcagagaggagaacaccgtggtgagcagcgaccccaccaagaccgccgccagagacatcatcgactacgagagcgacgtggagcccgagaccaagagactgaagctggccgccagcgaggaccactgcagccccagcgaggagacccccagccagagcaagcagatcagaacccccctggtggagagcgtgcaggaggccaaggcccagctgaccacccccgccttccccgtggagggctggcagtgcagcctgtgcacctacatcaacaacagcgagctgccctactgcgagatgtgcgagaccccccagggcagcgccgtgatgcagatcgacagcctgaaccacatccaggacaagaacgagaaggacgacagccagaaggacaccagcaagaaggtgcagaccatcagcgactgcgagaagcaggccctggcccagagcgagcccggccagctggccgacagcaaggaggagacccccaagatcgagaaggaggacggcctgaccagccagcccgagcagtggaagagcagcgacaccctgcccgtgtacgacaccctgatgttctgcgccagcagaaacaccgacagaatccacatctacaccaaggacggcaagcagatgagctgcaacttcatccccctggacatcaagctggacctgtgggaggacctgcccgccagcttccagctgaagcagtacagaagcctgatcctgagattcgtgagagagtggagcagcctgaccgccatgaagcagagaatcatcagaaagagcggccagctgttctgcagccccatcctggccctggaggagatcaccaagcagcagaccaagcagaactgcaccaagagatacatcaccaaggaggacgtggccgtggccagcatggacaaggtgaagaacgtgggcggccacgtgagactgatcaccaaggagagcagacccagagaccccttcaccaagaagctgctggaggacggcgcctgcgtgcccttcctgaacccctacaccgtgcaggccgacctgaccgtgaagcccagcaccagcaagggctacctgcaggccgtggacaacgagggcaaccccctgtgcctgagatgccagcagcccacctgccagaccaagcaggcctgcaaggccaacagctgggacagcagattctgcagcctgaagtgccaggaggagttctggatcagaagcaacaacagctacctgagagccaaggtgttcgagaccgagcacggcgtgtgccagctgtgcaacgtgaacgcccaggagctgttcctgagactgagagacgcccccaagagccagagaaagaacctgctgtacgccacctggaccagcaagctgcccctggagcagctgaacgagatgatcagaaaccccggcgagggccacttctggcaggtggaccacatcaagcccgtgtacggcggcggcggccagtgcagcctggacaacctgcagaccctgtgcaccgtgtgccacaaggagagaaccgccagacaggccaaggagagaagccaggtgagaagacagagcctggccagcaagcacggcagcgacatcaccagattcctggtgaagaagtag

SEQ ID NO: 26432 - DNA, 1794 bp, Artificial Sequence
  Description of Artificial Sequence: Synthetic coding sequence
atgaccagctgcgacgagagcaagagattcagagaggagaacaccgtggtgagcagcgaccccaccaagaccgccgccagagacatcatcgactacgagagcgacgtggagcccgagaccaagagactgaagctggccgccagcgaggaccactgcagccccagcgaggagacccccagccagagcaagcagatcagaacccccctggtggagagcgtgcaggaggccaaggcccagctgaccacccccgccttccccgtggagggctggcagtgcagcctgtgcacctacatcaacaacagcgagctgccctactgcgagatgtgcgagaccccccagggcagcgccgtgatgcagatcgacagcctgaaccacatccaggacaagaacgagaaggacgacagccagaaggacaccagcaagaaggtgcagaccatcagcgactgcgagaagcaggccctggcccagagcgagcccggccagctggccgacagcaaggaggagacccccaagatcgagaaggaggacggcctgaccagccagcccgagcagtggaagagcagcgacaccctgcccgtgtacgacaccctgatgttctgcgccagcagaaacaccgacagaatccacatctacaccaaggacggcaagcagatgagctgcaacttcatccccctggacatcaagctggacctgtgggaggacctgcccgccagcttccagctgaagcagtacagaagcctgatcctgagattcgtgagagagtggagcagcctgaccgccatgaagcagagaatcatcagaaagagcggccagctgttctgcagccccatcctggccctggaggagatcaccaagcagcagaccaagcagaactgcaccaagagatacatcaccaaggaggacgtggccgtggccagcatggacaaggtgaagaacgtgggcggccacgtgagactgatcaccaaggagagcagacccagagaccccttcaccaagaagctgctggaggacggcgcctgcgtgcccttcctgaacccctacaccgtgcaggccgacctgaccgtgaagcccagcaccagcaagggctacctgcaggccgtggacaacgagggcaaccccctgtgcctgagatgccagcagcccacctgccagaccaagcaggcctgcaaggccaacagctgggacagcagattctgcagcctgaagtgccaggaggagttctggatcagaagcaacaacagctacctgagagccaaggtgttcgagaccgagcacggcgtgtgccagctgtgcaacgtgaacgcccaggagctgttcctgagactgagagacgcccccaagagccagagaaagaacctgctgtacgccacctggaccagcaagctgcccctggagcagctgaacgagatgatcagaaaccccggcgagggccacttctggcaggtggaccacatcaagcccgtgtacggcggcggcggccagtgcagcctggacaacctgcagaccctgtgcaccgtgtgccacaaggagagaaccgccagacaggccaaggagagaagccaggtgagaagacagagcctggccagcaagcacggcagcgacatcaccagattcctggtgaagaagctgcacgagagccacaaggtgaccggcgccgagcagggcctgcaggtgagcggcctgcccgacagcgccgcccccgagggcggcgccgcccacaccaacgaccagagaagatgccagagaatgaagcagcccctgaccgaggtgcagatcctgagccacagcagctag

SEQ ID NO: 26433 - DNA, 1902 bp, Artificial Sequence
  Description of Artificial Sequence: Synthetic coding sequence
atgctgagaagaggctacaaggccagcgagagaagaagacacctgagcgagagactgagctggcaccaggaccaggccctgagcagcagcatctacctgctgagagagatgggccccaccggcttcctgctgagagaggaggagcccgagtacatggacttcagagtgttcctgggcaacccccacgtgtgcaactgcagcaccttccccaagggcggcgagctgtgcaagcacatctgctgggtgctgctgaagaagttcaagctgcccagaaaccacgagagcgccctgcagctgggcctgggcgagagagagatcagcgacctgctgagaggcatccacagagtgcagaccccccagcccggcaccaacgacgagaacgagcacgtggaggaggacggctacatcaagcagaaggagatcgacagcgaggacatctgcagcatctgccaggagctgctgctggagaagaagctgcccgtgaccttctgcagattcggctgcggcaacagcatccacatcaagtgcatgaagatcctggccaactaccagagcaccagcaacaccagcatgctgaagtgccccctgtgcagaaaggagttcgcccccctgaagctgatcctggaggagttcaagaacagcagcaagctggtggccgccgccgagaaggagagactggacaagcacctgggcatcccctgcaacaactgcaagcagttccccatcgagggcaagtgctacaagtgcaccgagtgcatcgagtaccacctgtgccaggagtgcttcgacagctgctgccacctgagccacaccttcaccttcagagagaagagaaaccagaagtggagaagcctggagaagagagccgacgaggtggtgaagtacatcgacaccaagaacgagatcgaggagaagatgagccacttccaggagaagcagggccaggtgtacacccccaagcacatcgtgagaagcctgcccctgcagctgatcaccaagaacagcaagctgctggcccccggctaccagtgcctgctgtgcctgaaggccttccacctgggccagcacaccagactgctgccctgcacccacaagttccacagaaagtgcatcgacaactggctgttccacaagtgcaacagctgccccatcgacggccaggtgatctacaaccccctgacctggaagaacagcgccgtgaacggccaggcccaccagagcgtgagcaacagagacatcatccacctgagcaagcagaaggagcccgacctgttcatccccggcaccggcctggtgctgaagcagaacagactgggcatcctgcccagcatcccccagtgcaacttcgacgagctgaacaccccccagagccccaaggacgcctacgagaacaccaccatcgacaacctgtgcagcatcaagctggacaacagcaacagcaagaagctgacctacgactacaagatcagccagcacttccccagatacctgcaggacctgcccaccgtgagcttcggcaagatccccagccagaccctgctgccccccatcgtgcacaagaacatcgtgtgccccaccgccatggagagcccctgcatcagcggcaagttccacaccagcctgagcagaatgaccaagggctgcaagtgcaacaaccacaacctgaagaagacccccgccaccaagatcagagaggacaacaagagaagcaccctgctgcccgaggacttcaacctgatcgtgaactggagcaccgccaagctgagcctgagcaagagatacagcaactgcatgggcgagatcaccagaaagtgcagccacctgagcagacagcccgtgagccacagcgtgaacaccaagagcaccgagctgagcctgatcatcgagggcgtgcagctgtag

SEQ ID NO: 26434 - DNA, 2091 bp, Artificial Sequence
  Description of Artificial Sequence: Synthetic coding sequence
atggagctgggcagctgcttcaagacctacgaggacttcaaggagtgcttcagcgcctacaagagagagaacagatgcagcttcatcctgagagactgcgtgagcgtgagattccacaacctgaaccacggcaccagcatcagagaggacatcctgtacgtgcaggtgaagttcgtgtgcatcagaacccagagcaacagaaagagaaccagagaggccgacatgtgccccgcctacctgctgctgagatacaacgagagactggacagactgttcatcagcgagctgaacacccagcacatccacggcgacagcaaggtggccagccccggcggcgacaccaccggcaagagccagaagaccatgtgcctgcagagactgcagcccgtgcagcccaccaccaagaaggacctggacaccgccgagaagagcctggtggagcccagcttctgcctggacaaggtgcaggtgagcagcaagcccgagcaggagggcatcacccccagcgacctggccaagatcgccaaggtgatgaagaacttcctgaaggtggacgagggcagcatggccagcttcagcgtgggcgacagccagcacctggacagactgagcttccagagcagcaagatgaccgacctgttcatcagattccccgagaacctgctgctgcacagagtggagaacacccagggccacatcctgtacgccttcctggtggagaacaaggagagagagagcagagtggtgcacttcgccgtgctgaaggccgagaccgtgaccagcgtggccaagatgctgagcatcttcaccgagttcaacagcgactggcccaaggtgaaggtggtgttcgtggaccccagcttccactacagagccatcctgcaggagatcttccccgccgccagaatcctgctgagcatctaccacaccaccagactgctggagaagaagctgcacagaagcagcgccaaccccagcttcaagagactgatgaaggaggccctgagagaggccgtgttcgtgaccagcgaggccagcctgaagaacctgtgccagatgagccaggccgtgctggacgaggacctgttcaacttcctgcaggcccactggttcacctgcgagctgctgtggtacatgcacgtgagaaagggcctgctggcctgcaacacctacatggacagcctggacatcgtgaccagcaaggtgagcagcctgttcagagagcagcagagcctgctggactgcatcctgtgcttcgtggactacatcgacttcttcaacaccaagggcctgaagaacctgcccacccccccccccaagctgaagagagccagacccgccagcatgcccctgaagagcaagaaggccttcggcatctgcggcgagagcctgaccagcctgcccgccgaggagaccaagcccgacgcccagcaggtgcaggtgcagcagcagagccaggtgccccccagccaggtgggcatgctggacaccctgcaccagagcggcagcgagctggcctacaagctgtgccacaacgagtgggaggtggtgcagaacagcacccacctggtggacatggccggcagcagcgtggacgtgcagctgctggaggacagccaccaggtgagcaaggacggctgcagctgcagctgcagcttccagcagtggtaccacctgccctgcagacacatcctggccctgctgcacaccagccagcagcccgtgggcgaggccatggtgtgcagaagatggcagaagaagtaccagtacctgctgggccccaacggcgagctgcaggacagaggcatggtgcccaacaccggccagcccgagaagcagggcagaaacgacatgatccaggacctgagcagagagctggccaacctgctgatgcagaccgagggccccgagctggaggagagatacagcaccctgagaaagatcgtggacatctgggccggccccagccagcccagcgagctgttccagcagcccggcgacttcaaggacgtgggcagactgcccttcctgtggggcaagcaggaggagggcgagggcttcccccccgccaccgccgtgatgcactactag

SEQ ID NO: 26435 - DNA, 2073 bp, Artificial Sequence
  Description of Artificial Sequence: Synthetic coding sequence
atgaagaccagactggagagacaggccgagaccaccagcggccaccccagcctggccagcctgtactactggaccgcccccgccctgcccggccccgagctggagatggccccccccccccactgcgcccacaacagatacgtgcaggtgaagttcgtgtgcatcagaacccagagcaacagaaagagaaccagagaggccgacatgtgccccgcctacctgctgctgagatacaacgagagactggacagactgttcatcagcgagctgaacacccagcacatccacggcgacagcaaggtggccagccccggcggcgacaccaccggcaagagccagaagaccatgtgcctgcagagactgcagcccgtgcagcccaccaccaagaaggacctggacaccgccgagaagagcctggtggagcccagcttctgcctggacaaggtgcaggtgagcagcaagcccgagcaggagggcatcacccccagcgacctggccaagatcgccaaggtgatgaagaacttcctgaaggtggacgagggcagcatggccagcttcagcgtgggcgacagccagcacctggacagactgagcttccagagcagcaagatgaccgacctgttcatcagattccccgagaacctgctgctgcacagagtggagaacacccagggccacatcctgtacgccttcctggtggagaacaaggagagagagagcagagtggtgcacttcgccgtgctgaaggccgagaccgtgaccagcgtggccaagatgctgagcatcttcaccgagttcaacagcgactggcccaaggtgaaggtggtgttcgtggaccccagcttccactacagagccatcctgcaggagatcttccccgccgccagaatcctgctgagcatctaccacaccaccagactgctggagaagaagctgcacagaagcagcgccaaccccagcttcaagagactgatgaaggaggccctgagagaggccgtgttcgtgaccagcgaggccagcctgaagaacctgtgccagatgagccaggccgtgctggacgaggacctgttcaacttcctgcaggcccactggttcacctgcgagctgctgtggtacatgcacgtgagaaagggcctgctggcctgcaacacctacatggacagcctggacatcgtgaccagcaaggtgagcagcctgttcagagagcagcagagcctgctggactgcatcctgtgcttcgtggactacatcgacttcttcaacaccaagggcctgaagaacctgcccacccccccccccaagctgaagagagccagacccgccagcatgcccctgaagagcaagaaggccttcggcatctgcggcgagagcctgaccagcctgcccgccgaggagaccaagcccgacgcccagcaggtgcaggtgcagcagcagagccaggtgccccccagccaggtgggcatgctggacaccctgcaccagagcggcagcgagctggcctacaagctgtgccacaacgagtgggaggtggtgcagaacagcacccacctggtggacatggccggcagcagcgtggacgtgcagctgctggaggacagccaccaggtgagcaaggacggctgcagctgcagctgcagcttccagcagtggtaccacctgccctgcagacacatcctggccctgctgcacaccagccagcagcccgtgggcgaggccatggtgtgcagaagatggcagaagaagtaccagtacctgctgggccccaacggcgagctgcaggacagaggcatggtgcccaacaccggccagcccgagaagcagggcagaaacgacatgatccaggacctgagcagagagctggccaacctgctgatgcagaccgagggccccgagctggaggagagatacagcaccctgagaaagatcgtggacatctgggccggccccagccagcccagcgagctgttccagcagcccggcgacttcaaggacgtgggcagactgcccttcctgtggggcaagcaggaggagggcgagggcttcccccccgccaccgccgtgatgcactactag

SEQ ID NO: 26436 - DNA, 2970 bp, Artificial Sequence
  Description of Artificial Sequence: Synthetic coding sequence
atggagccccccgccgccaagagaagcagaggctgccccgccggccccgaggagagagacgccggcgccggcgccgccagaggcagaggcagacccgaggccctgctggacctgagcgccaagagagtggccgagagctgggccttcgagcaggtggaggagagattcagcagagtgcccgagcccgtgcagaagagaatcgtgttctggagcttccccagaagcgagagagagatctgcatgtacagcagcctgggctaccccccccccgagggcgagcacgacgccagagtgcccttcaccagaggcctgcacctgctgcagagcggcgccgtggacagagtgctgcaggtgggcttccacctgagcggcaacatcagagagcccggcagccccggcgagcccgagagactgtaccacgtgagcatcagcttcgacagatgcaagatcaccagcgtgagctgcggctgcgacaacagagacctgttctactgcgcccacgtggtggccctgagcctgtacagaatcagacacgcccaccaggtggagctgagactgcccatcagcgagaccctgagccagatgaacagagaccagctgcagaagttcgtgcagtacctgatcagcgcccaccacaccgaggtgctgcccaccgcccagagactggccgacgagatcctgctgctgggcagcgagatcaacctggtgaacggcgcccccgaccccaccgccggcgccggcatcgaggacgccaactgctggcacctggacgaggagcagatccaggagcaggtgaagcagctgctgagcaacggcggctactacggcgccagccagcagctgagaagcatgttcagcaaggtgagagagatgctgagaatgagagacagcaacggcgccagaatgctgatcctgatgaccgagcagttcctgcaggacaccagactggccctgtggagacagcagggcgccggcatgaccgacaagtgcagacagctgtgggacgagctgggcgccctgtgggtgtgcgtggtgctgagcccccactgcaagcccgaggagagagccggctggctgcagctgctgagcagatgggacaagctggacgtgtgccccctggaggagggcaactacagcttcgacggccccagcctgcagcccaccatggcccccgcccccgagctgctgcagaagggcagcacctgcatcaccaacaccgagggctgggtgggccaccccctggaccccatcggctgcctgtgcagagccctgctggaggcctgcagactggaggaggagaccctgaccctgtaccccgacagcggccccgagaagagaaaggtggcctaccagcacgtgcccgtgcccggcagccccggcgagagctacctggtgctggccctggaggtggccctgctgggcctgggccagcagagagccctgcccgagggcctgtacgcccaggacaaggtggtgagaaacgaggagcagctgctggccctgctggaggaggtggagctggacgagagactggtgcaggtgctgagaaagcaggccggcctgctgctggagggcggccccttcagcggcttcggcgaggtgctgttcagagagagcgtgcccatgcacacctgcgccagatacctgttcaccgccctgctgccccacgaccccgacctggcctacagactggccctgagagccatgagactgcccatcctggagaccgccttccccgccggcgagccccaccccagccccctggacagcatcatgagcaacagattccccagatggttcatcctgggccacctggagaccagacagtgcgagctggccagcaccatgctgaccgccgccaagggcgaccccaagtggctgcacaccgtgctgggcagcatccagcagaacatccacagccccgccctgctgttcaagctggcccaggacgcctgcaagaccgccacccccgtgagcgccccccccgacaccaccctgctgggcatcgccctggagctgggcctgcaggtgatgagaatgaccctgaacgtgatgacctggagaagaagagagatggtgagatggctggtgagctgcgccaccgagatcggcccccaggccctgatgaacatcatgcagaactggtacagcctgttcacccccgtggaggccgccaccatcgtggccgtgaccggcaccacccacgccaccctgctgagactgcagctggacaccagcagaagagaggagctgtgggcctgcgccagaaccctggccctgcagtgcgccatgaaggacccccagaactgcgccctgcccgccctgaccctgtgcgagaagaaccacagcgccttcgaggccgcctaccagatcgtgctggacgccgccgccggcggcctgggccacgcccacctgttcaccgtggccagatacatggagcacagaggcctgcccctgagagcctacaagctggccaccctggccctggcccagctgagcatcgccttcaaccaggacagccaccccgccgtgaacgacgtgctgtgggcctgcagcctgagccacagcctgggcagacacgagctgagcgccatcgtgcccctgatcatcagaagcatccactgcgcccccatgctgagcgacatcctgagaagatggaccctgagcgcccccggcctgggccccctgggcgccagaagagccgccaagcccctgggcgccgacagagcccccctgtgccagctgctggacgccgccgtgaccgcctacatcaccaccagccacagcagactgacccacatcagccccagacactacggcgacttcatcgagttcctgggcaaggccagagagaccttcctgctggcccccgacggccacctgcagttcagccagttcctggagaacctgaagcagacctacaagggcaagaagaagctgatgctgctggtgagagagagattcggctag

SEQ ID NO: 26437 - DNA, 2472 bp, Artificial Sequence
  Description of Artificial Sequence: Synthetic coding sequence
atgttcagcaaggtgagagagatgctgagaatgagagacagcaacggcgccagaatgctgatcctgatgaccgagcagttcctgcaggacaccagactggccctgtggagacagcagggcgccggcatgaccgacaagtgcagacagctgtgggacgagctgggcgccctgtgggtgtgcgtggtgctgagcccccactgcaagcccgaggagagagccggctggctgcagctgctgagcagatgggacaagctggacgtgtgccccctggaggagggcaactacagcttcgacggccccagcctgcagcccaccatggcccccgcccccggcagcgaggaggaggaggaggtggccgccaccagccccagacacaccgtgttcggcagagccctgctggccggcgagctgcactggaacgacgcctacctgcagagaatcctggccagcgacagctacggccccagcctgaccggcagcgtgggcggcgacaagcccaccttcgacccccagggcagacccctgtggctgggcgagcccttccccaccgcctgcgccagagtggacaccctgagagcccacggctaccccagacaggccctgagactggccagcgccatcatcaacaccctgagactgcagcagagacaccagctggagagctacaagcagcagaagaaggagctgctgcagaagggcagcacctgcatcaccaacaccgagggctgggtgggccaccccctggaccccatcggctgcctgtgcagagccctgctggaggcctgcagactggaggaggagaccctgaccctgtaccccgacagcggccccgagaagagaaaggtggcctaccagcacgtgcccgtgcccggcagccccggcgagagctacctggtgctggccctggaggtggccctgctgggcctgggccagcagagagccctgcccgagggcctgtacgcccaggacaaggtggtgagaaacgaggagcagctgctggccctgctggaggaggtggagctggacgagagactggtgcaggtgctgagaaagcaggccggcctgctgctggagggcggccccttcagcggcttcggcgaggtgctgttcagagagagcgtgcccatgcacacctgcgccagatacctgttcaccgccctgctgccccacgaccccgacctggcctacagactggccctgagagccatgagactgcccatcctggagaccgccttccccgccggcgagccccaccccagccccctggacagcatcatgagcaacagattccccagatggttcatcctgggccacctggagaccagacagtgcgagctggccagcaccatgctgaccgccgccaagggcgaccccaagtggctgcacaccgtgctgggcagcatccagcagaacatccacagccccgccctgctgttcaagctggcccaggacgcctgcaagaccgccacccccgtgagcgccccccccgacaccaccctgctgggcatcgccctggagctgggcctgcaggtgatgagaatgaccctgaacgtgatgacctggagaagaagagagatggtgagatggctggtgagctgcgccaccgagatcggcccccaggccctgatgaacatcatgcagaactggtacagcctgttcacccccgtggaggccgccaccatcgtggccgtgaccggcaccacccacgccaccctgctgagactgcagctggacaccagcagaagagaggagctgtgggcctgcgccagaaccctggccctgcagtgcgccatgaaggacccccagaactgcgccctgcccgccctgaccctgtgcgagaagaaccacagcgccttcgaggccgcctaccagatcgtgctggacgccgccgccggcggcctgggccacgcccacctgttcaccgtggccagatacatggagcacagaggcctgcccctgagagcctacaagctggccaccctggccctggcccagctgagcatcgccttcaaccaggacagccaccccgccgtgaacgacgtgctgtgggcctgcagcctgagccacagcctgggcagacacgagctgagcgccatcgtgcccctgatcatcagaagcatccactgcgcccccatgctgagcgacatcctgagaagatggaccctgagcgcccccggcctgggccccctgggcgccagaagagccgccaagcccctgggcgccgacagagcccccctgtgccagctgctggacgccgccgtgaccgcctacatcaccaccagccacagcagactgacccacatcagccccagacactacggcgacttcatcgagttcctgggcaaggccagagagaccttcctgctggcccccgacggccacctgcagttcagccagttcctggagaacctgaagcagacctacaagggcaagaagaagctgatgctgctggtgagagagagattcggctag

SEQ ID NO: 26438 - DNA, 3558 bp, Artificial Sequence
  Description of Artificial Sequence: Synthetic coding sequence
atggccgacggcggcgagagagaggagctgctgagccccagccccgtgagccccgccaagagacagtgcagctggcccagcccccaggcccaccaccccagaggcagccccggcgccgccggcggcggcgccggcggcgtgggcagcagctgcctggtgctgggcgccagaccccacctgcagcccgacagcctgctggactgcgccgccaagaccgtggccgagaagtgggcctacgagagagtggaggagagattcgagagaatccccgagcccgtgcagagaagaatcgtgtactggagcttccccagaaacgagagagagatctgcatgtacagcagcttccagtacagaggcggccccggcgccggcgccgccggcggcgccgccggcgccagccccgccgaggagggcccccagcccccccccggcgccgccgcccccgccggcagcgcccccggcggcgtggccgccggcgccagccccggcctgggcgccggcgccggcgccgccggctgcggcggcgagggcctgcccttcagaagaggcatcagactgctggacagcggcagcgtggagaacgtgctgcaggtgggcttccacctgagcggcaccgtgaccgagctggccaccgccagcgagcccgccgtgacctacaaggtggccatcagcttcgacagatgcaagatcaccagcgtgacctgcggctgcggcaacaaggacatcttctactgcgcccacgtggtggccctgagcctgtacagaatcagaaagcccgaccaggtgaagctgagactgcccatcagcgagaccctgttccagatgaacagagaccagctgcagaagttcatccagtacctgatcaccgcccaccacaccgaggtgctgcccaccgcccagaagctggccgacgagatcctgagcagcaacagcgagatcaaccaggtgaacggcgcccccgaccccaccgccggcgccagcatcgacgacgagaactgctggcacctggacgaggagcaggtgaaggagcaggtgaagctgttcctgagccagggcggctactgcggcagcggcaagcagctgaacagcatgttcgccaaggtgagagagatgctgagaatgagagacagcaacggcgccagaatgctgaccctgatcaccgagcagttcgtggccgaccccagactgaccctgtggagacagcagggcaccaacatgaccgacaagtgcagacagctgtgggacgagctgggcgccctgtgggtgtgcatcatcctgaacccccactgcaagctggaggagaagagctgctggctgcagcagctgcagaagtggagcgacctggacgtgtgccccctggaggacggcaactacggccacgagctgcccaacatcaccaacgccctgccccagagcgccatccacagccccgacagcctgagcagacccagaagaaccgtgttcaccagagccatcgagggcagagagctgcactggcaggacagccacctgcagagaatcatcagcagcgacgtgtacaccgcccccgcctgccagagagagagcgagagactgctgttcaacagccagggccagcccctgtggctggagcacgtgcccaccgcctgcgccagagtggacgccctgagaagccacggctaccccaaggaggccctgagactgaccgtggccatcatcaacaccctgagactgcagcagcagagacagctggagatctacaagcaccagaagaaggagctgctgcagagaggcaccaccaccatcaccaacctggagggctgggtgggccaccccctggaccccatcgactgcctgttcctgaccctgaccgaggcctgcagactgaacgacgacggctacctggagatgagcgacatgaacgagagcagaccccccgtgtaccagcacgtgcccgtggccgccggcagccccaacagcagcgagagctacctgagcctggccctggaggtggccctgatgggcctgggccagcagagactgatgcccgagggcctgtacgcccaggacaaggtgtgcagaaacgaggagcagctgctgagccagctgcaggagctgcagctggacgacgagctggtgcagaccctgcagaagcagtgcatcctgctgctggagggcggccccttcagcggcctgggcgaggtgatccacagagagagcgtgcccatgcacaccttcgccaagtacctgttcagcgccctgctgccccacgaccccgacctgagctacaagctggccctgagagccatgagactgcccgtgctggagaacagcgccagcgccggcgacaccagccacccccaccacatggtgagcgtggtgcccagcagataccccagatggttcaccctgggccacctggagagccagcagtgcgagctggccagcaccatgctgaccgccgccaagggcgacaccctgagactgagaaccatcctggaggccatccagaagcacatccacagcagcagcctgatcttcaagctggcccaggacgccttcaagatcgccacccccaccgacagcagcaccgacagcaccctgctgaacgtggccctggagctgggcctgcaggtgatgagaatgaccctgagcaccctgaactggagaagaagagagatggtgagatggctggtgacctgcgccaccgaggtgggcgtgagagccctggtgagcatcctgcagagctggtacaccctgttcacccccaccgaggccaccagcatcgtggccgccaccgccgtgagccacaccaccatcctgagactgagcctggactacccccagagagaggagctggccagctgcgccagaaccctggccctgcagtgcgccatgaaggacccccagagctgcgccctgagcgccctgaccctgtgcgagaaggaccacatcgccttcgaggccgcctaccagatcgccatcgacgccgccgccggcggcatgacccacagccagctgttcaccatcgccagatacatggagctgagaggctaccccctgagagccttcaagctggccagcctggccatgagccacctgaacctggcctacaaccaggacacccaccccgccatcaacgacgtgctgtgggcctgcgccctgagccacagcctgggcaagaacgagctggccgccctgatccccctggtggtgaagagcgtgcactgcgccaccgtgctgagcgacatcctgagaagatgcaccgtgaccgcccccggcctggccggcatccccggcagaagaagcagcggcaagctgatgagcaccgacaaggcccccctgagacagctgctggacgccaccatcaacgcctacatcaacaccacccacagcagactgacccacatcagccccagacactacggcgagttcatcgagttcctgagcaaggccagagagaccttcctgctgccccaggacggccacctgcagttcgcccagttcatcgacaacctgaagcagatctacaagggcaagaagaagctgatgctgctggtgagagagagattcggctag

SEQ ID NO: 26439 - DNA, 3648 bp, Artificial Sequence
  Description of Artificial Sequence: Synthetic coding sequence
atggccgagagaggccagcagcccccccccgccaagagactgtgctgcagacccggcggcggcggcggcggcggcggcagcagcggcggcggcggcggcgccggcggcggctacagcagcgcctgcagacccggccccagagccggcggcgccgccgccgccgccgcctgcggcggcggcgccgccctgggcctgctgccccccggcaagacccagagccccgagagcctgctggacatcgccgccagaagagtggccgagaagtggcccttccagagagtggaggagagattcgagagaatccccgagcccgtgcagagaagaatcgtgtactggagcttccccagaagcgagagagagatctgcatgtacagcagcttcaacaccggcggcggcgccgccggcggccccggcgacgacagcggcggcggcggcggcgccggcggcggcggcggcggcggcagcagcagcagccccgccgccaccagcgccgccgccaccagcgccgccgccgccgccgccgccgccgccgccgccgccgccgccgccgccggcgccggcgcccccagcgtgggcgccgccggcgccgccgacggcggcgacgagaccagactgcccttcagaagaggcatcgccctgctggagagcggctgcgtggacaacgtgctgcaggtgggcttccacctgagcggcaccgtgaccgagcccgccatccagagcgagcccgagaccgtgtgcaacgtggccatcagcttcgacagatgcaagatcaccagcgtgacctgcagctgcggcaacaaggacatcttctactgcgcccacgtggtggccctgagcctgtacagaatcagaaagcccgaccaggtgaagctgcacctgcccatcagcgagaccctgttccagatgaacagagaccagctgcagaagttcgtgcagtacctgatcaccgtgcaccacaccgaggtgctgcccaccgcccagaagctggccgacgagatcctgagccagaacagcgagatcaaccaggtgcacggcgcccccgaccccaccgccggcgccagcatcgacgacgagaactgctggcacctggacgaggagcaggtgcaggagcaggtgaagctgttcctgagccagggcggctaccacggcagcggcaagcagctgaacctgctgttcgccaaggtgagagagatgctgaagatgagagacagcaacggcgccagaatgctgaccctgatcaccgagcagttcatggccgaccccagactgagcctgtggagacagcagggcaccgccatgaccgacaagtacagacagctgtgggacgagctgggcgccctgtggatgtgcatcgtgctgaacccccactgcaagctggagcagaaggccagctggctgaagcagctgaagaagtggaacagcgtggacgtgtgcccctgggaggacggcaaccacggcagcgagctgcccaacctgaccaacgccctgccccagggcgccaacgccaaccaggacagcagcaacagaccccacagaaccgtgttcaccagagccatcgaggcctgcgacctgcactggcaggacagccacctgcagcacatcatcagcagcgacctgtacaccaactactgctaccacgacgacaccgagaacagcctgttcgacagcagaggctggcccctgtggcacgagcacgtgcccaccgcctgcgccagagtggacgccctgagaagccacggctaccccagagaggccctgagactggccatcgccatcgtgaacaccctgagaagacagcagcagaagcagctggagatgttcagaacccagaagaaggagctgccccacaagaacatcaccagcatcaccaacctggagggctgggtgggccaccccctggaccccgtgggcaccctgttcagcagcctgatggaggcctgcagaatcgacgacgagaacctgagcggcttcagcgacttcaccgagaacatgggccagtgcaagagcctggagtaccagcacctgcccgcccacaagttcctggaggagggcgagagctacctgaccctggccgtggaggtggccctgatcggcctgggccagcagagaatcatgcccgacggcctgtacacccaggagaaggtgtgcagaaacgaggagcagctgatcagcaagctgcaggagatcgagctggacgacaccctggtgaagatcttcagaaagcaggccgtgttcctgctggaggccggcccctacagcggcctgggcgagatcatccacagagagagcgtgcccatgcacaccttcgccaagtacctgttcaccagcctgctgccccacgacgccgagctggcctacaagatcgccctgagagccatgagactgctggtgctggagagcaccgcccccagcggcgacctgaccagaccccaccacatcgccagcgtggtgcccaacagataccccagatggttcaccctgagccacatcgagagccagcagtgcgagctggccagcaccatgctgaccgccgccaagggcgacgtgagaagactggagaccgtgctggagagcatccagaagaacatccacagcagcagccacatcttcaagctggcccaggacgccttcaagatcgccaccctgatggacagcctgcccgacatcaccctgctgaaggtgagcctggagctgggcctgcaggtgatgagaatgaccctgagcaccctgaactggagaagaagagagatggtgagatggctggtgacctgcgccaccgaggtgggcgtgtacgccctggacagcatcatgcagacctggttcaccctgttcacccccaccgaggccaccagcatcgtggccaccaccgtgatgagcaacagcaccatcgtgagactgcacctggactgccaccagcaggagaagctggccagcagcgccagaaccctggccctgcagtgcgccatgaaggacccccagaactgcgccctgagcgccctgaccctgtgcgagaaggaccacatcgccttcgagaccgcctaccagatcgtgctggacgccgccaccaccggcatgagctacacccagctgttcaccatcgccagatacatggagcacagaggctaccccatgagagcctacaagctggccaccctggccatgacccacctgaacctgagctacaaccaggacacccaccccgccatcaacgacgtgctgtgggcctgcgccctgagccacagcctgggcaagaacgagctggccgccatcatccccctggtggtgaagagcgtgaagtgcgccaccgtgctgagcgacatcctgagaagatgcaccctgaccacccccggcatggtgggcctgcacggcagaagaaacagcggcaagctgatgagcctggacaaggcccccctgagacagctgctggacgccaccatcggcgcctacatcaacaccacccacagcagactgacccacatcagccccagacactacagcgagttcatcgagttcctgagcaaggccagagagaccttcctgatggcccacgacggccacatccagttcacccagttcatcgacaacctgaagcagatctacaagggcaagaagaagctgatgatgctggtgagagagagattcggctag

SEQ ID NO: 26440 - DNA, 8886 bp, Artificial Sequence
  Description of Artificial Sequence: Synthetic coding sequence
atgggcaacgcccccagccacagcagcgaggacgaggccgccgccgccggcggcgagggctggggcccccaccaggactgggccgccgtgagcggcaccacccccggccccggcgtggccgcccccgccctgccccccgccgccgccctgctggagcccgccagactgagagaggccgccgccgccctgctgcccacccccccctgcgagagcctggtgagcagacacagaggcgccctgttcagatggctggaggagagactgggcagaggcgaggagagcgtgaccctggagcagttcagagagctgctggaggccagaggcgccggctgcagcagcgagcagttcgaggaggccttcgcccagttcgacgccgagggcgacggcaccgtggacgccgagaacatgctggaggccctgaagaacagcagcggcgccaacctgcagggcgagctgagccacatcatcagacagctgcaggcctgcagcctggtgcccggcttcaccgacatcttcagcgagagcaaggagggcctggacatccacagcagcatgatcctgagattcctgcacagaaacagactgagcagcgccgtgatgccctaccccatgctggagcactgcaacaacatgtgcaccatgagaagcagcgtgctgaaggagagcctggaccagctggtgcagaaggagaaggagagccccggcgacctgaccagaagccccgagatggacaagctgaagagcgtggccaagtgctacgcctacatcgagaccagcagcaacagcgccgacatcgacaagatgaccaacggcgagaccagcagctactggcagagcgacggcagcgcctgcagccactggatcagactgaagatgaagcccgacgtggtgctgagacacctgagcatcgccgtggccgccaccgaccagagctacatgccccagcaggtgaccgtggccgtgggcagaaacgccagcgacctgcaggaggtgagagacgtgcacatccccagcaacgtgaccggctacgtgaccctgctggagaacgccaacgtgagccagctgtacgtgcagatcaacatcaagagatgcctgagcgacggctgcgacaccagaatccacggcctgagagccgtgggcttccagagagtgaagaagagcggcgtgagcgtgagcgacgccagcgccatctggtactggagcctgctgaccagcctggtgaccgccagcatggagaccaaccccgccttcgtgcagaccgtgctgcacaacacccagaaggccctgagacacatgccccccctgagcctgagccccggcagcaccgacttcagcaccttcctgagccccaacgtgctggaggaggtggacagcttcctgatcagaatcaccagctgctgcagcacccccgaggtggagctgaccctgctggccttcgccctggccagaggcagcgtggccaaggtgatgagcagcctgtgcaccatcaccgaccacctggacacccagtacgacgccagcagcctgatcctgagcatggccagcgtgagacagaacctgctgctgaagtacggcaagcccctgcagctgaccctgcaggcctgcgacgtgaagggcaaggaggacaagagcggccccgagaacctgctggtggagccctggaccagagacggcttcctgaccgagaccggcaagaccagagccagcaccatcttcagcaccggcaccgagagcgccttccaggtgacccagatcagaatcatggtgagaagaggcggcatcggcgcccagtgcggcctggtgttcgcctacaacagcagcagcgacaagttctgcgccgaggagcacttcaagagattcgagaagtacgacaagtggaagctgcaggagctgagacagttcgtgaagagcagaatcggctgcagcagcgacgacctgggcgaggacgaccccatcggctggttcgagctggaggaggagtgggacgaggccgacgtgaagctgcagcagtgcagagtggccaagtacctgatggtgaagttcctgtgcaccagacaggagagcgccgagagactgggcgtgcagggcctgaccatcagcggctacctgagacccgccagagccgaggccgagcagagcgtgacctgcgcccactgcagaaaggacaccgaggagagcgtgtgcggcgccaccctgctgctgagaaccctgcagttcatccagcagctggcccacgacctggtgcagcagaaggagagcggcctgaagtacaagagcttcctggacttcgccggcctggacctgcagatcttctggaacttctacagcaagctgaagcagaaccccagagaggagtgcgtgagcgcccagaccctgctgctgcagctgctgcagagctgcttcagcgtgctgcagggcgacgtgctggccgccagcgaggaggagaaggcccccatccagagccccaagggcgtggaggccgccaaggagctgtacacccacctgtgcgacgtggtggacaaggtggacggcgacagcgtgcccatggagatcctgaagcaggaggtgagaaacaccctgctgaacggcgccgccatcttcttccccaacagacagaccagaagaaaccacctgttcaccatgatgaacgtgaccgagcaggagcacaagcagagcctgcagctgaccttcagaagcctgtgcacctacttcagcgacaaggaccccggcggcctgctgctgctgcccgagaagaacgacctggccaagatgaacatcagcgaggtgctggccgtgatggacaccctggtgagcgtggccgccagagagtgcgagctgctgatgctgagcggcgcccccggcgaggtgggcagcgtgctgttcagcctgttctggagcgtgcagggcagcctgctgagctggtgctacctgcagctgaagagcaccgacagcggcgccaaggacctggccgtggacctgatcgagaagtacgtgggccagttcctggccagcatgagagccatcctggagagcctgttcagccagtacagcggcaagaccatcgtggagagactgtgcaacagcgtgttcagcatggccgccagacagctggtgatcttcctgctggacttctgcaccctggacatcccccactgcgtgctgctgagagagttcagcgtgctgaccgagctgctgaagaagctgtgcagcggccccgagggcggcctgagaaagctggacgtggagacctggcagcaggagcagcccgtggtgctgcacacctggaccaaggagagcgcccacaactacgagaacaactgccacgaggtgagcgtgttcgtgagccccggcgccacctacttcgaggtggagttcgacgacagatgcgagaccgagaagagatacgactacctggagttcaccgacgccagaggcagaaagaccagatacgacaccaaggtgggcaccgacaagtggcccaagaaggtgaccttcaaggccggccccagactgcagttcctgttccacagcgacagcagccacaacgagtggggctacaagttcaccgtgaccgcctgcggcctgcccgacgtggccgtgagctggggcctggacctgcagctgctggtgagcagactgatgggcagactggccagccagtgcatggccctgaagagcgtgagacagctgggcagcaacatggtggtgccccaggccaagatggccctggtgctgagcagccccctgtggaagcccgtgttcagacaccaggtgtgccccgagctggagctggaggccagctggcccacccacccccacagaaacagcaaggaggtgaagaacatccccgacgacccctgcagacacttcctgctggacttcgcccagagcgagcccgcccagaacttctgcggcccctacagcgagctgttcaagggcttcatccaggcctgcagaaagcaggcccccaagaccgacatcgtggccggcagcaccatcgaccaggccgtgaacgccaccttcgccgccctggtgtacagaacccccgacctgtacgagaagctgcagaagtacgtgaacagcggcggcaagatcgccctgagcgaggagttcgcccaggtgtacagcctggccgacggcatcagaatctggatgctggagatgaagcagaagagcctgatgagcctgggcaacgaggccgaggagaagcacagcagcgaggccaccgaggtgaaccccgagagcctggccaaggagtgcatcgagaagagcctgctgctgctgaagttcctgcccaccggcatcagcagcaaggagagctgcgagaagctggagaccgccgacgagaccagccacctgcagcccctgaacaagagacagagaaccagcagcgtggtggaggagcacttccaggccagcgtgagccccaccgaggccgccccccccgccaccggcgaccagagccccggcctgggcacccagcccaagctgcccagcagcagcggcctgcccgccgccgacgtgagccccgccaccgccgaggagcccctgagccccagcacccccaccagaagaccccccttcaccagaggcagactgagactgctgagcttcagaagcatggaggaggccagactggtgcccaccgtgaaggagaagtaccccgtgctgaaggacgtgatggacttcatcaaggaccagagcctgagccacagaagcgtggtgaaggtgctgagcctgagaaaggcccaggcccagagcatcctggaggtgctgaagatcacccagcactgcgccgagagcctgggccagccccactgcttccacccccccttcatcctgttcctgctggagctgctgacctgccagaaggacttcaccaactacttcggccacctggagggctgcggcgccgacctgcacaaggagatcagagacacctactaccagctggtgctgttcctggtgaaggccgtgaagggcttcagcagcctgaacgacagaagcctgctgcccgccctgagctgcgtgcagaccgccctgctgcacctgctggacatgggctgggagcccaacgacctggccttcttcgtggacatccagctgcccgacctgctgatgaagatgagccaggagaacatcagcgtgcacgacagcgtgatcagccagtggagcgaggaggacgagctggccgacgccaagcagaacagcgagtggatggacgagtgccaggacggcatgttcgaggcctggtacgagaagatcgcccaggaggaccccgagaagcagagaaagatgcacatgttcatcgccagatactgcgacctgctgaacgtggacatcagctgcgacggctgcgacgagatcgccccctggcacagatacagatgcctgcagtgcagcgacatggacctgtgcaagacctgcttcctgggcggcgtgaagcccgagggccacggcgacgaccacgagatggtgaacatggagttcacctgcgaccactgccagggcctgatcatcggcagaagaatgaactgcaacgtgtgcgacgacttcgacctgtgctacggctgctacgccgccaagaagtacagctacggccacctgcccacccacagcatcaccgcccaccccatggtgaccatcagaatcagcgacagacagagactgatccagccctacatccacaactacagctggctgctgttcgccgccctggccctgtacagcgcccacctggccagcgccgaggacgtggacggcgagaagctggacccccagaccagaagcagcgccaccaccctgagaagccagtgcatgcagctggtgggcgactgcctgatgaaggcccaccagggcaagggcctgaaggccctggccctgctgggcgtgctgcccgacggcgacagcagcctggaggaccaggccctgcccgtgaccgtgcccaccggcgccagcgaggagcagctggagaagaaggccgtgcagggcgccgagctgagcgaggccggcaacggcaagagagccgtgcacgaggagatcagacccgtggacttcaagcagagaaacaaggccgacaagggcgtgagcctgagcaaggaccccagctgccagacccagatcagcgacagccccgccgacgccagcccccccaccggcctgcccgacgccgaggacagcgaggtgagcagccagaagcccatcgaggagaaggccgtgacccccagccccgagcaggtgttcgccgagtgcagccagaagagaatcctgggcctgctggccgccatgctgccccccctgaagagcggccccaccgtgcccctgatcgacctggagcacgtgctgcccctgatgttccaggtggtgatcagcaacgccggccacctgaacgagacctaccacctgaccctgggcctgctgggccagctgatcatcagactgctgcccgccgaggtggacgccgccgtgatcaaggtgctgagcgccaagcacaacctgttcgccgccggcgacagcagcatcgtgcccgacggctggaagaccacccacctgctgttcagcctgggcgccgtgtgcctggacagcagagtgggcctggactgggcctgcagcatggccgagatcctgagaagcctgaacagcgcccccctgtggagagacgtgatcgccaccttcaccgaccactgcatcaagcagctgcccttccagctgaagcacaccaacatcttcaccctgctggtgctggtgggcttcccccaggtgctgtgcgtgggcaccagatgcgtgtacatggacaacgccaacgagccccacaacgtgatcatcctgaagcacttcaccgagaagaacagagccgtgatcgtggacgtgaagaccagaaagagaaagaccgtgaaggactaccagctggtgcagaagggcggcggccaggagtgcggcgacagcagagcccagctgagccagtacagccagcacttcgccttcatcgccagccacctgctgcagagcagcatggacagccactgccccgaggccgtggaggccacctgggtgctgagcctggccctgaagggcctgtacaagaccctgaaggcccacggcttcgaggagatcagagccaccttcctgcagaccgacctgctgaagctgctggtgaagaagtgcagcaagggcaccggcttcagcaagacctggctgctgagagacctggagatcctgagcatcatgctgtacagcagcaagaaggagatcaacgccctggccgagcacggcgacctggagctggacgagagaggcgacagagaggaggaggtggagagacccgtgagcagccccggcgaccccgagcagaagaagctggaccccctggagggcctggacgagcccaccagaatctgcttcctgatggcccacgacgccctgaacgcccccctgcacatcctgagagccatctacgagctgcagatgaagaagaccgactacttcttcctggaggtgcagaagagattcgacggcgacgagctgaccaccgacgagagaatcagaagcctggcccagagatggcagcccagcaagagcctgagactggaggagcagagcgccaaggccgtggacaccgacatgatcatcctgccctgcctgagcagacccgccagatgcgaccaggccaccgccgagagcaaccccgtgacccagaagctgatcagcagcaccgagagcgagctgcagcagagctacgccaagcagagaagaagcaagagcgccgccctgctgcacaaggagctgaactgcaagagcaagagagccgtgagagactacctgttcagagtgaacgaggccaccgccgtgctgtacgccagacacgtgctggccagcctgctggccgagtggcccagccacgtgcccgtgagcgaggacatcctggagctgagcggccccgcccacatgacctacatcctggacatgttcatgcagctggaggagaagcacgagtgggagaagatcctgcagaaggtgctgcagggctgcagagaggacatgctgggcaccatggccctggccgcctgccagttcatggaggagcccggcatggaggtgcaggtgagagagagcaagcacccctacaacaacaacaccaacttcgaggacaaggtgcacatccccggcgccatctacctgagcatcaagttcgacagccagtgcaacaccgaggagggctgcgacgagctggccatgagcagcagcagcgacttccagcaggacagacacagcttcagcggcagccagcagaagtggaaggacttcgagctgcccggcgacaccctgtactacagattcaccagcgacatgagcaacaccgagtggggctacagattcaccgtgaccgccggccacctgggcagattccagaccggcttcgagatcctgaagcagatgctgagcgaggagagagtggtgccccacctgcccctggccaagatctgggagtggctggtgggcgtggcctgcagacagaccggccaccagagactgaaggccatccacctgctgctgagaatcgtgagatgctgcggccacagcgacctgtgcgacctggccctgctgaagcccctgtggcagctgttcacccacatggagtacggcctgttcgaggacgtgacccagcccggcatcctgctgcccctgcacagagccctgaccgagctgttcttcgtgaccgagaacagagcccaggagctgggcgtgctgcaggactacctgctggccctgaccaccgacgaccacctgctgagatgcgccgcccaggccctgcagaacatcgccgccatcagcctggccatcaactaccccaacaaggccaccagactgtggaacgtggagtgctag

SEQ ID NO: 26441 - DNA, 588 bp, Artificial Sequence
  Description of Artificial Sequence: Synthetic coding sequence
atgggcgtgtggggcaagaagcacctgagactgacccacgcccccagccccaccttcagccacctgccccccagcccccaggccggcgagcccggcatcgacggcatcagcctggccgtggtgtgcgccgccttcatcagaatccaccccgccagaagacaccccgccagaaacggcagcagactggcctgcacccccacccccagacccaacgccggcctggaggtggtgagcagcgccagagtggccgccagcctgcccagcgagggcggctggaccagcggcgcccccagaagcagcggcctgagcctgcccggcagcgcctggcagcccccccccctgcccgtgctgagaaagcccgcctggcccggcagccccgccgtgaagaacgagagcaagttccccaacagaggcagcagaaacttccccagaagaagactgccccccgcccccgtgagcggcgagccccccgagagatgcaagctggccagagagatcagatggagactgtggaaggcccacgagggctggggcggcggcgccaagagacccctgggcgaccccgcctggagcggcgtgaagagatag

SEQ ID NO: 26442 - DNA, 7872 bp, Artificial Sequence
  Description of Artificial Sequence: Synthetic coding sequence
atggtgccccccgtgtggaccctgctgctgctggtgggcgccgccctgttcagaaaggagaagccccccgaccagaagctggtggtgagaagcagcagagacaactacgtgctgacccagtgcgacttcgaggacgacgccaagcccctgtgcgactggagccaggtgagcgccgacgacgaggactgggtgagagccagcggccccagccccaccggcagcaccggcgcccccggcggctaccccaacggcgagggcagctacctgcacatggagagcaacagcttccacagaggcggcgtggccagactgctgagccccgacctgtgggagcagggccccctgtgcgtgcacttcgcccaccacatgttcggcctgagctggggcgcccagctgagactgctgctgctgagcggcgaggagggcagaagacccgacgtgctgtggaagcactggaacacccagagacccagctggatgctgaccaccgtgaccgtgcccgccggcttcaccctgcccaccagactgatgttcgagggcaccagaggcagcaccgcctacctggacatcgccctggacgccctgagcatcagaagaggcagctgcaacagagtgtgcatgatgcagacctgcagcttcgacatccccaacgacctgtgcgactggacctggatccccaccgccagcggcgccaagtggacccagaagaagggcagcagcggcaagcccggcgtgggccccgacggcgacttcagcagccccggcagcggctgctacatgctgctggaccccaagaacgccagacccggccagaaggccgtgctgctgagccccgtgagcctgagcagcggctgcctgagcttcagcttccactacatcctgagaggccagagccccggcgccgccctgcacatctacgccagcgtgctgggcagcatcagaaagcacaccctgttcagcggccagcccggccccaactggcaggccgtgagcgtgaactacaccgccgtgggcagaatccagttcgccgtggtgggcgtgttcggcaagacccccgagcccgccgtggccgtggacgccaccagcatcgccccctgcggcgagggcttcccccagtgcgacttcgaggacaacgcccaccccttctgcgactgggtgcagaccagcggcgacggcggccactgggccctgggccacaagaacggccccgtgcacggcatgggccccgccggcggcttccccaacgccggcggccactacatctacctggaggccgacgagttcagccaggccggccagagcgtgagactggtgagcagacccttctgcgcccccggcgacatctgcgtggagttcgcctaccacatgtacggcctgggcgagggcaccatgctggagctgctgctgggcagccccgccggcagcccccccatccccctgtggaagagagtgggcagccagagaccctactggcagaacaccagcgtgaccgtgcccagcggccaccagcagcccatgcagctgatcttcaagggcatccagggcagcaacaccgccagcgtggtggccatgggcttcatcctgatcaaccccggcacctgccccgtgaaggtgctgcccgagctgccccccgtgagccccgtgagcagcaccggccccagcgagaccaccggcctgaccgagaaccccaccatcagcaccaagaagcccaccgtgagcatcgagaagcccagcgtgaccaccgagaagcccaccgtgcccaaggagaagcccaccatccccaccgagaagcccaccatcagcaccgagaagcccaccatccccagcgagaagcccaacatgcccagcgagaagcccaccatccccagcgagaagcccaccatcctgaccgagaagcccaccatccccagcgagaagcccaccatccccagcgagaagcccaccatcagcaccgagaagcccaccgtgcccaccgaggagcccaccacccccaccgaggagaccaccaccagcatggaggagcccgtgatccccaccgagaagcccagcatccccaccgagaagcccagcatccccaccgagaagcccaccatcagcatggaggagaccatcatcagcaccgagaagcccaccatcagccccgagaagcccaccatccccaccgagaagcccaccatccccaccgagaagagcaccatcagccccgagaagcccaccacccccaccgagaagcccaccatccccaccgagaagcccaccatcagccccgagaagcccaccacccccaccgagaagcccaccatcagccccgagaagctgaccatccccaccgagaagcccaccatccccaccgagaagcccaccatccccaccgagaagcccaccatcagcaccgaggagcccaccacccccaccgaggagaccaccatcagcaccgagaagcccagcatccccatggagaagcccaccctgcccaccgaggagaccaccaccagcgtggaggagaccaccatcagcaccgagaagctgaccatccccatggagaagcccaccatcagcaccgagaagcccaccatccccaccgagaagcccaccatcagccccgagaagctgaccatccccaccgagaagctgaccatccccaccgagaagcccaccatccccatcgaggagaccaccatcagcaccgagaagctgaccatccccaccgagaagcccaccatcagccccgagaagcccaccatcagcaccgagaagcccaccatccccaccgagaagcccaccatccccaccgaggagaccaccatcagcaccgagaagctgaccatccccaccgagaagcccaccatcagccccgagaagctgaccatccccaccgagaagcccaccatcagcaccgagaagcccaccatccccaccgagaagctgaccatccccaccgagaagcccaccatccccaccgagaagcccaccatccccaccgagaagctgaccgccctgagacccccccaccccagccccaccgccaccggcctggccgccctggtgatgagcccccacgcccccagcacccccatgaccagcgtgatcctgggcaccaccaccaccagcagaagcagcaccgagagatgcccccccaacgccagatacgagagctgcgcctgccccgccagctgcaagagccccagacccagctgcggccccctgtgcagagagggctgcgtgtgcaaccccggcttcctgttcagcgacaaccactgcatccaggccagcagctgcaactgcttctacaacaacgactactacgagcccggcgccgagtggttcagccccaactgcaccgagcactgcagatgctggcccggcagcagagtggagtgccagatcagccagtgcggcacccacaccgtgtgccagctgaagaacggccagtacggctgccacccctacgccggcaccgccacctgcctggtgtacggcgacccccactacgtgaccttcgacggcagacacttcggcttcatgggcaagtgcacctacatcctggcccagccctgcggcaacagcaccgaccccttcttcagagtgaccgccaagaacgaggagcagggccaggagggcgtgagctgcctgagcaaggtgtacgtgaccctgcccgagagcaccgtgaccctgctgaagggcagaagaaccctggtgggcggccagcaggtgaccctgcccgccatccccagcaagggcgtgttcctgggcgccagcggcagattcgtggagctgcagaccgagttcggcctgagagtgagatgggacggcgaccagcagctgtacgtgaccgtgagcagcacctacagcggcaagctgtgcggcctgtgcggcaactacgacggcaacagcgacaacgaccacctgaagctggacggcagccccgccggcgacaaggaggagctgggcaacagctggcagaccgaccaggacgaggaccaggagtgccagaagtaccaggtggtgaacagccccagctgcgacagcagcctgcagagcagcatgagcggccccggcttctgcggcagactggtggacacccacggccccttcgagacctgcctgctgcacgtgaaggccgccagcttcttcgacagctgcatgctggacatgtgcggcttccagggcctgcagcacctgctgtgcacccacatgagcaccatgaccaccacctgccaggacgccggccacgccgtgaagccctggagagagccccacttctgccccatggcctgcccccccaacagcaagtacagcctgtgcgccaagccctgccccgacacctgccacagcggcttcagcggcatgttctgcagcgacagatgcgtggaggcctgcgagtgcaaccccggcttcgtgctgagcggcctggagtgcatccccagaagccagtgcggctgcctgcaccccgccggcagctacttcaaggtgggcgagagatggtacaagcccggctgcaaggagctgtgcgtgtgcgagagcaacaacagaatcagatgccagccctggagatgcagagcccaggagttctgcggccagcaggacggcatctacggctgccacgcccagggcgccgccacctgcaccgccagcggcgacccccactacctgaccttcgacggcgccctgcaccacttcatgggcacctgcacctacgtgctgaccagaccctgctggagcagaagccaggacagctacttcgtggtgagcgccaccaacgagaacagaggcggcatcctggaggtgagctacatcaaggccgtgcacgtgaccgtgttcgacctgagcatcagcctgctgagaggctgcaaggtgatgctgaacggccacagagtggccctgcccgtgtggctggcccagggcagagtgaccatcagactgagcagcaacctggtgctgctgtacaccaacttcggcctgcaggtgagatacgacggcagccacctggtggaggtgaccgtgcccagcagctacggcggccagctgtgcggcctgtgcggcaactacaacaacaacagcctggacgacaacctgagacccgacagaaagctggccggcgacagcatgcagctgggcgccgcctggaagctgcccgagagcagcgagcccggctgcttcctggtgggcggcaagcccagcagctgccaggagaacagcatggccgacgcctggaacaagaactgcgccatcctgatcaacccccagggccccttcagccagtgccaccaggtggtgcccccccagagcagcttcgccagctgcgtgcacggccagtgcggcaccaagggcgacaccaccgccctgtgcagaagcctgcaggcctacgccagcctgtgcgcccaggccggccaggcccccgcctggagaaacagaaccttctgccccatgagatgcccccccggcagcagctacagcccctgcagcagcccctgccccgacacctgcagcagcatcaacaaccccagagactgccccaaggccctgccctgcgccgagagctgcgagtgccagaagggccacatcctgagcggcaccagctgcgtgcccctgggccagtgcggctgcaccgaccccgccggcagctaccaccccgtgggcgagagatggtacaccgagaacacctgcaccagactgtgcacctgcagcgtgcacaacaacatcacctgcttccagagcacctgcaagcccaaccagatctgctgggccctggacggcctgctgagaagagccagcggcgtgggcgtgtgccagctgcccggcgagagccactacgtgagcttcgacggcagcaaccacagcatccccgacgcctgcaccctggtgctggtgaaggtgtgccaccccgccatggccctgcccttcttcaagatcagcgccaagcacgagaaggaggagggcggcaccgaggccttcagactgcacgaggtgtacatcgacatctacgacgcccaggtgaccctgcagaagggccacagagtgctgatcaacagcaagcaggtgaccctgcccgccatcagccagatccccggcgtgagcgtgaagagcagcagcatctacagcatcgtgaacatcaagatcggcgtgcaggtgaagttcgacggcaaccacctgctggagatcgagatccccaccacctactacggcaaggtgtgcggcatgtgcggcaacttcaacgacgaggaggaggacgagctgatgatgcccagcgacgaggtggccaacagcgacagcgagttcgtgaacagctggaaggacaaggacatcgaccccagctgccagagcctgctggtggacgagcagcagatccccgccgagcagcaggagaaccccagcggcaactgcagagccgccgacctgagaagagccagagagaagtgcgaggccgccctgagagcccccgtgtgggcccagtgcgccagcagaatcgacctgacccccttcctggtggactgcgccaacaccctgtgcgagttcggcggcctgtaccaggccctgtgccaggccctgcaggccttcggcgccacctgccagagccagggcctgaagccccccctgtggagaaacagcagcttctgccccctggagtgccccgcctacagcagctacaccaactgcctgcccagctgcagccccagctgctgggacctggacggcagatgcgagggcgccaaggtgcccagcgcctgcgccgagggctgcatctgccagcccggctacgtgctgagcgaggacaagtgcgtgcccagaagccagtgcggctgcaaggacgcccacggcggcagcatccccctgggcaagagctgggtgagcagcggctgcaccgagaagtgcgtgtgcaccggcggcgccatccagtgcggcgacttcagatgccccagcggcagccactgccagctgaccagcgacaacagcaacagcaactgcgtgagcgacaagagcgagcagtgcagcgtgtacggcgaccccagatacctgaccttcgacggcttcagctacagactgcagggcagaatgacctacgtgctgatcaagaccgtggacgtgctgcccgagggcgtggagcccctgctggtggagggcagaaacaagatggacccccccagaagcagcatcttcctgcaggaggtgatcaccaccgtgtacggctacaaggtgcagctgcaggccggcctggagctggtggtgaacaaccagaagatggccgtgccctacagacccaacgagcacctgagagtgaccctgtggggccagagactgtacctggtgaccgacttcgagctggtggtgagcttcggcggcagaaagaacgccgtgatcagcctgcccagcatgtacgagggcctggtgagcggcctgtgcggcaactacgacaagaacagaaagaacgacatgatgctgcccagcggcgccctgacccagaacctgaacaccttcggcaacagctgggaggtgaagaccgaggacgccctgctgagattccccagagccatccccgccgaggaggagggccagggcgccgagctgggcctgagaaccggcctgcaggtgagcgagtgcagccccgagcagctggccagcaacagcacccaggcctgcagagtgctggccgacccccagggccccttcgccgcctgccaccagaccgtggcccccgagcccttccaggagcactgcgtgctggacctgtgcagcgcccaggaccccagagagcaggaggagctgagatgccaggtgctgagcggctacgccatcctgtgccaggaggccggcgccgccctggccggctggagagacagaaccctgtgcgccggccagcagctgagcgactag

SEQ ID NO: 26443 - DNA, 8067 bp, Artificial Sequence
  Description of Artificial Sequence: Synthetic coding sequence
atggtgccccccgtgtggaccctgctgctgctggtgggcgccgccctgttcagaaaggagaagccccccgaccagaagctggtggtgagaagcagcagagacaactacgtgctgacccagtgcgacttcgaggacgacgccaagcccctgtgcgactggagccaggtgagcgccgacgacgaggactgggtgagagccagcggccccagccccaccggcagcaccggcgcccccggcggctaccccaacggcgagggcagctacctgcacatggagagcaacagcttccacagaggcggcgtggccagactgctgagccccgacctgtgggagcagggccccctgtgcgtgcacttcgcccaccacatgttcggcctgagctggggcgcccagctgagactgctgctgctgagcggcgaggagggcagaagacccgacgtgctgtggaagcactggaacacccagagacccagctggatgctgaccaccgtgaccgtgcccgccggcttcaccctgcccaccagactgatgttcgagggcaccagaggcagcaccgcctacctggacatcgccctggacgccctgagcatcagaagaggcagctgcaacagagtgtgcatgatgcagacctgcagcttcgacatccccaacgacctgtgcgactggacctggatccccaccgccagcggcgccaagtggacccagaagaagggcagcagcggcaagcccggcgtgggccccgacggcgacttcagcagccccggcagcggctgctacatgctgctggaccccaagaacgccagacccggccagaaggccgtgctgctgagccccgtgagcctgagcagcggctgcctgagcttcagcttccactacatcctgagaggccagagccccggcgccgccctgcacatctacgccagcgtgctgggcagcatcagaaagcacaccctgttcagcggccagcccggccccaactggcaggccgtgagcgtgaactacaccgccgtgggcagaatccagttcgccgtggtgggcgtgttcggcaagacccccgagcccgccgtggccgtggacgccaccagcatcgccccctgcggcgagggcttcccccagtgcgacttcgaggacaacgcccaccccttctgcgactgggtgcagaccagcggcgacggcggccactgggccctgggccacaagaacggccccgtgcacggcatgggccccgccggcggcttccccaacgccggcggccactacatctacctggaggccgacgagttcagccaggccggccagagcgtgagactggtgagcagacccttctgcgcccccggcgacatctgcgtggagttcgcctaccacatgtacggcctgggcgagggcaccatgctggagctgctgctgggcagccccgccggcagcccccccatccccctgtggaagagagtgggcagccagagaccctactggcagaacaccagcgtgaccgtgcccagcggccaccagcagcccatgcagctgatcttcaagggcatccagggcagcaacaccgccagcgtggtggccatgggcttcatcctgatcaaccccggcacctgccccgtgaaggtgctgcccgagctgccccccgtgagccccgtgagcagcaccggccccagcgagaccaccggcctgaccgagaaccccaccatcagcaccaagaagcccaccgtgagcatcgagaagcccagcgtgaccaccgagaagcccaccgtgcccaaggagaagcccaccatccccaccgagaagcccaccatcagcaccgagaagcccaccatccccagcgagaagcccaacatgcccagcgagaagcccaccatccccagcgagaagcccaccatcctgaccgagaagcccaccatccccagcgagaagcccaccatccccagcgagaagcccaccatcagcaccgagaagcccaccgtgcccaccgaggagcccaccacccccaccgaggagaccaccaccagcatggaggagcccgtgatccccaccgagaagcccagcatccccaccgagaagcccagcatccccaccgagaagcccaccatcagcatggaggagaccatcatcagcaccgagaagcccaccatcagccccgagaagcccaccatccccaccgagaagcccaccatccccaccgagaagagcaccatcagccccgagaagcccaccacccccaccgagaagcccaccatccccaccgagaagcccaccatcagccccgagaagcccaccacccccaccgagaagcccaccatcagccccgagaagctgaccatccccaccgagaagcccaccatccccaccgagaagcccaccatccccaccgagaagcccaccatcagcaccgaggagcccaccacccccaccgaggagaccaccatcagcaccgagaagcccagcatccccatggagaagcccaccctgcccaccgaggagaccaccaccagcgtggaggagaccaccatcagcaccgagaagctgaccatccccatggagaagcccaccatcagcaccgagaagcccaccatccccaccgagaagcccaccatcagccccgagaagctgaccatccccaccgagaagctgaccatccccaccgagaagcccaccatccccatcgaggagaccaccatcagcaccgagaagctgaccatccccaccgagaagcccaccatcagccccgagaagcccaccatcagcaccgagaagcccaccatccccaccgagaagcccaccatccccaccgaggagaccaccatcagcaccgagaagctgaccatccccaccgagaagcccaccatcagccccgagaagctgaccatccccaccgagaagcccaccatcagcaccgagaagcccaccatccccaccgagaagctgaccatccccaccgagaagcccaccatccccaccgagaagcccaccatccccaccgagaagctgaccgccctgagacccccccaccccagccccaccgccaccggcctggccgccctggtgatgagcccccacgcccccagcacccccatgaccagcgtgatcctgggcaccaccaccaccagcagaagcagcaccgagagatgcccccccaacgccagatacgagagctgcgcctgccccgccagctgcaagagccccagacccagctgcggccccctgtgcagagagggctgcgtgtgcaaccccggcttcctgttcagcgacaaccactgcatccaggccagcagctgcaactgcttctacaacaacgactactacgagcccggcgccgagtggttcagccccaactgcaccgagcactgcagatgctggcccggcagcagagtggagtgccagatcagccagtgcggcacccacaccgtgtgccagctgaagaacggccagtacggctgccacccctacgccggcaccgccacctgcctggtgtacggcgacccccactacgtgaccttcgacggcagacacttcggcttcatgggcaagtgcacctacatcctggcccagccctgcggcaacagcaccgaccccttcttcagagtgaccgccaagaacgaggagcagggccaggagggcgtgagctgcctgagcaaggtgtacgtgaccctgcccgagagcaccgtgaccctgctgaagggcagaagaaccctggtgggcggccagcaggtgaccctgcccgccatccccagcaagggcgtgttcctgggcgccagcggcagattcgtggagctgcagaccgagttcggcctgagagtgagatgggacggcgaccagcagctgtacgtgaccgtgagcagcacctacagcggcaagctgtgcggcctgtgcggcaactacgacggcaacagcgacaacgaccacctgaagctggacggcagccccgccggcgacaaggaggagctgggcaacagctggcagaccgaccaggacgaggaccaggagtgccagaagtaccaggtggtgaacagccccagctgcgacagcagcctgcagagcagcatgagcggccccggcttctgcggcagactggtggacacccacggccccttcgagacctgcctgctgcacgtgaaggccgccagcttcttcgacagctgcatgctggacatgtgcggcttccagggcctgcagcacctgctgtgcacccacatgagcaccatgaccaccacctgccaggacgccggccacgccgtgaagccctggagagagccccacttctgccccatggcctgcccccccaacagcaagtacagcctgtgcgccaagccctgccccgacacctgccacagcggcttcagcggcatgttctgcagcgacagatgcgtggaggcctgcgagtgcaaccccggcttcgtgctgagcggcctggagtgcatccccagaagccagtgcggctgcctgcaccccgccggcagctacttcaaggtgggcgagagatggtacaagcccggctgcaaggagctgtgcgtgtgcgagagcaacaacagaatcagatgccagccctggagatgcagagcccaggagttctgcggccagcaggacggcatctacggctgccacgcccagggcgccgccacctgcaccgccagcggcgacccccactacctgaccttcgacggcgccctgcaccacttcatgggcacctgcacctacgtgctgaccagaccctgctggagcagaagccaggacagctacttcgtggtgagcgccaccaacgagaacagaggcggcatcctggaggtgagctacatcaaggccgtgcacgtgaccgtgttcgacctgagcatcagcctgctgagaggctgcaaggtgatgctgaacggccacagagtggccctgcccgtgtggctggcccagggcagagtgaccatcagactgagcagcaacctggtgctgctgtacaccaacttcggcctgcaggtgagatacgacggcagccacctggtggaggtgaccgtgcccagcagctacggcggccagctgtgcggcctgtgcggcaactacaacaacaacagcctggacgacaacctgagacccgacagaaagctggccggcgacagcatgcagctgggcgccgcctggaagctgcccgagagcagcgagcccggctgcttcctggtgggcggcaagcccagcagctgccaggagaacagcatggccgacgcctggaacaagaactgcgccatcctgatcaacccccagggccccttcagccagtgccaccaggtggtgcccccccagagcagcttcgccagctgcgtgcacggccagtgcggcaccaagggcgacaccaccgccctgtgcagaagcctgcaggcctacgccagcctgtgcgcccaggccggccaggcccccgcctggagaaacagaaccttctgccccatgagatgcccccccggcagcagctacagcccctgcagcagcccctgccccgacacctgcagcagcatcaacaaccccagagactgccccaaggccctgccctgcgccgagagctgcgagtgccagaagggccacatcctgagcggcaccagctgcgtgcccctgggccagtgcggctgcaccgaccccgccggcagctaccaccccgtgggcgagagatggtacaccgagaacacctgcaccagactgtgcacctgcagcgtgcacaacaacatcacctgcttccagagcacctgcaagcccaaccagatctgctgggccctggacggcctgctgagaagagccagcggcgtgggcgtgtgccagctgcccggcgagagccactacgtgagcttcgacggcagcaaccacagcatccccgacgcctgcaccctggtgctggtgaaggtgtgccaccccgccatggccctgcccttcttcaagatcagcgccaagcacgagaaggaggagggcggcaccgaggccttcagactgcacgaggtgtacatcgacatctacgacgcccaggtgaccctgcagaagggccacagagtgctgatcaacagcaagcaggtgaccctgcccgccatcagccagatccccggcgtgagcgtgaagagcagcagcatctacagcatcgtgaacatcaagatcggcgtgcaggtgaagttcgacggcaaccacctgctggagatcgagatccccaccacctactacggcaaggtgtgcggcatgtgcggcaacttcaacgacgaggaggaggacgagctgatgatgcccagcgacgaggtggccaacagcgacagcgagttcgtgaacagctggaaggacaaggacatcgaccccagctgccagagcctgctggtggacgagcagcagatccccgccgagcagcaggagaaccccagcggcaactgcagagccgccgacctgagaagagccagagagaagtgcgaggccgccctgagagcccccgtgtgggcccagtgcgccagcagaatcgacctgacccccttcctggtggactgcgccaacaccctgtgcgagttcggcggcctgtaccaggccctgtgccaggccctgcaggccttcggcgccacctgccagagccagggcctgaagccccccctgtggagaaacagcagcttctgccccctggagtgccccgcctacagcagctacaccaactgcctgcccagctgcagccccagctgctgggacctggacggcagatgcgagggcgccaaggtgcccagcgcctgcgccgagggctgcatctgccagcccggctacgtgctgagcgaggacaagtgcgtgcccagaagccagtgcggctgcaaggacgcccacggcggcagcatccccctgggcaagagctgggtgagcagcggctgcaccgagaagtgcgtgtgcaccggcggcgccatccagtgcggcgacttcagatgccccagcggcagccactgccagctgaccagcgacaacagcaacagcaactgcgtgagcgacaagagcgagcagtgcagcgtgtacggcgaccccagatacctgaccttcgacggcttcagctacagactgcagggcagaatgacctacgtgctgatcaagaccgtggacgtgctgcccgagggcgtggagcccctgctggtggagggcagaaacaagatggacccccccagaagcagcatcttcctgcaggaggtgatcaccaccgtgtacggctacaaggtgcagctgcaggccggcctggagctggtggtgaacaaccagaagatggccgtgccctacagacccaacgagcacctgagagtgaccctgtggggccagagactgtacctggtgaccgacttcgagctggtggtgagcttcggcggcagaaagaacgccgtgatcagcctgcccagcatgtacgagggcctggtgagcggcctgtgcggcaactacgacaagaacagaaagaacgacatgatgctgcccagcggcgccctgacccagaacctgaacaccttcggcaacagctgggaggtgaagaccgaggacgccctgctgagattccccagagccatccccgccgaggaggagggccagggcgccgagctgggcctgagaaccggcctgcaggtgagcgagtgcagccccgagcagctggccagcaacagcacccaggcctgcagagtgctggccgacccccagggccccttcgccgcctgccaccagaccgtggcccccgagcccttccaggagcactgcgtgctggacctgtgcagcgcccaggaccccagagagcaggaggagctgagatgccaggtgctgagcggctacgccatcctgtgccaggaggccggcgccgccctggccggctggagagacagaaccctgtgcgccatggagtgccccgccggcaccatctaccagagctgcatgaccccctgccccgccagctgcgccaacctggccgaccccggcgactgcgagggcccctgcgtggagggctgcgccagcatccccggctacgcctacagcggcacccagagcctgccctggctgaccgtggccgcccccgccatggccagcaccaccagctgggccgccgccttctag

SEQ ID NO: 26444 - DNA, 3555 bp, Artificial Sequence
  Description of Artificial Sequence: Synthetic coding sequence
atggcctgcccccccaacagcaagtacagcctgtgcgccaagccctgccccgacacctgccacagcggcttcagcggcatgttctgcagcgacagatgcgtggaggcctgcgagtgcaaccccggcttcgtgctgagcggcctggagtgcatccccagaagccagtgcggctgcctgcaccccgccggcagctacttcaaggtgggcgagagatggtacaagcccggctgcaaggagctgtgcgtgtgcgagagcaacaacagaatcagatgccagccctggagatgcagagcccaggagttctgcggccagcaggacggcatctacggctgccacgcccagggcgccgccacctgcaccgccagcggcgacccccactacctgaccttcgacggcgccctgcaccacttcatgggcacctgcacctacgtgctgaccagaccctgctggagcagaagccaggacagctacttcgtggtgagcgccaccaacgagaacagaggcggcatcctggaggtgagctacatcaaggccgtgcacgtgaccgtgttcgacctgagcatcagcctgctgagaggctgcaaggtgatgctgaacggccacagagtggccctgcccgtgtggctggcccagggcagagtgaccatcagactgagcagcaacctggtgctgctgtacaccaacttcggcctgcaggtgagatacgacggcagccacctggtggaggtgaccgtgcccagcagctacggcggccagctgtgcggcctgtgcggcaactacaacaacaacagcctggacgacaacctgagacccgacagaaagctggccggcgacagcatgcagctgggcgccgcctggaagctgcccgagagcagcgagcccggctgcttcctggtgggcggcaagcccagcagctgccaggagaacagcatggccgacgcctggaacaagaactgcgccatcctgatcaacccccagggccccttcagccagtgccaccaggtggtgcccccccagagcagcttcgccagctgcgtgcacggccagtgcggcaccaagggcgacaccaccgccctgtgcagaagcctgcaggcctacgccagcctgtgcgcccaggccggccaggcccccgcctggagaaacagaaccttctgccccatgagatgcccccccggcagcagctacagcccctgcagcagcccctgccccgacacctgcagcagcatcaacaacatcacctgcttccagagcacctgcaagcccaaccagatctgctgggccctggacggcctgctgagaagagccagcggcgtgggcgtgtgccagctgcccggcgagagccactacgtgagcttcgacggcagcaaccacagcatccccgacgcctgcaccctggtgctggtgaaggtgtgccaccccgccatggccctgcccttcttcaagatcagcgccaagcacgagaaggaggagggcggcaccgaggccttcagactgcacgaggtgtacatcgacatctacgacgcccaggtgaccctgcagaagggccacagagtgctgatcaacagcaagcaggtgaccctgcccgccatcagccagatccccggcgtgagcgtgaagagcagcagcatctacagcatcgtgaacatcaagatcggcgtgcaggtgaagttcgacggcaaccacctgctggagatcgagatccccaccacctactacggcaaggtgtgcggcatgtgcggcaacttcaacgacgaggaggaggacgagctgatgatgcccagcgacgaggtggccaacagcgacagcgagttcgtgaacagctggaaggacaaggacatcgaccccagctgccagagcctgctggtggacgagcagcagatccccgccgagcagcaggagaaccccagcggcaactgcagagccgccgacctgagaagagccagagagaagtgcgaggccgccctgagagcccccgtgtgggcccagtgcgccagcagaatcgacctgacccccttcctggtggactgcgccaacaccctgagcctggagtgccccgcctacagcagctacaccaactgcctgcccagctgcagccccagctgctgggacctggacggcagatgcgagggcgccaaggtgcccagcgcctgcgccgagggctgcatctgccagcccggctacgtgctgagcgaggacaagtgcgtgcccagaagccagtgcggctgcaaggacgcccacggcggcagcatccccctgggcaagagctgggtgagcagcggctgcaccgagaagtgcgtgtgcaccggcggcgccatccagtgcggcgacttcagatgccccagcggcagccactgccagctgaccagcgacaacagcaacagcaactgcgtgagcgacaagagcgagcagtgcagcgtgtacggcgaccccagatacctgaccttcgacggcttcagctacagactgcagggcagaatgacctacgtgctgatcaagaccgtggacgtgctgcccgagggcgtggagcccctgctggtggagggcagaaacaagatggacccccccagaagcagcatcttcctgcaggaggtgatcaccaccgtgtacggctacaaggtgcagctgcaggccggcctggagctggtggtgaacaaccagaagatggccgtgccctacagacccaacgagcacctgagagtgaccctgtggggccagagactgtacctggtgaccgacttcgagctggtggtgagcttcggcggcagaaagaacgccggcctgtaccagagaagaagaagagacaagggcagaagctgggccagcgccagagccagcaagtgccccaacgtggccagaagcagctggagagccaccgcccccagacccgtgggctgctggcagacccccagagcccccctgctgcccgtgaccagaagatggccccagagccccagcaagagcaccgcctgctggatctgcgccctgctgagaacccaggagagcaagagaagctgcgtggccagaagcagcgtgggcacccccagcagcgccagaagaagagccctgccctggctggccggcggcaccgcccccagcgccctgggcagcagcttcctgaccgaggactgcagccagagatgcacctgcgccagcagcagaatcctgctgtgcgagcccttcagctgcagagccggcgaggtgtgcaccctgggcaaccacacccagggctgcttccccgagagcccctgcctgcagaacccctgccagaacgacggccagtgcagagagcagggcgccaccttcacctgcgagtgcgaggtgggctacggcggcggcctgtgcatggagcccagagacgcccccccccccagaaagcccgaggccagcaacctggtgggcgtgctgctgggcctgctggtgcccgtggtggtggtgctgctggccgtgaccagagagtgcatctacagaaccagaagaaagagagagaagacccaggagggcgacagactggccagactggtggacaccgacaccgtgctggactgcgcctgctag

SEQ ID NO: 26445 - DNA, 8163 bp, Artificial Sequence
  Description of Artificial Sequence: Synthetic coding sequence
atggtgccccccgtgtggaccctgctgctgctggtgggcgccgccctgttcagaaaggagaagccccccgaccagaagctggtggtgagaagcagcagagacaactacgtgctgacccagtgcgacttcgaggacgacgccaagcccctgtgcgactggagccaggtgagcgccgacgacgaggactgggtgagagccagcggccccagccccaccggcagcaccggcgcccccggcggctaccccaacggcgagggcagctacctgcacatggagagcaacagcttccacagaggcggcgtggccagactgctgagccccgacctgtgggagcagggccccctgtgcgtgcacttcgcccaccacatgttcggcctgagctggggcgcccagctgagactgctgctgctgagcggcgaggagggcagaagacccgacgtgctgtggaagcactggaacacccagagacccagctggatgctgaccaccgtgaccgtgcccgccggcttcaccctgcccaccagactgatgttcgagggcaccagaggcagcaccgcctacctggacatcgccctggacgccctgagcatcagaagaggcagctgcaacagagtgtgcatgatgcagacctgcagcttcgacatccccaacgacctgtgcgactggacctggatccccaccgccagcggcgccaagtggacccagaagaagggcagcagcggcaagcccggcgtgggccccgacggcgacttcagcagccccggcagcggctgctacatgctgctggaccccaagaacgccagacccggccagaaggccgtgctgctgagccccgtgagcctgagcagcggctgcctgagcttcagcttccactacatcctgagaggccagagccccggcgccgccctgcacatctacgccagcgtgctgggcagcatcagaaagcacaccctgttcagcggccagcccggccccaactggcaggccgtgagcgtgaactacaccgccgtgggcagaatccagttcgccgtggtgggcgtgttcggcaagacccccgagcccgccgtggccgtggacgccaccagcatcgccccctgcggcgagggcttcccccagtgcgacttcgaggacaacgcccaccccttctgcgactgggtgcagaccagcggcgacggcggccactgggccctgggccacaagaacggccccgtgcacggcatgggccccgccggcggcttccccaacgccggcggccactacatctacctggaggccgacgagttcagccaggccggccagagcgtgagactggtgagcagacccttctgcgcccccggcgacatctgcgtggagttcgcctaccacatgtacggcctgggcgagggcaccatgctggagctgctgctgggcagccccgccggcagcccccccatccccctgtggaagagagtgggcagccagagaccctactggcagaacaccagcgtgaccgtgcccagcggccaccagcagcccatgcagctgatcttcaagggcatccagggcagcaacaccgccagcgtggtggccatgggcttcatcctgatcaaccccggcacctgccccgtgaaggtgctgcccgagctgccccccgtgagccccgtgagcagcaccggccccagcgagaccaccggcctgaccgagaaccccaccatcagcaccaagaagcccaccgtgagcatcgagaagcccagcgtgaccaccgagaagcccaccgtgcccaaggagaagcccaccatccccaccgagaagcccaccatcagcaccgagaagcccaccatccccagcgagaagcccaacatgcccagcgagaagcccaccatccccagcgagaagcccaccatcctgaccgagaagcccaccatccccagcgagaagcccaccatccccagcgagaagcccaccatcagcaccgagaagcccaccgtgcccaccgaggagcccaccacccccaccgaggagaccaccaccagcatggaggagcccgtgatccccaccgagaagcccagcatccccaccgagaagcccagcatccccaccgagaagcccaccatcagcatggaggagaccatcatcagcaccgagaagcccaccatcagccccgagaagcccaccatccccaccgagaagcccaccatccccaccgagaagagcaccatcagccccgagaagcccaccacccccaccgagaagcccaccatccccaccgagaagcccaccatcagccccgagaagcccaccacccccaccgagaagcccaccatcagccccgagaagctgaccatccccaccgagaagcccaccatccccaccgagaagcccaccatccccaccgagaagcccaccatcagcaccgaggagcccaccacccccaccgaggagaccaccatcagcaccgagaagcccagcatccccatggagaagcccaccctgcccaccgaggagaccaccaccagcgtggaggagaccaccatcagcaccgagaagctgaccatccccatggagaagcccaccatcagcaccgagaagcccaccatccccaccgagaagcccaccatcagccccgagaagctgaccatccccaccgagaagctgaccatccccaccgagaagcccaccatccccatcgaggagaccaccatcagcaccgagaagctgaccatccccaccgagaagcccaccatcagccccgagaagcccaccatcagcaccgagaagcccaccatccccaccgagaagcccaccatccccaccgaggagaccaccatcagcaccgagaagctgaccatccccaccgagaagcccaccatcagccccgagaagctgaccatccccaccgagaagcccaccatcagcaccgagaagcccaccatccccaccgagaagctgaccatccccaccgagaagcccaccatccccaccgagaagcccaccatccccaccgagaagctgaccgccctgagacccccccaccccagccccaccgccaccggcctggccgccctggtgatgagcccccacgcccccagcacccccatgaccagcgtgatcctgggcaccaccaccaccagcagaagcagcaccgagagatgcccccccaacgccagatacgagagctgcgcctgccccgccagctgcaagagccccagacccagctgcggccccctgtgcagagagggctgcgtgtgcaaccccggcttcctgttcagcgacaaccactgcatccaggccagcagctgcaactgcttctacaacaacgactactacgagcccggcgccgagtggttcagccccaactgcaccgagcactgcagatgctggcccggcagcagagtggagtgccagatcagccagtgcggcacccacaccgtgtgccagctgaagaacggccagtacggctgccacccctacgccggcaccgccacctgcctggtgtacggcgacccccactacgtgaccttcgacggcagacacttcggcttcatgggcaagtgcacctacatcctggcccagccctgcggcaacagcaccgaccccttcttcagagtgaccgccaagaacgaggagcagggccaggagggcgtgagctgcctgagcaaggtgtacgtgaccctgcccgagagcaccgtgaccctgctgaagggcagaagaaccctggtgggcggccagcaggtgaccctgcccgccatccccagcaagggcgtgttcctgggcgccagcggcagattcgtggagctgcagaccgagttcggcctgagagtgagatgggacggcgaccagcagctgtacgtgaccgtgagcagcacctacagcggcaagctgtgcggcctgtgcggcaactacgacggcaacagcgacaacgaccacctgaagctggacggcagccccgccggcgacaaggaggagctgggcaacagctggcagaccgaccaggacgaggaccaggagtgccagaagtaccaggtggtgaacagccccagctgcgacagcagcctgcagagcagcatgagcggccccggcttctgcggcagactggtggacacccacggccccttcgagacctgcctgctgcacgtgaaggccgccagcttcttcgacagctgcatgctggacatgtgcggcttccagggcctgcagcacctgctgtgcacccacatgagcaccatgaccaccacctgccaggacgccggccacgccgtgaagccctggagagagccccacttctgccccatggcctgcccccccaacagcaagtacagcctgtgcgccaagccctgccccgacacctgccacagcggcttcagcggcatgttctgcagcgacagatgcgtggaggcctgcgagtgcaaccccggcttcgtgctgagcggcctggagtgcatccccagaagccagtgcggctgcctgcaccccgccggcagctacttcaaggtgggcgagagatggtacaagcccggctgcaaggagctgtgcgtgtgcgagagcaacaacagaatcagatgccagccctggagatgcagagcccaggagttctgcggccagcaggacggcatctacggctgccacgcccagggcgccgccacctgcaccgccagcggcgacccccactacctgaccttcgacggcgccctgcaccacttcatgggcacctgcacctacgtgctgaccagaccctgctggagcagaagccaggacagctacttcgtggtgagcgccaccaacgagaacagaggcggcatcctggaggtgagctacatcaaggccgtgcacgtgaccgtgttcgacctgagcatcagcctgctgagaggctgcaaggtgatgctgaacggccacagagtggccctgcccgtgtggctggcccagggcagagtgaccatcagactgagcagcaacctggtgctgctgtacaccaacttcggcctgcaggtgagatacgacggcagccacctggtggaggtgaccgtgcccagcagctacggcggccagctgtgcggcctgtgcggcaactacaacaacaacagcctggacgacaacctgagacccgacagaaagctggccggcgacagcatgcagctgggcgccgcctggaagctgcccgagagcagcgagcccggctgcttcctggtgggcggcaagcccagcagctgccaggagaacagcatggccgacgcctggaacaagaactgcgccatcctgatcaacccccagggccccttcagccagtgccaccaggtggtgcccccccagagcagcttcgccagctgcgtgcacggccagtgcggcaccaagggcgacaccaccgccctgtgcagaagcctgcaggcctacgccagcctgtgcgcccaggccggccaggcccccgcctggagaaacagaaccttctgccccatgagatgcccccccggcagcagctacagcccctgcagcagcccctgccccgacacctgcagcagcatcaacaaccccagagactgccccaaggccctgccctgcgccgagagctgcgagtgccagaagggccacatcctgagcggcaccagctgcgtgcccctgggccagtgcggctgcaccgaccccgccggcagctaccaccccgtgggcgagagatggtacaccgagaacacctgcaccagactgtgcacctgcagcgtgcacaacaacatcacctgcttccagagcacctgcaagcccaaccagatctgctgggccctggacggcctgctgagaagagccagcggcgtgggcgtgtgccagctgcccggcgagagccactacgtgagcttcgacggcagcaaccacagcatccccgacgcctgcaccctggtgctggtgaaggtgtgccaccccgccatggccctgcccttcttcaagatcagcgccaagcacgagaaggaggagggcggcaccgaggccttcagactgcacgaggtgtacatcgacatctacgacgcccaggtgaccctgcagaagggccacagagtgctgatcaacagcaagcaggtgaccctgcccgccatcagccagatccccggcgtgagcgtgaagagcagcagcatctacagcatcgtgaacatcaagatcggcgtgcaggtgaagttcgacggcaaccacctgctggagatcgagatccccaccacctactacggcaaggtgtgcggcatgtgcggcaacttcaacgacgaggaggaggacgagctgatgatgcccagcgacgaggtggccaacagcgacagcgagttcgtgaacagctggaaggacaaggacatcgaccccagctgccagagcctgctggtggacgagcagcagatccccgccgagcagcaggagaaccccagcggcaactgcagagccgccgacctgagaagagccagagagaagtgcgaggccgccctgagagcccccgtgtgggcccagtgcgccagcagaatcgacctgacccccttcctggtggactgcgccaacaccctgtgcgagttcggcggcctgtaccaggccctgtgccaggccctgcaggccttcggcgccacctgccagagccagggcctgaagccccccctgtggagaaacagcagcttctgccccctggagtgccccgcctacagcagctacaccaactgcctgcccagctgcagccccagctgctgggacctggacggcagatgcgagggcgccaaggtgcccagcgcctgcgccgagggctgcatctgccagcccggctacgtgctgagcgaggacaagtgcgtgcccagaagccagtgcggctgcaaggacgcccacggcggcagcatccccctgggcaagagctgggtgagcagcggctgcaccgagaagtgcgtgtgcaccggcggcgccatccagtgcggcgacttcagatgccccagcggcagccactgccagctgaccagcgacaacagcaacagcaactgcgtgagcgacaagagcgagcagtgcagcgtgtacggcgaccccagatacctgaccttcgacggcttcagctacagactgcagggcagaatgacctacgtgctgatcaagaccgtggacgtgctgcccgagggcgtggagcccctgctggtggagggcagaaacaagatggacccccccagaagcagcatcttcctgcaggaggtgatcaccaccgtgtacggctacaaggtgcagctgcaggccggcctggagctggtggtgaacaaccagaagatggccgtgccctacagacccaacgagcacctgagagtgaccctgtggggccagagactgtacctggtgaccgacttcgagctggtggtgagcttcggcggcagaaagaacgccgtgatcagcctgcccagcatgtacgagggcctggtgagcggcctgtgcggcaactacgacaagaacagaaagaacgacatgatgctgcccagcggcgccctgacccagaacctgaacaccttcggcaacagctgggaggtgaagaccgaggacgccctgctgagattccccagagccatccccgccgaggaggagggccagggcgccgagctgggcctgagaaccggcctgcaggtgagcgagtgcagccccgagcagctggccagcaacagcacccaggcctgcagagtgctggccgacccccagggccccttcgccgcctgccaccagaccgtggcccccgagcccttccaggagcactgcgtgctggacctgtgcagcgcccaggaccccagagagcaggaggagctgagatgccaggtgctgagcggctacgccatcctgtgccaggaggccggcgccgccctggccggctggagagacagaaccctgtgcgagagcccctgcctgcagaacccctgccagaacgacggccagtgcagagagcagggcgccaccttcacctgcgagtgcgaggtgggctacggcggcggcctgtgcatggagcccagagacgcccccccccccagaaagcccgccagcaacctggtgggcgtgctgctgggcctgctggtgcccgtggtggtggtgctgctggccgtgaccagagagtgcatctacagaaccagaagaaagagagagaagacccaggagggcgacagactggccagactggtggacaccgacaccgtgctggactgcgcctgctag

SEQ ID NO: 26446 - DNA, 2280 bp, Artificial Sequence
  Description of Artificial Sequence: Synthetic coding sequence
atggtgcacttcctgcaccccggccacacccccagaaacatcgtgccccccgacgcccagaaggacgccctgggctgctgcgtggtgcaggaggaggccagcccctacaccctggtgaacatctgcctgaacgtgctgatcgccaacctggagaagctgtgcagcgagagacccgacggcaccctgtgcctgcccgagcactggagcttcccccaggaggtggccgagagattcctgagagtgatgacctggcagggcaagctgaccgacagaaccgccagcatcttcagaggcaaccagatgaagctgaagctggtgaacatccagaaggccaagatcagcaccgccgccttcatcaaggccttctgcagacacaagctgatcgagctgaacgccaccgccgtgcacgccgacctgcccgtgcccgacatcatcagcggcctgtgcagcaacagatggatccagcagaacctgcagtgcctgctgctggacagcaccagcatcccccagaacagcagactgctgttcttcagccagctgaccggcctgagaatcctgagcgtgttcaacgtgtgcttccacaccgaggacctggccaacgtgagccagctgcccagactggagagcctggacatcagcaacaccctggtgaccgacatcagcgccctgctgacctgcaaggacagactgaagagcctgaccatgcactacctgaagtgcctggccatgaccaagagccagatcctggccgtgatcagagagctgaagtgcctgctgcacctggacatcagcgaccacagacagctgaagagcgacctggccttccacctgctgcagcagaaggacatcctgcccaacgtggtgagcctggacatcagcggcggcaactgcatcaccgacgaggccgtggagctgttcatcagactgagacccgccatgcagttcgtgggcctgctggccaccgacgccggcagcagcgacttcttcaccaccaagcagggcctgagagtggccggcggcgccagcatgagccagatcagcgaggccctgagcagatacagaaacagaagctgcttcgtgaaggaggccctgcacagactgttcaccgagaccttcagcatggaggtgaccatgcccgccatcctgaagctggtggccatcggcatgagaaaccaccccctggacctgagagtgcagttcaccgccagcgcctgcgccctgaacctgaccagacagggcctggccaagggcatgcccgtgagactgctgagcgaggtgacctgcctgctgttcaaggccctgaagaacttcccccactaccagcagctgcagaagaactgcctgctgagcctgaccaacagcagaatcctggtggacgtgcccttcgacagattcgacgccgccaagttcgtgatgagatggctgtgcaagcacgagaaccccaagatgcagaccatggccgtgagcgtgaccagcatcctggccctgcagctgagccccgagcagaccgcccagctggaggagctgttcatggccgtgaaggagctgctggccatcgtgaagcagaagaccaccgagaacctggacgacgtgaccttcctgttcaccctgaaggccctgtggaacctgaccgacggcagccccgccgcctgcaagcacttcatcgagaaccagggcctgcagatcttcatccaggtgctggagaccttcagcgagagcgccatccagagcaaggtgctgggcctgctgaacaacatcgccgaggtgagagagctgagcagcaagctggtgaccgaggacgtgctgaagcacatcaacagcctgctgtgcagcagagagatggaggtgagctacttcgccgccggcatcatcgcccacctgaccagcgacagacagctgtggatcagcagagacttccagagaagaaccctgctgcaggacctgcacgccaccatccagaactggcccagcagcagctgcaagatgaccgccctggtgacctacagaagcttcaagaccttcttccccctgctgggcaacttcagccagcccgaggtgcagctgtgggccctgtgggccatgtaccacgtgtgcagcaagaaccccagcaagtactgcaagatgctggtggaggaggagggcctgcagctgctgtgcgacatccaggagcacagcgaggccacccccaaggcccagcagatcgccgccagcatcctggacgacttcagaatgcacttcatgaactaccagagacccaccctgtgccagatgcccttctag

SEQ ID NO: 26447 - DNA, 1254 bp, Artificial Sequence
  Description of Artificial Sequence: Synthetic coding sequence
atgagccagatcagcgaggccctgagcagatacagaaacagaagctgcttcgtgaaggaggccctgcacagactgttcaccgagaccttcagcatggaggtgaccatgcccgccatcctgaagctggtggccatcggcatgagaaaccaccccctggacctgagagtgcagttcaccgccagcgcctgcgccctgaacctgaccagacagggcctggccaagggcatgcccgtgagactgctgagcgaggtgacctgcctgctgttcaaggccctgaagaacttcccccactaccagcagctgcagaagaactgcctgctgagcctgaccaacagcagaatcctggtggacgtgcccttcgacagattcgacgccgccaagttcgtgatgagatggctgtgcaagcacgagaaccccaagatgcagaccatggccgtgagcgtgaccagcatcctggccctgcagctgagccccgagcagaccgcccagctggaggagctgttcatggccgtgaaggagctgctggccatcgtgaagcagaagaccaccgagaacctggacgacgtgaccttcctgttcaccctgaaggccctgtggaacctgaccgacggcagccccgccgcctgcaagcacttcatcgagaaccagggcctgcagatcttcatccaggtgctggagaccttcagcgagagcgccatccagagcaaggtgctgggcctgctgaacaacatcgccgaggtgagagagctgagcagcaagctggtgaccgaggacgtgctgaagcacatcaacagcctgctgtgcagcagagagatggaggtgagctacttcgccgccggcatcatcgcccacctgaccagcgacagacagctgtggatcagcagagacttccagagaagaaccctgctgcaggacctgcacgccaccatccagaactggcccagcagcagctgcaagatgaccgccctggtgacctacagaagcttcaagaccttcttccccctgctgggcaacttcagccagcccgaggtgcagctgtgggccctgtgggccatgtaccacgtgtgcagcaagaaccccagcaagtactgcaagatgctggtggaggaggagggcctgcagctgctgtgcgacatccaggagcacagcgaggccacccccaaggcccagcagatcgccgccagcatcctggacgacttcagaatgcacttcatgaactaccagagacccaccctgtgccagatgcccttctag

SEQ ID NO: 26448 - DNA, 2235 bp, Artificial Sequence
  Description of Artificial Sequence: Synthetic coding sequence
atgcccgaggaccaggccggcgccgccatggaggaggccagcccctacagcctgctggacatctgcctgaacttcctgaccacccacctggagaagttctgcagcgccagacaggacggcaccctgtgcctgcaggagcccggcgtgttcccccaggaggtggccgacagactgctgagaaccatggccttccacggcctgctgaacgacggcaccgtgggcatcttcagaggcaaccagatgagactgaagagagcctgcatcagaaaggccaagatcagcgccgtggccttcagaaaggccttctgccaccacaagctggtggagctggacgccaccggcgtgaacgccgacatcaccatcaccgacatcatcagcggcctgggcagcaacaagtggatccagcagaacctgcagtgcctggtgctgaacagcctgaccctgagcctggaggacccctacgagagatgcttcagcagactgagcggcctgagagccctgagcatcaccaacgtgctgttctacaacgaggacctggccgaggtggccagcctgcccagactggagagcctggacatcagcaacaccagcatcaccgacatcaccgccctgctggcctgcaaggacagactgaagagcctgaccatgcaccacctgaagtgcctgaagatgaccaccacccagatcctggacgtggtgagagagctgaagcacctgaaccacctggacatcagcgacgacaagcagttcaccagcgacatcgccctgagactgctggagcagaaggacatcctgcccaacctggtgagcctggacgtgagcggcagaaagcacgtgaccgacaaggccgtggaggccttcatccagcagagacccagcatgcagttcgtgggcctgctggccaccgacgccggctacagcgagttcctgaccggcgagggccacctgaaggtgagcggcgaggccaacgagacccagatcgccgaggccctgaagagatacagcgagagagccttcttcgtgagagaggccctgttccacctgttcagcctgacccacgtgatggagaagaccaagcccgagatcctgaagctggtggtgaccggcatgagaaaccaccccatgaacctgcccgtgcagctggccgccagcgcctgcgtgttcaacctgaccaagcaggacctggccgccggcatgcccgtgagactgctggccgacgtgacccacctgctgctgaaggccatggagcacttccccaaccaccagcagctgcagaagaactgcctgctgagcctgtgcagcgacagaatcctgcaggacgtgcccttcaacagattcgaggccgccaagctggtgatgcagtggctgtgcaaccacgaggaccagaacatgcagagaatggccgtggccatcatcagcatcctggccgccaagctgagcaccgagcagaccgcccagctgggcaccgagctgttcatcgtgagacagctgctgcagatcgtgaagcagaagaccaaccagaacagcgtggacaccaccctgaagttcaccctgagcgccctgtggaacctgaccgacgagagccccaccacctgcagacacttcatcgagaaccagggcctggagctgttcatgagagtgctggagagcttccccaccgagagcagcatccagcagaaggtgctgggcctgctgaacaacatcgccgaggtgcaggagctgcacagcgagctgatgtggaaggacttcatcgaccacatcagcagcctgctgcacagcgtggaggtggaggtgagctacttcgccgccggcatcatcgcccacctgatcagcagaggcgagcaggcctggaccctgagcagaagccagagaaacagcctgctggacgacctgcacagcgccatcctgaagtggcccacccccgagtgcgagatggtggcctacagaagcttcaaccccttcttccccctgctgggctgcttcaccacccccggcgtgcagctgtgggccgtgtgggccatgcagcacgtgtgcagcaagaaccccagcagatactgcagcatgctgatcgaggagggcggcctgcagcacctgtacaacatcaaggaccacgagcacaccgacccccacgtgcagcagatcgccgtggccatcctggacagcctggagaagcacatcgtgagacacggcagaccccccccctgcaagaagcagccccaggccagactgaactag

SEQ ID NO: 26449 - DNA, 2025 bp, Artificial Sequence
  Description of Artificial Sequence: Synthetic coding sequence
atgcccgaggaccaggccggcgccgccatggaggaggccagcccctacagcctgctggacatctgcctgaacttcctgaccacccacctggagaagttctgcagcgccagacaggacggcaccctgtgcctgcaggagcccggcgtgttcccccaggaggtggccgacagactgctgagaaccatggccttccacggcctgctgaacgacggcaccgtgggcatcttcagaggcaaccagatgagactgaagagagcctgcatcagaaaggccaagatcagcgccgtggccttcagaaaggccttctgccaccacaagctggtggagctggacgccaccggcgtgaacgccgacatcaccatcaccgacatcatcagcggcctgggcagcaacaagtggatccagcagaacctgcagtgcctggtgctgaacagcctgaccctgagcctggaggacccctacgagagatgcttcagcagactgagcggcctgagagccctgagcatcaccaacgtgctgttctacaacgaggacctggccgaggtggccagcctgcccagactggagagcctggacatcagcaacaccagcatcaccgacatcaccgccctgctggcctgcaaggacagactgaagagcctgaccatgcaccacctgaagtgcctgaagatgaccaccacccagatcctggacgtggtgagagagctgaagcacctgaaccacctggacatcagcgacgacaagcagttcaccagcgacatcgccctgagactgctggagcagaaggacatcctgcccaacctggtgagcctggacgtgagcggcagaaagcacgtgaccgacaaggccgtggaggccttcatccagcagagacccagcatgcagttcgtgggcctgctggccaccgacgccggctacagcgagttcctgaccggcgagggccacctgaaggtgagcggcgaggccaacgagacccagatcgccgaggccctgaagagatacagcgagagagccttcttcgtgagagaggccctgttccacctgttcagcctgacccacgtgatggagaagaccaagcccgagatcctgaagctggtggtgaccggcatgagaaaccaccccatgaacctgcccgtgcagctggccgccagcgcctgcgtgttcaacctgaccaagcaggacctggccgccggcatgcccgtgagactgctggccgacgtgacccacctgctgctgaaggccatggagcacttccccaaccaccagcagctgcagaagaactgcctgctgagcctgtgcagcgacagaatcctgcaggacgtgcccttcaacagattcgaggccgccaagctggtgatgcagtggctgtgcaaccacgaggaccagaacatgcagagaatggccgtggccatcatcagcatcctggccgccaagctgagcaccgagcagaccgcccagctgggcaccgagctgttcatcgtgagaaacaacatcgccgaggtgcaggagctgcacagcgagctgatgtggaaggacttcatcgaccacatcagcagcctgctgcacagcgtggaggtggaggtgagctacttcgccgccggcatcatcgcccacctgatcagcagaggcgagcaggcctggaccctgagcagaagccagagaaacagcctgctggacgacctgcacagcgccatcctgaagtggcccacccccgagtgcgagatggtggcctacagaagcttcaaccccttcttccccctgctgggctgcttcaccacccccggcgtgcagctgtgggccgtgtgggccatgcagcacgtgtgcagcaagaaccccagcagatactgcagcatgctgatcgaggagggcggcctgcagcacctgtacaacatcaaggaccacgagcacaccgacccccacgtgcagcagatcgccgtggccatcctggacagcctggagaagcacatcgtgagacacggcagaccccccccctgcaagaagcagccccaggccagactgaactag

SEQ ID NO: 26450 - DNA, 1701 bp, Artificial Sequence
  Description of Artificial Sequence: Synthetic coding sequence
atgcccgaggaccaggccggcgccgccatggaggaggccagcccctacagcctgctggacatctgcctgaacttcctgaccacccacctggagaagttctgcagcgccagacaggacggcaccctgtgcctgcaggagcccggcgtgttcccccaggaggtggccgacagactgctgagaaccatggccttccacggcctgctgaacgacggcaccgtgggcatcttcagaggcaaccagatgagactgaagagagcctgcatcagaaaggccaagatcagcgccgtggccttcagaaaggccttctgccaccacaagctggtggagctggacgccaccggcgtgaacgccgacatcaccatcaccgacatcatcagcggcctgggcagcaacaagtggatccagcagaacctgcagtgcctggtgctgaacagcctgaccctgagcctggaggacccctacgagagatgcttcagcagactgagcggcctgagagccctgagcatcaccaacgtgctgttctacaacgaggacctggccgaggtggccagcctgcccagactggagagcctggacatcagcaacaccagcatcaccgacatcaccgccctgctggcctgcaaggacagactgaagagcctgaccatgcaccacctgaagtgcctgaagatgaccaccacccagatcctggacgtggtgagagagctgaagcacctgaaccacctggacatcagcgacgacaagcagttcaccagcgacatcgccctgagactgctggagcagaaggacatcctgcccaacctggtgagcctggacgtgagcggcagaaagcacgtgaccgacaaggccgtggaggccttcatccagcagagacccagcatgcagttcgtgggcctgctggccaccgacgccggctacagcgagttcctgaccggcgagggccacctgaaggtgagcggcgaggccaacgagacccagatcgccgaggccctgaagagatacagcgagagagccttcttcgtgagagaggccctgttccacctgttcagcctgacccacgtgatggagaagaccaagcccgagatcctgaagctggtggtgaccggcatgagaaaccaccccatgaacctgcccgtgcagctggccgccagcgcctgcgtgttcaacctgaccaagcaggacctggccgccggcatgcccgtgagactgctggccgacgtgacccacctgctgctgaaggccatggagcacttccccaaccaccagcagctgcagaagaactgcctgctgagcctgtgcagcgacagaatcctgcaggacgtgcccttcaacagattcgaggccgccaagctggtgatgcagtggctgtgcaaccacgaggaccagaacatgcagagaatggccgtggccatcatcagcatcctggccgccaagctgagcaccgagcagaccgcccagctgggcaccgagctgttcatcgtgagacagctgctgcagatcgtgaagcagaagaccaaccagaacagcgtggacaccaccctgaagttcaccctgagcgccctgtggaacctgaccgacgagagccccaccacctgcagacacttcatcgagaaccagggcctggagctgttcatgagagtgctggagagcttccccaccgagagcagcatccagcagaaggtgctgggcctgctgggctag

SEQ ID NO: 26451 - DNA, 966 bp, Artificial Sequence
  Description of Artificial Sequence: Synthetic coding sequence
atggagagattcgtgagagtgccctacggcctgtaccagggctacggcagcaccgtgcccctgggccagcccggcctgagcggccacaagcagcccgactggagacagaacatgggcccccccaccttcctggccagacccggcctgctggtgcccgccaacgcccccgactactgcatcgacccctacaagagagcccagctgaaggccatcctgagccagatgaaccccagcctgagccccagactgtgcaagcccaacaccaaggaggtgggcgtgcaggtgagccccagagtggacaaggccgtgcagtgcagcctgggccccagaaccctgagcagctgcagcccctgggacggcagagacccccaggagcccctgcccgcctgcggcgtgaccagccccgccaccggcagaagaggcctgatcagactgagaagagacggcgacgaggccgagagcaaggccctgcccggccccgccgaggccagccagccccagccccccagcagaagaagcggcgccgacagacaggaggagcccggccagctggaggagagcggcgagaaggacgccccctgcccccaggagaccaagagcaagcaggtgcccggcgacgccgccagcgagcccctgagaagacccaacttccagttcctggagcccaagtacggctacttccactgcaaggactgcaagaccagatgggagagcgcctacgtgtggtgcatcagcggcaccaacaaggtgtacttcaagcagctgtgctgcaagtgccagaagagcttcaacccctacagagtggaggccatccagtgccagacctgcagcaagagccactgcagctgcccccagaagaagagacacatcgacctgagaagaccccacagacaggagctgtgcggcagatgcaaggacaagagattcagctgcggcaacatctacagcttcaagtacgtgatgtag

SEQ ID NO: 26452 - DNA, 78 bp, Artificial Sequence
  Description of Artificial Sequence: Synthetic coding sequence
atggagagattcgtgagagtgccctacggcctgtaccagggctacggcagcaccgtgcccctgggccagcccggctag

SEQ ID NO: 26453 - DNA, 504 bp, Artificial Sequence
  Description of Artificial Sequence: Synthetic coding sequence
atgctgaccgtggccctgctggccctgctgtgcgccagcgccagcggcaacgccatccaggccagaagcagcagctacagcggcgagtacggcggcggcggcggcaagagattcagccacagcggcaaccagctggacggccccatcaccgccctgagagtgagagtgaacacctactacatcgtgggcctgcaggtgagatacggcaaggtgtggagcgactacgtgggcggcagaaacggcgacctggaggagatcttcctgcaccccggcgagagcgtgatccaggtgagcggcaagtacaagtggtacctgaagaagctgctgttcgtgaccgacaagggcagatacctgagcttcggcaaggacagcggcaccagcttcaacgccgtgcccctgcaccccaacaccgtgctgagattcatcagcggcagaagcggcagcctgatcgacgccatcggcctgcactgggacgtgtaccccagcagctgcagcagatgctag

SEQ ID NO: 26454 - DNA, 489 bp, Artificial Sequence
  Description of Artificial Sequence: Synthetic coding sequence
  Description of Combined DNA/RNA Molecule: Synthetic coding sequence
atggccgcaggccctagtggttgcctggtgccagcttttggattgaggctccttctcgccacagtcttacaggcggtgtccgctttcggagcagagttttcaagcgaggcttgtcgggagctggggttttcctctaatctgctatgctccagctgcgacttactcggacagttcaaccttctacaacttgaccccgattgcaggggatgttgtcaagaagaagcccagttcgagaccaagaaactgtacgccggagcgatcctagaggtgtgcggaugaaagttaggcaggttcccccaagtccaggcatttgttcggagtgacaagccgaaattgtttaggggtctgcagatcaaatacgtcagaggcagcgaccccgtgctgaagcttctggacgacaatggtaatattgccgaagaactgagcatcttgaagtggaataccgattccgtcgaggagttcctcagtgagaagctggagcgtatttag

SEQ ID NO: 26455 - DNA, 366 bp, Artificial Sequence
  Description of Artificial Sequence: Synthetic coding sequence
  Description of Combined DNA/RNA Molecule: Synthetic coding sequence
atggccgctggcccgagcgggtgtctcgtgccggcgttcggactgcggttactcttggccacggttctgcaggccgtatccgcattcggcgcagagttcagttccgaagcctgtcgggaactcggattttcttcaaacctgctatgttcatcttgtgacctgctcggtcagttcaatctgttacagcttgacccagactgcaggggttgctgtcaggaggaagcgcaattcgaaacaaagaagctgtatgcaggcgcgatactggaggtgtgcggaugaaaacttggtaggttccctcaagttcaagtgtgcccctggtttaggccttgcattaaggcattcgggagacagtgggaacactgttag

SEQ ID NO: 26456 - DNA, 426 bp, Artificial Sequence
  Description of Artificial Sequence: Synthetic coding sequence
atggccgcaggaccttctgggtgtcttgtccctgccttcggcctgagattactgctagccaccgttcttcaggccgtgagtgcctttggcgcagaattcagctccgaggcatgccgtgagctcggattcagttccaatcttctctgctcatcttgtgacttgctcggtcagttcaacctgctacagttggaccccgactgccgtggatgttgtcaagaggaggctcagttcgagacaaaaaaatattcaagcatcgtgtcgaaacaggaatgccaccacagtaattgtatgcaggaattgtttctcaagttcgtggacgaaaactgggaaggttctctcaagtcgaaactcctgcttggcgtgattaaccccaattgttccgaggactgtaaatcctccatgagtgtggtgcagactctctactag

SEQ ID NO: 26457 - DNA, 1707 bp, Artificial Sequence
  Description of Artificial Sequence: Synthetic coding sequence
atgtcacaccggtctgacaccctccccgtaccaagcgggcagcggcggggtagggtgccaagggatcatagcatttatactcagttgctagagatcacccttcatcttcagcaggctatgacagagcactttgtgcagctcacatctaggcaggggttgtcactagaggaacggcggcataccgaggctatctgcgagcatgaggctctcctttctagactcatctgcagaatgatcaacttgctgcagagtggcgctgcgtcgggtctggagcttcaggtccctttgccaagcgaggatagccgaggtgatgtcaggtacggacagcgtgcacagttaagtgggcagccagatccagtgccccaactgtcagattgtgaggcagcttttgtgaacagagatctgtcaattcgggggatcgacattagtgtgttctatcaatcaagcttccaggactacaatgcgtaccagaaagataaatatcacaaggacaaaaatactctaggtttcattaatttaggaacctctgaaaacaaactgtgtatggatctaatgaccgagcgcctccaggagagcgacatgaattgtatcgaggacactctgctgcagtatccagactggcgggggcagcccttcctgagagaggaagtcgcccggttcctcacatactattgccgggctcccacccggcttgatcccgagaatgttgtggtgctgaatggctgctgcagcgtgttctgtgcgctggctatggtcctctgcgatccaggcgaggcctttctggttcctgctcccttctacgggggttttgccttttcatcccgtctttacgctaaagtggagctcatcccagtgcatctcgaatctgaggtcacagtgactaacacacacccatttcagttaacagttgataagctggaggaggccttactcgaagcccggctagaagggaagaaggttcgcgggctagtgctcattaatccccagaacccactgggagacatttacagtcccgattcactgatgaagtacctcgagtttgccaaaaggtataacctgcatgtgataatcgatgaaatatacatgcttagtgtgtttgacgaaagcataacgtttcactccatcctgtccatgaagtccttgccggattctaatcgcacacacgtgatctggggtaccagtaaggacttcgggataagtggatttcggttcggcgctctgtacactcataacaaggaggtggcttcggcagtaagtgcctttggatatcttcacagcatatccggtataacacagcacaaactgtgtcagctgctccagaacactgaatggattgataaggtgtaccttccgaccaactgctaccggttacgcgaagcccataagtacattactgccgagctgaaggctctggagattccattccacaataggagcagtggattgtatgtgtggatcaaccttaagaagtacctcgacccttgcacatttgaggaagaaaggctcctgtactgtcgtttcctcgataacaagctgctcctgtcgcgcgggaaaacctacatgtgcaaggaaccaggatggttttgcctgatctttgccgatgaactgcctagactcaaattggccatgcggcggttctgtgatgttctccaagagcagaaggaggcattgatcgtgaaacagctcgaggatgccatgcgagagtag

SEQ ID NO: 26458 - DNA, 264 bp, Artificial Sequence
  Description of Artificial Sequence: Synthetic coding sequence
atggctaaacatctgaagttcatagcccggacggtcatggtccaagagggcaacgtggagtccgcttataggacactgaacagaattctcactatggatggactcattgaggacatcaaacataggaggtactacgaaaagccatgttgccggaggcagcgggagagttatgagcgttgcagaagaatctataatatggagatggcccggaagattaattttctgatgaggaagaatcgcgcagatccttggcaggggtgttag

SEQ ID NO: 26459 - DNA, 1629 bp, Artificial Sequence
  Description of Artificial Sequence: Synthetic coding sequence
atgaacggcaaacgtccagcggagcctggccccgctagagtggggaagaaagggaagaaggaagttatggctgagttctctgacgcggtcaccgaggaaactctgaaaaaacaagttgccgaggcctggtctaggagaactccctttagtcacgaggttatcgtgatggacatggacccctttttgcattgcgtgatcccgaactttatccagtcccaggatttcctcgagggcctgcagaaagaactcatgaatttggactttcacgagaagtacaatgatctgtacaaattccagcagtctgacgaccttaagaaacggcgcgagcctcacatttctacgctgcggaagattttgtttgaggacttcagaagctggctgagtgatatcagcaaaattgacctggagagtactattgacatgtcatgcgcaaagtacgagttcactgacgccctgctctgccacgatgacgagctggaaggacgaagaatcgcctttatcctgtatttagtccctccatgggatcgcagcatgggagggactcttgatctctattctatcgatgagcatttccagcctaaacaaatcgtgaaatcattgattccgtcctggaataaattagtgttctttgaagtctccccagtgagtttccatcaagtctcagaggttctgagcgaggagaagagtcggttaagcatcagtggctggttccatgggcctagtctgacccggccaccaaactattttgaacctcccattcctaggtccccccacatccctcaggatcacgagatcctgtacgactggatcaaccccacctaccttgacatggattaccaggtgcagattcaggaggagttcgaagagagcagcgagatccttttaaaggagtttctgaagcccgaaaagtttactaaagtctgtgaagcattggagcacggccatgtggagtggtcttccaggggccccccaaataagcgcttctatgagaaggccgaagaaagcaagttacccgaaattcttaaggaatgcatgaaactgtttcgcagcgaggccctattccttctcctcagtaacttcaccggccttaaactgcattttctcgccccatccgaggaagacgagatgaacgacaaaaaggaagccgaaacaactgacattaccgaggaagggactagccatagccctccagagcctgaaaataatcagatggccatttcgaacaactctcaacaatcaaatgaacagactgaccctgaacctgaggagaatgagactaaaaaagaatcttctgttcctatgtgccagggcgagctcagacactggaagaccggccattacacacttattcacgatcactccaaagctgagttcgctctggacctgatcctatactgtggctgcgaagggtgggaaccagaatatggcggatttacctcatatatagcaaagggtgaggacgaggagctgttgactgtgaacccagaatcaaactccctcgctttggtctacagggaccgagaaactctgaagtttgtgaagcacatcaaccataggtccctcgagcagaaaaaaacattccccaaccgcaccggcttctgggatttcagtttcatatactatgagtag

SEQ ID NO: 26460 - DNA, 1161 bp, Artificial Sequence
  Description of Artificial Sequence: Synthetic coding sequence
atgaatagcctgatgccttgctgcgcctttatcctgtacctcgtgccgccttgggaccgctcaatgggcggaacactcgatttatatagcatagacgagcattttcagccaaagcaaattgtgaagtcgcttattcccagttggaacaaactggtcttcttcgaggtgagtcctgtctcctttcaccaagtgtccgaagtcctctccgaggagaagtctaggctgtcaatcagtggctggtttcatggtccttcccttacaagacctcccaactatttcgaaccaccgatacctagatctccacacatcccacaggatcacgagattctgtatgactggattaatcctacctatcttgacatggactatcaggttcagattcaggaggaatttgaggagtcatccgagattctgttgaaagaattcctcaagccggaaaagtttacaaaggtgtgtgaggccctggagcatggacatgtggaatggtcttcccgcggcccgcctaataagagattctacgagaaggccgaggaaagtaaactcccagagattctgaaggagtgcatgaagctttttcgatctgaggcgctgttcttactcttgtccaattttacagggttaaagttgcacttcctggctccttccgaagaggacgagatgaatgataagaaagaagccgaaactacagacatcacggaagaaggcaccagccactcaccacccgagccagaaaacaatcaaatggccatttcaaataattctcagcaatctaatgagcagacggatcccgagccagaggagaacgaaaccaagaaagagtcaagtgttccaatgtgtcaaggcgaactcaggcattggaaaacagggcactacactctgatccacgatcactccaaagctgaattcgccctagacctcatcctgtattgcgggtgtgagggatgggagcccgagtacggaggtttcacttcgtacatcgccaagggggaggacgaagaactcttgaccgttaacccagagagcaattcgttggctctggtgtacagggacagagagacattgaaatttgtgaaacacattaatcataggtcactagagcagaaaaaaacttttccaaaccgtacgggcttttgggatttctcatttatctattacgagtag

SEQ ID NO: 26461 - DNA, 1629 bp, Artificial Sequence
  Description of Artificial Sequence: Synthetic coding sequence
atgaacggaaaacggcccgccgagccaggaccagctagagtcggaaagaagggaaaaaaggaagtgatggctgaatttagcgatgccgtgacagaagaaacattaaaaaaacaggtagctgaagcatggtcccgcaggacccctttctctcacgaggtgattgtgatggatatggatccttttctgcactgtgtcatcccaaactttattcaatcacaggactttttagaggggctgcagaaagagttaatgaatctggattttcacgagaaatacaacgacctttacaaattccagcaatccgatgacttgaaaaagcggcgggagccacatatcagcacactgagaaagatcctgtttgaagactttaggagctggttgtctgatatctccaagatcgacctcgagtccacaatagacatgtcctgtgccaaatacgaatttacggatgccctgttatgccacgacgatgaactggaaggaaggagaatcgcctttatcttgtatttggttccaccttgggaccgctccatgggtgggactctagacctttacagtattgatgaacatttccaacctaagcaaattgtcaagtcgctcatcccaagctggaacaagctagtgtttttcgaggtgtcccctgtttctttccaccaagtgtcggaggttctctctgaggagaaaagtcggctttctattagcggctggtttcacggcccaagcctgacgcgcccgccaaattactttgaaccccctatcccccggtctcctcacatcccccaggatcatgagatcctttacgattggattaatcccacgtatctggatatggattaccaggtgcagatccaggaagagtttgaagagagttctgaaattctgctgaaagagttccttaagcctgagaagttcactaaggtctgcgaagctctggaacatggccatgtggaatggagtagccgtggaccacccaacaagcggttctatgagaaagccgaagaaagcaaactgccagagatcctgaaagaatgcatgaaactttttcggtccgaagccttgtttctactcctctccaatttcaccgggctcaagttacattttctggctccatctgaagaagacgaaatgaatgataagaaagaggccgaaactaccgacattactgaggaaggcacaagtcactcaccgcctgagccagagaacaaccagatggctatttcaaacaacagccaacagtccaacgaacagaccgatccagagcccgaggaaaatgaaaccaagaaagagtcatcggtgcctatgtgtcagggggagttgcggcattggaagaccgggcattataccctgatccatgatcatagcaaagctgagtttgccttagacctgattctctactgcggctgtgaagggtgggagcccgaatatgggggcttcacatcatatatcgcgaagggggaggatgaggagctgctcacagtcaacccggaaagcaacagtctcgccttagtgtaccgggatcgggagaccttaaagtttgtgaagcacatcaatcaccgatctttagagcaaaaaaagacattccccaacagaacgggtttttgggacttttcatttatctattatgaatag

SEQ ID NO: 26462 - DNA, 1308 bp, Artificial Sequence
  Description of Artificial Sequence: Synthetic coding sequence
atgctgctcccttgggcgacaagtgcccctggcctcgcgtggggacctttagtgctgggcctcttcggtctgctcgccgcctctcagccacaagctgtgcctccctacgcaagtgagaatcagacttgccgcgatcaggaaaaagaatattatgaaccccagcatcgaatttgctgttctaggtgtcccccgggcacctatgtatccgccaaatgcagcaggattagggatactgtctgcgcaacctgtgcagagaactcctacaatgaacactggaattacttgaccatctgccaactttgcaggccgtgcgatcccgtgatgggtctggaagaaattgccccgtgcacctctaaacggaagacgcagtgccgctgtcagccaggaatgttctgtgctgcctgggctctcgagtgcacgcattgcgaactactttctgactgtcccccaggcacggaagcagaactcaaagacgaggttggtaagggaaacaaccattgcgtgccatgtaaagccggccattttcagaacacttctagtccaagcgcgcgctgccagccgcatacacggtgtgaaaatcagggcctggtggaggctgcaccaggcactgcccagtccgacactacctgcaaaaatcctcttgagcctctccccccagagatgagtgggacaatgctcatgttggctgtccttctgccattggcattcttcctgctcctcgcaacagtgttcagctgcatctggaagtctcatccatccttgtgccgcaagcttggaagcctgctcaaaaggaggccccagggcgagggcccaaacccggtagccggctcatgggaaccgcccaaggcacatccttacttccccgacctggtacaacctctcctccctatttccggagacgtctctccggtgtccacaggactccccgccgcccctgttctcgaagcaggggtcccgcaacagcagtctccactagacctgacgcgcgagccccagctggagccgggggagcagtctcaagtcgcccacgggacgaatggtatccacgtgactggtggatcgatgacaattaccggcaatatctatatctataatgggccagtgctcggaggtccacccgggcctggtgacctgcccgccacgccggaacccccataccctatcccagaggaaggagatcctgggcccccaggactgagcactccacaccaagaagacggcaaggcttggcatctggccgagactgaacattgcggagcaacccctagcaatcgcggaccgcggaatcaattcataacgcatgactag

SEQ ID NO: 26463 - DNA, 873 bp, Artificial Sequence
  Description of Artificial Sequence: Synthetic coding sequence
atggttgagctagagcaagaagtggagcgaagacaaagacttggccaggagtccgcagccaggaaggctctcatcgcaagttcataccaccccgcacggcccgaggtttacgactccctccaggatgccgccctcgcccctgaattcttggcagtgaccgagtactcagtttcaccagacgccgatctcaagggtctcctccagaggctagaaacagtaagcgaagagaagcggatttacagagtcccagtctttacagcccctttctgccaggccctccttgaagagttggagcactttgaacagagtgatatgccaaaagggaggcctaacacaatgaacaactatggagtgctgctgcatgaacttgggcttgacgaaccactgatgaccccccttcgagaacgatttcttcagcctttaatggctctgctgtaccccgactgcggtggggggaggctggattcacaccgcgccttcgttgtgaaatacgcaccaggccaggacctggaattgggctgccactatgataatgccgagctgacactcaatgtggctcttggaaaggtcttcacagggggggcactgtactttggggggttgttccaggctccaaccgccctgacagaacccttggaagttgaacacgtggtggggcagggggttctccataggggcgggcagttgcacggagctcgaccgttgggcactggcgaaaggtggaatcttgtggtgtggcttagggccagcgccgtgaggaacagtctgtgccctatgtgctgtcgggagcctgatctggtcgacgatgagggctttggcgatggatttactcgggaagagccagctaccgtcgacgtgtgcgcacttacctag

SEQ ID NO: 26464 - DNA, 1023 bp, Artificial Sequence
  Description of Artificial Sequence: Synthetic coding sequence
atgggtaacgtgccttcagctgtaaaacattgcttgagctatcagcaactcttacgggagcacttgtggatcggagacagcgtggccggagccctagatccagcacaggagacatctcagctctcagggctgccagaatttgtgaaaatagttgaggtggggccaagagatggcctccaaaatgagaaagtgatagtccccacagatattaagattgaattcatcaaccgcctgtcccagacaggtctaagtgttattgaggtgacatcattcgtcagttcccggtgggtgccccagatggcagaccatactgaggtgatgaagggcatacaccagtatccaggagttcgctaccctgtattgactcctaatttacagggattccaccacgccgtggcagccggtgcaacagagatctcagtgttcggcgcagcatcagagtcctttagcaagaaaaatataaattgctcaatcgaggaatctatgggtaaatttgaggaagtcgtgaagtcagcccggcatatgaacatcccagctcgggggtatgtatcttgcgctctgggttgtccttatgaagggtcaattaccccccagaaggtgacagaggtgagcaagcgtctgtacggcatgggctgttatgagatctcccttggggatactatcggcgtaggtactcccggatctatgaagcgcatgttagagagcgtgatgaaggaaattccacccggcgcactggccgtgcattgtcacgatacatatgggcaagcactggcaaacatcctcacagcactgcagatgggcattaacgtggtggacagcgccgtgtccgggctggggggatgtccttatgccaagggagcctccggtaacgtggctacggaggacctgatctatatgctcaacggactgggcctgaacactggagtcaatctgtacaaagtgatggaagctggagacttcatctgtaaggcggtaaataaaacaaccaattctaaggtggctcaagccagtttcaacgcctag

SEQ ID NO: 26465 - DNA, 162 bp, Artificial Sequence
  Description of Artificial Sequence: Synthetic coding sequence
atgggaaatgtaccgtccgccgtgaagcattgtttgagttaccaacaactgctgagggagcacctatggattggggacagtgtagctggagccctggaccccgctcaagagcttcaatctgtgatgttaatgctgcaccacggcccccttcggaaaccttag

SEQ ID NO: 26466 - DNA, 1113 bp, Artificial Sequence
  Description of Artificial Sequence: Synthetic coding sequence
atgggcaatgttcctagcgccgtgaaacattgcctgtcctaccaacagttgctcagggagcatttatggataggggactccgttgctggcgcactggaccctgcacaaacaagtctgttaaccaatttgcattgcttccaacctgacgtttccggattctccgtgtctctggccggaacagtcgcctgcatccactgggaaacgtcgcagctaagcggcctgccagaattcgtcaaaattgtagaagttgggcctcgggatgggttacagaatgagaaggtgatcgtacctaccgatatcaagattgaatttatcaatcgcttgtcccagaccggtctcagtgtgatcgaggtgactagtttcgtgtcaagtcggtgggtgcctcagatggctgatcataccgaagtcatgaaaggaatccaccagtacccaggagttaggtatccagttttgactccaaacctacagggcttccaccatgccgtggcagccggagccactgaaatatctgtgttcggcgccgcctcggagtctttcagcaagaaaaacattaactgttctatcgaggaatctatgggtaaatttgaggaagtggttaagagtgcacggcacatgaatatacccgctagggggtatgtcagctgtgcactggggtgcccatatgaaggctctattactccgcagaaagtgaccgaagtatcaaaaaggttgtatgggatgggctgctacgagatctcacttggtgatacaatcggagtcggaacacccggctctatgaagaggatgctcgagtccgtgatgaaggaaatcccaccgggggctttggcagtgcattgccatgatacatacggccaggctctcgccaatatcctgactgccctacagatgggcattaacgtggtcgacagtgccgtcagcgggctgggcggctgcccttacgctaagggcgcctccggcaacgttgctactgaggatctcatctatatgctcaacggcctgggtctgaacacaggcgtgaatctgtacaaagtgatggaggcaggcgactttatttgtaaggcggtgaacaagaccactaactctaaagtagctcaggcctcatttaatgcatag

SEQ ID NO: 26467 - DNA, 1116 bp, Artificial Sequence
  Description of Artificial Sequence: Synthetic coding sequence
atggccgccccagccttgagactctgtcacatagccttccacgtaccagccggccagccactggccagaaatctacagagactcttcggcttccaaccactggcatcccgggaagtggatggatggcggcaacttgcgctccggtccggcgacgctgtattccttgtgaacgagggagccggatcaggagagccgctgtatggactggatccccgccatgctgtgccttcagctactaacctctgcttcgatgtagcagacgcaggcgctgctactagagagcttgccgccctgggatgtagcgttccagtcccccccgtgcgcgtgcgagacgctcagggcgccgccacctatgcagtggttagcagtcctgccggtatcctgagtctcacactgctcgagagagccggataccgtggtccctttctgccaggctttcggccagtgagtagtgcccctgggccaggatgggtgtcccgagtagatcacctgaccctggcctgcacacctgggtcatctcctacactgctgcggtggttccacgactgcctgggcttttgccacctgcctctctccccaggtgaggatccggagttagggcttgagatgactgctgggttcggattgggcggccttaggctgaccgccttgcaggcacagcctggctccatcgtgcccaccctggtgctggctgaatcactaccgggcgctaccacacgacaggatcaagttgaacagtttcttgctagacacaaggggcctggtctacagcacgtcggactttacactcctaacatcgtcgaggctaccgaaggggtagcaaccgccggtgggcagtttctcgcaccccctggcgcttactaccaacagccgggtaaggaaagacagattagagctgcaggccatgaacctcacctgctggctcggcaaggcattttgctggatggggataagggaaagtttctgctccaggtgtttacaaagagcctgttcactgaggacacctttttcctggagctgatccaacggcagggcgctaccggattcggccagggcaacatcagagccctgtggcagtccgtgcaggaacagtctgctcgtagtcaggaggcctag

SEQ ID NO: 26468 - DNA, 1368 bp, Artificial Sequence
  Description of Artificial Sequence: Synthetic coding sequence
atggcacagcacttctcattggcggcttgcgacgtggtggggttcgatttagaccatacgctctgtcgttacaatcttcctgagagcgctcccctaatctacaacagcttcgcgcaattcctggtgaaggagaaaggctacgataaagagctgctcaatgtgacgcccgaggactgggacttttgctgcaagggcttggcgctggacttggaggacggtaattttctgaaactggcgaacaatggtacagtgctgcgtgcatctcacggcacaaaaatgatgacccccgaagtactggctgaggcatacggcaaaaaggaatggaagcacttcttgagcgacaccggcatggcctgcaggtccggtaagtattacttttatgataactatttcgacttgcctggggctttactttgcgcaagagttgtcgattacctcaccaaactgaacaatggtcaaaaaaccttcgacttttggaaggatatcgtggccgcaatccagcataactacaagatgagcgccttcaaagaaaactgcggcatttacttccccgaaataaaaagggaccctgggagataccttcactcctgtccagaatcagtgaaaaagtggcttcgccagctcaagaacgcaggaaaaatcctgctgttgatcacctccagccactccgactattgcagactgttatgcgaatacattctgggaaatgatttcaccgatctctttgacattgtcatcactaatgcacttaagccaggatttttctcgcatctgccttcgcagcggccgttccgtacgttagagaacgacgaggaacaggaagcgttgcccagcttagataagccagggtggtacagtcagggaaacgccgttcacctgtatgagctcctgaaaaagatgaccggaaagcctgaacctaaggtcgtatatttcggcgactctatgcatagtgacatcttccccgcacgacattattctaattgggaaacagtgcttattttagaggagctgcggggggatgagggaacacggtcacaaagacccgaagagagcgagcctctcgaaaagaagggcaagtatgagggtccgaaagccaagcccctgaatacctcatctaagaagtggggttcattctttatcgactcagtcctcggtttagaaaatacagaagactccttggtctatacctggagctgtaaaagaatcagcacctattcaacaattgcgataccctctatagaggccatagctgagctgcccttagactataaattcaccagattctcatcatcaaatagtaaaaccgcagggtactaccctaatccaccactggtcctgagttctgacgaaaccctgatctcgaagtag

SEQ ID NO: 26469 - DNA, 588 bp, Artificial Sequence
  Description of Artificial Sequence: Synthetic coding sequence
atggcccagcacttctcactggccgcttgcgatgtggtgggcttcgatttagaccacacactgtgtcggtacaaccttccagaatcagctccgttaatttataattcttttgcccagttcctagtgaaggagaaagggtacgacaaggaactactgaatgtgacacccgaggactgggacttctgttgcaaagggctagcattagatttggaggacggtaatttcctgaagcttgctaacaatggtaccgtccttcgggctagccacggaacaaaaatgatgacccctgaagtcttagcagaagcatacggaaagaaggagtggaagcattttctctcagacaccggaatggcctgcagaagtgggaaatattacttttatgataattacttcgacctcccaggcgccctcctctgtgcccgggtagtggactacctcacaaagctgaacaacggccagaagacatttgacttctggaaagatatcgtggcggctattcagcataactataaaatgtcagccttcaaagtgaggagacttgcaacatcactgctgcaggacataagtacatctttcattctcatttag

SEQ ID NO: 26470 - DNA, 336 bp, Artificial Sequence
  Description of Artificial Sequence: Synthetic coding sequence
taatcccatggcaccaagatgatgacccctgaagtgttagcagaggcctatggaaagaaggaatggaagcactttctttccgacactggcatggcatgtcgtagtggaaaatactacttctacgataattacttcgacctgccaggggctctcttgtgcgcacgcgtcgtggactatctcactaaactaaataatggccagaaaactttcgatttctggaaggacatagtggcggcaatccagcacaattataaaatgtcagcctttaaggggaaatattgcgaagagggtccctccaacacttgccttctctcttatgtgtgcttagtgaactag

SEQ ID NO: 26471 - DNA, 588 bp, Artificial Sequence
  Description of Artificial Sequence: Synthetic coding sequence
atggcgcaacatttttcactggctgcatgtgacgtggtgggctttgacctcgatcacaccctgtgtcgctacaacctcccagagagcgcaccattaatctataactcctttgcccagtttctggtgaaggaaaaaggttatgacaaggaactgctgaacgtgacacccgaggattgggatttctgctgtaaagggctggctctcgacttggaagatgggaattttctgaaactcgccaataatggaacagtgcttcgcgcctctcacggaactaagatgatgacccccgaggtgcttgccgaggcgtacggcaagaaggagtggaaacactttctgtccgatacaggcatggcctgcaggtcgggcaagtattatttttacgataattatttcgatctcccaggcgcactactgtgtgcacgcgttgtggactaccttactaagcttaacaatggccagaagacatttgacttttggaaggatatcgtcgctgcaatccagcataactacaagatgtctgcttttaaagtgcgacgactggctacctctttactccaagatatttctaccagcttcatccttatttag

SEQ ID NO: 26472 - DNA, 1563 bp, Artificial Sequence
  Description of Artificial Sequence: Synthetic coding sequence
atgcgagtggaaagtggatccgcacaggagaggggcatattgttagaaagtctctccacgctgctggagaaaactactgcctctcatgaaggtagagcccccggaaaccgagagcttacagacttgttgccccctgaggtgtgcagcctcctgaatcccgcagctatatacgcaaataatgaaattagtctgagggatgttgaagtatacggttttgactacgactatactctcgctcagtacgctgatgcgctgcaccctgagatattcagtacagcaagagatattctaattgagcactataagtaccctgagggaattagaaaatacgattacaacccgagttttgctataagaggcctgcattacgacatccagaaatctcttctcatgaagattgatgcctttcactatgtgcagctcggcacagcctacaggggcctccagcctgtgcccgatgaagaagtgattgagctttatggaggcacacagcatatacctctgtaccagatgtccgggttttacggaaaagggcccagtatcaagcagttcatggatatcttttccctgcccgagatggctctactctcttgcgtagtggattatttcctcggccattccctcgagttcgatcaggcccacctctacaaggacgttacagacgccatcagggatgtgcatgtcaagggcctaatgtaccagtggatagagcaagatatggaaaaatatattctcaggggtgacgagacatttgccgttctgtcccgactcgtagcacatggtaagcagcttttcctgattacaaactctccctttagtttcgtggataaaggaatgagacatatggtggggcctgattggcgccagctgttcgatgtcgtgatagtacaagctgacaaaccaagcttctttaccgaccgacggaaaccattccgcaagctcgacgagaaggggagcctgcaatgggacaggattactaggctggaaaagggtaaaatttatcgacaggggaatttattcgacttcctccgcttaacggagtggcgtggacctcgggtcctctactttggcgatcacctgtatagtgacctggctgacttgatgttgcgacacggatggcgcacaggcgcgatcatccctgaactagaacgcgaaatccgcatcattaacactgaacagtatatgcatagtctgacttggcaacaagccctgacagggttgctcgaaagaatgcagacatatcaggacgctgaatctcgccaagtactggccgcttggatgaaagagcgccaggagttgcggtgcataaccaaggccttattcaatgctcagttcggatccattttccggacctttcataacccaacatacttcagccgacggctcgttcgattttctgatctgtatatggctagcctatcatgcctgcttaattatagggttgattttacattctatccacggcgcactcctctccagcacgaggctccactctggatggaccaactctgtacggggtgcatgaagaccccttttctgggtgacatggcacacatccggtag

SEQ ID NO: 26473 - DNA, 1386 bp, Artificial Sequence
  Description of Artificial Sequence: Synthetic coding sequence
atgaggaggctggtccacgatttgctccctcccgaggtgtgttcgctgttaaatccagccgccatatacgctaataacgagatatcgctgagagacgtggaggtctacggtttcgactatgactatactctcgcacagtacgctgacgcgttgcatccagaaattttttccactgcaagagatattctgatcgaacactacaagtctctgcttatgaagatagacgcctttcattacgtgcagctcggaacagcataccggggtctgcaacccgtccccgatgaggaggtgatcgagttgtatggaggtacccagcatatacctctgtatcagatgtcaggcttctatggcaagggaccctccatcaaacagtttatggacatctttagcctgcctgagatggctctgctgtcatgtgtcgttgactattttctgggccattcactggaattcgatcaggcacacctgtataaagacgtgaccgacgcgattagggacgttcatgttaaggggctcatgtaccagtggattgagcaagatatggaaaagtacatcctgcggggggacgagacattcgccgttctgtcacgtttggttgcacacggaaagcagttatttcttattactaactctcccttctccttcgttgacaagggcatgcggcacatggttggtcctgactggcgtcaattatttgatgtcgtcatagttcaagccgataaaccaagtttttttaccgaccgtcggaaacctttccggaaactggatgaaaaaggctcattacaatgggatcgcataacacggcttgaaaagggaaaaatctaccgtcagggtaatctttttgactttttacgattaaccgagtggaggggaccccgggttctgtacttcggcgatcacctatacagtgatctggccgaccttatgttaaggcacgggtggaggaccggtgccattattcctgaactagagagggaaatcagaatcattaacacggaacagtacatgcacagcctgacctggcagcaagctctcacaggcttgctagagcgcatgcagacttatcaggacgccgagagcagacaagtgctggccgcttggatgaaagaaagacaggagcttcggtgcatcacgaaagctctcttcaacgcgcaatttgggtcaatcttccgcaccttccacaatcctacctactttagccggcgcctggtgcgattctcggacctgtacatggcaagcttgtcctgtctgttgaattacagggttgatttcacattttatccccgtcgcaccccgctccagcatgaggccccgctgtggatggatcagctgtgtactggctgcatgaagacaccttttctcggggatatggcccacatcaggtag

SEQ ID NO: 26474 - DNA, 1674 bp, Artificial Sequence
  Description of Artificial Sequence: Synthetic coding sequence
atggctggagcgggactgagggccgctgcaagacggtggctgctttgcgggggccatggtggccctcgcgctgcaagtagctccccttcttgccccgggtgcggtccacccggacctggtgctcattgccctggcgtcccccgatccgctcctgcccaggccccgacatccggcgctgatttatctgcgcacctctgggctagataccaggacatgaggcgtctcgtacatgatctgcttcctccagaggtctgttcactgctgaacccagcagctatctacgcaaataacgaaatttcactacgagacgtcgaagtgtatggcttcgactatgattatacgctcgcccaatatgctgacgctttgcatcctgaaattttctctaccgccagagatatcctgatcgagcattacaagtaccccgaaggtataaggaaatacgattacaacccaagctttgccattcgcggactgcattacgacatacagaagagcctcctaatgaagattgatgcttttcactacgtgcagttaggcactgcctatcggggtctacagcccgtgcctgacgaggaggtgatcgagctctatggaggcacacagcacatccccctgtatcagatgtctggcttttacggaaaaggaccgagtattaagcaatttatggacatcttcagcctacccgaaatggccctgctgagttgcgtagtggattactttcttggccacagccttgaatttgaccaagcacacctgtataaggatgtgacggatgctatccgcgatgtccatgtcaaagggctcatgtatcagtggatagagcaggatatggagaaatacatcctgcggggggacgaaacgttcgccgtgctctcacgactggtggcacatggcaaacagttgttcttaatcacaaactctccgttttcattcgtggacaagggcatgcgccatatggtgggcccagactggcgacaacttttcgacgtggtcattgtgcaagcggataagccatcattctttacagacaggagaaaacctttccggaagctggatgagaagggctctttacagtgggataggattacccggttggagaagggaaaaatctacagacagggaaacctcttcgacttcctccgcctgaccgaatggagaggcccaagagttctgtactttggagatcatttgtacagtgacctggctgacctcatgctcagacatggctggagaaccggtgccatcatcccagagctggagcgggaaataagaatcatcaacaccgaacagtacatgcatagcttaacatggcagcaagcactcaccggcctgttggaacgcatgcagacataccaggacgcagagtcccggcaagtgctcgccgcttggatgaaagagaggcaggagctgaggtgtatcactaaagcattgttcaatgcacagttcgggtccatatttagaacattccacaatcccacctatttttcaagacgattagtgcgcttctctgatctctacatggcctcgctgtcttgtctcctgaactatcgagtggacttcacattttacccacggaggacccctctgcaacatgaggcgccgctctggatggatcagctgtgcactgggtgtatgaaaaccccgttcctgggagacatggcccacatacggtag

SEQ ID NO: 26475 - DNA, 2538 bp, Artificial Sequence
  Description of Artificial Sequence: Synthetic coding sequence
atgtcagatgacatcgactggcttaggtctcacaggggtgtgtgcaaagtggatttgtataatccagagggacaacaggaccaggatagaaaggtaatatgcttcgttgacgtgagcactttaaatgtggaggacaaggactacaaagatgctgcctcttcaagtagcgaaggaaatctcaatctagggagcctggaggagaaggaaattatcgtcatcaaagataccgagaagaaagaccaaagcaaaacggaaggcagcgtctgtctatttaagcaggcaccttcagaccctgtgtcggttctcaactggctgctgtccgacctccaaaaatacgccctgggatttcaacacgcgctgagcccaagtacctcaacctgcaagcataaagtcggagataccgagggggagtatcaccgggcttcctccgaaaactgttattccgtatacgcagaccaggttaacatcgactacctcatgaatagacctcagaatctaaggctggaaatgacagcagcaaagaacaccaataataatcaatcccctagcgcccccccagctaagccaccaagcactcagcgcgcagtaatctcacctgacggggagtgttcaatagatgacctctcgttctacgtgaaccgcctaagtagtttggttatccagatggcacataaggagatcaaggagaaattagaggggaaatctaagtgtctacaccacagcatttgcccatcccccggcaacaaggaacgcatatctccccgtacaccggccagtaaaatcgcctccgagatggcttacgaagccgtggaactgactgctgccgaaatgagggggaccggcgaggagtccagagagggcggacaaaaaagcttcctctacagcgagcttagcaataaatccaagagcggcgacaaacagatgtctcagagagaatcaaaggaatttgcagactccatctccaaaggcctcatggtctatgccaaccaggtggcaagtgacatgatggtgtctctgatgaaaacccttaaggttcattctagtggaaagcccatccccgctagcgttgtactcaagcgcgtgcttttgcggcataccaaggagatagtgtccgatctgattgacagctgcatgaaaaaccttcataatattacaggcgtcttgatgacagactcagacttcgtttcggcagttaaaaggaacctctttaaccagtggaaacagaacgctaccgacattatggaagccatgctgaaaaggttggtctctgcgctcatcggcgaggaaaaggagaccaaatctcagtctctatcttacgcatcgcttaaagctggctcccatgatccgaaatgtagaaatcagagcctggaattctctactatgaaggccgagatgaaagagagagataaaggaaagatgaagtcggacccatgcaaatctctcactagtgctgagaaggtcggagagcatattctcaaggagggacttaccatttggaatcaaaaacagggcaattcatgtaaagtcgcaacgaaggcttgctcaaataaagacgaaaaaggcgagaagataaatgcttcaactgactccctggcaaaagatttgattgtatctgctctaaagctgatacagtaccatttgacacagcagacaaaagggaaggacacttgcgaggaggattgcccaggctcgacaatgggatacatggcccagagcacgcaatatgaaaagtgcggcgggggccagtctgccaaagccctgtctgtcaagcagctggaatcccatcgcgctccggggccctccacttgtcagaaggaaaatcagcacttagactctcagaagatggacatgtctaacatagtgcttatgctcattcagaagcttctgaatgaaaacccattcaagtgtgaggatccctgtgagggggaaaataagtgttcagagcccagggcttccaaggctgcttctatgtcgaaccggtcagacaaagcagaggaacagtgccaggagcaccaggaacttgactgcacttcgggaatgaagcaggctaacgggcagttcatcgacaagctagtcgagtccgtgatgaaactgtgtttgatcatggctaagtactccaatgacggagccgcactggccgaactagaagagcaggcagcttcagccaacaagcccaacttcaggggaacaagatgcattcacagtggggcaatgcctcagaactatcaagacagcctgggccacgaggtgattgtcaacaaccagtgtagcaccaacagcttacagaagcagctccaggccgtcttacagtggattgctgccagccaattcaacgtgcccatgttgtactttatgggagacaaggatgggcagctggagaaactgccacaagtgagtgcaaaagctgcagagaaggggtatagcgtgggtgggcttctgcaggaggttatgaaattcgccaaggagaggcaaccagatgaggccgtaggaaaagtggcccggaagcagctcctggactggctgctcgcaaacctatag

SEQ ID NO: 26476 - DNA, 1089 bp, Artificial Sequence
  Description of Artificial Sequence: Synthetic coding sequence
atggatgcacaggactgccaagcggctgcttctcctgagcccccgggcccccccgcaaggagttgcgttgccgcctggtgggacatggtggaccgaaatctgcgctactttccacactcttgctcaatgcttggtaggaaaattgccgccctgtacgacagttttacgagcaagtccctcaaggagcatgtgttcctgcccttaatcgatatgctgatatattttaattttttcaaggctccattcctagtggaccttaagaaacccgagctgaaaattccacacaccgtgaacttctacctcagggttgagccaggcgtgatgttgggcatctggcatacagtgccctcgtgcagaggggaagacgcaaaagggaaagattgttgctggtacgaggctgcccttagagacggcaacccaattattgtatatctccacggaagtgctgaacatcgcgcggcttcacacagactgaagctcgtaaaggttctctccgacggtgggttccatgttctcagcgtcgattatcggggcttcggcgactcaaccgggaagcctacggaggaagggcttaccacagacgccatctgcgtatacgagtggacaaaggcaaggagtggaattacccctgtgtgcctttgggggcactccctcggtacaggagttgccactaatgccgccaaggttttggaggaaaaaggatgccccgtggatgctatcgtgctggaggccccattcaccaatatgtgggtcgctagtattaattatccactcctaaaaatctacaggaacatccccggatttctaagaaccttgatggacgcactgaggaaggataaaattatatttcccaacgatgagaatgtcaaattcctgtcctctcctcttctgatcttgcacggcgaggatgatcgaaccgtcccactggaatacgggaaaaagctgtacgaaatcgcccgcaacgcgtacaggaacaaggagagggtgaaaatggtcatcttccctccgggcttccagcataacctcctatgcaagtctcctactttgctgattaccgtgcgagattttctatccaagcaatggtcgtag

SEQ ID NO: 26477 - DNA, 858 bp, Artificial Sequence
  Description of Artificial Sequence: Synthetic coding sequence
atggacgctcaagactgccaggccgccgcctcccctgaacctccagggccaccagccagatcctgcgttgcagcatggtgggacatggtagaccggaaccttcggcacacggttccaagctgccggggggaagacgctaaggggaaggattgctgttggtacgaagccgccctgagggacggaaaccccatcatcgtttacctgcacggctcagccgaacacagggccgcctctcaccggctgaaacttgtcaaagtgctgtctgacggcggatttcacgtgctctccgtggactaccgggggttcggggactccacaggcaagcctacggaagagggactgacgactgatgcgatttgtgtgtacgaatggacaaaggcccgctcggggattaccccagtctgtttgtgggggcactctttgggaactggggtcgccacaaatgcggcaaaggttttggaggagaaaggctgccccgtggacgccattgttctagaggccccttttactaatatgtgggtcgcatcaataaactatccacttctgaaaatataccgtaacatccccggctttttgcgcactctcatggatgctttgcgcaaggacaaaatcatcttccccaatgacgagaatgtcaagtttttgagctcaccacttctgatcctgcacggcgaggacgatagaactgtcccactggagtacggtaaaaagttgtatgaaattgccaggaacgcataccggaacaaggagcgcgtgaaaatggttatttttcccccaggattccaacataaccttctgtgtaagagcccaaccctgttaattaccgtgagagactttctctccaagcagtggtcctag

SEQ ID NO: 26478 - DNA, 768 bp, Artificial Sequence
  Description of Artificial Sequence: Synthetic coding sequence
atgctgggcatctggcacacggtgcctagctgccgcggggaggatgctaagggcaaggattgttgctggtacgaggccgctctgagggacgggaaccccatcatcgtgtaccttcacggttcagccgagcacagagctgcatcccaccgattgaaactggtgaaagtgctgtcagatggaggattccacgtgctttcagtcgattaccgtggcttcggcgacagtacaggcaaaccaactgaagaagggctgacaacggacgcgatctgcgtatatgagtggactaaggctcgaagtgggatcacccccgtttgcctctggggccatagcctgggtactggggtggccacaaatgcggctaaggtcctggaagaaaagggctgtccagtagacgctattgtcctggaagctcccttcactaacatgtgggtagctagtattaattatcctctgcttaaaatctatcggaacatccctggctttcttaggactctgatggatgccctcaggaaagacaagatcatatttcccaatgatgagaacgtcaagtttctgagctcacccttgctaattctgcacggtgaagacgaccggaccgttcctctggagtatggaaagaagctgtatgagatcgcccggaacgcctataggaataaagaaagggtgaaaatggtgatctttccccccggttttcaacacaatttgctctgtaagtcacccactctcctcatcacagtaagagatttcctgtctaagcagtggtcctag

SEQ ID NO: 26479 - DNA, 1410 bp, Artificial Sequence
  Description of Artificial Sequence: Synthetic coding sequence
atgtgtgttatctgctttgtaaaggccttagtaagggtcttcaaaatctatcttactgctagctacacctacccctttcgcggctggcctgtagcattcaggtgggacgacgtgagagccgtggggagaagctcatctcatagggccctgacctgcgccgctgccgccgccggtgtatggttgctgcgcgacgaaaccctggggggagatgctctaggacggcctccccgtggggcccgtagccaggcccagtgcttgctccagcagctgcgagaactgccaggccaactggctagctacgccctggcgcatagtctgggcagatggttagtctatcccggtagcgtctcattgatgaccagggctctgctacctctgttgcagcagggtcaagaacgactggtcgagagataccacggccgccgggcgaagctagttgcttgcgatggtaacgaaattgacactatgttcatggatcgtagacagcatcctggaagtcacgtacacggtccacgcctggtaatctgttgcgaaggaaacgccggtttttacgaaatgggctgcctgtccgccccgctggaggctgggtatagtgtcttggggtggaatcaccctggattcgggagttctactggcgtcccctttccacagcacgacgcaaacgctatggacgtggtggtggaatacgcactgcaccgccttcacttccctcccgcccacctcgtcgtctacgggtggagtgtaggcgggttcactgctacttgggccactatgacttaccccgagctgggagccctcgtgctggacgccacctttgacgatctcgtgcctctggcgctgaaggtcatgccccattcatggaagggcctggtggtacggaccgtgcgcgagcacttcaatctcaacgtcgctgaacagctgtgctgttaccccggacctgtccttttgctccggagaacacaagatgacgtggtgtccacatcggggcgcttgagacctctgagtcccggagacgtggaggggaacaggggaaatgaactgttactgagattgctggagcacaggtaccccgtcgtgatggctagggaaggccgagctgtagttactcgctggctgagagcaggctccttggcccaggaagcagctttttacgctaggtatagagtggatgaggactggtgtctggctttgctacgctcttacagggcacgttgcgaggaggaacttgagggtgaagaagcacttggcccgcatggccccgcattcccatggttggtaggacaaggcctctccagtaggagacgcagacgactggctctgttcctggcacgaaagcacctcaagaacgtggaggccactcacttttccccactggaacccgaggagttccagctcccctggcgactgtag

SEQ ID NO: 26480 - DNA, 1029 bp, Artificial Sequence
  Description of Artificial Sequence: Synthetic coding sequence
atggccgacgaccttgaacagcagtctcagggttggcttagcagttggctgcctacttggaggcctacatcgatgagccagctcaaaaatgtggaggcacgcatcctgcagtgtctccaaaacaaatttttggctcgatacgtgtccttgcccaatcagaacaagatttggacagtcacggtgagcccagagcaaaacgatagaacaccattagtgatggtgcacggctttgggggcggtgttggcctttggattctgaacatggattcgctgtctgcacgaagaacgcttcatacctttgacctcctcggattcggccggtcttctcgccccgccttcccacgtgaccctgaaggggcagaggacgaatttgtcacttcgatcgagacctggcgagagactatggggatcccctccatgatattgctcggacacagcctgggcggattccttgctacttcctacagcataaaataccccgatcgcgtaaaacacctgattctggttgacccttggggattcccattacggcccactaacccctcagagatacgcgcccctcccgcctgggttaaggctgtggcctctgtgttaggtagatcaaaccccctggctgtattgcgcgtggctgggccatggggtcctggcctggtccagcgatttagacctgacttcaagaggaaattcgccgatttcttcgaggacgataccatctcagaatacatataccactgcaatgcacagaaccccagtggcgagacggcattcaaggcaatgatggaatcttttggctgggcaaggaggcccatgcttgaaagaatccacctgatccgcaaggatgtacctatcactatgatctacggtagcgacacatggattgacacttctacagggaaaaaagtcaaaatgcagagacccgatagttacgttagagatatggagattaagggagcctcacatcacgtgtacgcggatcagcctcacatcttcaacgctgtggtcgaggagatttgcgattctgtcgactag

SEQ ID NO: 26481 - DNA, 1320 bp, Artificial Sequence
  Description of Artificial Sequence: Synthetic coding sequence
atgttgactggggtgaccgatggaatcttctgctgccttcttgggactccccctaacgccgtgggcccgctcgagtcagtggagtcctctgatggctatacatttgtcgaggtgaagcctggccgggtgctacgggtcaagcacgccggtccggctccggcagcagcgccgccacccccgtcatcagcgtcgagcgacgccgcccagggagatttatcaggtttggtcaggtgtcaacgccgaattactgtgtataggaacggtcggttgctcgtggagaacctgggacgcgcaccgcgtgctgaccttctgcacgggcaaaacggttctggcgagccaccagccgctctggaagttgagttagctgaccccgccggtagcgacgggcggctggcaccaggctcggcagggagcggttctggctccggctctggcggccgtcggaggcgggctagaaggccaaagcggacaatccacatcgactgtgagaagcggattacctcttgtaagggcgctcaggccgacgtcgtgctcttcttcatacacggggttggcggctctctcgctatatggaaggaacaactcgattttttcgtgcgattggggtacgaggtggtcgctcccgacctcgccggccacggggcctcctccgctccgcaggtggccgccgcttacactttctacgctttagccgaagacatgcgtgcaatctttaagcgttatgccaagaagaggaatgtcttgatagggcattcatacggtgtatctttctgtacgttcctggcgcacgaatatcctgacctggtgcacaaagtcataatgatcaatggaggaggacccaccgccctcgagccttctttttgctcgatcttcaatatgccaacttgcgtcctacactgtttatctccatgtctcgcttggagttttttaaaggctggcttcgcacgacagggcgccaaagagaagcaactactaaaggaaggcaatgcattcaacgtgtccagcttcgtgctgagggccatgatgagtggtcagtactggcccgagggcgacgaagtttaccacgcagagctgacagtgccagtgctcctagtgcacggcatgcatgataagtttgtgccagtggaggaggatcaaaggatggccgaaatcctgctcctcgccttcctgaaactgatcgacgagggttcccacatggttatgctggagtgtcctgaaacagtgaacacgctgctccatgaatttctgctctgggagccagagcccagcccaaaagccttacccgaacctttacctgcacctccggaggacaagaaatag

SEQ ID NO: 26482 - DNA, 1158 bp, Artificial Sequence
  Description of Artificial Sequence: Synthetic coding sequence
atggcaaccccacccccgagttccgcatcttcagacgctgcgcagggggacctgagtgggctagtccggtgccaaaggcggatcacggtatatagaaacggtcgactgctagtcgagaacttgggcagggcgcccagggccgacctgctgcatggacagaatggatcaggcgagccgccagcagcattggaggtcgaactggccgacccggccggcagcgacggtagactcgcacccggctctgcagggtcaggaagcggctccggcagcggtggccggcgacgcagggctagaaggccaaaacgaactattcacatcgactgtgaaaagcggattacaagctgcaagggcgcccaggccgacgtggtactgtttttcatccacggcgttggagggtctctggcgatctggaaagagcagctggacttctttgtgagattggggtatgaagtggtggcccccgatctagccggtcacggtgcatcgtccgccccacaggtagctgctgcgtataccttttacgctcttgccgaggacatgagggccatctttaaacgctacgctaagaaacgcaatgtactgatcggacacagctacggggtcagcttctgtacgtttctggcccacgaatatcctgacctggtccataaggtcattatgatcaatggcggcggaccgactgctcttgagccttccttctgttccattttcaacatgccaacatgtgtgttgcattgtctctccccctgtttagcgtggtcctttcttaaggcggggttcgctcggcagggcgcaaaggaaaagcagttgctgaaagaggggaacgctttcaacgtgtcttctttcgtcctcagagctatgatgtctggccagtattggcctgaaggggacgaggtgtaccacgcggaattaactgttcccgtgcttctggtgcacgggatgcacgacaagtttgtgccagtagaggaagatcaacgcatggctgaaatcctgctgctggctttcctgaagctcattgacgaagggtcccatatggttatgcttgaatgccctgaaacagtgaacacactgcttcacgaatttctcctgtgggagcctgagccttcgcctaaagccctgcccgaacctctacccgcaccacccgaagataaaaagtag

SEQ ID NO: 26483 - DNA, 1851 bp, Artificial Sequence
  Description of Artificial Sequence: Synthetic coding sequence
atggagttacgcactccgggcaccaagtggtccccacaggggatagggtcactgcgtagagtggtttgggattacagtacaccggaaatcagcctcttttctgaagagggtctcaaaggagagcaggtgaagctcacggaggcactgaaaaactcccagggccttgagaagcctttgcaagttgcttctgcaacggtgtccgcaggactttggctgttgtacccaaagcctcttttcgaggataccccatacatattagagcctggtgaataccccacttccgaggcctggggaaccagtgacccatccgtaggtagcctcaagcccatgagattaggctgcccctctgtagagaagcctggtgagccacgggcagtggtgtacgaagccccgggcttccagggtcgaagctgggaagttagcagagatatttacaacctccagcaaccagaggatagtcagagtccccacctggctagcgtaggatccttacgagtcctggggggctgttgggttggatacgagaaagagggctttaggggccaccaatacctcctagaagaaggcgagtatcccgattggagccattggggagggtacgacgaactgctgacgagcctgcgagtgattcgaactgactttggcgaccctgcagttgtccttttcgaagcgatggatttcgaaggacatggcgtggaggtctccaaggccctacctgatgtcgagctggtgcagcacggaccaagtacccaagccatccacgtgctgagcggtgtctgggtggcttatcaggaagtgggcttctccggggaacagtacgtgctggaaaagggcgtttacaggaattgtgaggactggggcgctggtaattccaccttggcaagcctccagccggttttgcaagtgggagaacacgacctccactttgttagcaaaattcaactgttttctcgcccggatttcctgggagatcacttctcattcgaggatgatcaggccgccctccccgcctcgtttaggccccaatcatgcagagtgcatggcggtagctggatactgtttgatgaaaccaattttgagggggaccagcatattctgtccgagggagagtttccaacgctgacagctatgggttgtctcgcctccactgtgctcggcagcctgcaaaaagtttccttacactttagtgaaccatctatcttcctctacggactcgaatgtttcgaaggtaaagaaatcgagctgagcagggaagtgcgctccctccaggccgaggggtttaataaccacgtgctgtccgtgcggattaagggaggcatctgggtgctgtgcgagcattctgattttaggggtcgccaatggctggtcggctcctgtgaaataacaaactggctcacatactcggggacgcagagagtgggcagcttatatcccatcaaacagcggcgagtttatttcagactgtggaacgccgccctgggaggctttctggccgtacctgaccacgttgaagacatgaaggccggtagagtcgttgttgctgacccacaggctggaggctcctgtatctggtactatgaagatggactgttaaaaaaccagatggcgccaaccatgagtctgcaggtgattgggcccccaagcccgggaagtaaggtggtactttgggctgagtcccgcctgcccaggcagacatggagcatctctgaatccggccatatttgtagccagatgttcgaaggtcagatcctagacgttaaaggcggtcggggttatgatcgagaccacgtcgtcctgtgggagccagacgaggatagagcgagtcagatttggacgattcacgtgctgtag

SEQ ID NO: 26484 - DNA, 282 bp, Artificial Sequence
  Description of Artificial Sequence: Synthetic coding sequence
atggaagaggcaggaggtcctatggctcgtgcaaaggcacgagtcgacggacctgttgatccccctgccgccacagtgctccccatggtgaggagcgaacatgtgacggtccccggacaacctccagcgcccagtacaacaagaaggaaggatgtaccatcccctggagtggatagggtgagcccgtccccaggcgggacacctgccccagtccccacaggagcggaggcctctaccgaaagtcagctcgttagcgacccaacagaagggaagacttgttag

SEQ ID NO: 26485 - DNA, 2364 bp, Artificial Sequence
  Description of Artificial Sequence: Synthetic coding sequence
atgatgaaaaagcacgtcgcaggcactaagggcccgcacagtgaattgggacttgagctacagggcgggagtcgccctacaagcaggctcggcggttcgctcctattcggaagcctcgtgccaacggctaaagaggcgtctaccccagagccactcggtacaaagcttagtgccttactgcctcacggagctccaggtttgcggaaagttccaggccaactgcccctgttatgttccgagaggtcatcaccaacggaaaaattggcatgctcactgccccttgaggggtggtcccctgccttgaagacacagggaaaactaaataccaggcctggaaaggttattttcttcagtgagagtgggtgtcagggctccgggagagaggtgtggggggatattgtggacgcgtctggctgggcacctgtggcttcaatccgagtcgtccggggttgctgggtgctatacgaggagcctgagttcaggggccaaaagttggtgctgccagagggggacatggagctgagaacccccgggaccaagtggtcacctcaggggatcgggagtcttaggcgggtggtttgggattactccactcccgagattagtctgttcagtgaggagggccttaagggggagcaggtcaagctgaccgaagctttgaagaattctcaaggccttgagaagcctttgcaggtggcctccgcaactgtgtctgccgggctgtggcttttatacccgaagcctctgtttgaggataccccttatattctggagccaggcgagtatccaaccagcgaggcatggggaacctctgacccatctgtgggctctctgaagccaatgcgacttggttgccccagtgtggaaaagcccggggaaccccgggctgtggtctacgaagccccaggcttccagggccgcagttgggaggtgtcaagggacatctacaatctgcaacagcctgaggattcacagagtccacatcttgcgagcgtaggatcgctgagggtgcttgggggttgttgggttggatatgaaaaagagggatttagaggccaccagtatttgctcgaagagggagagtatccagattggtctcactgggggggttacgatgagttactgacatccctgagagtgattaggactgacttcggtgaccccgctgtagtcctgttcgaggccatggactttgaaggacatggcgtagaagtctccaaggcacttcccgatgtggagctagtgcagcacggacccagcacacaagccattcatgtcttgagtggcgtgtgggtggcctaccaggaggtcgggttctctggggagcagtatgtgttagaaaaaggcgtgtaccgaaattgcgaggattggggcgcaggaaattctaccttagcttcactgcaacctgtgctacaggtgggagaacatgacctacatttcgtctcgaagatccagctgtttagccgaccagacttcctgggcgaccacttttcttttgaggatgatcaagctgctctcccggccagctttaggccgcagtcctgtcgagtgcacggagggagctggatactatttgatgaaaccaattttgaaggagatcagcacattttatctgaaggagagttccccacactgactgcaatgggatgcctcgcttccaccgttctgggaagcctccagaaagtatcgcttcacttttcggagccgtctatcttcctttatgggttggagtgtttcgaggggaaagagatcgaattatccagagaggtacgcagtctccaggccgaggggttcaacaaccatgtcctcagcgtccggattaagggagggatatgggtgctgtgtgagcattctgacttcagaggccggcagtggttagtcggttcctgcgagatcactaattggctgacctacagcggcactcagagggtgggcagcctctacccaatcaagcagcgcagggtctatttccgcttgtggaacgcagcactggggggttttttggctgtgcctgaccatgtggaggacatgaaggctgggcgcgtggtcgttgccgacccccaagctggaggcagctgcatctggtactacgaggatggtttgttgaagaaccagatggctcccactatgagcctccaagtgatcggcccaccatcccccggtagcaaggtggtgctgtgggccgagtctaggctcccccgccagacatggagcatcagcgaatccgggcacatttgttcccagatgtttgaaggacagatcctggacgtgaaaggagggcgaggatatgatagagatcacgtggttctgtgggaaccagatgaggatagagcctcccagatttggacgatccatgtgctctag

SEQ ID NO: 26486 - DNA, 1224 bp, Artificial Sequence
  Description of Artificial Sequence: Synthetic coding sequence
atggaagaagccggcggcccaatggccagggctaaggcccgcgtcgtgtccgctaccctgacctggcgtcagaggccccctactcaagaggagattaaacacgggttccacaaggtatccctggtgagcggagcccagatggaggctcctcaaaaggagatgtttgaattctccagacgggaagaggtagaagttaatggttttgccacccaggaagaggagaccgtaaattgccaaggaccccgggacacagctggaagtaaaaatttccagagccacggacccattttcagcaaaaagtatattcccccgccaaaggagaagcgccccgaggggcgcctgaaggaggccgtggatcagagtgatgggtcacgccaggccccacgtactgagcccccctgcgtgggcgccatggcaagaacggagcttctcgtgccgctcccaggtcctagggagccaagcccacatccaggcgtcgggctgactagcggctcttcccgatctttggaggagtatcgcgtaactagaaccgtgcggaccacaacagtcgtgggtggacatgtggataggaggatgagcagtagtgtgacagttcgcccagtgtcaagcggggaagcactgccccggggccgccaagtcagtcggatggtgccccccgtcgtggttggatctccacctggttctcccagcaggagccaggctgtcaaggtgctctcgaatctcgtgcccgccggtcactcccccccagcaagccaccttccacgccctacagccgggggaccgagatcaacggggctggggtctacagtgggcgctgctctcagacagctgccagagacgggaaccgccgaactcaaggacagctccgcgttagcttccacaggaattcccgcctccgcacacctgcctaaaaaccaagatgcccctgccgcctgccctgatagagatcagggacgggctccggacgcccgcgcctgcgagctgtggcaggtgcttggcgccccaagcagcaccgagctgccactgcagacgtcccagggccaggcaagcgtgccttcaagccccaggctcgagacacacgtcccatcacccggtctgacccatcctgccaaacagccggtcgtgcccacccaccccggagccaggttgacgcccctggtgctccctccgaaaaagcggacagggccatggacccctctcttacctccctcatgtccctggtag

SEQ ID NO: 26487 - DNA, 1128 bp, Artificial Sequence
  Description of Artificial Sequence: Synthetic coding sequence
atggaggaagaaattgccgcgctcgttattgataatggctccggtatgtgtaaggcagggttcgcgggggatgacgcacctcgggctgtattcccatccattgtgggccgtccccggcatcagggagttatggtcgggatgggacaaaaagacagctatgtgggggacgaagcccagagcaagagaggcatcttgacgctcaagtacccgatcgaacacggcatcgtcaccaattgggacgacatggagaaaatatggcaccacactttctacaacgaattacgcgttgctcctgaggaacatcctgtgcttcttaccgaggcgccccttaatccgaaggctaaccgagagaagatgacacagatcatgttcgagacatttaatacaccagcaatgtatgtggccatacaggcggtgctttccctttatgcttccggtcgcacaactggaattgtgatggattctggcgatggggtcacccacactgtgcccatttacgaagggtacgctctaccacacgctatcctcagactggacctggccggccgggacctgactgattacctaatgaagatactgaccgaacgaggctatagcttcactacgactgctgagcgggagatcgtgagagatatcaaagagaagctttgttacgtagctctggacttcgagcaggagatggccactgcagcctcatccagttcactggagaagtcttacgagctacccgatggacaggtgataaccatcgggaacgagagattccgctgtcctgaagctctgtttcagcccagtttcctgggcatggaatcctgtggcatccacgaaacaacgtttaactctattatgaagtgtgatgtggatatcagaaaggatctgtacgccaatacagtgctgagtggaggcacaacaatgtatcctgggattgcggatcgaatgcagaaagagataacggcactggcaccatccacgatgaagatcaaaattatcgcccctcctgagaggaaatactctgtgtggatcgggggatcaattttagcttccctaagcacgttccagcagatgtggatcagcaaacaggagtacgacgagagcggtcctagtatcgtgcatcggaagtgtttctag

SEQ ID NO: 26488 - DNA, 1128 bp, Artificial Sequence
  Description of Artificial Sequence: Synthetic coding sequence
atggaagaggaaatcgcagccttagtcatagataacgggtctggaatgtgcaaggcaggctttgctggagatgatgccccacgggccgtgttccctagcattgtgggtaggccacggcatcaaggggtgatggtgggcatgggtcagaaggattcttacgtgggtgacgaagcccagtcaaagcgtggaattctcacgctcaagtacccgatcgaacatggaatcgtcacgaactgggacgatatggaaaaaatttggcaccacaccttctacaatgagctgcgcgtcgcacccgaagagcatcccgtgctgctcacggaggctcccttgaatcccaaggcaaatcgagaaaagatgactcagatcatgttcgagacctttaacactcctgcaatgtatgtagccatccaggcggttctgtctttgtatgccagcggaaggaccacggggatcgttatggactccggggacggcgtgactcataccgtgccaatctacgagggatatgccctgccgcacgcgattctacgccttgatctggccggcagggatttaactgactatctcatgaaaatcctgacggaaagagggtacagttttacgacaactgcagaacgagagattgttagagacataaaggagaagctgtgctatgtggccctagactttgagcaggaaatggccaccgccgcaagctcaagttctcttgaaaagtcttatgagttgcctgacggacaggtgatcacaatcggaaacgagcgattccgatgccctgaggccctatttcagccgtcttttttaggaatggagtcttgcggcattcacgagaccaccttcaacagtattatgaaatgtgacgtggacattcggaaggacttgtacgccaacacagtcctctcgggaggaactacaatgtacccgggcatcgctgataggatgcagaaggagatcacagccttagctccaagcacaatgaagatcaagataattgccccccctgagcggaaatactccgtgtggattggagggtcaatcctggcatcattaagcacgtttcaacagatgtggatcagcaagcaggagtatgacgagtccggcccctctattgtgcatcgcaaatgcttttag

SEQ ID NO: 26489 - DNA, 1026 bp, Artificial Sequence
  Description of Artificial Sequence: Synthetic coding sequence
atgggaactgagaaggaaagtcccgaacctgactgtcagaagcagtttcaggccgctgtgtccgtgatacagaatctgcccaaaaacggatcctatcgcccgtcttacgaggagatgctgcggttctacagctattataaacaagccaccatgggtccatgcctcgtgccgagacccggtttctgggatcccatcgggagatataaatgggatgcctggaactccttggggaagatgtcgagagaggaggctatgtctgcttatatcaccgagatgaagctcgttgcgcaaaaggtgatcgacacagttccccttggagaagtggctgaagacatgttcggatatttcgagcctctgtaccaagttataccggatatgcctcggcctccggaaactttcctccgccgtgtgacaggatggaaggagcaagtggtgaatggcgatgtgggtgctgtgagcgaacccccctgtcttcccaaggaacctgcacccccttcccctgcttctctgtgggcagtgaccctgcccacacccccgcagagccctattcatcctggcacctggacacctcgttttagtgtaatcccatggagctcttggagtctgagttggtttggccagagctctggacagcacctggaagagtcagtcattcctggcactgcaccatgcccgcctcagcggaagcgcggctgtggcgccgccaggagaggtccgagaagctggacgtgtggttgctggggtcaatttgagcactatagacgagcctgtaggcgctgccgtcgcggttgtcgcgcatggcgggcctgtcccggcccactgagtcgaggcagatcccctggccctgtgcttgggcacggacccttaggcagccgcggaccaagatgttcttcctcttcctgcggaccttcatcttcatctgggtcctccgagtgtttcggtcctaagagaggggattgtcagtggagggggctctgctcacaattgagattatcttgttgtgcgttgtctcttccgcgggtttag

SEQ ID NO: 26490 - DNA, 807 bp, Artificial Sequence
  Description of Artificial Sequence: Synthetic coding sequence
atgggcaccgagaaggagtctcccgagcccgactgtcagaaacagttccaggctgccgtgtcagtgatccagaatctcccaaagaacggctcgtatcgtccaagctacgaggagatgctaagattctactcatactacaagcaggcaacaatgggaccatgcttagtgcctaggccggggttctgggaccctatcggacggtacaaatgggacgcctggaattcccttggcaaaatgtctagagaagaggccatgagtgcttatatcacagagatgaaactggtcgcacaaaaggtgatcgatacagtacccctcggggaagtggctgaggatatgtttggatatttcgagcctctataccaggtaatccctgacatgcccaggcctccggaaacgtttcttcggcgcgtcaccggttggaaggagcaggttgtcaatggcgatgtgggagccgtatctgagcctccttgcctgccgaaggagcccgccccacctagccccgaaagccactctcctagggacctggatagcgaagtattctgcgatagccttgaacagttggagcctgagctgagctccggccaacatctggaagagtcagtgatcccaggtaccgcgccttgccccccacaacggaaacggggctgtggggccgcaagacggggcccaagaagttggacatgtgggtgctggggtcaattcgagcactatcgacgcgcttgccgtagatgcagacgcggatgtagagcatggagggcgtgcccaggaccactgagctctctcacccttagtgtgcggctcgagtag

SEQ ID NO: 26491 - DNA, 918 bp, Artificial Sequence
  Description of Artificial Sequence: Synthetic coding sequence
atgggtactgagaaggagagcccagaaccagattgtcagaaacaattccaggcagcagtcagcgtcattcagaacctcccaaagaacggatcttatcggccctcttacgaagagatgcttagattttattcatactataagcaagctaccatgggcccttgtttggtacctcgccctggtttctgggacccaattggccggtacaaatgggacgcttggaactcactggggaaaatgtcaagggaggaggccatgtcggcatatatcaccgagatgaagttggttgcacagaaagtaattgacactgtcccactaggcgaagtggccgaagacatgttcggctatttcgagccgttgtatcaggtgattccagatatgccccgcccccccgaaactttcctccgccgcgtgacagggtggaaagagcaagtcgtgaacggtgacgtaggagccgtgtctgagcctccttgtctgccaaaggagccagcacctccctccccagaaagccactccccacgcgatctggatagcgaggtcttctgtgattctctagaacagttggaaccagagctggtatggacggagcagcgcgccgcctccggggggaagcgagatcctcgtaatagtcctgtcccacccaccaagaaggagggcttaagagggtcaccaccaggcccccaagagctggatgtctggttgctcggaacagtgcgcgcactgcaggagtccatgcaagaagtgcaggcccgggttcaaagtctggagagcatgccacggcccccagagcaacgaccccagcccagacccagcgcccgaccctggccactcgggctgccgggcccagccctgctgttcttccttctatggcccttcgtcgtgcagtggctattccgcatgttccggactcaaaagcgttag

SEQ ID NO: 26492 - DNA, 1026 bp, Artificial Sequence
  Description of Artificial Sequence: Synthetic coding sequence
atgggcacagaaaaagagagccccgagccagactgccagaaacagttccaagctgcagtgtctgtgatacaaaaccttcccaagaacggctcttacagaccctcgtacgaagagatgctgcgcttttatagctactataagcaagctactatgggcccctgtctcgtgccccggcccggtttctgggatcctatcggacgttataaatgggacgcctggaactctcttgggaagatgtcccgcgaagaggcaatgtctgcttacataactgaaatgaagcttgtggcccagaaggtcatagatacggtgccactgggggaggttgcagaagatatgtttggctacttcgagccactgtaccaagtgatccctgacatgcctcgcccaccagaaacgtttctcagaagagtgaccgggtggaaagaacaggtcgtgaatggagacgtcggggccgtcagtgaacctccctgtctcccaaaagagcccgctccaccgagccccgcatccctgtgggccgtcaccctgccaacccccccccagtccccaattcatcccggaacatggacgccccggtttagtgttattccctggagctcctggtcactgtcctggttcggccagtcgagcgggcagcacctcgaggagtctgtcatcccgggaacggcgccttgtccacctcaacgcaaacggggttgtggagccgcaaggcgggggcccagatcctggacttgtggatgctggggccaatttgagcattaccgtcgggcttgtagacggtgtcgcagagggtgccgtgcttggcgcgcttgtcctggccctttgtccagaggtaggagcccagggcccgtcctgggacacggtcccctgggatccaggggtcctaggtgcagcagtagcagctgtgggccgtcctcatcttctgggagctcagaatgttttgggccaaagcgcggcgactgccagtggcgcggcctgtgctcacagctaagactgtcttgctgcgccctgtccctccctcgtgtctag

SEQ ID NO: 26493 - DNA, 267 bp, Artificial Sequence
  Description of Artificial Sequence: Synthetic coding sequence
atggcactgcaggcagacttcgaccgcgcagccgaagatgtccgtaaattgaaagctaggcctgatgacggtgagctcaaggaactatatggcctgtacaagcaggcaatagtaggcgacattaacattgcttgtcctgggatgctggatctgaagggcaaagctaagtgggaagcttggaacctgaagaaagggctgtctaccgaggacgcaacctccgcatacatctctaaggccaaggagcttatagagaaatacggaatatag

SEQ ID NO: 26494 - DNA, 3180 bp, Artificial Sequence
  Description of Artificial Sequence: Synthetic coding sequence
atgtgtgtgcgttcttgtttccaaagccccaggcttcagtgggtatggaggactgcctttctgaaacatacacaacgtagacatcagggaagccaccggtggactcacctcggcgggagtacatacagagcagtcatctttgacatgggcggtgtgcttatcccttcccctggaagagtggccgcagagtgggaagttcagaacaggattccttctgggacaatcctgaaggccctgatggagggtggggagaacggtccctggatgcgctttatgagagcggaaattaccgcagaaggctttctcagggaattcgggagactgtgcagtgaaatgctgaagactagcgtgcctgtggactcttttttctccctactgacttcagagcgggtagccaagcagtttcccgtcatgacggaggccattacccagatcagggctaaaggtctacaaacagctgttctttccaataacttctatcttccgaatcagaaatcctttctgccccttgacaggaaacagtttgatgtcattgtggagagctgtatggaaggcatctgtaagcccgatccccggatctataagctgtgcctggaacagttggggctgcagccctctgaatcaatcttcttagatgatttggggacaaatttgaaagaggcagcccggcttggaatccataccatcaaagtcaatgaccctgaaacagcagtcaaggagttggaggccctgctcggtttcaccttgcgagtcggcgtcccaaacacgaggccggtgaagaagacaatggagattcccaaagattctcttcaaaagtacctcaaggatttgcttggaatccagacaacaggcccccttgagcttctgcagttcgaccacggtcaaagtaatcccacgtattatatcaggctcgctaatagagacctggtgttgagaaaaaaaccgccaggcacccttttgccatctgcccacgctatcgagagagagtttcgtattatgaaggccctggccaacgcaggcgtgccggtgcctaatgtgcttgacttgtgtgaagatagttcagtgatcggtacccctttctacgtgatggagtactgcccgggattaatatacaaggatccctctctaccgggcttggagccatctcaccgtagagccatttacactgccatgaataccgttctctgcaagatacatagtgtggacctgcaggcagtaggtctcgaggattacggcaagcagggagattatattccaagacaggtgaggacgtgggttaagcaataccgcgcgagtgagacatcgacaatccccgctatggaaaggctcattgagtggcttccccttcatctgccgcgccaacagagaactaccgtggtccacggggactttcgccttgacaacctggtgtttcatcctgaggaacccgaagttttggcagtgctggattgggagctgagcactcttggggatcctctggccgatgtggcctatagttgcttagctcactatttgccttcctccttccccgtactgagagggattaacgattgcgatctcacccagctaggtattcccgccgctgaagagtacttccggatgtattgccttcagatggggctacctcctacagagaattggaatttctacatggctttcagtttcttccgggtcgcagccattttgcaaggagtatacaaacgctcccttactggccaagcctcttccacatacgcggagcagacgggcaagctgacggagttcgtgtctaatctcgcctgggacttcgccgtcaaggagggtttcagggtgttcaaggaaatgcccttcacaaatccactgactcgaagctatcacacatgggcccgcccacagtctcaatggtgccctacggggtccagatcttattccagcgtgccagaggcttctccagctcatacttctcgcggaggccttgtaataagtccagagtcacttagcccacccgttcgagagctctaccacaggctgaaacattttatggagcagagagtataccctgccgagcctgagttacaatcgcaccaagcctctgccgcccgctggagccctagtccactgatcgaggatttaaaagagaaggccaaggcagagggcctatggaacctgtttttgcctctcgaagcagatcctgagaagaagtacggtgccggcctaaccaatgttgaatatgcacacctgtgcgagctaatggggacctcactgtacgctccagaagtctgcaattgctctgcccccgacacaggaaatatggaattactggtacgctacggcactgaggcacagaaggctcgctggctcatacccctgctcgagggtaaggccaggtcttgttttgctatgacagagccacaggtcgcatctagcgacgctacgaacattgaggctagcattcgtgaggaagactccttctatgtcatcaacggccacaagtggtggattaccggaattcttgaccctcgttgccaactgtgcgtgtttatgggcaagactgatccacatgcaccaagacacagacaacaatctgtgctacttgtccctatggacaccccaggtataaagattataagacccctgaccgtatatggactggaggatgcacctggcggccatggcgaggtgcggttcgagcatgtgcgcgtgcctaaggagaacatggttctgggcccaggccggggatttgaaattgcccaaggccgcctgggccccggaaggattcaccactgcatgcgcctcataggtttctccgaacgtgccctcgctctgatgaaggcccgggtgaagagtcgcctggcatttgggaaacctctcgtcgaacagggcactgtcttagcagacatcgctcagtcccgcgtggaaattgaacaggcccgcctgttagtgctccgcgcggcccatctgatggatctcgccgggaacaaggccgcggccctcgatatagcaatgatcaagatggtggctccttctatggcttcacgggtgattgacagggctatacaggctttcggggccgcaggcctgtcttcagattatccacttgcacaattctttacatgggcccgggcgctgcgttttgcagatggaccggatgaggtgcatagagctacagttgctaaactggagctcaaacataggatatag

SEQ ID NO: 26495 - DNA, 1479 bp, Artificial Sequence
  Description of Artificial Sequence: Synthetic coding sequence
atgttagaatacttgtcattaacattcctaatctccgtgaagatccagggggactacatcccacgacaggtgcgaacatgggtgaaacaataccgggcgagcgaaaccagcacgattccagctatggaacgactgatcgaatggcttcccctgcacctgccaaggcagcagagaaccaccgtggtacacggagattttcggctggacaaccttgtctttcatcccgaagagccggaggtactcgcagtcctggattgggagttgtctaccctgggggatcctctagctgatgtcgcctactcatgtctggcgcactatcttccgtcaagcttccctgtattaagaggaatcaatgattgtgatctgacacagctcggaattcctgcagctgaggagtactttagaatgtattgtttacagatgggcctgccccccacagagaattggaatttctatatggcctttagtttctttcgtgtcgctgctatcctacaaggcgtgtataagaggagcttgaccgggcaggcaagtagtacatatgccgagcaaaccgggaagctgaccgaattcgtttcaaacctggcttgggacttcgctgtgaaagagggattccgagtgttcaaggagatgcccttcaccaacccgctgacgaggagctatcacacctgggctcggccacagtcccagtggtgcccgacaggctcccgttcgtactcttccgtccctgaggcttcccccgcacacacatcaagaggaggcctggtcatatctccagagtcactctcacctcccgtacgggagctgtatcatcgcctcaagcatttcatggagcagcgagtgtaccccgcggagcccgagcttcagtcacaccaggcttcagccgctcgctggtccccctccccattaatagaggatcttaaagagaaggccaaagccgaaggtctctggaatctattcctgccgctggaggccgacccagagaaaaaatatggagctggcttgactaatgtggagtatgctcacttgtgtgagctgatgggcacttccttgtacgccccagaagtttgcaactgtagcgcaccagataccggaaatatggaactgctcgtgagatatgggactgaagcccagaaggcccgctggctcattccactgctggaggggaaagctagatcgtgcttcgctatgaccgagcctcaagttgccagctctgatgccacaaacattgaggcaagcataagagaggaagactccttttatgttatcaacggccacaaatggtggatcactggcattctggatcccaggtgtcaactctgcgtatttatggggaaaactgaccctcacgctccgagacatcgccagcagagtgtactcctggtcccaatggatacaccaggaattaagattatcaggcccctcactgtctacggcttggaggatgcaccaggctgttttctcccatcttttagtctgtag

SEQ ID NO: 26496 - DNA, 2673 bp, Artificial Sequence
  Description of Artificial Sequence: Synthetic coding sequence
atgtgcgtgcgctcatgtttccagagtccaagactgcagtgggtgtggaggaccgccttcctgaaacacacccagcgtcggcatcagggatcgcataggtggacacacctcggtggatcgacgtatcgtgccgtgatcttcgacatgggaggcgtgctcatccctagtcctggaagggtcgcagccgaatgggaagtgcagaacagaatcccatccggtactatcttgaaggcccttatggagggcggtgagaacggcccctggatgaggttcatgagggctgagataaccgccgaaggattccttagagagtttggtaggctctgttctgagatgctgaagacctctgtacctgtagactcctttttctccctacttacgtcggagcgagtcgcaaagcagtttccagtaatgaccgaagctatcacccagatccgggccaaaggattgcaaacagccgtactatctaacaacttttacttgccaaatcaaaagagtttcttaccactggataggaagcaatttgacgttatagtggaatcctgtatggaaggaatctgtaagcccgatcccaggatctacaagttgtgcctggagcagctgggactgcagccatccgagtccatctttctggatgatctgggcacgaacctgaaggaagcggcacgcttgggaattcacaccataaaggtcaatgatccagagactgctgtgaaggagttggaggctctgttgggattcacattgagggtgggtgttcctaatactcgacccgtgaagaagacgatggaaatcccaaaagattctctccagaaatatttgaaagatctgctcggcatccaaacaaccggccccttggagctgctccagtttgaccatggccaaagcaaccccacctattacatccgcctcgccaatcgggacctcgtgcttcgcaaaaagcctccagggacactcttgccgagcgctcatgccattgaacgtgagtttagaatcatgaaagcactcgcgaatgccggcgtcccagtgcccaatgttctggatctgtgcgaggactcgtcagtgattggtacgcctttctacgtgatggagtattgtccgggcctgatctacaaagacccaagccttcctgggctggagccttcacacaggcgagctatatacaccgcaatgaatacagtattatgcaaaatccatagtgttgacctgcaggcagtgggcctggaagattacggcaagcaaggcgactacatccctcgccaagtcagaacttgggtcaagcaatatcgcgcatcagaaacgtcaacgatccccgctatggaaaggctaatcgaatggcttcctctgcatttaccgaggcaacagcgtaccactgttgtgcacggtgacttcaggctcgataatctcgtctttcatcctgaggaacccgaagtacttgcagtgcttgactgggagctgagcactctcggggatccattagccgatgtcgcctattcttgtttggcacactaccttccttcaagctttcctgtgcttcgcggaattaacgactgtgacctgactcagctgggaatcccagctgcagaagagtacttccgaatgtactgccttcagatgggactaccgcccaccgaaaattggaacttctacatggccttttctttcttccgtgttgccgctatcctacagggggtatacaagcggtctctgacaggacaggcatcttctacttatgcagaacaaactgggaagctaaccgagttcgtcagcaaccttgcatgggacttcgctgtcaaagagggattccgggtttttaaggaaatgccttttactaatcccctaactcgtagttaccacacatgggcaagaccacagtctcagtggtgcccaactggctcaagatcttatagctccgtcccagaggcctctcccgcccacacatcaaggggaggcttagttatttcccccgaatccctgagtcctcctgtgcgggaattgtaccatcgcttgaaacatttcatggagcagcgtgtctatcctgcagagcccgagctacagtctcaccaggctagcgccgcacgctggtcaccgagtccgttaattgaggacttgaaagagaaagctaaagccgaaggcctgtggaatctcttcctccctctggaagccgacccagagaagaagtatggcgctgggctcactaatgttgagtacgcgcacctgtgcgaactgatgggaaccagcctttacgctcccgaggtgtgcaactgctctgcgccggataccggtaatatggagctcctggtccgctacggcaccgaggcacagaaggctcgatggctaatcccactgctggaaggtaaggctcgctcttgttttgcaatgacagagccgcaagtggcatcctccgacgccaccaacatcgaagcctccattagagaggaggattcattctacgtgatcaatgggcacaaatggtggatcacaggaatattagacccacggtgtcagttatgcgtgtttatggggaaaaccgacccccacgccccacgacatagacaacagtccgtgctgctcgtgcccatggatacaccaggtatcaagattattcgtccactaactgtttatggacttgaagatgcccccggatgttttctgcccagctttagcttgtag

SEQ ID NO: 26497 - DNA, 3273 bp, Artificial Sequence
  Description of Artificial Sequence: Synthetic coding sequence
atgtgcgttcggtcgtgtttccaatcaccaagactccagtgggtatggcggactgcctttctgaaacatacccagagacggcatcaggggtcccataggtggacccaccttggtggcagcacatacagagcggtcatcttcgacatgggcggagtccttatcccatcccctggccgcgtggcggccgaatgggaggtccagaaccgtatcccctccggaacaattcttaaagcactgatggagggaggcgagaatggcccatggatgcggttcatgagagccgaaattacggccgaagggttcttacgcgagttcgggaggctttgcagtgaaatgctcaagaccagcgtgcccgtggactccttcttctcgcttctgacatccgagagggtcgcaaaacagtttcctgtcatgaccgaggctattacccagatccgcgccaaggggcttcaaacagcagtcctgtcaaacaacttctatctgccgaaccaaaagtctttcttaccgttggaccggaagcagtttgacgttattgtcgaaagttgcatggaaggtatttgtaaacctgacccacgaatttacaagctttgcttggaacagctgggtctccagccttccgagtcaatattcctggacgacctgggaaccaatctaaaggaagccgcccggctagggattcatacaataaagcgacagggatttgcggtgttgccaaaattggtgtccaacagctgggcccaggctatttatcccccttacccaccaaaggtggttcggttgcaggtcaatgaccccgaaactgccgtaaaggagctggaggcgctgctagggtttactctacgcgtgggggttcctaacaccaggcctgttaaaaaaacgatggagataccgaaggatagcctacaaaaatatttaaaggatcttctggggattcagaccaccggccccttggaactgttgcagttcgatcacggacaaagcaatcccacttactacatccggcttgcgaacagagacctagtgctgcggaagaagccacccggcactctgctgcccagcgcgcatgccattgagagggagttcaggattatgaaggcgttggctaatgccggcgttccagtccccaatgtcctagatctctgtgaagactctagcgtcataggaacccctttctacgtgatggagtactgcccaggcttgatatataaggaccccagcctgccagggctcgagccatcgcatcggcgagccatctacaccgccatgaacaccgtgctttgtaagatccactccgtggatctgcaagccgttgggctggaggactatgggaaacaaggcgattacatccccaggcaggtgaggacctgggttaagcagtaccgagcatctgaaaccagcacgatcccagcaatggagaggctcatagagtggcttccattacacttgccccggcagcagagaaccacggtggtgcatggtgattttcgactggataacctcgtgttccatcctgaggagcccgaggtactcgcagtccttgattgggagctctccaccctcggcgatcctctggcagacgtcgcctattcctgcctggcccattatctgccgtctagcttccccgtcctgaggggtatcaatgactgtgacctgactcagctcgggatcccagcagccgaagagtactttcggatgtactgtctccagatgggacttccccccacagagaactggaatttctacatggccttctcgttttttcgagtggctgctattctgcagggggtttacaagcgttccctgaccggccaggctagttcaacttacgccgaacagaccggcaagctgacagagttcgtatccaatctggcctgggacttcgccgttaaggaggggtttagagttttcaaggagatgcctttcaccaatccacttacaagaagctatcacacttgggcccgaccacagtcacagtggtgtccaacgggttcccgctcgtactcctctgtgccagaggcctccccagcacacaccagccgcggcggcctggtcatttccccagagtcactgagccctccagtcagagaactttaccaccgactcaaacactttatggaacagagggtgtaccccgccgagccagagttgcagtctcatcaggcttcagccgcacgatggtcaccctcacctctgatcgaagacttgaaggagaaagccaaagctgagggtctttggaacctgttccttcctctggaggctgaccccgaaaagaagtatggagccgggttgactaacgtggagtacgcccatctctgtgagctgatgggcacaagcctgtatgcccctgaggtctgtaactgttcagcaccagacacgggaaacatggaactcctggtgcgttacgggacggaggcacaaaaagcgcgatggctgatccccctcctggaagggaaagctcgttcatgcttcgccatgacagagccacaagtcgcatcctccgacgctacaaacattgaagccagcattcgcgaggaggacagcttttacgtgatcaacgggcacaagtggtggatcacaggcattctcgaccctcgttgccagctttgtgtgttcatgggaaaaactgacccccatgccccccgccaccggcagcagtcggttttactggttcccatggacaccccaggcattaagatcattagaccgctcaccgtgtatggtctggaggacgcccctgggggccacggcgaggtgcggttcgaacacgttagggttcctaaagagaatatggttcttgggcccggccgaggattcgagatcgcccagggacgccttggcccagggcggatccatcactgcatgcgccttatcgggttcagcgaacgcgcgctggccctgatgaaggcaagagtcaaatctcggctggcatttgggaagcccctggttgaacagggcaccgttcttgctgatattgcgcaatcaagagtagagattgaacaggcacgtctgctggtgttgcgcgccgcccatctgatggatctcgctggcaataaagccgccgccctcgacatcgctatgatcaaaatggtggcaccctcgatggccagcagggttatcgatagggcaatacaagcgttcggggctgcgggcctgtcctctgattaccctctggctcaattctttacgtgggctcgcgccctgcggttcgcggacggaccagacgaagtccaccgcgccacagtcgccaagttggagctgaaacatagaatttag

SEQ ID NO: 26498 - DNA, 291 bp, Artificial Sequence
  Description of Artificial Sequence: Synthetic coding sequence
atgtgcgtgagatcttgttttcaaagcccgaggctccagtgggtatggcggacagcttttctcaagcacacacaacggcgacatcaaggcagccacaggtggacacacttgggaggaagtacgtatcgggccgtgatcttcgacatggggggggtgttgattccaagccctggacgggtggcagccgagtgggaagtgcagaaccgaatcccaagcggtacaatcctaaaagctctcatggagggaggtgaaaatggcccgtggatgagatttatgagggccgaaatttag

SEQ ID NO: 26499 - DNA, 3312 bp, Artificial Sequence
  Description of Artificial Sequence: Synthetic coding sequence
atggcgccggcttgccagattctgagatgggccctggctctgggcctcgggctcatgtttgaagtcacacacgctttcaggagccaagacgaatttctgtctagcttggagagctatgaaattgctttccctacgagggttgatcacaacggtgctctgctggctttctcgccacccccaccaagaaggcagcgaagaggcactggcgctactgctgaatccagattattttataaagtcgccagtccgtcaacccacttcctactgaacctcaccaggtcctctcgcctgctggccggccatgtgtctgtcgagtattggactcgcgaaggcctggcatggcagagggctgctagaccacactgtctttatgcaggccatctgcagggccaagcatcctccagccatgtcgccatcagcacctgtggtggtctgcacggactgattgtggcagacgaggaggaatatctgatcgagcctttacatggaggccccaaggggtcacgctcacccgaggagagtggtccgcacgttgtttacaaacgcagttccctgcgacatccccatctggatactgcttgcggagtgcgggacgagaagccttggaagggcaggccatggtggcttcgcactctcaagcccccccccgcccggcctctgggaaacgaaacagagaggggtcagcccgggttgaagagatcagtgagtcgtgagcggtatgttgagacactggtagttgcagataagatgatggttgcttaccacggtcgaagggatgtggagcagtatgttctcgccataatgaacatcgtcgccaagttgtttcaagactctagcctggggtccacagtcaacatcctggtgactagacttatactgttaaccgaggatcagcccaccctcgaaatcacacaccatgccggtaaatctctggatagcttttgtaaatggcagaagtccatcgtgaaccattccggccacggcaacgccattccggagaatggggtcgcgaatcacgacactgccgtgctgattacaagatatgatatctgcatctacaaaaacaaaccatgtggcacactcggcctcgcccctgttggcggaatgtgtgagcgggagaggtcatgctcagtgaacgaagacatcggtctggctactgcctttactatcgcccacgaaattggccataccttcggtatgaatcatgatggcgttgggaactcatgcggcgcccgcgggcaggacccagcgaagttgatggctgcgcatattaccatgaagactaatcctttcgtttggagcagctgcagtagagattatattacttcattccttgatagtggccttgggctctgtctgaacaacaggccaccacggcaagactttgtttaccctacggtggctccagggcaggcctatgacgccgacgaacagtgtcgcttccagcatggagtaaagagcaggcagtgcaagtatggcgaagtatgttcagagctctggtgcctttcaaagagtaatagatgcattaccaattcaattccagcggccgaaggcactctttgccagacacacacaattgacaaaggctggtgttacaaaagggtgtgcgtgccatttggttcccgtccggaaggagtggacggggcctggggcccctggaccccctggggcgactgttccaggacatgcgggggtggcgtcagttcatcctctaggcactgtgactctccacgcccgacaataggagggaaatattgcctgggcgaaagaaggcggcaccgatcctgcaacacggacgactgtcctcccggcagccaggatttcagagaggtgcagtgtagcgagtttgacagtatcccgtttcgtgggaaattctacaaatggaaaacttatcgcggaggcggcgtgaaagcttgctccctgacctgtcttgccgaaggctttaacttttacactgagagggccgccgctgtggtagatggaactccgtgcagacccgatacagttgatatttgcgtcagtggcgagtgcaaacatgtgggctgtgaccgagtgctgggttctgatctgcgggaagataagtgccgagtgtgtgggggcgatgggagtgcctgcgaaacaatcgagggagtattctccccagctagtcccggcgccgggtatgaggatgttgtctggataccaaaaggttctgtccatatcttcatacaggacctgaatctttctctgagccaccttgccctgaagggggatcaggagtccctgctcttagaaggcttgccaggtactccacaaccccaccgccttcctcttgctggaacaaccttccagctgcgacagggacctgaccaggtgcaaagcctggaagcactgggcccgattaacgcctccctgatcgtaatggtactcgctaggacagaacttcctgcacttaggtataggtttaacgcgcccatagccagagatagcctccctccgtatagttggcactacgccccatggaccaaatgctccgcccaatgcgccggtgggtcccaagtgcaggcagttgagtgcagaaaccagctggactcttcggcagtagcaccacactattgcagtgctcactccaagctgccaaagaggcagagggcttgtaataccgagccttgtccccctgactgggtcgtcggaaactggtcactgtgcagcagatcctgcgacgcgggagtgcgatcccgaagtgttgtgtgccagcggcgcgtgtctgcagcggaggaaaaagctttggacgattctgcttgtcctcagccgagaccccccgtgctcgaagcctgtcacggcccgacttgccctcccgaatgggctgcactggattggtcagagtgtactccctcctgcggtcctggcctccggcacagggtcgtgctgtgtaaaagcgcagatcacagagcgaccctgccccccgcccactgctcccccgcagctaaaccccccgccactatgagatgcaacctcaggcggtgccctcccgcgaggtgggtggcgggggaatggggcgaatgttctgctcaatgtggggttggacagcggcagaggagtgtcagatgtacctcccacaccggtcaggcgagccacgaatgcaccgaagctctgcggcctcctaccactcagcagtgcgaagctaaatgcgattcaccaactcccggggacggcccagaggaatgtaaagacgtgaataaagtggcttattgtcccctggtgttaaaatttcaattctgttccagggcttattttagacagatgtgctgtaaaacctgccacggccactag

SEQ ID NO: 26500 - DNA, 1998 bp, Artificial Sequence
  Description of Artificial Sequence: Synthetic coding sequence
atggcatccgcttcacagggagcagatgacgacggaagtcggcgcaagccacgtctcgcagcttccctgcagattagccctcagccccgaccatggcgtccgctcccagcacaggcccaatccgcttgggggcctgcacctgccccagccacatacagagcagagggagggtggccacaggtcagcgtgctgagggattccgggcccggagccggagccggcgtgggagagctgggggccgctagagcctgggagaacctgggcgaacagatgggaaaggccccccgcgtgcccgtgccccctgctggactctccttacccctcaaggaccctccagcgtctcaggcagtgagcttgctgactgaatacgcggcttccctgggtatattccttctcttccgtgaagatcagccaccgggcaaggtgttcaagtatagggccccagggggtgaggaattgaaggccatgtgtctctggcaggtggaagtgctgagagcctttctgcttcggacagggtggaggggtctgtggcgtggagatcttgatctcggacctgacagctcttgggcaaatagacttcccttcctgctgatttgtgagatggaatcccgaatacccgccgttgaagagttagggccctgttttccctttagcgtcagtgccgagctcgatggggtggtgtgtcccgccggtacggcaaactctaaaactgaagccaaacagcaggctgccttgagcgcactctgctatattcggtcccagctagagaatccggagtcgccccaaacttcctcaaggccgccactggcgcctcttagtgtcgagaatattttaacccatgaacagaggtgtgccgccttagtgtcggctgggttcgatctgctgctagatgaaagaagcccctactgggcctgtaaggggaccgttgcaggggtgatcctggaaaggggttgggccgtgtccgcaccgagctgcaccgaaatacccagagccagaggacacgtgaaggagatctataaactggtcgcgctagggactgggtctagctgctgtgccgggtggcttgagttctccgggcaacagctgcatgactgtcatggactcgtcatcgccaggagagcacttctgcgctttctgtttcgccaactgctccttgccacgcagggagggccaaaggggaaggaacagagcgtgctagccccacaaccgggaccaggccccccatttactcttaaaccacgagttttcttgcacctctacatttcaaatactcccaaaggagccgcgagagatatctaccttccccccacttcagaggggggcctcccacattcgccaccaatgaggctgcaagcccatgtcctgggtcagctgaagcctgtttgctatgtggccccttcgctgtgcgatactcatgtcggatgtctgtccgctagcgacaaactggcccgttgggcagtgctgggcctaggcggggccttgctggcccacctggtgagccctctatatagcacctcccttatacttgcagacagctgccatgaccccccaaccctgagccgcgctattcacacccgcccgtgcttagattctgtcctggggccctgtctcccgccaccctacgtgaggaccgcactccatttattcgcaggaccccccgtcgccccttctgagcctacccccgacacctgtcggggcctgagcctgaactggagtttgggtgacccaggcatcgaagttgtggacgtggcaactggaagagtcaaagcaaacgctgctttgggacctccttctaggttatgcaaggctagcttcttgagagccttccatcaggccgccagagctgtgggtaagccctacctcttagcactaaagacgtacgaggccgcaaaggctggaccataccaggaggcgcgtagacagctatctctgctgttggatcagcaggggcttggggcctggccttccaagccactcgttggcaaattccgaaattag

SEQ ID NO: 26501 - DNA, 1752 bp, Artificial Sequence
  Description of Artificial Sequence: Synthetic coding sequence
atggctagcgcctcccagggcgccgacgatgatggttctcgccgcaaacccagattagccgcttctctacagatcagccctcagccccggccctggagacccctacccgctcaagcacaatctgcttggggtcctgcgcctgcgcctgccacgtacagagctgaaggaggctggccccaggtgtcggtcctccgcgatagcggacccggtgcgggtgcaggtgttggggagctgggggcggcccgagcttgggagaacttgggcgagcagatggggaaggcaccaagggtgcccgtgccccctgctggtctgagtcttccgcttaaggatcctcccgcctctcaggccgtgtctttgctaactgagtatgcagcctcacttggcatctttctgttatttagggaggatcagcctcccggaccctgttttcccttttcagtgtctgccgaactggatggtgtggtctgcccagcgggtactgctaattcgaaaacagaggccaaacagcaggcagccctgtctgccctttgttatattcgatcccagctcgagaatcccgaatcaccacagactagctctaggccaccactggcccctctgagcgtggagaatatcctgactcatgaacaacggtgtgcagccttagtgagtgccggcttcgatcttcttcttgatgagcggtctccatattgggcatgtaagggtacggtcgcaggagtgattcttgagcgagagatcccaagggcccgaggacatgttaaggagatatataagctggtcgcactcgggactgggtcatcttgctgcgcaggctggctcgaattctcagggcaacagctgcatgattgccacggccttgtaatagctcggcgggctttactgcgattcttgttcaggcagctgctgttggctactcagggagggccgaagggcaaggagcagtcagtactcgccccccagcccggccccggccccccttttacactgaagcctcgtgttttcctgcatctctatatctcaaacactcccaaaggagccgcgagagacatctacctgccaccgacatccgaggggggactcccccacagcccccccatgcgtctgcaggctcacgttctcggacaactcaagccggtctgttatgtagctccaagtctgtgcgacacccatgttggttgtctgagcgcatcagataaactggctcggtgggcagtactgggactcgggggcgcactgctggctcacctggtttcccctctatacagcacgagcctgatactggccgactcatgtcatgacccaccaacattaagccgcgcaatacacacccgaccatgcttggatagcgtcttggggccctgcttgcctcccccctacgtcaggacagccctacatttgtttgccgggccacctgttgccccctcagagccgactcctgatacctgcagggggctgagcctgaactggtccctgggtgaccctgggattgaagtcgtggatgtggctactggcagggtcaaggctaacgcagcactcggaccacccagcaggttatgtaaggccagcttcctccgggctttccaccaagcagcaagagccgtggggaaaccctatctgctggcattaaagacatatgaagcagccaaagcagggccctaccaggaagccaggcggcagctgagcctcctgctggatcagcagggtctcggtgcatggccttcaaagcctcttgtgggaaaatttcggaactag

SEQ ID NO: 26502 - DNA, 576 bp, Artificial Sequence
  Description of Artificial Sequence: Synthetic coding sequence
atggaagccaaggcggctccaaagcccgccgcctccggtgcctgcagcgtctcagccgaagaaacggagaaatggatggaggaagcaatgcacatggccaaagaggccctggaaaatacagaagtcccagttggatgcctgatggtgtataataacgaagttgtaggtaaagggaggaatgaggtaaaccagaccaagaacgctactcggcacgctgagatggtagctatagatcaagtcctggactggtgtcgccagtcagggaagagtccctccgaagtcttcgagcacactgttttgtatgtcactgtggagccatgcatcatgtgcgccgcggccctgagactgatgaaaattcccctggtggtgtacgggtgtcagaacgaaaggtttggcggttgcggttcagttctgaatattgcctcagccgacctgccgaataccggccgtccatttcagtgcatcccaggctaccgcgcagaagaggccgtggaaatgctaaagacattctataagcaggaaaatcctaatgcaccgaagtctaaagtgcgcaagaaggaatgtcagaagtcctag

SEQ ID NO: 26503 - DNA, 111 bp, Artificial Sequence
  Description of Artificial Sequence: Synthetic coding sequence
atggaggccaaggcagctccaaagccggctgcttcaggcgcctgtagtgtgtcagccgaggaaacagagaagtggatggaagaggctatgcatatggagatattcctatag

SEQ ID NO: 26504 - DNA, 435 bp, Artificial Sequence
  Description of Artificial Sequence: Synthetic coding sequence
atggtatataacaatgaagtcgttgggaaaggaaggaacgaagttaatcagacaaagaacgcaacaagacatgcggagatggtggcaattgaccaagtcctggattggtgcagacaaagtggaaagtctccttccgaagtctttgagcatactgtcctgtatgtgacggtcgagccctgcattatgtgtgccgcagctctgagattgatgaagatccccctggtcgtgtacggctgccaaaatgagaggttcgggggatgcgggagcgttctcaatattgcctccgccgatctcccaaacactggacgcccctttcaatgcatacccggttatagagccgaggaagcggtggaaatgctgaaaacattttataaacaagaaaatcccaacgcacctaaatctaaggtccgtaaaaaggagtgtcagaagagttag

SEQ ID NO: 26505 - DNA, 1056 bp, Artificial Sequence
  Description of Artificial Sequence: Synthetic coding sequence
atggaacctgccccagggctggtggagcagcccaagtgtctggaggcaggtagccccgaaccagaacctgcgccatggcaggccctgcccgtgttatctgagaagcaatctggcgatgtcgaattagtcctcgcctacgccgccccggtgctcgacaagagacagacatccagactcctgaaggaagttagcgccttgcaccctttaccagcccagccacatttgaagcgggttaggccttcccgggacgcaggcagtccacacgccttggaaatgcttctgtgtctggcaggccccgcttccggccccaggtctctggcagaacttctccccaggccggccgtcgacccgaggggtctcggccagccctttctggtccctgtgcctgcaagacctcccctaacccgtgggcagtttgaggaggcccgggcacattggcctacatctttccacgaagataaacaggtgaccagcgcgttagccggaagacttttctccactcaggaacgcgctgccatgcagagccacatggagagagccgtgtgggctgcacgccgagcagcagctcggggactccgggccgtgggcgcagtggtcgtcgatccagctagcgatcgtgttttagcaaccgggcacgactgctcatgcgctgacaatccgctgctccacgctgttatggtatgtgttgatctggtggcgagaggacagggtcgcggtacatacgattttaggccttttccagcatgctcatttgccccagcagccgcacctcaggcagtgcgtgccggagccgtgagaaaactggacgctgacgaggacgggctgccctacctttgcactgggtatgacctatacgtgacccgggagccctgcgctatgtgcgcaatggccctggtacatgcgaggattctgcgtgtgttctacggggccccatctcctgatggcgctttgggaacacgatttaggattcatgcacggccagacctgaatcatcgcttccaggtatttagaggggtcctggaggaacaatgccggtggctagaccccgacacatag

SEQ ID NO: 26506 - DNA, 162 bp, Artificial Sequence
  Description of Artificial Sequence: Synthetic coding sequence
atggaacctgcacctggcttggtcgagcaacccaaatgcctggaagctggcagtcctgagcctgagcccgcaccatggcaagccctccccgtgctctctgaaaaacaatccggagatgttgagctcgtactggcctatgcagcccccgtgctggacaagtag

SEQ ID NO: 26507 - DNA, 804 bp, Artificial Sequence
  Description of Artificial Sequence: Synthetic coding sequence
atgatagaagcggaagaacaacagccctgtaaaacagacttttattcagagcttcccaaagttgagctacacgcccacctcaatggtagcatttccagtcacacaatgaagaaattgatcgcccagaaacccgacctcaaaatccatgaccaaatgaccgtcatcgataagggtaaaaaacgaaccctagaggagtgcttccagatgtttcagaccatacaccagctcacctcatcgccggaggacatcttgatggtgacaaaggacgtgattaaggagttcgcagatgatggtgtcaagtacctcgagctaaggtcaactcctcggcgcgagaacgcaaccgggatgactaagaagacttacgtcgagtcaattttggagggcatcaagcagtcaaagcaggagaacctcgacatcgacgtcaggtacctgatcgcggtcgatagaaggggaggaccattagtggccaaggaaacagtgaaacttgctgaggaattcttcctgtccacagagggaaccgtcctgggtctggatctgagcggagatcctactgtgggtcaggctaaggactttctggagcctctgcttgaagctaagaaggccggtctgaaactcgcactccacctgagtgagattcctaatcagaaaaaagagacccagattttgctcgatctccttccagatcggataggacacggcacatttctgaattccggcgagggtgggtcgctggacctagtggattttgtgcggcagcaccgtatccctctcggcaaggcttggtcttttagatcatccaggtag

SEQ ID NO: 26508 - DNA, 1068 bp, Artificial Sequence
  Description of Artificial Sequence: Synthetic coding sequence
atgatcgaagccgaggagcagcagccatgtaagacggatttctactctgaactgcctaaagttgagctccacgctcacctgaatggatctatctcctcacataccatgaagaaactcatagcccaaaagcctgacctcaaaattcacgatcagatgacggtgattgataaaggcaaaaagaggacattagaggaatgtttccagatgttccaaaccatacaccagctcactagttcccccgaggacatcctaatggtgacgaaagatgtgataaaagagtttgcggatgacggggtaaagtatcttgagttacggagcactcccaggcgggagaacgccacagggatgaccaagaaaacatatgtagagtccattctggaggggatcaaacaaagtaaacaggagaacctggatattgacgtcaggtatttgatcgcagtggataggaggggcgggcccctcgttgcaaaagagaccgtgaaactggcagaggagtttttcttatcaaccgaaggcactgttcttgggctggatctgagcggagacccaaccgttggccaggctaaagatttcctcgagcccctactcgaagccaagaaggcggggctcaaacttgctctgcacctgagtgaaattccaaaccaaaaaaaagaaactcagatacttctggacttgctgccagaccggatcggccacggcacctttcttaattcaggagaaggcggctcactggatcttgttgacttcgtccgccaacatcggatacctctggagctgtgcctgacctccaacgtgaagagccagacagtgccttcttatgaccagcaccacttcggcttttggtacagtatagcgcacccctcggtgatctgtactgatgataagggtgtctttgcaacccatctcagccaggagtatcagttggccgctgagaccttcaatctcactcagagccaggtctgggacctgagttatgagtctatcaattacatttttgcctcagatagcacaaggagtgagctgcggaaaaaatggaatcatctcaaacctcgcgtgctccatatctag

SEQ ID NO: 26509 - DNA, 987 bp, Artificial Sequence
  Description of Artificial Sequence: Synthetic coding sequence
atgatcgaggctgaagagcaacagccatgtaaaacagacttttacagcgagctgcccaaggttgagctgcacgcccacctgaacggctctattagttctcacactatgaaaaagcttattgcacaaaagcctgacctgaaaattcacgaccagatgaccgtgatagacaagggtaagaaacggactctggaggaatgtttccagatgtttcaaacaatccaccaacttacctctagccctgaagacatcctgatggtcacaaaggatgtgattaaagagttcgccgatgatggcgtgaaatacctggaactgcggtccacaccgcgaagggaaaacgcgacaggcatgaccaaaaaaacctatgtggagagcatcctggagggtattaagcagtcaaaacaagagaacctggacatcgatgtgcgatatctgatcgcggtggataggcgcgggggccccctcgtggccaaggagaccgtgaaacttgccgaagaattcttcctgtctactgaaggaacagtgctgggtttagaccttagcggcgacccaaccatcccaaaccagaagaaggagacccagatcctcctggatctcttgcccgaccggatcggacacgggactttcctgaactctggagagggaggctctctggacctagtggactttgtcagacaacacaggattcctctggaactctgtcttacctccaacgttaaatcacagacagtgcctagctatgaccagcatcatttcgggttctggtattctatcgcacatccctcggtcatctgcacagatgacaaaggagttttcgctactcacctatcccaagagtaccaacttgccgcggagacttttaacctgacacagtctcaagtgtgggatctgagttacgagagtatcaactacatcttcgcgagcgactccactaggtctgaacttcgcaagaagtggaaccacctgaagccccgcgttctgcatatttag

SEQ ID NO: 26510 - DNA, 1836 bp, Artificial Sequence
  Description of Artificial Sequence: Synthetic coding sequence
atgtcagtacaggtggtttccgcggctgcagccgccaaggtcccggaggtggaactgaaggatctctctccttccgaggccgaatcccagttgggcctgagcacagccgccgtgggagccatggcaccccctgctggcggtggtgatccggaggctccggctcccgcagcggaacgccctccagtacccggcccagggtctggaccagccgccgcgttgtctcctgccgccggaaaggtccctcaggcaagcgccatgaagcggtcagacccccaccatcagcatcaacgtcatagagatggaggcgaagcgttggtctctccagacggcaccgttacagaggcgcccagaacggtaaagaaacagatccaattcgcagaccagaagcaggaattcaacaaacgaccaacaaaaattgggcggcgctcgctatcaaggtctatcagtcaaagctcaaccgacagctacagcagcgcggccagctataccgattcttcggacgatgaaacatctccccgcgataaacagcaaaaaaattctaaggggagctcagacttttgcgtgaagaatattaaacaggccgagttcggcaggcgagaaatcgagatagccgagcaggagatgcctgccctgatggctctgcgaaagagggcgcagggggagaagcccctcgcaggtgcgaagattgttggatgtactcatataaccgcccagaccgcggtgctaatggagactctgggtgcgctcggagcccaatgccggtgggcagcgtgcaatatctactccacactgaacgaggttgcagctgccctggccgagtctgggttccccgtattcgcatggaagggagaatccgaggatgatttttggtggtgcatagacaggtgcgtcaatgtggaaggttggcaacccaacatgatcctggacgacggaggggacttgacccattggatctataagaaatatccgaatatgtttaaaaagatcaagggcattgtggaagagtcagtcaccggggttcaccgtctgtaccaactgtcaaaagctgggaagttgtgcgtgcctgccatgaatgtgaacgattccgtgacgaaacagaaatttgacaatctgtattgctgtcgggaaagcatcctggatgggctgaagcgcactacagacatgatgttcggcgggaagcaggtggtggtgtgcgggtacggcgaggtggggaagggatgctgcgccgccctgaaagcaatgggctccattgtctacgtgacagagatagatcctatctgtgctcttcaggcctgtatggatggattccggctcgttaaactgaatgaggtgatacgccaagtagacattgtgatcacctgtactgggaataaaaatgttgtaacgcgcgagcatctggacaggatgaagaattcatgcatcgtctgcaacatgggacatagtaataccgagatcgacgtggcgtccctgcgaactcctgagctcacgtgggaacgcgtgcgcagtcaggtggaccacgtgatttggcccgacggtaagcgcattgtcctgcttgctgagggccgactgctgaacctgtcttgttcaaccgtccctacgttcgttctgtctatcaccgcgactacgcaggcccttgctttaatcgagctgtacaatgcccctgagggccggtacaagcaagacgtctaccttctgccaaaaaagatggatgagtatgtggcatccctccacctgcctacattcgacgctcacttaactgaactcaccgatgaacaggctaagtacctgggactcaacaaaaacgggcctttcaagcccaactattatcgctattag

SEQ ID NO: 26511 - DNA, 1530 bp, Artificial Sequence
  Description of Artificial Sequence: Synthetic coding sequence
atggaaaaatgggacggcaacgagggaacaagtgcttttcatatgcctgaatggatgcagatccaattcgccgaccagaagcaagagtttaataagaggccaacaaaaattggcagacgatccctttccagatctatttctcaatcctccacagattcctatagcagcgcagcctcctataccgacagtagtgacgacgagacctcccctagagacaagcagcagaagaactcaaaaggttcatctgatttctgtgtgaaaaacatcaaacaagccgaatttggaaggcgggaaatcgaaatagcagagcaggaaatgcccgctctcatggcacttagaaagcgggcacagggagaaaaaccactggccggtgctaaaattgtaggctgtactcatattacagcccagacagcagtcctcatggaaacgttaggtgctctgggtgctcagtgtaggtgggccgcttgtaatatttattccactctgaatgaggttgctgccgctctggctgagtccggcttccccgttttcgcctggaaaggtgagagtgaagacgatttttggtggtgcatagaccggtgtgtgaatgtggagggttggcaaccaaatatgatcctcgatgatggcggtgatctcacccattggatttacaagaaatatccaaatatgttcaagaagatcaaagggatagtggaagaaagtgtcacaggggtgcataggctgtaccagttgagcaaggcagggaaactgtgtgtacccgctatgaatgttaacgattctgtaactaaacagaagttcgataacctttactgctgtcgtgagagcatcctcgacggactgaagaggaccacggacatgatgttcggtggaaagcaggtggtggtatgtgggtacggtgaggtcggtaagggttgttgtgcagcactgaaggccatgggctctattgtgtacgtgacggaaatagaccctatatgtgcactacaagcctgcatggacggatttagactagtaaagctgaatgaagtgattcggcaggttgatatagtgatcacctgcacaggtaataaaaatgtggtcacgcgtgaacacctggatcgtatgaaaaacagctgcattgtgtgcaacatgggacattctaatactgagatagatgtggcctctctccgaactccagaactgacttgggaaagagtaaggagtcaggtggaccatgtcatttggcctgatgggaaacggattgtgctgctcgccgagggccggttactgaatctgtcttgcagtacggtgccaaccttcgtcctcagtatcacagccactacgcaggccctggccctgattgagctttataacgcccccgaagggaggtataaacaagacgtttacctgctgcctaagaagatggacgagtatgtggcttcactgcatctgccgacatttgacgcccatctgacagagcttaccgacgaacaggctaaatatctgggcctcaacaaaaatggccctttcaaaccaaactactaccgctactag

SEQ ID NO: 26512 - DNA, 1833 bp, Artificial Sequence
  Description of Artificial Sequence: Synthetic coding sequence
atgtccgtccaggtcgtgagcgcagctgctgctgcaaaggttcccgaggtggagctcaaagatctgtcccctagcgaggcagaatcccaactggggctgtctaccgctgccgtgggggcaatggcaccccctgccggagggggagatcctgaggcccccgcgcctgcagcggagcgcccaccagtgccaggacctggctctggaccagcggcagccctgtctcccgccgccggtaaagtgccacaggcctccgcgatgaagcgtagtgatccacatcatcaacatcagcgacacagagatggcggtgaggccctcgtgtcaccagacgggaccgttacagaggctccacgtaccgtcaagaaaatccaatttgctgatcagaaacaagagttcaacaaaagaccaacgaaaattgggagacgatcactgtccagatcaatcagccagtcatcaaccgactcatactcttcagcggcttcatatactgatagctcagatgatgagactagcccccgagacaagcagcaaaagaatagcaagggctcatccgatttctgtgtgaaaaatatcaagcaggccgagtttggaaggcgcgaaattgagatcgccgagcaagaaatgccggctttgatggctcttcgcaaaagagcccagggcgagaagcctttagctggagctaagatcgtcgggtgcacacatattaccgctcagaccgcagtcctgatggaaacacttggtgcgcttggggctcagtgtaggtgggccgcttgtaacatatattcaactctaaacgaggtggcagcagccttagccgagagtggatttccagtctttgcttggaagggtgagtcagaggatgacttctggtggtgcatcgacaggtgcgtgaacgtggaggggtggcagccaaacatgatcctggatgacggcggagatcttacccactggatttacaaaaaatatcctaacatgtttaaaaaaattaaaggaattgtggaggagagtgtgacaggagtgcacagactctaccagctctctaaggctggtaagctctgtgttccggccatgaacgtcaacgactccgtgactaaacagaagtttgacaatttgtattgttgccgggagagtatcctggacggcttgaagcgtactacagacatgatgttcggcggaaaacaagtcgttgtctgcgggtacggtgaggtgggcaaggggtgctgcgcggctctgaaggcaatgggatccatagtgtatgtgacagaaatcgacccaatctgcgctctgcaagcctgcatggacggattcagactcgttaaactgaacgaagtgatccgccaggttgatatcgtgataacctgcaccggtaacaagaatgtcgtcactcgcgagcacctggatcgaatgaaaaactcttgtattgtgtgtaatatgggtcacagcaacactgagattgatgtggccagtctgcgcaccccagaacttacatgggaacgggtgcggtcacaggttgatcatgtcatctggccagacgggaaacgcattgtgcttctcgcggagggcaggcttcttaacctgtcctgctccacagtccccaccttcgtgctgagtataacagctaccacccaggccctcgccttgattgaactgtacaatgcaccggaaggacgttacaagcaggatgtttatctcctcccaaaaaagatggacgaatacgtggcctctctgcatctccccacttttgacgcgcacctaaccgaactgacagacgagcaagctaaatacttgggtcttaacaaaaacggaccattcaagccgaactactatcgatactag

SEQ ID NO: 26513 - DNA, 228 bp, Artificial Sequence
  Description of Artificial Sequence: Synthetic coding sequence
atggagaagtgggatggcaacgaaggcacctccgcatttcatatgccagagtggatgcagattcaattcgctgatcagaaacaggagttcaacaagagacccactaagatcggtcgtaggtccttgtctaggagtatttcacagtcttccacggactcatactcgtcggcagccagctatacagatagctctgacgatgagacgagtcctagggataagcagcaatag

SEQ ID NO: 26514 - DNA, 1527 bp, Artificial Sequence
  Description of Artificial Sequence: Synthetic coding sequence
atggagaagtgggacggcaacgagggcacctccgcttttcacatgccggagtggatgattcagttcgccgatcagaagcaagagtttaataagaggcccaccaaaatcggtcggcggagtttgtctagaagcataagccagagctccaccgactcatattctagcgctgcgagttataccgatagcagcgatgacgaaacgtcgcctcgagataagcagcagaaaaatagcaagggcagttctgacttctgcgttaaaaatattaagcaggccgaatttgggcggcgcgagatagagattgcggaacaggagatgccagccctgatggcactcaggaagcgtgctcagggcgagaagcctctggcaggggctaagatagtcgggtgcacccatatcaccgctcagaccgcagtactgatggagaccctcggagcactgggagcccagtgcaggtgggccgcctgtaatatatactctactctcaatgaggtggctgcagctctggccgaatccggttttccagtgttcgcatggaaaggcgaaagcgaagatgatttctggtggtgcatagataggtgcgtcaacgtggagggttggcagcccaatatgatcctggatgacggaggcgatctgacacattggatctacaagaaataccctaatatgttcaaaaaaatcaaaggcatcgtggaagagagtgtaaccggagttcatagactataccagctgtccaaggccgggaaattatgcgtccctgcaatgaatgtgaatgatagcgtcaccaaacagaagttcgataatctctactgttgtcgagaatcaattctcgatgggctcaagcgtacaacagatatgatgtttggaggcaaacaggtcgttgtgtgcggttacggtgaagtgggaaagggatgctgtgccgcactgaaggctatgggttccattgtctacgttacagagattgaccccatctgtgctcttcaagcctgtatggacgggtttcggctcgtgaaattgaacgaggtcattcggcaggtcgacatcgtgatcacctgcacaggaaacaagaacgtcgtgacccgggagcatcttgaccggatgaagaatagctgtatcgtttgcaacatggggcattctaatactgaaatcgacgtcgcctctctgcgcactcccgaactgacttgggaacgggtccggtcccaggttgatcacgttatatggcccgacggcaagcggattgtgctactcgcagagggtcgactcctgaacttatcgtgttccacagtgccaaccttcgtccttagcatcacagccacaactcaggctttggcactgatcgagctttacaacgcccctgaaggacggtacaagcaggacgtgtacctgctgcccaagaagatggacgagtacgttgccagcctgcatcttcctactttcgacgcccacctcaccgaattaaccgacgaacaggctaagtacctcggactcaataaaaacggccccttcaaacccaactactatagatactag

SEQ ID NO: 26515 - DNA, 1593 bp, Artificial Sequence
  Description of Artificial Sequence: Synthetic coding sequence
atgtattttctctgttttttttgtctgtttgtgagcggtaggaagtggtccagacagtttctgttgagcttctggtgcaccgtttgcagcgctcaccagggcacaattttcctttctctgaaaatacagttcgcagatcagaaacaggagtttaacaaacgtcccactaagatcggtcgacggtccctcagtagatcgatcagtcaatcctctacagacagctactccagtgctgcatcttatactgattcgagtgatgacgaaacctctcctcgggataaacagcagaagaactccaaaggcagtagcgacttctgcgtgaagaacatcaaacaggccgaattcggaaggcgtgaaattgagatcgccgaacaggaaatgcccgccctaatggcgctgagaaaaagagctcagggggagaagcccttagcaggagctaaaattgtcgggtgcacacacatcaccgcccagaccgccgtgctgatggagacgttgggagctctgggggctcagtgcagatgggccgcctgcaacatctatagcaccctaaatgaggttgcggcagctcttgccgagagtgggttccccgtgtttgcctggaaaggggaatccgaagatgacttttggtggtgcattgacagatgtgttaatgtggaagggtggcaaccaaacatgatacttgatgacggaggggatctgacacactggatttacaagaaatatccaaatatgttcaaaaagattaaagggatcgtggaagaatctgttactggtgtgcatagactgtatcagttgtctaaggcaggcaagctttgtgtgcccgcaatgaacgtgaacgacagcgttaccaagcaaaagttcgacaacttgtactgctgcagggagagcatccttgacggtctgaagcgaacaaccgacatgatgtttggcggtaaacaagtggtggtgtgtggttatggtgaagtgggaaaggggtgctgcgcagccctgaaggcaatggggtccattgtgtatgtgaccgagatcgatcctatctgtgccctgcaagcatgcatggacggtttcaggctggtgaaactcaacgaggtgattagacaagtagacattgtgattacctgcactggaaataagaatgtggtcacacgcgagcacctggacaggatgaagaactcatgtattgtctgcaatatgggacattccaatacagagatcgacgtagcatccctgcgtactcccgagttaacatgggagcgcgtccggagccaggtggatcacgtgatttggcccgatggtaagcgcattgttcttctggcagagggacgactgttaaacctctcttgtagcaccgtgcccaccttcgttctgagcatcacggccaccacgcaagctctcgctctgatagaattatataacgctccagaggggagatacaagcaggatgtctatttgctgcctaagaagatggatgaatatgtcgcaagtctccacctccctacattcgacgcacacctcacagagttgacggacgagcaggccaagtacctggggcttaacaagaacggaccgtttaagcctaactattacagatactag

SEQ ID NO: 26516 - DNA, 1527 bp, Artificial Sequence
  Description of Artificial Sequence: Synthetic coding sequence
atgttgggatccaagaagaagtatattgtcaatggaaacagcggcatcaaggcccagattcagttcgctgaccaaaaacaggagtttaacaagcgacctactaagattggtcggcgaagcctgagcagaagtatcagccaatcctccaccgatagctacagctccgctgcttcctacaccgattcttccgatgatgagacaagccctagagataaacaacaaaagaactccaaaggcagctccgacttttgtgtgaagaacattaagcaagccgaattcgggcggagggagattgagatcgcagaacaggagatgcccgcactgatggcactgcgtaaacgagcccagggcgagaagcccctggccggcgcgaaaattgtcggatgcacacacatcactgcccagaccgccgtgctaatggaaacgctgggcgcactgggagctcaatgcagatgggccgcctgcaacatttactcgactcttaacgaagtcgccgccgccttagccgaatcgggtttccctgtattcgcttggaaaggcgaatcagaagatgatttctggtggtgtatcgatagatgcgtgaacgtggaggggtggcagcccaatatgattttagacgatggcggggatcttactcattggatttacaagaaataccccaacatgtttaaaaaaattaaagggatcgtcgaagagtctgtgacaggggttcacaggttataccagctcagcaaagcaggaaaactgtgtgtgccagctatgaatgttaacgattctgtcacgaagcaaaaatttgataatttgtactgttgtagggaaagcatcctggacggcctgaagaggacgacagacatgatgtttgggggcaagcaggtggtggtctgcggctatggtgaagtgggcaagggttgctgcgctgcgctgaaggctatgggatcaatcgtgtatgtgacggaaattgacccaatctgcgctctacaggcatgcatggacgggttccggctggtgaagctcaatgaggttatcaggcaggtcgacatcgtaataacatgcactggcaacaagaacgtggtgacacgggagcacttggataggatgaaaaattcttgcattgtatgtaacatgggacacagcaataccgagattgatgtggcgtccctccggaccccagagctcacctgggaaagagtccgctcgcaggttgaccatgtaatttggccggacggtaaacgcatcgtcttgttagccgagggacggctgttaaatctcagctgtagtactgtccctactttcgttctgagcattaccgctacaacccaagctctcgcgttgattgagttgtataatgcaccggaaggtagatacaagcaggacgtatacctgctgccaaaaaaaatggacgaatatgtggcctcactccaccttccaaccttcgacgcacaccttacagagcttactgatgaacaggcaaaatacctcggcctgaacaagaacggacctttcaagcccaactactaccggtattag

SEQ ID NO: 26517 - DNA, 1266 bp, Artificial Sequence
  Description of Artificial Sequence: Synthetic coding sequence
atgacgtctcaggaaaagaccgaggagtatccttttgcagatatctttgatgaagacgagacggagcgaaactttctgctgagtaaacccgtttgtttcgtcgtgtttggcaagcccggcgttgggaagactactctggcccgctatatcacccaggcgtggaagtgcattcgggtggaagccctccctattctggaggaacagattgcggccgaaacagagtctggcgttatgctgcaatctatgctgatctctggacagtcaattcctgacgaattggtaatcaagctcatgctggagaaactgaacagccctgaagtctgtcatttcggctacatcattacagagataccttcccttagtcaggacgccatgaccaccctacaacagatcgaacttatcaagaacctcaatctgaaaccagacgtcatcattaacataaagtgcccagattatgatctttgccagcggatctcaggccagcgtcagcataacaataccgggtacatctacagcagggaccaatgggaccccgaggtgattgagaatcaccgcaagaagaaaaaggaggcgcagaaagacggcaagggggaagaggaggaggaagaagaggagcaggaggaggaagaggcattcatcgctgagatgcagatggttgctgagatactgcatcacctagtgcagcgaccagaggattacttggagaacgtggagaatatcgtgaagctgtacaaggagaccatcctgcagactttggaagaggtaatggccgaacacaatccccagtacctgattgaactgaacggaaacaaacccgctgaagaactcttcatgattgtgatggacagattaaagtatcttaacctgaaacgcgcggccatcctgactaagttgcagggcgccgaggaagaaattaacgacaccatggaaaatgatgaactgtttagaaccttggcctcttataagctcattgcaccccgctacaggtggcaacgctccaaatgggggcgcacatgccccgtgaacctgaaagatggcaacatttactcagggttaccagattacagcgtgtcctttcttgggaagatctactgcctaagctccgaggaggccctcaagcccttccttctgaacccacgcccatacctgctgccacccatgcctggacccccctgcaaagtgtttattctgggcccccagtactctgggaagactactctctgtaatatgctggccgagaattataagggcaaagtgaccaattag

SEQ ID NO: 26518 - DNA, 1089 bp, Artificial Sequence
  Description of Artificial Sequence: Synthetic coding sequence
atgaaggagagaaaacgtcatctgggcgatacgaaacatttctgccccgtcgtgctgaaggagaatttcatactgcaaccaggcaacacggaggaagcggcgaaataccgagaaaagatctattacttttcttcagctgaagccaaagagaaatttcttgagcaccctgaagactacgttgcgcacgaagaaccattgaaagcacccccgctgcggatctgtttggtcgggccccagggatccgggaaaacaatgtgcggacgtcagttagccgaaaagctgaacatcttccatattcaattcgaagaggtcctgcaagagaagcttctcctaaagacagaaaaaaaagtaggccctgagtttgaagaagattctgagaatgagcaggcagcgaaacaggagcttgaggagctcgctatccaggctaatgtgaaggtcgaagaagaaaacacaaagaaacagctgcccgaagttcagttgaccgaggaggaagaggttataaagagctccctgatggagaatgagcccttgcctccagaaatcctggaggtgatcctttcagagtggtggctcaaagaaccgattcggagtacgggattcattttggatggatttcctcgatacccagaggaagctcagtttttgggtgaccggggttttttccccgacgccgcggtatttattcaggtcgatgatcaggatatcttcgatcggctcctgccggctcagattgaaaaatggaagctgaagcagaaaaagaagctagagcgcaagaagctgattaaagatatgaaggccaaaattcgcgttgatactatcgcgaaacgcagagccgagctcatcctggaaagagacaagaaacggcgagagcctaacaaagaaaaaagaaagagagggatctccgagaataccacgtgctataaatgcaatcacatgtcgccatggtgcgaatacgcaggcctcccctatcgaggactgcttatattgtattctgccactgctactgccacagcaggcactaaacactgtcggtcgggggctaaggtgattgtcgccctgagcaagcagaatattcacaaccaaaagtag

SEQ ID NO: 26519 - DNA, 2211 bp, Artificial Sequence
  Description of Artificial Sequence: Synthetic coding sequence
atgacgtcacaagagaagacagaagagtacccctttgcagatattttcgatgaagacgagaccgagcgcaactttctgctctctaaaccggtctgcttcgtggtgttcgggaagcctggtgtaggtaaaactactctcgctcggtatattacccaagcttggaaatgcattcgcgtcgaagcactgcctatccttgaagagcagatcgcagcggaaacagagtcaggggttatgcttcagtctatgctgatctccggacagtccatacccgatgaactggttattaagctgatgctggaaaagctcaattcccccgaagtgtgtcattttggctacatcattaccgagattcctagcctgtcacaggatgcaatgactacccttcagcaaatcgagctcatcaagaatctgaaccttaaaccagatgttatcatcaatatcaagtgccctgactacgatctgtgccagagaattagtgggcagcgacaacacaataataccggctatatatactcgcgagaccaatgggacccggaggtgatagaaaatcacagaaaaaaaaaaaaggaggcacaaaaggacggcaagggagaggaagaagaggaagaggaagagcaggaggaagaagaggcatttatcgctgaaatgcaaatggtggcagaaatattacaccatcttgttcaacgccctgaggattacctggagaatgtggagaatattgttaaactgtataaagaaactatcctgcagactctggaagaggtcatggctgaacacaatcctcagtatcttatcgagctgaacggaaacaaaccagccgaagagttgttcatgattgtgatggaccgcctgaaatatttgaacctcaagagagcagcgatcctcacaaaattgcagggagctgaggaagaaataaatgacacaatggagaatgatgagttgttccggactctggcgagctacaagctgattgccccacgctatcggtggcagcggagcaagtgggggaggacatgcccagtcaatctgaaagatggtaacatatatagtggcttacctgattattctgttagttttctaggtaagatatattgcctgagctccgaagaggctctaaagccatttctgctgaatcccagaccctatctgctgccccccatgccagggccgccctgcaaagtgttcatcctgggcccacagtacagcgggaaaactaccctgtgtaatatgttagctgagaattataaaggaaaagtggtcgattatgcccagctggtgcagcctcggttcgataaggcacgggagaccctggtcgaaaatactattgcagaggcaaccgctgctgcgataaaggtggttaaagaaaagctgcttcgcgagttgcaagcccgaaaacaggccgaaactgcgctgagggaattccaaaggcagtacgagaagatggagttcggagtcttccccatggaagctactcacagtagcattgatgaggagggctatatccaagggtcccaaagggacaggggatcctcactggttgatactgaagaggccaaaacgaaatccgaaaacgtgctacacgaccaggcagcgaaagtggataaggatgacggtaaagagacgggcgaaaccttcacattcaagcgccatagccaggatgcctctcaggatgtgaaactttactcagatactgccccgaccgaggaccttatagaggaagtgacagcagatcacccagaggtggtgaccatgatcgaggaaacaatcaagatgagccaggatattaatttcgagcagccctatgagaagcacgccgagatcttgcaggaagtgcttggggaggttatggaggagaacaaggataggtttcctggcgcaccaaaatacggaggatggatagttgataactgtccaattgttaaagagctgtggatggccctcatcaagaaaggaatcattcccgacctggtgatttacctgtcagatacggagaacaacgggaaatgtctgttcaatcgaatctacttgcagaagaagtcggagattgatagcaaaatcctggaacgactgcttgaagagcttcagaaaaaaaagaaagaagaagaggaagctaggaaggccactgaggaggagcttcggttagaggaagagaacaggcgtttacttgagctgatgaaggttaaagcaaaggggaagcatcgccttctgtag

SEQ ID NO: 26520 - DNA, 5736 bp, Artificial Sequence
  Description of Artificial Sequence: Synthetic coding sequence
atgacaagccaggaaaagacagaagaatatccctttgccgatatttttgatgaagacgagaccgagaggaactttttgctgtcaaagccggtgtgctttgttgtttttggcaaaccaggcgttggcaagacaacactggcaagatacatcactcaggcctggaaatgcatccgggtggaggcccttcccatcctggaagagcagatcgccgccgagaccgagtccggggtgatgcttcagtccatgctgatctctggccagtcaattcccgacgagttagtgattaaactcatgctggagaagctcaactcccctgaggtgtgccatttcggctatatcatcacagagattccttccctgtcccaggacgcgatgaccacactacagcaaatagaactgataaaaaatctcaatttgaaaccagatgtcattattaatataaagtgtcctgactatgatctgtgtcagcgcatctccggacagcggcaacacaataatactggctatatatatagtcgcgaccagtgggaccctgaagttatcgaaaaccataggaagaagaagaaggaggcccaaaaggatggaaaaggagaagaggaagaagaagaggaggaacaggaggaggaggaagctttcatcgccgagatgcaaatggtcgctgagatcttacaccatcttgtgcagcggccggaggactacttagagaacgtggagaacattgttaaactgtacaaagaaacaatacttcagaccctggaagaggttatggcagaacataaccctcagtacctgatcgaacttaacggcaataagccagccgaggagctttttatgatagtcatggaccgcctgaagtacctgaacctgaaacgagccgctattctgactaagctccagggagccgaagaggaaatcaatgatacaatggaaaatgacgaattattcaggacactggcttcttacaaactgatcgctccgaggtatagatggcagagatccaagtggggtcggacttgcccggtgaacctcaaagatggcaacatttattctggcctacccgattattctgtaagcttccttggtaagatttactgcttgagtagtgaggaggcactgaagccattcctgctgaatccaaggccataccttctgccgccaatgcctggaccaccttgcaaagtatttatcctagggccacagtattcaggcaaaacaacgctttgtaacatgctggcggagaactacaaaggcaaagtggtcgactatgctcagcttgtgcagcctcgatttgataaagctcgtgagacactggtggagaacacaatcgcggaggcaaccgcagcagccatcaaagtcgtgaaggaaaagttgctccgcgaattacaggcacggaagcaagccgagacagcccttcgggagtttcaacgtcagtatgaaaaaatggaattcggcgtcttccccatggaggcgacgcactcctccattgacgaggaggggtacatacagggttcacagcgcgaccgcgggtcttctctggtggacactgaggaagctaaaacgaagtctgagaacgttctacacgatcaggctgccaaggtcgacaaggacgacggaaaggaaacaggtgaaacatttacctttaagaggcacagccaagacgccagccaggatgtgaagctgtatagtgacaccgcccctaccgaagaccttatagaggaggtgaccgctgatcatcccgaggtggtgactatgatagaggagaccataaagatgagtcaggacatcaactttgagcagccttacgagaagcacgccgaaatcctgcaagaggtgctaggcgaggtcatggaggagaataaggatcgcttccccggagcgccgaagtacggtggatggatcgtggacaactgtcctattgttaaggagttgtggatggcactgatcaagaagggtataatccctgatctagttatttatctgtccgacacagagaacaacggaaagtgtctctttaacaggatatacctgcagaaaaaaagtgagatagactcaaaaatcttagagagactgctcgaagagctccagaaaaagaagaaggaagaagaggaggcccgaaaggccacggaggaagagctcaggctagaggaggagaacagacggctgttagaattaatgaaagtgaaggccaaagaggcagaagagacagataacgaagatgaggaagaaatcgagggagacgagttagaggtgcacgaagaacccgaagcatcgcatgatacccggggatcctggctgcccgaagaattcgaagcctctgaggtgcccgagacagagcctgaagcggtaagcgagcctattgaggaaactactgtggagactgagatccccaagggatctaaagagggcttggagatagagaagctgtcagaaactgttgttttacccgaattcccagaggactcataccctgacgttccagaaatggagcccttcaaggaaaagatcgggagcttcattatcctgtggaaacagctggaggccacgatctcggaggcgtatattaagattctcaatctcgagatcgctgaccgaacccctcaagaactgctgcagaaagtggtggagaccatggaaaagccatttcaatacaccgcttgggaactgacaggggaagactacgaggaggaaacggaggactaccaaaccgaagccgaggtcgacgaggagttggaggaggaggaagaggaagaaggggaagacaaaatgaaagaacgcaagaggcatctgggcgacacaaaacatttttgccctgtcgtgttaaaggagaattttatcctccagcctggcaatacagaggaggcagcgaaatatcgagagaaaatctattatttcagtagtgccgaggcaaaggaaaagtttttagagcacccagaagattacgtggctcatgaggaaccgctgaaggctcctcctttgcggatctgccttgtcggtccccaaggatccggaaagactatgtgtgggcgccagctcgctgagaagctcaatatctttcacattcaattcgaggaagtgcttcaggagaagctacttttgaaaactgaaaaaaaagtgggccccgagtttgaagaagatagcgaaaatgagcaggctgctaagcaggagctagaggagctagcaattcaggctaacgtcaaagtcgaggaagagaatacaaagaaacaactgcccgaggtgcagttgacagaagaagaagaagttatcaagtccagccttatggaaaacgagccgcttccgcccgagatcttagaggtcattctttccgaatggtggctgaaagagcctataaggtccacaggttttatactggacgggttcccacgctatcccgaagaggctcagtttctgggggaccgcggcttttttcccgatgcagctgtcttcattcaagtggatgatcaggacatattcgatcgattattacccgcacagattgaaaaatggaagcttaagcagaagaagaaattggaacgaaaaaaactgataaaagatatgaaggccaaaattcgcgtggatactattgcaaaacgtagagcggaactcattcttgagcgcgataaaaagagaagggaaaatgtcgtcagggacgacgaggaaataagcgaggaggaactagaggaagacaatgatgacattgagaacattttagaggatgagtttccgaaggatgaggaggagatgtctggggaagaggatgaggagcaggaaactgatgccatcgagcggctgcggggggagctcggagagaagtttgaagcagacacccacaatctccagattatccaggacgaactggagcgctaccttattccaattatttctatcaacggggctcgacgtaatcacatcgttcagtatacactgaacatgaagctcaagccccttgttgaaaatcgcgcgtccatctttgagaaatgtcaccccattccggctccactcgcccagaaaatgctgacctttacatataaatacatatcttccttcgggtattgggaccccgtgaaattgtcagaaggcgagactatcaaacccgtggaaaatgctgaaaaccccatctatcctgtgattcatagacagtatatctacttcctatcttccaaagaaacaaaggagaagttcatgaagaacccgattaaatacatccgacaacccaaacccaaacccacagtccctatacgcatcatcattgtgggaccaccaaagtctggtaaaactacggttgcaaagaaaatcacttccgagtacggccttaagcacctttcaatagggggtgcactccgctacgtgttgaataaccacccagagacggagctcgcccttatgctcaattggcatctgcacaaaggtatgacagccccggacgaattggctatccaggcactggagctgtcactcatggagtctgtgtgcaacacggctggagtcgtgattgatggatacccagtgactaaacaccaaatgaacctgctggaggcccgatccatcatccctatggtgattttcgaactctccgtgccaagcaaggagatctttaagcggctcctgcttgaaaaggaaaatgaacagaggctgccctacccactgcataactcagcccaaatcgtcgccgtgaacaatgttaagtataggaagaacatcggagagatccgtcaatactaccaggaacagcatcagaattggtacgtcatagacggatttcatagcaagtggtgggtctggaacgaggtgatcaagaatgtacaaatggtcaataagtacatgcaaacttatctagagagaatcaaagcaggtaaggccgcttgcatcgacaagctgtgtatcactccccaggagttgctctcacgcttaggagagtttgaacagttttgcccagtaagtctggcggagtcacaggagttattcgactgtagcgccactgatagtctcgagttcgccgcagaattcagaggccactactacaagatgtcgtctcaggaaaagctgaacaaattcctcgagaaccctgagctctacgttcccccgctagcaccccaccctctgccatccgcagacatgatcccgaagcgcctcacactatccgagctcaagagtaggtttcccaaatgtgccgagctgcaggggtattgtcccgtgacttacaaggatggcaatcagaggtacgaagccctcgtacctggaagcataaattatgccctagagtatcacaatcgaatctacatttgtgaaaataaggaaaagctgcagaaattcctgcggagcccactcaagtactgggaacagaaactcccccataaacttccacctctccgcgagcccatcctgctcacttctctgcctcttcccggctacctcgagcagggtatcgctacctcactcatcaaggccatgaatgcggcaggctgtctgaaaccaaagtttcctttcctgtcaataagacggagcgctctgttgtatatcgccctccatctcaaggcctttaatccaaagggatctgaatatactagaaagaagtacaaaaagaaaatggagcagtttatggagtcatgcgagctaattacttatctcggtgccaagatgacaagaaagtacaaggaaccgcaattccgtgccatcgatttcgatcataagttgaaaactttcttatcgctgaggaacatcgatccgattaatgggtag

SEQ ID NO: 26521 - DNA, 684 bp, Artificial Sequence
  Description of Artificial Sequence: Synthetic coding sequence
atgctgcagtccatgctaattagtggacagagtattcccgacgaactcgtaatcaagctgatgttagagaagttgaatagtccagaagtgtgtcattttggctatatcatcaccgaaatcccttccctcagtcaggacgcaatgacaacactgcagcagattgaactcataaaaaaccttaacttaaaacctgatgtgatcatcaacattaagtgtcctgattatgacctgtgccaacgcatcagcggacagcgccagcacaataatacggggtatatctactccagggaccagtgggatcctgaggtcatcgaaaatcaccgtaagaaaaaaaaggaagcacaaaaagacggtaagggcgaggaggaggaggaggaagaggaacaggaagaggaggaggcattcatagccgagatgcagatggttgcagagattttgcatcatttggtccagcggccggaggactacctggagaacgttgaaaatattgtgaaactgtacaaagagaccattctgcagactctagaagaggtcatggctgaacacaatcctcagtacctgatcgaactcaatggcaataaaccggctgaggagttattcatgatcgtgatggacagattaaagtatttgaacttgaaaagagcagcaatccttaccaaattgcagggcgcagaagaggagtag

SEQ ID NO: 26522 - DNA, 1074 bp, Artificial Sequence
  Description of Artificial Sequence: Synthetic coding sequence
atggagaagtacgtggccgctatggtcctaagcgctgctggcgacgccctgggatactataatggcaaatgggagttcctccaggatggggagaagatccacagacagctcgcccagttgggggggttagatgcactggatgttggcaggtggcgggtctctgacgacacggtgatgcatcttgccactgctgaggcccttgtcgaggcgggcaaagcgccaaaactgacgcagctctattatctgcttgcgaaacattaccaggattgcatggaagatatggatggcagggctcctggcggtgctagtgtgcacaatgctatgcagctcaagccaggcaaacccaatgggtggcgcatacctttcaatagtcatgagggagggtgtggagctgccatgagagcaatgtgtattgggttacgttttccacatcatagccagctggatacacttatacaggtttctatcgaatctgggcggatgacacaccatcaccccactgggtatctgggggctctggcctcagcactctttacagcctacgccgttaattcccggccacctctgcagtggggtaaggggctgatggagttgctgcccgaagccaagaagtacattgtccaaagcggctatttcgtggaggagaatctgcagcactggtcttacttccaaacaaaatgggaaaactatcttaagctgcgtggcatcctcgatggcgaatcggcacccacatttccggagtcctttggcgtgaaagaaagagatcagttctacacttcattgagctattccggctggggaggatcttctggacacgacgcccctatgattgcctacgatgccgttcttgccgcgggcgactcatggaaggagctggctcaccgcgcctttttccatggaggcgactccgattctacagcggcaattgccggttgttggtggggcgtgatgtacggcttcaaaggggtgtcaccatctaactatgaaaagctggaataccgcaacaggctcgaagagacggctcgggcgctctactccctgggctcaaaagaagatacagtgatctccctgtag

SEQ ID NO: 26523 - DNA, 1074 bp, Artificial Sequence
  Description of Artificial Sequence: Synthetic coding sequence
atggaaaagtatgtggctgctatggtgctgtctgctgcaggcgacgctctcgggtactacaacggaaagtgggagtttttgcaagacggagaaaaaatccaccgccagttggcccaattgggggggctggacgccttagacgtgggtcggtggagagtatcggacgacacagtaatgcaccttgccacagccgaggcgttggtggaggcagggaaagcacccaaactgactcagctgtactaccttctcgccaagcattaccaagactgcatggaagacatggatggcagggcgcctgggggagcctccgtgcataacgctatgcagctgaagccaggaaagccgaatggctggcgaataccctttaactctcacgaaggaggctgtggcgctgccatgcgagccatgtgcatcgggttgcgctttccccatcatagtcagcttgacacattgattcaggtcagcatcgagtcagggcgcatgacacaccaccaccccactgggtacctcggagccttagcatccgcgctctttaccgcatacgccgttaacagtagacctccattgcagtggggcaaaggcctcatggaactgctccctgaagcaaagaagtatattgttcagtccggctacttcgtggaagagaacctgcagcactggtcatacttccagactaaatgggagaattacctcaaactcaggggtattctggacggggagagtgcccccactttccctgagagctttggcgttaaggagcgcgaccaattctacacaagcctgtcctatagtgggtgggggggatcctcgggccacgacgccccgatgatcgcttacgacgccgttttggcagccggcgattcctggaaagaattggcacatcgggcattcttccacgggggcgattcagattcaactgctgccattgccggctgctggtggggcgttatgtatggctttaagggagtaagccccagcaactacgagaagttggagtaccgcaaccggctggaagagaccgcccgcgccctctacagcttaggctcaaaggaagacacggttatttcattatag

SEQ ID NO: 26524 - DNA, 1074 bp, Artificial Sequence
  Description of Artificial Sequence: Synthetic coding sequence
atggaaaaatatgtggccgccatggtgcttagtgctgctggcgatgccttggggtactataacggcaagtgggaattccttcaggatggcgagaaaatccaccgacagctagcacagctgggcggcttggacgcccttgatgtaggcagatggagagttagcgatgacactgtcatgcatctggccacagcagaagctctggttgaggccgggaaagccccaaagcttacgcaattgtattaccttctggctaaacactaccaggactgcatggaggatatggacgggagagcgccaggtggggcttccgtgcataacgcgatgcagctaaagcccggtaaaccgaatgggtggaggataccatttaactcccatgaggggggatgtggagccgccatgagggccatgtgcataggcctgagatttcctcaccactctcaattagacacacttatccaggtgtccatagagagcggaagaatgacacaccaccacccgacagggtacctcggggcacttgcttctgcgttatttacagcatacgccgtcaatagcaggcccccactgcagtggggcaagggactgatggagctgctgcccgaagcgaagaaatacattgtacagagtggatatttcgttgaggaaaatttacagcactggtcatactttcaaaccaagtgggagaactacctcaagcttcgcggtatcctcgacggcgagtccgcccctactttccccgaatcttttggagtgaaggagagagaccagttttatacaagtctgagctatagcggctgggggggctcctctggccacgacgcgcctatgatcgcatacgatgccgttctcgctgccggcgattcctggaaggagctggcacacagggccttcttccacggaggcgactctgactctaccgccgcaattgccggctgttggtggggcgtcatgtacggatttaaaggcgttagccccagcaattacgagaagcttgaatacagaaaccgactcgaggaaaccgcacgggctctgtatagcctcgggtcaaaggaggatacagtcatttccctctag

SEQ ID NO: 26525 - DNA, 1074 bp, Artificial Sequence
  Description of Artificial Sequence: Synthetic coding sequence
atggagaaatacgtcgctgccatggtcctttccgccgcaggtgatgccctggggtactacaacggaaaatgggagtttctgcaggacggcgaaaaaattcatcggcaactcgcccaactaggcggcctggatgccctggacgtgggccggtggagggtctcagacgacaccgtgatgcacttggctacagctgaggcccttgtagaggcaggcaaagcacccaagctaacacagttgtactatctgctcgcaaagcattaccaggattgcatggaagatatggatggccgggctccgggcggggctagcgtgcacaacgctatgcagttgaagcccggcaagcccaatgggtggcggatacctttcaacagccacgagggcggctgtggcgctgcgatgagagcaatgtgcattggccttagattcccccaccattcccaactcgatacccttatacaggtcagtattgagtccgggaggatgacacaccaccacccaactggatacctgggcgcactcgcatcagccctttttacagcatacgccgtcaattccagacccccattacagtggggtaagggactgatggagctgctgcccgaagccaagaagtatatagttcaaagcggctacttcgtcgaggagaatcttcagcattggtcatattttcaaactaaatgggaaaactatctcaagctgcggggcattttagacggcgaaagcgcacccacctttcccgaatcattcggagtcaaggagcgggaccagttctacacaagtctaagttactcggggtggggcggctcctctggtcacgatgctccaatgatcgcttacgacgccgtgctggcagcaggcgattcttggaaggaactggcccatcgcgctttctttcacggtggcgactctgacagtacagctgcgattgccggctgctggtggggcgtgatgtatggtttcaaaggggtttcgccttcaaactacgagaaactggagtaccgcaatcggctggaagaaacagcacgcgccttgtactcccttggctcgaaggaagacacagtaatatcgctttag

SEQ ID NO: 26526 - DNA, 378 bp, Artificial Sequence
  Description of Artificial Sequence: Synthetic coding sequence
atggagaaatacgtggctgcaatggtgctgtctgccgcaggagacgccttaggctattataatggtaaatgggagttcctgcaggacggcgaaaaaattcaccggcagctcgcgcagctggggggcttggatgccctcgacgttggcaggtggcgtgtctcagacgataccgttatgcacctcgctactgcagaagccttggtggaggcaggtaaagcccccaagcttacacagttatactacttactcgccaagcattaccaagattgcatggaagatatggatgggcgggctcctgggggggcatctgtccacaacgcgatgcagctgaagcctgggaaacccaacgggtggcggattccattcaactcacattag

SEQ ID NO: 26527 - DNA, 735 bp, Artificial Sequence
  Description of Artificial Sequence: Synthetic coding sequence
atggctccacgcccattagggcccttggtgcttgccctgggcggggccgctgcagtgctcggttctgtgctgtttattctgtggaagacttactttgggcggggcagagaacgtcggtgggacaggggagaagcttggtggggcgcagaggcggctcgtctgccagagtgggacgagtgggaccctgaggacgaagaggacgaagagcctgcgttggaggaacttgagcagagagaagtgctcgtgttgggcttagacggggccgggaagagtacctttttgagggttctctctgggaaacccccattggaaggccacatccccacatgggggttcaatagcgtgcgcctcccaaccaaggatttcgaggttgatctccttgaaattgggggaagccagaatctgcgtttctactggaaagaatttgtatctgaagtggacgtcctggtttttgtggtcgattctgccgaccgcctgcggctgccatgggcgcgacaggaacttcacaagctactagataaagacccagacctcccggttgttgtcgtggccaataaacaggacctgagcgaagctatgagcatgggcgagcttcagcgtgaattgggattgcaggcgatcgacaaccagagagaggtatttctgctcgccgcgtccatcgcacccgccgggccgacatttgaggagcccgggacagtccacatttggaaactgttgctggagctcctatcttag

SEQ ID NO: 26528 - DNA, 771 bp, Artificial Sequence
  Description of Artificial Sequence: Synthetic coding sequence
atgttcagactgctgagcagttgttgcagctgcctgaggacaacagaagaaactcggaggaacgtgaccataccaattatcggcctgaacaacagcggcaaaactgtcctggtcgaggccttccaaaaactgctgccgtccaagactgatcactgtatgaagtccgagttgaccacactgctcctggacgaatatgagctgagcatctatgacttaaacggcgacctcaaagggcgcgaggcctggcccaactattatgcccaggctcatggcctcgtgtttgtgctggattcttctgatataagaaggatgcaggaagtcaaaatcattttgacccacctgctttccgataaacgcgtggccggcaaaccaatacttatccttgcgaataaacaggataagaaaaaggccttaatgccttgtgacattattgattacttgctgctgaagaagctagtaaaggagaataagtgtccgtgccgcgtcgaaccttgttctgctatccgtaacctggagcggcgcaatcaccagccaatagtcgagggtcttagatggctgcttgccgtgatcgatacatgtcagttgccccctacctctagcatttccatttccaagaacaacacaggatcaggggaacggtgtagttcccattctttttctacaaggaccggcatgtctaaagagaagaggcagcatcttgaacaatgctcaatcgaggctaaacctcttaaaagtatcttgcagccttcgaaccagagctatacgcattag

SEQ ID NO: 26529 - DNA, 873 bp, Artificial Sequence
  Description of Artificial Sequence: Synthetic coding sequence
atgttcaggctcctctctagttgctgcagttgtctgagaactactgaggagacccgcagaaatgtgaccattccgatcattggcttgaacaattctggtaaaaccgttctggtcgaagctttccagaaactcttgccaagcaagaccgatcattgtatgaagtctgagcttaccacattgctactcgacgagtacgagctctctatctacgacctgaacggagatttgaagggaagggaagcttggccgaactactacgcccaagcacatggtctggtgtttgtgctggactcttcagacatcagacgcatgcaggaggtcaagattatcttgacccatcttctttccgataaacgggtcgctggcaagccgatcctaatcctggctaataagcaagacaaaaagaaagcgctgatgccctgtgatataatcgattacctgttgctgaagaagctggtgaaagagaacaaatgtccttgtagagtagagccctgcagtgccatacggaatctggaaaggagaaatcaccagcccatcgtcgaaggccttcggtggcttttggcagtgattgatacatgtcagctgcctccaacctcctccatctccatcagtaagaataacacaggtagcggagaacgctgcagcagtcacagctttagcacacgaacaggaatgtcgaaagagaaaagacagcacttagaacaatgcagtatcgaagccaaacctctaaaatcaatcctgcagaaggagggaactagactatggagtaagaaaaacatgtcggtcacattcgctttggatgagccgatgaaagagggggagtgtagccggagaatgcgtgctcagaataccaccaagctgtgctacaactag

SEQ ID NO: 26530 - DNA, 594 bp, Artificial Sequence
  Description of Artificial Sequence: Synthetic coding sequence
atgcgggttgccggaggccgggccctgtcaagaggcgccgagctacgggtacccggcggcgctaagcacggcatgtgtcttctgttgggagcgacaggggtgggcaagaccctgctcgtcaagcgactacaggaagtttcttccagggacgggaaaggggatttaggggagccacctcctacacggccgacagttggaacgaacctcaccgatatagtggcccagaggaagatcactattagagaacttgggggatgcatgggacccatctggtcctcctactacggcaactgcaggtcccttctgtttgtgatggacgcttcagacccaacacagctttcagcatcctgcgtccagcttctgggcttactttctgctgagcagcttgcagaggcaagtgtcctaatcttgttcaacaaaattgatctcccatgttacatgtccacagaagagatgaagagcctgatcagacttcccgatattatagcgtgtgccaagcaaaacatcaccacggctgaaatctctgccagagaaggaacaggactggccggtgtgctggcctggctgcaggccacacatcgagcaaatgattag

SEQ ID NO: 26531 - DNA, 540 bp, Artificial Sequence
  Description of Artificial Sequence: Synthetic coding sequence
atgggccagctgattgctaagttgatgagtatcttcggcaaccaggagcacacggtcataatcgttggcctagacaacgagggcaaaaccacaatactgtaccggttcctgacaaatgaagtggtgcacatgtgtcctactattggctctaacgtggaggaaataatactgccaaagacacatttctttatgtgggatattgtacgacccgaagccttgtcattcatatggaatacttactacagcaacaccgagttcatcatactggtcatcgatagcactgacagagatcgtctgctgaccacacgcgaagaactctacaagatgctggcacatgaagccctccaagatgctagtgtgctaatttttgccaataaacaggacgtgaaggacagcatgagaatggtcgaaatttctcacttcctcaccttgtccactataaaagatcacagttggcacatccaaggatgttgcgccctgacccgcgagggtctacccgctaggttacagtggatggaaagccaggccgcagccaattag

SEQ ID NO: 26532 - DNA, 540 bp, Artificial Sequence
  Description of Artificial Sequence: Synthetic coding sequence
atgggtcaactgattgcgaagctgatgagtatcttcggcaaccaggaacataccgttatcatcgttggactcgataacgaaggcaagaccacaatactgtatcggtttctcacaaatgaagtggtgcatatgtgcccaaccatcggaagcaatgttgaggaaatcattctgcctaaaacgcatttcttcatgtgggacattgttaggccagaggcgctttcttttatctggaatacctattacagcaataccgaatttattattctcgtgattgactccaccgaccgcgataggctgctgactactcgcgaagagctgtataaaatgctcgcccatgaagctctgcaggatgcctccgtgctcattttcgcgaataagcaggacgtgaaggattctatgcgaatggttgaaatttcacatttcctcaccttatctactatcaaagatcactcttggcacatccagggatgctgtgctctgacacgggagggactacccgctcgcctccagtggatggagagccaggctgctgcgaactag

SEQ ID NO: 26533 - DNA, 3936 bp, Artificial Sequence
  Description of Artificial Sequence: Synthetic coding sequence
atggatctgtttgattttttcagggactgggatcttgagcagcagtgtcattacgaacaggataggtccgccttgaagaagcgtgagtgggagaggaggaaccaggaggtgcaacaggaagacgacctctttagctccggcttcgacctgtttggggagccgtacaaggtggccgagtatacaaacaagggcgacgctctagcaaaccgcgtccagaatactttagggaactacgatgaaatgaaaaacctgctgactaaccacagtaaccaaaaccatctcgtaggaatccccaaaaactctgtcccccaaaacccaaataacaaaaatgagccgagtttctttcctgaacagaagaatagaatcataccaccccaccaggacaatactcatccatccgcgcccatgcccccaccatctgtggtcatactgaactcaactttgatccactctaacaggaaatcaaagcccgaatggtcacgcgattcacataacccatccactgttctcgcctcgcaggccagcggtcagccaaacaagatgcagaccctgactcaagaccagtcgcaagcaaaacttgaggactttttcgtgtaccctgctgaacagccccagattggggaagtggaagagtcgaatccgtccgcaaaggaggactcaaacccaaacagttccggcgaggacgccttcaaagagatcttccagtctaactcgcccgaggaatcagaatttgccgtgcaggctcccggctcacccttagttgcatcatccctcctagctccgtcatccggtctgtctgtgcagaactttccacccgggctttattgcaagaccagcatggggcaacaaaagccaacagcctatgttaggccaatggacggacaggaccaggcacctgacatctcccccacactgaaaccctctattgagtttgagaactctttcggtaacctgtccttcgggactctgttagacggcaagccgagtgctgcaagttctaagacaaaactgccaaagttcacgattcttcagacatccgaggtaagtctcccatcagatccatcctgcgtggaagaaattctgagggagatgacccactcttggcctaccccattgacatctatgcataccgctggccattctgagcagtcgacgttcagcattcccggacaggagtctcagcacctgactcccggcttcactctacagaagtggaacgacccaacaacacgagccagtacgaagtccgtgtccttcaagagcatgctcgaagacgatctgaagctctcatcagatgaagatgaccttgaacctgtgaagaccctgacaacccaatgtacagccacagagctgtatcaagctgtcgagaaggccaaaccaagaaataaccccgttaatccccctcttgccaccccacaaccccccccagcggttcaagcctccggcggcagcgggtctagttctgagtccgagtctagctctgagtcagactcagataccgagtcatcaactaccgactctgaatcgaacgaagcgcccagagtagccacacctgaaccggagccccctagcactaataagtggcagctggataagtggctcaacaaagtgactagccagaataagtcatttatttgtgggcagaatgagacccctatggagacaatatcccttccgccacctattattcagccaatggaggtacaaatgaaagtcaaaaccaatgcatcacaggtccctgctgagccaaaggaacgaccattactttctctcatccgtgagaaggctcgacctcgcccgacacagaaaattcccgagaccaaagctcttaaacataagctcagcaccacctctgagacagtcagtcagaggacgattggaaagaagcaacctaaaaaggtggaaaaaaacacctcaaccgacgaatttacgtggccaaagcctaacattacttccagcacccccaaagagaaagagagcgtggagttgcacgacccaccgagagggcgtaacaaggcgacggctcacaaacccgctcctcgtaaggaacctcgaccgaatatccctctggcccctgaaaaaaaaaaatacagaggcccggggaagatcgtgcccaaaagccgagagtttatcgagaccgacagcagcacaagtgacagtaacaccgaccaagaggagaccttacagatcaaggtgctgcccccttgcattatttccggaggcaacaccgctaagtctaaggaaatctgtggcgccagcctgacgctgtctacccttatgtcaagctccgggtccaataacaacctcagtatcagtaatgaagaaccgactttctctcccatccccgtgatgcagacggagattctatctccacttcgagaccatgagaacctgaaaaacctctgggtcaagatcgacctggacctcctgtccagggtgcctgggcactcttcgctccatgccgcccctgccaagcctgatcacaaagagacagccactaagccaaaaaggcagactgccgttacagcggtggaaaaacctgcccccaaggggaagaggaagcataaaccgattgaggtggccgagaaaatacctgagaaaaaacagcgacttgaggaggcgacgacgatttgcctcctgccaccttgtatttctcctgccccaccccacaagccgcccaacacccgtgagaataattcttcacgcagagcgaacaggcgcaaagaggagaaattgtttcctccccccctgagtcccctccccgaggatcctccccgtagacggaatgttagtgggaataatggccctttcggacaggacaagaatattgcgatgaccggccagattaccagtactaagcccaagagaactgaaggcaaattctgtgctactttcaaggggatctccgtcaatgaaggagacacacctaagaaagcttcctctgccaccatcactgtcaccaatacggctatagctacagcgacggtgactgccaccgccattgtgaccacaactgtgactgccactgccactgccactgccaccacaactacaactactacaaccattagcacaatcacctcaaccatcaccaccggacttatggatagcagtcacctggaaatgacgtcctgggccgctctgcctctgctttcctctagctctaccaacgttcggcgcccaaaactgaccttcgacgatagcgtgcacaatgcagactattacatgcaggaagccaagaagctcaaacataaagctgacgccttgtttgaaaagtttggcaaagccgttaactacgctgatgcagccttgtccttcaccgaatgcggaaacgctatggagcgcgatcctctggaggccaaatcaccttataccatgtacagcgagacagtagagctacttcggtacgccatgcggctcaaaaactttgctagcccactggcctctgacggcgacaagaaactggccgtgctctgttataggtgcctttcactgctctacctgcggatgttcaagctcaaaaaggaccacgctatgaaatatagccgcagcctgatggaatactttaagcaaaatgcctccaaagtcgcccaaatacctagcccctgggtgtcaaacggaaagaatacccccagccccgtgagcctcaataatgtgagcccaataaatgctatgggcaactgtaataacggtccagtgaccatccctcagcggattcaccacatggcagcttctcacgtgaacataacttccaacgtcttgcggggatacgaacattgggacatggctgacaagctgacacgcgaaaataaggaatttttcggcgatttggacactctgatgggcccacttacacaacactcatccatgaccaatctcgtgagatatgtgagacaggggctttgttggctccgaattgacgcccatctactttag

SEQ ID NO: 26534 - DNA, 3831 bp, Artificial Sequence
  Description of Artificial Sequence: Synthetic coding sequence
atggacctgtttgatttttttagagattgggatttggagcagcagtgccattacgagcaggatcggagcgcactgaagaagcgcgagtgggagagacgaaatcaggaggtgcagcaggaagatgacttgttctcgagtggatttgacttgttcggggagccctacaagacgaataaaggggatgccctggccaatcgcgtgcaaaatacactgggcaattacgatgagatgaagaatctcctgaccaatcatagtaatcaaaatcacctcgtcggcattcccaagaattccgtccctcagaatccaaataataagaacgagcccagcttctttcctgagcagaagaataggatcatccctccccatcaagataacacccacccatccgccccgatgccgcccccatccgttgtcatcttaaactccacccttatccactccaatcgtaagtccaagcccgagtggtctagagactctcataaccctagtaccgtgttagcctctcaagcatctgggcagcctaacaagatgcagactctgactcaggaccagtcccaggccaagctggaagacttctttgtgtatcctgcagagcagccccagatcggcgaggttgaggagagtaatccaagtgcgaaggaggactcaaacccaaatagctctggcgaggacgcctttaaggaaatctttcagagcaatagcccagaagagtcagagttcgccgtacaggcccccggatcacctcttgtagcttccagcctgctggctccttccagcggactgagcgtccagaactttccaccaggcctttattgcaaaaccagtatgggccaacaaaagcccaccgcctatgtgcgacccatggacggacaggatcaggcccccgacatcagtcccactctgaagcccagcattgaattcgaaaactcattcggtaacctatctttcggtacgctgctggacggcaagcccagcgctgcctcttccaagactaaattacctaagttcactatacttcaaacatcagaagtgtcgctgccctccgacccatcttgtgttgaagaaatcctgcgcgagtcccaacatctcacgccagggttcacccttcagaaatggaacgacccaaccactcgagcgagtacaaagtcagtatcgtttaaaagcatgctcgaagacgacttaaaactttctagtgatgaggacgatctggagcctgttaagacattgaccacccagtgcacagcaactgagctttaccaggctgtggaaaaggccaaacctcggaataacccagtgaaccctcccctggcgaccccacagcctcccccagcagtgcaggcatcaggtggttctggcagctcctcggaaagcgaatcttcctctgagtcagactctgataccgagtcctccacaaccgattccgaaagcaacgaagccccacgcgtggcaacccccgaacccgaaccaccgtccacaaacaaatggcagctggataagtggctgaataaggtcacctctcaaaacaagtctttcatctgtggccagaacgagacacccatggagacaatatcactacctccgcccattatccagccgatggaagtgcaaatgaaggtgaagacaaacgcctcccaggtgccagctgaaccgaaagaacgcccgcttctttctctgatcagggagaaggcacgcccaaggcccacgcaaaagatcccggagaccaaggctttgaaacacaaactgtcaactacaagtgagaccgtgagccagaggacgatcggcaaaaaacagcccaaaaaagtggaaaaaaacactagtactgacgaatttacgtggcccaagcccaacattaccagtagcaccccgaaggagaaagaatctgtggaactgcatgacccacctagagggagaaataaagccacagcccataaacccgccccgaggaaagagccccgccccaacatccccttggctccagagaaaaaaaaatatcgtggcccaggaaaaatcgtgccaaagtcccgggaatttattgagactgattccagtacaagcgattcaaatactgaccaagaagagacattgcagattaaagtgctccccccctgcatcatttcaggcggcaacaccgcaaaatcgaaggagatctgtggagcttcgctgaccctgtctaccctcatgagcagctcgggcagtaataacaacctttcaatatccaacgaagagccaacattcagccctatccccgtaatgcagaccgaaattcttagccctttgagagatcacgaaaatctgaagaatttatgggtgaaaattgacctcgatctgctgagtcgagtgcccggacattcttcactccacgccgcccccgcaaaaccagatcataaggaaacagcaactaaaccaaagcgccagacagctgtgaccgcagtagagaaacctgctcctaaaggcaagcgaaaacacaagcccatagaagtggcagagaagataccagaaaagaaacagaggcttgaagaggcaaccactatttgcttgctgcctccttgtattagtcccgcaccccctcataaacctcctaacacgcgcgagaataactcttcaagaagagccaaccgacggaaggaagagaaattgtttccacccccactgagcccattgccagaggacccaccgcggaggcggaatgtgagtgggaacaatggacccttcgggcaggacaagaacatcgccatgacaggacaaattacaagcacgaaaccaaagagaaccgagggaaaattctgcgccacctttaaaggcatttccgaaggtgatacccctaagaaagccagctccgccaccatcactgttacaaacaccgctatcgcaactgctacagttaccgctacagccattgtgacaacaaccgtcactgccaccgccactgctacggccacaacaacaactactactacaaccatcagcactatcacttcaaccattacaaccggtcttatggattcttcacatctcgaaatgactagttgggcagcattgcccctcctctcttcatcctccactaacgtgcgccggcccaaattaacattcgatgacagtgtgcataacgctgactattacatgcaggaagctaaaaaactgaagcataaggccgacgcgctctttgagaagttcggcaaggccgtaaattacgcagacgccgctctttcatttacggagtgtggcaacgccatggagcgggaccctctcgaagctaaaagtccgtacaccatgtacagcgagacggtggagttattaaggtacgcgatgcggttaaagaattttgcttccccccttgccagcgatggcgacaagaagcttgctgtcctgtgctatcgttgtctatccctcttatacctgagaatgttcaagttaaaaaaggaccacgcaatgaagtactctaggtccctcatggagtactttaaacagaatgcctccaaagtcgctcagattcctagcccctgggtctcaaacggcaagaacacacccagcccagtgtctcttaataatgtcagcccaatcaacgcgatgggaaactgtaacaacggacctgttacaattccccagagaatacaccacatggccgcctctcacgtcaacatcacgagcaacgtactaaggggctatgaacactgggatatggcggacaaactgacccgagagaacaaagaattcttcggtgatctggacaccctcatgggtcccctcactcagcactcttcaatgacgaatctggtgagatacgtgaggcaagggctgtgctggctgcggatcgatgcccacttgctgtag

SEQ ID NO: 26535 - DNA, 1332 bp, Artificial Sequence
  Description of Artificial Sequence: Synthetic coding sequence
atgacgcggccccgcaaacatgccgagaccctcggcgggggaaagttatgcgacctattttgcggaagacccgggcaagtgagctccagtcgcgggcgtcaaggcatacccgatatggagcccattgttcacatccatcaggaactgctgacaggaatagaatctgaagcttcacttagcaagctgagccccactagccagaagggaacatcctcgtcttccagctacattttccagaagatttcccaggggaaacagatgtgccagaaacttaaagagcagactgaccaacttaagacaaaagttcaggaattcagcaaaaggatcaaacaggacagcccctatcacctgcaagataagaaactggtactggagaaactgcagggacacctggagctattggagcagaacttcctggccacaaaagataagcacttgacccttcagcagcaggtacataaacacgagtctacgatcgtcggcgatttcgatcccgagcgtaaggtcgagggggaaatctttaaactcgaaatgttgctggaagatgttaaagagaaaatggatgaatctaagtacacttccgccccatctttacccgtaagcagcccagtcacactggacgacctcgcctcaaccttctcatccctttccaacgaaatacccaaagagcacccaggacatcctagtgggcctagaggctcaggcggaagcgaagtgacaggcactccccagggagggccccaggaggcacccaacgaagaactgtgcgagctggccccacaaacgtatctgaacggccactatggtgacgctgccgctcagaacaagccagatcaggtggctatgcgcctctctagcaatagtggggaagacccaaacggtacacctaggcgccaagactgcgccgagatgacagcgccttcaccaagctgcgcattttgtcgccgcctactggaatggaaacagaatgtggagaaaaagggacacggccgaataaattgtggccggttttccattgtgctgcacgaaaaagccccacactctgactcaactccaaatagcgacacgggtcacagtttctgctctgactccgggactgaaatgcagtcgaataaatgccaggattgtgggaccaaaatccccacgagccgcagggcatgtcgtaaagagccaactaaggagttccattacaggtacaacactcccgggcagaattactcaaatcacagcaaacgcggggcctttgtccagcctcattccctagatgaatctaagaatagctctccctgtaaatatatctcctgcatgacaccctcaatctcaaccacctag

SEQ ID NO: 26536 - DNA, 2169 bp, Artificial Sequence
  Description of Artificial Sequence: Synthetic coding sequence
atggacgaggcagacttttccgagcatacaacctacaaacaggaagatctgccttacgatggcgatctaagtcagatcaagattgggaacgactacagtttcaccagcaaaaaagatgggcttgaagtactcaatcagatcattttcattgcagatgacccccaagaaaaggcaatgcacagtgagacctgcggcaacactgccgtcacaatacctctggggaagatcaccgaaaacgccgctaacaaaaaggacgagaaagagaagcagtgcactgcagcgcttcacattcctgccaatgaaggcgatgcctccaagagcagcattagtgacatactgttgcaccacctcagtaaagaacctttcctgcgaggacagggtattgattgcgaaacactgcctgaaatcagcaatgcagattcttttgaagaagaggccatcatcaagagtatcataagctgctacaacaaaaattcctggccaaaggagcagactcctgagctgacagaccagcttaaccctaagagagacggagagaattctaacaagcctggatcggccacgactaccgaggagaacacctccgacctggaggggccagtggctgcgggcgatagtagccaccaggaaaatgtgaatgtgctgacaaaaactaaagggcctggagacaagcagaagagctatcaaggtcagtctccacagaagcagcagactgaaaaggccaattctggcaatactttcaagtatggacaggggcaggtgcattaccagctgcccgacttttcaaaaatcgctccaaaagtgaagatacccaagaacaaaatcatcaacaaacctctcgccattgcaaaacaggcgtcattttcctcaaagtcccgagacaagccaactttagttcaagatagtttggagaccacccccgaatcaaactgtgttgagaagcagcatcaggaacagaaggggaaaataaccgagccgtcgcaacaaattcagatggagcctatcgtccatatccatcaggaactacttacaggtattgaatcagaagcttcccttagcaagctttcgcctacgagtcagaaaggaaccagctcttcttctagttacatcttccagaagatctcccagggaaagcaaatgtgtcagaaacttaaagaacagaccgaccagctgaagacaaaagtccaggagttcagcaagagaatcaaacaggattccccttaccacctgcaagacaagaaactggtgctggagaagctgcagggccacttggaacttttggaacagaattttctagcaactaaggataagcacttgaccctgcagcagcaggtgcataagcacgaaagtacgattgtgggagattttgatcccgagcgaaaagtagagggagagatattcaaactcgagatgctccttgaagatgtcaaggagaaaatggacgaaagcaaatacacctctgccccatccctaccagtcagtagccccgtgactttggacgacctagcctctacctttagcagcctcagtaacgaagccccaaacgaggaattatgcgaactggccccacagacatatctgaacggacactacggcgacgctgccgcgcagaataaacctgaccaggtggctatgagactgtctagcaatagtggcgaggaccctaacggaacgccgcgcagacaggactgcgctgagatgactgcacccagccccagctgcgccttttgcagaagactcctggaatggaagcagaacgtagagaagaaaggacatggccggattaattgtggcagattctccatcgttctgcacgagaaggctccccacagtgacagtaccccgaactccgatacgggccactccttctgctctgattcaggcaccgagatgcagtccaacaagtgccaggactgcgggaccaagattcccacctcacggagggcttgcagaaaagagcccacaaaggaatttcactataggtataatacaccaggccaaaattattcgaatcactccaaaagaggggcctttgtgcaacctcattccctggatgaatccaagaatagtagcccctgcctggtgcactcgccagacacgagtaaaagtagccctacaagtggatggcaggaagcagagctgggacttgagaacatgaagtcccagtag

SEQ ID NO: 26537 - DNA, 2286 bp, Artificial Sequence
  Description of Artificial Sequence: Synthetic coding sequence
atggatgaggcagacttctctgagcacacaacttataagcaggaagacttgccttatgatggagatctgtcgcagataaagatcgggaatgattacagcttcaccagcaaaaaggacggactggaagtcttaaatcagatcatcttcattgcggacgacccacaggagaaggctatgcactctgaaacctgcggtaataccgcggtaaccatccccctgggaaagatcacagaaaatgcagccaataaaaaggacgagaaggaaaaacagtgcactgcagcactgcatatacctgctaatgagggggatgcctccaagagtagcatatctgacatattactgcaccacttgagtaaagagccattcctacgcggacagggcatcgattgtgagacactgcctgagatcagtaacgcagattctttcgaagaggaagcaattatcaagagtatcatatcatgttacaataagaactcatggcccaaagagcagaccccagaactcactgatcaactgaatcctaaacgagacggcgagaacagcaacaaacccggctccgcaaccaccaccgaagagaacacatccgatttggaagggcctgtcgcagccggcgattcctcacaccaggagaacgtcaatgtgctgactaagactaaaggtccgggcgacaagcagaagtcttatcagggccagtcccctcagaaacagcagacagaaaaagccaactcgggaaacacttttaaatacggtcaaggtcaggttcattatcagctgcctgacttttctaagattgcccctaaagtcaagatccccaaaaacaaaatcatcaacaagccactggctattgctaagcaggcttccttttcctccaagagcagagacaagcctacattggtgcaggattcactggagaccaccccagaaagtaattgcgtcgagaaacaacatcaggagcaaaaaggaaaaatcactgagccctctcagcagatccaaatggagccgatcgtgcacatccaccaggagctactgacagggattgagtctgaggccagccttagtaagctgagtcccactagtcaaaaaggaacctcctcctcatcttcatatatattccagaagattagtcagggcaaacagatgtgtcagaagctgaaagagcagacagatcaacttaagaccaaggtgcaggaattctctaagagaatcaagcaggacagcccctaccacctgcaagacaagaagctcgtgttggaaaaactccaggggcacctcgaattgctggagcaaaacttcctggcaaccaaagacaagcatctcaccctgcaacagcaggtccataagcacgagagcacgatagttggggactttgaccctgaacgcaaggtggagggagagattttcaaactagagatgctgctagaggatgtcaaagagaagatggatgagtcaaagtacactagcgcaccatccctgccagtgagttcccccgtgacattggatgatcttgcatcaacattcagctctctgagcaacgagataccgaaagagcaccctggccaccccagtggaccccgaggcagcggcggttccgaagtgacagggaccccacaggggggaccccaagaggcccccaatgaagagctgtgtgagttggcacctcagacatatctgaacgggcattatggcgacgcggctgctcagaataagcccgatcaggtcgcaatgagactttctagcaattcgggggaggatccaaacgggactcccaggcgacaggattgcgctgaaatgaccgctcctagtccctcctgcgccttttgcaggaggctccttgagtggaagcagaatgtcgagaagaagggccacggaagaatcaactgcgggaggtttagtatcgttctacacgagaaggcacctcactcagattcaacccccaactctgataccggccatagtttttgctcagattcgggcacggagatgcagagtaacaagtgtcaggattgtgggaccaaaattcctacctctaggagggcttgcaggaaggaacccactaaggaatttcattaccggtataatacgcctggacaaaattatagcaatcacagcaagcgaggagctttcgtgcagccgcactcactagacgagtctaagaactccagtccgagccttgcttctcccttctgttgtcctggtttggtacactctcccgataccagcaaaagctctccgaccagcggctggcaggaggcagaattagggctagaaaacatgaaatcccagtag

SEQ ID NO: 26538 - DNA, 2511 bp, Artificial Sequence
  Description of Artificial Sequence: Synthetic coding sequence
atggacgaggccgatttctcggagcatactacctacaagcaggaggatctgccctacgatggcgacctgagtcagattaaaatcggcaacgattatagttttactagcaagaaggacgggcttgaagtcctgaaccaaatcattttcatcgcagatgacccacaggagaaagccatgcactcagagacttgtggaaataccgctgtgactatccccttagggaagatcactgagaatgcggcaaataagaaggacgaaaaggagaaacagtgcactgcagccctgcacataccagctaacgaaggggacgcatcaaagtctagcatctccgacatcctactgcaccacctgtccaaggaacctttcctgaggggtcagggtatagactgtgagactctcccagaaatcagcaatgctgacagctttgaggaggaggccatcattaaaagcatcatctcctgctataacaagaatagctggcctaaggaacaaacccccgaattgactgatcagctgaaccctaaacgagatggagagaacagcaacaaaccagggagtgccacaactaccgaggagaacacgagtgatctggaggggcccgtagccgccggcgattccagccaccaggaaaatgtgaatgtcctgaccaagaccaagggacctggggataagcaaaagagttaccagggtcaatcacctcaaaagcagcagacagagaaggcaaactcagggaacacattcaaatacggacagggacaagtgcactatcaactgcctgatttctcgaaaatagccccaaaggtcaagatccccaaaaataagatcatcaataagccactggccattgcaaagcaagctagtttcagtagcaagagccgtgataagccgacccttgtgcaggacagcctcgagacgacacccgaatccaattgcgtggaaaaacagcatcaagaacagaaaggcaagattaccgagccatcccagcagatccagatggagccaattgtccatattcaccaggagctcctcacaggaatcgaatccgaggcctcacttagtaaactcagtccaaccagtcagaagggcactagtagctcttcgtcttacattttccaaaagatcagtcagggtaaacagatgtgtcagaagcttaaggagcaaacagaccagctgaaaacaaaggttcaggagttttccaaacgtattaaacaggacagcccctatcatctgcaggacaagaagttggtacttgaaaagctgcaaggccatctcgaactgctggaacagaatttccttgccaccaaggacaagcacctcactctccagcagcaggtgcataaacatgaatccaccatcgtgggtgactttgaccctgaacgaaaggtagaaggagaaatctttaaactggagatgcttttggaggatgtcaaagagaagatggacgagtccaaatacacgtcggctcccagcctgcctgtctcttcacccgttacactggacgatctggcctccacttttagtagcttgagcaatgagatacctaaagagcaccctggccacccgagcggacctcgtggcagcggcggcagcgaagtgacaggaacaccccaaggggggccccaagaagcaccaaatgaagagctctgcgagctggcccctcagacatatttaaacggtcactatggggatgcagcagcccagaacaagccggatcaggtggccatgagactcagtagtaattcaggggaggatccaaacggaacccctcgaaggcaagactgtgcagagatgacggccccttctccatcctgcgcattctgcagacgattgctggaatggaagcaaaacgtagagaaaaaagggcacggccgaataaattgcggccgcttttcgatcgttttacatgagaaagcgccgcattccgactccaccccaaacagtgacactggccactcgttttgcagtgattctggaactgaaatgcagtcaaataagtgccaagactgtggcacaaagatcccaacctctaggagagcatgtagaaaagaacctaccaaagaatttcattacagatataacactcctggacaaaactattccaaccattccaaacggggggcctttgtacaacctcacagcctcgatgagtcaaagaattccagtccttctttcctgaagccaaagcgaatctgctcccagagggtgaacagcaagtcctttaagggcgagcatgaacccactcctggtaagaaaaaactgcaggccttcatgacatactcctccgatccggccaccccgagtccacacttctatagttgccgtatttccgggtcaaagtccctgtgcgactttgattccactgaggagatcaaaagtgagatactgaacagcgccctcgatcacgccctgagaaccgccacaattctcaaggagaccaccgaccagatgatcaaaactatagccgaggacctggctaaagcccaacggtggaggaaccgactaaagtactag

SEQ ID NO: 26539 - DNA, 1035 bp, Artificial Sequence
  Description of Artificial Sequence: Synthetic coding sequence
atggtgctgcagatggagccacaggtgaatagtaccaacaatttccaccagggacccctggatcagcctgtggggcctctgactggactgaaaagcagtcttctgaaggacactacaagtgccggacccctcctgcgaccctacccagcgagtctgctcggcaaggttaaggaagcagtcaaagtggcaatcgacgctgagtacaggcacattgactgcgcttatttctacgagaatcaacatgaggttggggaagctatccaggaaaagatacaggagaaagccgttatgcgggaagatctgttcattgttagcaaggtttggcccacattctttgaacgacccttggtccgaaaagcattcgaaaagaccctaaaggacttaaaactctcctacctggatgtctacctcattcactggcctcagggtttcaaaacgggcgacgatttttttcctaaagatgacaaaggtaacatgatctctgggaaaggcaccttcctcgatgcatgggaggccatggaggagctggtggacgagggtctggttaaagctttgggagtatcaaacttcaaccattttcagatagagcgcctgctaaacaaacccgggctcaagtataagccggtgactaatcaggtcgagtgtcatccatacctgacccaggagaaactcatacaatactgccactccaagggaattactgtgaccgcctactcccccttggggtcaccagacaggccttgggcaaaaccagaagatccatcgctgttggaagatccaaagatcaaggagatcgctgccaaacacaaaaaaaccactgcacaagtgttgattcgcttccatattcaacggaacgtcactgtgatccctaagagcatgacacctgctcatatcgtggaaaacatccaggttttcgacttcaaactgtcagacgaggaaatggcgaccatcctatctttcaataggaattggcgcgcctttgacttcaaggagttttcacatttggaggattttcctttcgacgctgaatattag

SEQ ID NO: 26540 - DNA, 972 bp, Artificial Sequence
  Description of Artificial Sequence: Synthetic coding sequence
atggattcgaagtatcaatgcgtgaagttgaacgacggacactttatgcctgtccttggcttcgggacatacgcacctgccgaggttccaaaaagcaaagcccttgaggccactaagctcgctatcgaggccggctttcgacacattgattccgcgcacctgtataacaacgaggagcaagtgggtttagctattagaagtaagatcgccgatggaagcgtgaagcgggaagacattttctatacctccaagctctggtgcaatagtcatcggcccgagcttgtacgcccagccttagagcgatccctgaaaaacctgcagttggattacgttgacctatacctgattcattttcccgtgagcgtgaagcccggtgaggaagtcatacccaaggatgagaatggaaaaatcctgttcgacacagtggatctgtgcgctacttgggaggcagtggagaagtgcaaagacgcgggtctggccaagtctattggcgtgtctaacttcaatcgtaggcagctggaaatgattctaaacaagcctgggctgaaatacaagccagtttgtaaccaggttgagtgccacccctacttcaaccagaggaaattgctagacttttgtaagtcaaaagacatcgttttagtcgcctacagcgctctcggctctcatcgcgaagagccttgggtggaccccaatagtcccgttctcttggaagacccagttctatgcgctctggccaagaaacacaaacgaacccccgccctgatcgcccttagatatcagctgcagcggggggttgtggtccttgcaaaaagctacaacgaacaacgaatacgtcagaacgtgcaggtgttcgagttccagctgacttccgaagagatgaaggctatagatggcctcaacagaaacgtgcggtacttaaccctggacatcttcgccggccctcccaattatccttttagcgacgagtattag

SEQ ID NO: 26541 - DNA, 972 bp, Artificial Sequence
  Description of Artificial Sequence: Synthetic coding sequence
atggatagtaagtaccagtgcgtcaagctcaatgatgggcattttatgcccgtgctcggtttcgggacttacgccccagctgaggttcctaagtcgaaagcccttgaagctgtgaaattagcaattgaggctggcttccatcacattgatagtgctcacgtctacaacaatgaggagcaggtgggtttggcaatcagatcaaagatcgccgatggctctgtaaagagggaagatattttctatacttccaaattatggtcaaattcccatcgaccggagctcgtgcgccctgctttggagagaagcctgaaaaaccttcagttggattatgtggatttgtacctgattcattttcccgtgagtgttaaacctggagaagaagtgatccccaaggatgagaatgggaagatactgttcgacaccgtggacttgtgtgctacctgggaggcaatggagaagtgtaaggacgccgggctcgcaaaatccattggagtctccaactttaaccacaggctcctggagatgatcctcaataaacccggactcaaatataagcccgtgtgtaaccaggtagagtgtcacccctatttcaaccaacggaaattattagacttttgcaaatcgaaagacatcgtgctggtagcctatagcgccctgggctctcatagagaggagccctgggttgatcctaacagtcccgttctcttagaggaccctgtgctttgcgcgctcgctaagaaacataagagaactcctgcactgattgctctcaggtaccaactacaacggggggtcgtggtgctcgctaagagctacaacgaacagcggatccgccaaaatgttcaggtattcgaattccagttgacaagtgaagagatgaaagctatcgacggccttaaccgcaatgtgcgatacctaaccctggatatctttgctggacctccgaattacccttttagtgacgagtattag

SEQ ID NO: 26542 - DNA, 972 bp, Artificial Sequence
  Description of Artificial Sequence: Synthetic coding sequence
atggactctaagcatcagtgcgtaaaattgaatgatggccacttcatgccagtgcttggtttcggcacctacgctcctcccgaggtcccgaggtcaaaggcccttgaggtgactaagctagcaattgaggcaggatttcgtcatatcgacagcgcccatctgtataacaatgaggaacaggtggggctggcaatccggtctaagatcgcggacggtagtgtcaaaagagaagacatcttctacacgtccaagttatggtcaacctttcataggcctgaattagttcggccagctctggagaactcactgaaaaaggctcagctcgactacgtcgatctatacctgatccatagtccgatgtcactcaagcctggggaagaattgtctcccacggacgagaacggcaaggtgatattcgatatcgtagacctatgcactacatgggaagccatggaaaagtgtaaggatgctggcctggccaagtcaattggcgtgtcaaacttcaacagaaggcaattagaaatgatcctgaataaacctggactcaagtataagcctgtgtgtaatcaagtcgagtgccacccctacttcaaccgaagcaaactgctggatttctgtaaatccaaagatatcgtgttggtcgcttactccgcactgggctctcagcgggataagcgctgggtggaccccaattcacctgttttactggaggatcccgtgctgtgcgcactggccaaaaagcataagagaacaccagccttgatcgcactccgataccagttacagcggggcgtggtggtgctagccaagtcctacaacgagcagcgcatcaggcagaacgtccaagtgttcgagtttcaacttacagccgaagacatgaaggccatagacgggcttgatcggaatctgcactatttcaacagcgactcttttgcgagccaccccaattacccctattccgacgagtattag

SEQ ID NO: 26543 - DNA, 972 bp, Artificial Sequence
  Description of Artificial Sequence: Synthetic coding sequence
atggatccaaaataccagagagtggagctgaacgatggacactttatgcctgtcctaggcttcggcacctacgctcctcccgaagtgcctaggaatcgcgccgtggaggtaaccaaactagcaatcgaggcgggcttccgtcatatcgactctgcatacctctacaataatgaggaacaagtgggcctcgccattcggagcaagattgccgacggatccgtgaagcgagaagatatcttttacacttctaaactctggtgtactttcttccagccccagatggtgcagccagctctggaatcaagcctgaaaaagctccagcttgattatgtggacctgtacttgttacatttccccatggccctgaagccaggcgagacaccactgccaaaggacgagaatgggaaagttatcttcgatacggtggatctaagtgcaacctgggaggttatggagaaatgcaaagatgctggcctcgccaaaagcatcggtgtgtccaacttcaactgtaggcagctcgaaatgattctcaacaagcccggcctcaagtacaaaccagtgtgtaaccaggtcgaatgtcatccatacctaaatcagagtaagctgctggacttttgcaagtccaaggacatcgtgttagtagcacattcagccctgggcacacagagacataagctgtgggtggacccaaattcacctgtgctgcttgaggatccagtgttatgcgccttggccaagaagcacaagcagaccccggctctgattgcccttaggtaccagctccagagaggagttgttgttcttgcaaagtcctacaacgagcaaaggattcgtgaaaacatccaggtattcgagtttcaactgacgagcgaggatatgaaagtactcgacggtctgaaccggaattacaggtacgtcgtcatggacttcctcatggatcatcctgactacccattcagcgatgaatactag

SEQ ID NO: 26544 - DNA, 972 bp, Artificial Sequence
  Description of Artificial Sequence: Synthetic coding sequence
atggatcccaagtaccaacgggtggagttaaacgatgggcacttcatgcccgttctgggcttcggcacctacgcccccccggaggttcctagaaatagggccgtggaagtcacgaaattagcaattgaggcaggatttcgccacattgatagcgcctacttatacaacaatgaagaacaggtggggctggctattagatctaagattgcggatggctctgtgaagagagaggatattttttatacttctaagctgtggtgcaccttttttcagccccagatggttcagcctgcactggaaagcagccttaaaaagctgcagctagattacgtggatctgtatctcttgcattttccaatggctctcaagcccggcgaaacgcccctgcctaaagatgagaacgggaaggttatcttcgatactgtggacttgtccgctacctgggaggtcatggaaaagtgtaaagacgcgggactggcaaaaagcattggcgtttctaacttcaactgccgccagctggagatgatcttgaacaagcccggactaaagtataagcctgtgtgcaaccaggtggagtgccatccttacttgaatcagagtaagctgctggacttttgcaagtccaaggacattgtcttggtggcacactccgccctgggtactcagcgccacaagctgtgggtcgaccctaatagtccggtcctgttagaggacccagtgttatgtgcattggccaagaagcacaagcaaaccccggccttgattgctctgcgataccagctgcaaagaggagtcgtcgtgctggctaaatcgtacaacgagcagcgtattcgagaaaatattcaggtgttcgagtttcagttgaccagcgaagacatgaaggtcctggatggactgaacaggaactataggtacgtcgtaatggatttcctgatggatcaccctgactaccccttctccgacgaatattag

SEQ ID NO: 26545 - DNA, 951 bp, Artificial Sequence
  Description of Artificial Sequence: Synthetic coding sequence
atggccacattcgtggaactgtccaccaaggccaaaatgcccattgtggggctgggcacgtggagaagtctgcttggcaaagtcaaggaggctgtcaaagtcgcaatagacgccgagtatcggcatatcgactgcgcgtacttttacgaaaaccagcacgaggtaggcgaggctatccaggagaagatccaagagaaggccgttatgagagaagatctgtttattgtcagtaaggtttggcccactttcttcgaacgtcctctcgtccgtaaagccttcgaaaagaccctgaaggatctgaaattaagctacttggatgtctacttgatacattggccccaaggttttaagaccggcgatgactttttccctaaggacgacaagggtaatatgatcagcggaaaaggcaccttcctcgacgcctgggaggctatggaagagctggtcgatgaggggcttgttaaggccctcggcgtcagcaacttcaatcacttccagatagagaggctgctgaataagcccggtctgaaatacaagcctgttaccaatcaggtggagtgccacccatacctaacacaggagaagttgattcaatattgtcacagtaaaggaattaccgtaaccgcttactccccgttaggatcacccgatcgcccgtgggcaaaacccgaggacccatccttgctggaagaccccaagattaaggagatcgccgccaaacacaaaaaaacgaccgcccaggttttgatacggttccatattcagaggaacgttactgtgatcccgaaatccatgaccccggcccatatagttgaaaatatccaagtgttcgacttcaagctgtcagatgaggaaatggccactatattgtcctttaacaggaattggcgcgcctttgattttaaggaattctcccacctcgaggactttccattcgacgccgaatattag

SEQ ID NO: 26546 - DNA, 84 bp, Artificial Sequence
  Description of Artificial Sequence: Synthetic coding sequence
aacccgaactggaagagaatcagactcaacgatggccccttcatgcccgtgctaggcttcggcacgtacgctccagaccactag

SEQ ID NO: 26547 - DNA, 462 bp, Artificial Sequence
  Description of Artificial Sequence: Synthetic coding sequence
atgcatcttacaacagccccccggtggaaaagacactgtgtgccagctacgtcctgcactcgcagagcaagctcttggtcccttgcctctccgaccatgccgccaggcaaatggccccgctccgtgcccagcgccagggctaccgcaggttcatgccctctttgcactagcttttggaaggagcaccattttgagggaatcgcactggtggagaaagcattgcaggccgcatacggagccagtgctccctctatgacgtctgctgctctccgatggatgtaccaccatagtcagttacaaggcgcccatggcgacgcggtaattctcggaatgtcgtccctcgaacagctggaacagaacttggccgccgcagaggagggtcctctcgagcctgccgtggtggatgccttcaatcaggcgtggcatcttttcgcacatgaatgccccaactactttatctag

SEQ ID NO: 26548 - DNA, 903 bp, Artificial Sequence
  Description of Artificial Sequence: Synthetic coding sequence
atggagttcccattcgatgtagatgccctctttcccgaacggatcaccgtcttggatcagcacctgcgtcctcccgctcgaagacccggcaccacgacccccgcgcgcgtggatctgcaacaacagattatgaccattatcgatgaactgggtaaggcaagtgcaaaggcacagaacctttccgctcctatcacttcagcaagtcgaatgcagtccaatcgacacgtggtatacatacttaaggatagctccgccagacctgctggaaagggagctatcatcggattcatcaaggtcggttacaagaaactgtttgtcctagacgatcgagaggcacacaacgaggttgagcccttatgtattctggatttctacatccacgaatctgtccagcgtcatggacacggtagagaattattccagtacatgctgcagaaagagagggtggagcctcaccagctagccattgatcggccctcacagaaactcctcaaattcttgaacaagcactataacttagagaccactgttccgcaggtgaacaacttcgtaatctttgaggggttctttgctcaccaacatccacccgccagaaaattacctccaaaaagggcagaaggggatattaaaccgtatagttcctcagaccgcgagttccttaaggtcgccgtggagccaccttggcccctgaatagagctcctaggcgagccacacccccagctcatccccccccccgatcttcaagcctcggtaattctcccgaaagaggcccactcaggcccttcgtgcccgagcaagaactgctgaggtctctgagactgtgccctccacatccaacagcacgtctgctgttggccgccgaccccggcggaagccctgcacagcgcagacgcacgagatag

SEQ ID NO: 26549 - DNA, 933 bp, Artificial Sequence
  Description of Artificial Sequence: Synthetic coding sequence
atggagttcccttttgacgtcgacgctctttttcctgaacggattacggtgctcgaccaacacctgcgacctccagcccggcgcccgggaacgactactcctgctagggtcgacctgcagcagcagattatgactattatagatgaattaggaaaagcctccgcaaaggctcagaacttatccgctcccatcacctccgcctcacgcatgcagtccaaccgccatgtggtgtacatcctgaaggacagttcggcacgacccgcggggaagggagctatcatcggctttatcaaggtgggctacaagaaactgttcgtgctggatgaccgggaggcccacaatgaggtcgaacccctgtgtattctggacttttacattcatgaatccgtccagcggcacggacacggtcgcgaactgttccagtacatgttacagaaagaaagggtcgagccgcatcagctggcgatagaccgtcccagccaaaagctcctcaaatttctgaataaacattataacctggaaaccaccgtgccgcaggttaataattttgtgatttttgagggattcttcgctcatcagcacccccctgctagaaagctgccacctaaaagggccgagggcgacattaagccgtactcctccagcgatagagaattcctaaaggtggccgttgagcctccctggcccctcaatagagccccccgtcgtgctacaccgcctgcccatccaccacctcggtctagttccttaggtaactcccccgaacgcggacctctgcgccccttcgtgcccgagcaggagctcctgagatccttgcgcctctgcccacctcacccaactgctaggctactccttgcggccgacccgggaggatcaccagcccagagaaggcgaacgtcatccctgcccaggagcgaggaatccaggtactag

SEQ ID NO: 26550 - DNA, 1002 bp, Artificial Sequence
  Description of Artificial Sequence: Synthetic coding sequence
atggaattcccctttgatgttgacgcactattcccagagaggattaccgtcctggatcagcacctgcggcctccggcccggagaccaggaactacaaccccggctagagtagacctacagcaacaaataatgactatcatcgacgaactgggaaaggcgagcgcaaaggcacagaacctcagtgccccaataactagcgcgtcccgcatgcagagtaatcggcacgtggtgtatatccttaaagattccagtgctcggcctgccgggaaaggagctattatcggattcataaaagtgggctacaagaaactcttcgtactggacgaccgagaagcgcataatgaggtggaacccttatgcatcctggacttttatatccatgagagtgtgcagcgacacgggcatggacgcgagctcttccagtacatgttgcagaaagagcgcgttgagcctcaccagttagccatcgataggccgagtcaaaaactcctgaaattcctgaataagcactacaatttggagaccacagtccctcaggtgaacaactttgtgattttcgagggcttcttcgcccatcagcacaggcccccagcccctagcttacgggccacaaggcattcacgcgctgcagctgttgaccctacccccgccgcccccgcccggaagctgccacccaaacgcgctgagggcgacattaagccctacagtagttctgatcgcgagtttctgaaagttgctgtcgagcctccctggccgttgaatagagcaccacgacgagctaccccccccgcgcacccacccccacgatctagctcactggggaactctccagaaaggggccccctgaggccctttgtgcctgaacaggaactgttgcggtctctgcggctctgccctcctcatccaaccgccaggctgttgctcgccgccgacccaggtggctcgcctgcacagcgcagaagaacctcctctctgccgcgcagcgaagagtctcggtattag

SEQ ID NO: 26551 - DNA, 1230 bp, Artificial Sequence
  Description of Artificial Sequence: Synthetic coding sequence
atgtggctcacctggcctttctgtttccttaccattaccctccgggaggagggtgtctgccacctggagtccgtagatcttcagcagcagatcatgacaattattgacgagcttgggaaggctagtgctaaggcacagaatttaagtgctcctatcaccagcgcatctaggatgcagtctaatagacacgtggtgtacatcctgaaggattccagtgccagacctgcaggcaagggagccatcatcgggttcattaaggtaggctacaagaagttatttgtgctggacgatcgggaagctcataacgaggtcgaacccctgtgtatactagatttttatatccacgaatccgtgcagagacacgggcatgggagagaactctttcagtatatgctgcagaaagagcgtgtggagccacaccaactggccattgaccgcccttcccaaaagctgctgaagtttctgaataaacactataatctggaaaccactgtgcctcaggtcaataatttcgtcatctttgaaggtttttttgcccaccagcacagaccaccagccccctcgcttagggccacacgccactccagggcagctgccgtagaccctacacccgccgcccctgctcggaaactgcccccaaagagagccgagggagatatcaaaccttattcaagctctgatagagaattcctgaaagtggccgtcgagccgccgtggcccctgaacagagcccccagacgtgcaacacccccagcacaccctccaccgagatcatcatcattgggtaactctccagagcgaggaccgctgagaccctttgtgcccgagcaggagctcctgagatcattgaggctttgccctccccatccgacagctcggcttcttctggccgcggatcctggaggatctcccgcacagcgccggaggactcgcggcacccctccagggctggtagcacagtcttgttgctacagccgtcacggaggtgtaaatagcagcagccccaataccgggaaccaagactctaaacagggggagcaagaaaccaaaaatcgttccgcctcggaagagcaagctttgtctcaggatggaagtggcgagaaaccaatgcacacagctccccctcaagcgccggcccctcctgcccagtcctggacagtcggcggggacatcctgaatgctcgattcattcgtaatctgcaggaaaggcgaagcacaaggccttggtag

SEQ ID NO: 26552 - DNA, 1197 bp, Artificial Sequence
  Description of Artificial Sequence: Synthetic coding sequence
atggaatttccatttgacgttgacgcactcttcccggaacggatcaccgtgctggaccagcacctgaggccacccgcccgccgacccgggactactactcccgcgcgggtcgacctgcaacagcagattatgactatcattgacgaattaggaaaggcctccgccaaagcccagaacctctccgcaccaatcacatccgcaagccggatgcaaagcaatcgccacgttgtttacatcctgaaagattctagtgcccgccctgctggaaaaggcgcaatcatagggttcataaaggtgggctataaaaaactgtttgtgctggacgaccgagaagctcacaacgaagttgaacccctgtgcattctggacttctatattcatgagtcagtgcagcgacacgggcatgggcgcgagctctttcagtatatgctacagaaagagagagtggagccccaccagctggccatcgatcgaccctcgcaaaaactgctgaagttcctgaataagcactataatcttgagacaaccgttccccaggtgaataattttgttatattcgagggtttctttgcccaccagcaccctccagcccggaaattaccaccaaagcgcgctgaaggagatattaagccctatagctctagtgaccgggagtttctgaaggtcgccgtggagccaccctggcctttgaaccgagcccccaggagggccaccccgccagcccaccctccccctcgatcaagcagcttgggcaactctcctgagcgagggcccctgcgcccctttgtgccggagcaggagctgctgcgtagtctgcgactttgccctccccatcccaccgcccgccttctgctcgccgccgaccctggagggtcaccggcgcagagaagaagaacacggggaactccccctggcctggtggcacagtcctgctgctactcccggcacgggggggtgaacagctcttcaccgaacacaggcaatcaagattctaagcagggcgagcaggagactaagaatagaagcgcttctgaggagcaagcattgtctcaggacggttcaggggagaaacctatgcacaccgcccctcctcaggcacccgcccccccagcccagtcctggacagtgggaggcgacatccttaatgctcggtttatccggaatttacaagagcgcagatctaccagaccctggtag

SEQ ID NO: 26553 - DNA, 972 bp, Artificial Sequence
  Description of Artificial Sequence: Synthetic coding sequence
atggagttcccttttgatgtggatgctttattccccgaacgtattaccgtgctagatcagcatttacgtccgcccgcccggaggcccgggactacaacacctgcaagagtggatttacagcagcaaattatgactataatcgatgagcttggaaaagcctcagcaaaggcccagaatctatcagctccaattacttccgcgagccgaatgcagtccaaccgacacgtggtgtacattctcaaagatagctctgctcggcccgcggggaagggggctataattggattcataaaggtgggatataaaaaactgtttgtgctcgatgaccgcgaagcccataacgaagtcgagcccctatgcatactggacttttacattcacgagtctgttcagcggcatggccatggccgagaactgtttcagtacatgctgcaaaaggagcgggtggagccacatcaactggcaatcgaccggcccagccaaaagctactaaaatttctgaacaagcactataatcttgagaccaccgttccacaggtgaacaattttgtgatcttcgaaggatttttcgcacaccagcatagaccccccgcccctagcttgcgtgcaacgcgccacagtcgcgccgctgccgtggatcctacacctgctgcgccggcacgtaagctgcctcctaagcgagccgagggcgacataaagccctattcctcttctgatcgcgagttcctgaaagtggctgttgaaccaccctggcccctgaacagagctcctaggcgagcgacaccacctgcgcacccacctccccggagctcatctctggggaattcccccgagcggggacccctgagaccttttgtaccagaacaggaactacttcgctcgttacgtctgtgtccgccccatcctactgcaaggttgctactggcagccgacccgggcggctcaccggcgcagcgacgtcggaccaggtag

SEQ ID NO: 26554 - DNA, 1266 bp, Artificial Sequence
  Description of Artificial Sequence: Synthetic coding sequence
atggagtttcctttcgatgtagatgccttgttccctgagcgcatcactgtgctcgaccaacacctaagaccccccgcgagacgtccagggacaacgacacctgcccgggttgacttacaacagcagataatgacaattatcgacgagctcggcaaggctagcgccaaagcacagaacctctccgcccctatcacctcagcttcacggatgcagtctaatcgccacgtcgtttacattcttaaggactcctcggcaagaccggctggcaagggggctattatcggatttattaaagtcggatacaagaagctgtttgttctggacgatcgggaggcacacaatgaggtcgaacccctctgcatcctcgacttctacattcatgaaagcgtacaacggcacggacatggacgggaactgtttcagtacatgctccagaaagagcgggtagaaccgcatcagttggctatcgaccggccgagccagaaactgctcaaattccttaacaaacactacaacctggaaaccactgtccctcaggtaaataattttgtaatctttgagggcttttttgctcaccagcaccggccgcccgccccttcactgcgcgctactcggcactcccgtgctgctgccgtcgaccctacaccagctgctcctgccagaaagctgcctcccaagcgagctgaaggcgatataaagccgtactcttcgtctgatagagaatttctgaaggttgccgttgaaccaccttggcctcttaatagggctcctagaagagcaaccccacccgcacaccctccgcctagatctagctccctggggaacagcccggaacggggtcctctcaggccgttcgtgcctgagcaggaactgctcaggtccctacgactgtgcccaccccaccctacagctaggctgctccttgcagcagatccaggaggatccccggcccagagaagaaggaccagaggtactccacccggcttggtggcccaatcctgttgctactctcgccatggaggagtcaattcatcttcacctaacaccggaaaccaggactccaagcagggggagcaggagaccaagaaccgtagtgctagcgaagaacaggcactgagccaggacggatcaggtgagaagcccatgcatacagcgcccccccaagctccggcgcctcctgcccagagctggaccgtaggtggcgacattttaaatgcaaggtttatccgtaatcttcaggaacggaggagcacccgcccctggtag

SEQ ID NO: 26555 - DNA, 1230 bp, Artificial Sequence
  Description of Artificial Sequence: Synthetic coding sequence
atgtggcttacatggccattttgctttctaaccattaccttaagggaggaaggagtatgccacttagagagcgtggacctccagcagcagattatgacaataatcgatgaactcggaaaggccagtgctaaagcacagaatctgagcgcccccattaccagtgctagccggatgcagagtaatcgtcatgtggtgtacatccttaaggattcaagcgcccgtccggcaggcaagggcgctataatcggattcataaaagtaggctataagaaactgtttgtgctggatgaccgcgaagcccacaacgaagtagaacctttgtgtatcctcgacttttacatccatgagtcagtccagcgtcatgggcacggaagggaactgtttcagtacatgctgcagaaggagcgagttgagcctcaccagctagctatcgatcgccctagccagaaactgttgaagttcctgaataaacattacaaccttgaaaccaccgtgccacaggtcaataatttcgttatcttcgagggcttctttgcccatcaacatcgacctccagcccccagcctgagagcaactcgccattcaagagctgcagcagtcgacccgacgcctgcagctcctgccaggaagctgccaccaaagcgggccgaaggcgacataaagccatactcctctagcgatagggaattccttaaggtggcagttgagccaccttggcctcttaaccgcgcaccgcggagggcaacacccccggctcacccacctccccgtagtagctccctcggaaacagccccgaacgcggcccacttcgccccttcgttcccgaacaggaattattgagatcactgcgcctttgtccacctcacccaacagcaaggttgcttctggccgcagatcccggcggcagcccagcacagcgaagaaggacaagaggcactccccctggtcttgttgcacagagctgttgttacagccgccatgggggtgtcaatagttctagtcccaacactggaaatcaggacagcaagcagggcgagcaggagacaaaaaaccggagtgcatctgaagaacaggccctcagtcaggacggctcaggagagaaacccatgcatactgctcccccgcaggcaccggcaccccccgcccagagctggaccgtgggcggagatattctgaacgctcgctttattcggaatctgcaggagagaaggtccacccgaccatggtag

SEQ ID NO: 26556 - DNA, 1002 bp, Artificial Sequence
  Description of Artificial Sequence: Synthetic coding sequence
atggaatttccatttgatgtggatgctctgtttcccgaacgcatcactgtgttggatcagcatctccggcctccagcacgaagacctggaacaactacacccgcccgggtcgatctacagcaacagatcatgacaataatcgatgagttaggcaaggcatcagccaaggcacagaacctgtctgctccaatcaccagcgcctccaggatgcagtccaatcgccatgtggtttacatcctcaaggatagctctgccaggcccgccggcaaaggcgcaatcattggcttcattaaagtcggatacaagaagctgttcgtactggacgaccgcgaggcacataatgaggtagagcccctctgtatcctcgacttctacatacacgagtccgtccaaagacatggccacggacgggaactgttccagtacatgctgcagaaggaacgggtggagcctcaccaattggcgatagatagaccctcccagaaactactgaaattcctgaataagcactataacctggagactacagtacctcaggtgaataactttgtcatctttgagggtttttttgcacaccaacataggccacccgcccctagtttaagagcaactcggcacagtagagcagcagctgtcgacccaacccccgcggcccctgccagaaaattaccacctaaaagggctgaaggagacatcaaaccctatagtagtagcgacagggagttcctgaaggtagccgtggagcccccctggcccctcaatcgagctccacgtagggctacaccacctgctcatccaccaccccgttccagcagcctgggcaactccccagaaaggggacctctcagaccctttgtaccggaacaggagttgctcagaagcctgaggctttgtcccccccatcctactgctcggctactgctggctgccgatcctggcgggagtcccgcacaacgcagaaggacaagcagcctgcccaggtcggaagagagtagatattag

SEQ ID NO: 26557 - DNA, 903 bp, Artificial Sequence
  Description of Artificial Sequence: Synthetic coding sequence
atggagtttccttttgacgtcgatgctcttttcccagaacgaatcactgtgctcgaccagcacttgcgccctcccgcccgcagaccagggactacaacaccggcccgcgtggacttgcagcagcagatcatgactatcatcgacgagctcggaaaggcctccgccaaagcccagaaccttagtgcgcctatcacgagcgcttcacgcatgcaaagtaaccgccacgtggtttacatcctgaaggacagttcagcacgacctgcagggaagggggcaatcatcgggtttatcaaagtaggatataagaaactgtttgtgctggacgatcgcgaagcacataatgaagtagaacctctgtgcatcctagatttctacattcatgaaagtgtgcaacgccatggacatggtcgagagttgttccagtacatgttacagaaagaacgtgttgagccacatcagctcgccattgatcgaccatcacagaagttgctcaagttcctaaacaaacactacaaccttgagaccaccgtgccccaggtgaacaatttcgttatcttcgagggcttcttcgctcaccagcacccacctgctaggaagctacccccaaagcgagcagagggggacattaaaccttacagctcatcggacagggagtttcttaaggtggccgtggagcccccatggccactcaatcgtgctccgagaagggccactcctccggcgcacccgccaccgcggtccagctccttgggcaactcgccagaacgggggcctcttagaccattcgtgcccgagcaagaattactgaggagtctgcggctgtgccccccccaccctaccgcccggctgctgttggcggccgatcccggcgggagccccgcacaaagaaggcgaacccggtag

SEQ ID NO: 26558 - DNA, 1266 bp, Artificial Sequence
  Description of Artificial Sequence: Synthetic coding sequence
atggagtttccatttgacgtggatgctctgttccctgaaaggatcaccgtccttgaccagcacctgcgacccccggcccgacgtcctggaaccacgaccccagcccgtgtggacctccagcagcagatcatgaccataatcgacgaactcgggaaggccagcgccaaagcccaaaacttgagcgcacccattaccagcgcctcacgtatgcagagcaatcgccatgtcgtctatattctgaaagattcttcagccagacccgccggcaagggcgccattatagggtttattaaggtcgggtataagaaactcttcgttctggatgaccgtgaagcccacaatgaagtggaacccctgtgtattctggatttttatatccatgaatccgttcagaggcatgggcatggcagggagctttttcagtatatgcttcagaaagagcgcgtcgagcctcatcaactcgctatcgatagaccaagccaaaaactgctgaagttcctgaacaagcattacaacctggagaccactgtgcctcaggtgaataatttcgtgatctttgagggattttttgcacaccaacaccgacccccagccccgagtttgcgggcaaccaggcactctagagccgcagctgtcgatccaacacctgccgcacccgccaggaagcttccccctaagagggcagaaggggatattaagccatacagctcatctgacagagaattcctgaaagtcgccgtggaaccaccctggcccctaaacagggctcctagaagggcgacgccgcccgcacacccaccacctaggagttcctccctcgggaactcaccggagagaggccctctgaggcctttcgttcctgaacaggagctcttacggagtctcagattgtgtcccccgcaccccaccgcaagactgcttttagcagctgatcctggcggcagccccgcgcagaggagaaggaccagagggacaccacctggtctcgtcgcacaaagctgctgttacagccgccatgggggtgttaacagctctagtcccaatacaggcaaccaggatagtaaacagggcgaacaggagacaaagaacagatcagcctctgaagaacaagcattatcacaagatgggagtggggaaaagcctatgcacacagcccccccacaggcacctgctccacctgctcaatcgtggactgtgggtggtgatatcctgaatgcgaggtttatcaggaatctccaggagagacggtccacaaggccgtggtag

SEQ ID NO: 26559 - DNA, 972 bp, Artificial Sequence
  Description of Artificial Sequence: Synthetic coding sequence
atggaatttcctttcgacgtcgatgcactctttcccgaacggataaccgtcctcgatcagcatctgcgcccaccggccaggaggcccgggacgaccacacccgcacgagtcgatctgcaacagcagattatgacgataatcgacgagctggggaaagcatcggccaaggcgcagaatctgtcggctcccatcactagcgctagcagaatgcagtcaaatagacacgtcgtctacattctgaaggattcctcagcacggccagccggaaagggtgctatcatcggctttataaaagtgggctacaagaaactgtttgttcttgatgacagagaagctcacaatgaggtagagcccctgtgcatcctggatttctatatccatgagagcgtacaacggcacgggcatggccgggagcttttccagtacatgctgcagaaagaacgggtcgaaccacaccagttggcaattgatagacctagccagaagctgctcaagtttttgaacaagcactacaatctcgaaacaaccgtcccacaggtcaacaatttcgtaatcttcgaaggctttttcgcacatcaacatcgtcctcctgccccctctcttagggccacccggcactctcgggccgcagcagtcgacccgacccccgccgcacccgctagaaaactaccaccaaaaagggccgaaggtgacattaaaccttactcaagcagtgatagagaatttctcaaagtagcagttgaacctccctggcccctcaaccgggcccctagacgcgctacccccccagcccacccacctcctcggtcaagctcactcgggaactctcccgagagaggcccgctcagaccttttgtgcccgaacaggagctgctcagatccctgagactgtgccctccacatcctaccgccaggctcttactcgctgcggatcctgggggatctcccgcccagcggagaagaacaagatag

SEQ ID NO: 26560 - DNA, 933 bp, Artificial Sequence
  Description of Artificial Sequence: Synthetic coding sequence
atggagtttccatttgacgtagatgctctgtttcccgagcgtattacggtgttagaccaacaccttaggccgcctgcgcggaggccaggtacaaccacccccgcccgtgtggacctgcagcagcagattatgactattatcgatgagctaggcaaggccagtgccaaggctcagaacttgtccgcacccattacttctgcctcacggatgcaaagcaaccgacatgtcgtgtatatcttgaaggactcttctgcccggcccgccgggaaaggggccattattggctttatcaaggtgggatataaaaaactttttgtgctcgacgatagggaggctcacaacgaagtggagccactgtgcatactggacttctacatccacgaaagcgtgcagaggcacggacatggtagagaactgttccagtacatgttgcagaaggagcgggtagagcctcaccagctggcgatcgatagacccagtcaaaagttgttgaagttcttgaacaaacactacaacctggaaaccacagtaccccaggtcaacaattttgtcattttcgaaggcttctttgcacatcagcaccctccggccagaaagctgccccccaagcgggccgagggagatataaagccatactcgtcctctgaccgtgaattcctgaaagtcgctgtggaaccaccatggcctctgaacagggcccccaggagggctaccccacccgcacatcctcccccaaggagcagcagccttggtaactcaccagaaagaggaccacttaggccatttgtcccagaacaggagttgctgagaagcctccgcctatgtccccctcaccccaccgctagattgctgctcgcagctgaccctggggggtcacccgcacagcgacgcaggacatcctcccttccccgctccgaggaatcgagatactag

SEQ ID NO: 26561 - DNA, 972 bp, Artificial Sequence
  Description of Artificial Sequence: Synthetic coding sequence
atggagtttccatttgacgtagatgctctattcccagaacgaatcacagtccttgaccagcacttgcggcctcccgcgcggcgtcctgggaccactacacccgctcgggtggatttgcaacaacagatcatgaccataatagatgaactggggaaagcttctgctaaagctcagaatttgagtgctcctattaccagcgcaagcagaatgcaaagcaaccgacacgtcgtgtacattctaaaggactccagtgctcgacccgccggcaaaggggccattattggattcattaaagtgggctataagaagttatttgtcctcgacgatagggaggcacataatgaagtggagcccttatgcatccttgacttctacattcatgaatctgtgcagcgacacggacacgggcgcgaactatttcagtacatgctacaaaaggaaagggttgaaccccaccagcttgccattgatcggccatcccagaagctgctgaaattcctgaataaacattataaccttgagaccactgtgcctcaagtgaataacttcgtcatatttgagggattttttgcgcaccagcacaggccaccagcgcccagccttagggctacgcgccacagtagggctgcggccgtggatcctactcctgcagcgccagctaggaagctgccacccaaacgcgcagagggggatattaaaccgtacagctcttctgatagagagtttttgaaggtggctgtggaacccccctggccgttgaacagagctcctagaagggcaacccctcctgcccaccccccgccaaggtccagctcactagggaacagcccggaaagagggcccctgagacctttcgttccggagcaggaactcttacggtctttgcgattatgtccacctcaccccaccgcacgcttgcttttagccgccgaccccggaggcagtccagcacagagaagacgaaccagatag

SEQ ID NO: 26562 - DNA, 1230 bp, Artificial Sequence
  Description of Artificial Sequence: Synthetic coding sequence
atgtggctgacttggccattctgcttcctgacaatcactctacgcgaagagggcgtctgtcacctcgaatccgtagacttgcagcagcagattatgacaatcatagatgaactgggcaaagccagcgctaaggcccagaatctgagtgcaccaataaccagcgcttcacgcatgcagtccaatcgtcatgtggtttacatcctcaaggacagcagcgcccgcccagcaggaaaaggggccataattggcttcattaaagtcggatataaaaaactcttcgtcttggacgacagagaggcacacaatgaagtggagccactgtgcatcctggatttttatattcacgaatctgtgcaaaggcacggccatggccgggaactttttcaatatatgctgcaaaaggaacgcgtcgaacctcaccagctggccattgaccggccatcccagaagttattgaagtttctgaacaaacactataacctggaaactaccgttccgcaggttaacaactttgtaatcttcgagggcttcttcgctcatcagcacagaccacctgctccaagcctgcgcgccacgcgtcacagcagagcagcagctgttgatcctacacctgccgctccagccagaaagctaccccctaagcgtgccgaaggggatatcaagccttacagtagctctgacagggaattccttaaagtcgctgtcgaacccccctggcctcttaatagggccccaagacgggccacaccccccgcacaccctccccctcgaagctcatccctgggtaactctcctgagagaggtccactccgcccatttgtgcccgagcaggaacttctccgcagtttgcgtctctgccctccccaccccaccgcaaggcttctactggctgcagacccgggcggatcaccagcccagagacgacgaacacgcggcacccccccgggcctggtggcacagtcttgttgttatagccgccatggaggggtgaattcctcctcaccaaacaccgggaaccaggactctaaacaaggagagcaggagacaaaaaacagaagcgcatctgaggaacaagccctgtcccaggacggctctggtgaaaagccaatgcacacagcccctccgcaggcgcctgcacccccagcacagagttggactgtcggaggcgatatactgaatgcgcggttcattagaaacctgcaggaacgacgatctacacgcccttggtag

SEQ ID NO: 26563 - DNA, 903 bp, Artificial Sequence
  Description of Artificial Sequence: Synthetic coding sequence
atggagtttccctttgacgtggacgcacttttccccgagcgtataacagtcctggaccaacatctgcgcccaccagcgcgtcggccagggaccaccacccccgcgagagttgacctccagcagcagatcatgaccataatcgatgaattggggaaagcttccgcgaaagcccagaacctgagcgcccctatcacctccgcatccagaatgcagtccaatcggcacgtcgtctacattctgaaggactcctcagcccggccggcaggaaagggtgctatcattgggtttatcaaggtgggatacaagaagctctttgtactggatgaccgcgaggctcacaatgaggtcgaaccactctgtatcctcgacttctacatccatgaaagtgtgcagagacacggtcacggacgcgagctgtttcagtacatgctgcagaaggagcgtgtggaaccacatcagcttgccatcgatagaccaagccagaagttactcaagttcctgaataaacattataacctggagacaacagtaccccaggtgaacaattttgtcatcttcgaggggttcttcgcccaccaacacccgcctgctcgaaaattgcccccaaaaagagcggaaggggatatcaagccttactcgagctctgacagagagtttctgaaagttgccgtggagcccccttggccccttaatcgtgcgcccagaagggctaccccccccgctcaccctcctccgcgatcctctagtttggggaattcacctgaacggggaccgctgcgcccctttgtacctgaacaggagctgctgaggtccctgcggctgtgtccccctcacccaacggcgcggctcctgctggccgcagatcctggaggttccccggcccagaggcgccgtacaaggtag

SEQ ID NO: 26564 - DNA, 903 bp, Artificial Sequence
  Description of Artificial Sequence: Synthetic coding sequence
atggagtttccattcgacgtcgatgctctttttcccgaacggattaccgtgttagatcagcatttacggcccccagcacgcagaccgggaaccacgacaccagcccgcgttgacctccagcaacaaatcatgacaataatcgacgaactcggtaaagccagcgctaaagcccagaatctctctgccccaattaccagcgcatctaggatgcagtccaatcgccacgtggtttatatcctgaaggatagttcggcacgacccgctggtaagggagccattataggcttcatcaaggttggctataaaaagttgttcgtgcttgacgatagggaggcacacaatgaagtggaaccgctatgtatcctcgatttctatatacacgaatcagtgcaacgccacggccacggccgggaattgtttcagtatatgttgcagaaagagagggttgagccccatcagttggctattgatagacctagtcaaaaactcctcaaattcctgaacaaacactacaacctggaaacgaccgtgccacaggtgaacaatttcgtgatttttgaagggttctttgcacatcagcatccaccagcaaggaagctaccacctaagagggctgaaggggatataaagccttactcctcatctgatagggaattcttgaaggtggcggtggagcctccctggcctctcaatagggcaccgcgtcgtgccaccccacctgcccacccacccccacgaagctctagtttaggcaattcgcccgaacgaggtccgctacggccgtttgtgccggaacaggagctgctgcgctccctgagactgtgtcccccacatcccacagcgcggctgctcttggcagctgaccctggcggaagccctgcccagaggaggagaacaagatag

SEQ ID NO: 26565 - DNA, 972 bp, Artificial Sequence
  Description of Artificial Sequence: Synthetic coding sequence
atggaattcccctttgatgttgatgctttgtttcctgaaagaattacggtgctagaccagcacctgcgaccaccagctaggcgccctggcactacaactccagctagagtggacctgcagcagcagattatgacgattattgacgaacttgggaaagccagtgccaaggcccagaacttatccgctccgattacgtccgccagtcgcatgcagagcaatcgtcatgtggtatatattctgaaggacagcagtgctagacccgcagggaagggcgctatcatcggatttatcaaggtcggatataagaagctgttcgtcctggacgatagggaggcccataatgaggtggagcctctctgcattcttgacttctatattcatgagtccgtacagcggcatggacacggtcgtgagttgtttcaatacatgttgcagaaggagcgcgtcgaacctcaccaactggccatcgaccggccttcccagaaactcctgaagttcctgaacaaacactataacttggaaactacggtgccacaagtcaataactttgttatcttcgaaggattcttcgcgcatcagcaccgccccccagctccctccttgcgggctactagacactcaagagctgctgctgtggaccctactcccgctgccccagcccggaaactgcctcctaagcgcgcagagggcgacataaagccatactcgagctccgatcgcgagttcttgaaggttgccgtggaacctccttggcctttgaatagagcgccaaggagggcgacacctcccgcgcaccccccacccaggtctagttccttaggcaatagccccgagagagggccgttgaggccgttcgtccccgagcaagagctgctcaggtcactgcggctatgcccccctcaccccaccgccagactgctgctggcagccgacccaggtgggagcccagctcagagacggcggacaagatag

SEQ ID NO: 26566 - DNA, 1266 bp, Artificial Sequence
  Description of Artificial Sequence: Synthetic coding sequence
atggaatttcccttcgatgtagacgctctctttccagagaggatcaccgtgctagatcagcatcttcgtcctcctgctcgcagaccaggaaccaccaccccagccagagtcgatctgcaacagcagatcatgactattatcgacgaactgggaaaagcatctgcaaaagcacaaaacctgagcgccccaattacctccgcaagccgcatgcaatcaaacagacatgtagtctacatcttgaaggactctagtgctcggcctgccggcaaaggagctattataggatttatcaaagtcggctataagaaacttttcgtcctcgatgatagggaggcacacaatgaagttgagcctctatgtatcttagatttctatatccacgagtccgtgcaacgacatgggcacggaagagaactcttccagtatatgctgcagaaagaacgagtggaaccgcaccagctggcgatagatcgcccttcccagaagctcttgaaattcttgaataagcactataacctggaaaccacagtgccccaggtcaataacttcgtgatctttgaagggtttttcgcgcatcagcataggccccctgcccccagtctaagagccaccaggcattcccgggctgctgctgtggaccccactcctgccgcgccagccagaaagctgccacccaagcgagcggaaggcgacattaagccatacagttcctcagaccgagagttcctcaaggttgccgtggaaccgccctggcccctgaatcgggctccgcgcagggccactccgccagcccatcccccccctaggagctctagtctgggcaatagcccagaaaggggcccactgcggcccttcgtgccagagcaagagctccttaggagtctgagactgtgccctcctcaccccacggctcgactgctgcttgccgcggatccagggggatcaccagctcagcggcgaaggacccgtgggaccccgcctggactggtcgcccagagctgctgctactctcgccatgggggcgtgaattcttcttcacctaatacaggtaaccaggacagcaaacaaggggagcaagaaaccaagaatcgtagcgcctctgaagagcaggccctttcgcaggatgggtcaggtgagaaacctatgcatacggcgccacctcaggcacctgctccccccgcccagtcatggaccgttggtggggatatccttaatgctcgttttattcgaaatctgcaggaaagacgttcaacccgcccttggtag

SEQ ID NO: 26567 - DNA, 903 bp, Artificial Sequence
  Description of Artificial Sequence: Synthetic coding sequence
atggaattccctttcgacgtcgacgccttgtttcctgagaggattaccgtccttgaccagcacctgcgcccccctgcccgacgcccgggcactacaaccccagctagagtggacttacagcagcagattatgaccattatcgatgaattgggcaaggcttcagcaaaagcccaaaatctaagcgctcccatcacatctgccagcagaatgcagagcaaccgccatgtagtgtatatcctgaaggatagttctgctcgccctgctggaaagggtgctatcattggctttatcaaggtgggttacaagaagctgttcgtgcttgatgacagagaagctcataatgaagtagagcctttatgcatccttgacttctatattcacgagtcagtgcaaaggcatggacatggtcgggagctgtttcagtacatgctccagaaagaacgcgtcgagcctcatcaactcgccattgacaggcccagccaaaaactgctcaagttccttaacaagcattataatttagaaactaccgttcctcaggtcaacaattttgttatcttcgagggattcttcgctcatcagcatccacctgcacgcaagttgcctcccaaacgggccgagggtgacatcaagccatactcctcatcagaccgggagttcctcaaggtagctgtggagcctccatggccactgaatagggcccctcgccgggcgactcctccggctcacccccccccccgctcctcatccctggggaattccccggagcggggacctctgagaccatttgtccccgaacaagaactcctccgaagtctgaggctgtgccccccccaccccactgcaaggctgctgcttgctgctgatccgggaggatcaccggcccagagaaggaggaccagatag

SEQ ID NO: 26568 - DNA, 972 bp, Artificial Sequence
  Description of Artificial Sequence: Synthetic coding sequence
atggaatttccgtttgacgtggacgcactgttcccagagcgcattaccgtactagatcaacacctgaggccgccggcgcgccgcccaggcaccacaacacccgcgcgcgttgaccttcaacagcagatcatgactatcatcgatgagctgggcaaggcttccgccaaagcccagaacctgagcgcgccaataacctccgcttcgaggatgcaatcaaatcggcacgtggtttacatcctcaaagactcttccgcccggccagctggtaagggcgccatcatcggctttattaaggtgggctataagaagctgttcgtgctggacgatagagaggctcacaatgaagtcgagccattatgcattctagacttttatatccacgaatccgtgcaacgtcacggccacggacgcgagttgtttcagtatatgttacaaaaggagcgggttgagccacatcagctggctatagacaggccatcacaaaaacttctaaagtttctgaataagcattataaccttgagactacagtcccgcaggtcaacaactttgtcatattcgaaggcttcttcgcccatcagcataggcccccagccccttccctgagagccacgcgtcactcaagagctgccgcagtcgaccccactcctgctgctcctgcacgaaagctgcccccgaaaagggctgagggagatatcaagccttattcttcgagcgacagggaatttttaaaagtagccgtggagcctccatggccactgaatcgggcccccaggcgagccacccccccggctcaccctccaccccgcagcagctctctgggcaatagccccgagcggggtccactgaggcctttcgtcccagaacaagaattactgagatcattgagactgtgccctcctcaccccacggcacgtctacttctggcggctgaccctggcggcagcccagctcaaaggaggcggacaagatag

SEQ ID NO: 26569 - DNA, 933 bp, Artificial Sequence
  Description of Artificial Sequence: Synthetic coding sequence
atggagttcccgtttgacgtcgatgctctatttcccgagcgaattacagttctggaccagcacctccggcctccggctcggcggcctgggactacgacacccgctagagtggatttacagcaacaaataatgaccatcatcgacgagctgggaaaggcctcagccaaggctcagaaccttagcgctcccatcacaagtgcatcacgtatgcagtccaatcgacacgtggtgtatatcttaaaagacagcagcgctcgaccagccggcaaaggagccatcattggctttattaaggtgggttataagaagctgttcgtactcgacgaccgagaagcacacaacgaagttgaacccctgtgcatcctggacttctatatccatgagtcagtccagagacatggccacggtagagaattgttccagtatatgctgcagaaggagagggttgagccgcatcagttagccatcgatcgaccctcccagaagttgctgaagttcctgaataagcattacaatcttgagaccaccgtcccacaagtgaataactttgtgatattcgaaggcttctttgcccatcaacaccccccagcacggaagctgccacccaagagggccgagggcgatattaagccttactcctccagcgaccgagagttcctcaaagtggcagtggagccgccatggccgcttaatcgtgcccccagacgggctactcctcctgcacacccaccgcctcgctcctcatcgctgggtaatagtcctgaaagaggccctctcaggcctttcgtccctgaacaggagctgcttcgttccctcaggctctgccccccgcacccgaccgctaggctcctcctcgctgctgatccagggggcagtccagcgcagcgaaggagaacttcctcactgcctcgatccgaggagagcaggtattag

SEQ ID NO: 26570 - DNA, 1230 bp, Artificial Sequence
  Description of Artificial Sequence: Synthetic coding sequence
atgtggctcacgtggcctttttgtttcctcacaataactctgcgagaggaaggcgtgtgtcacctggagtctgtggacctccagcagcagatcatgaccatcatcgacgaacttgggaaggcatccgccaaggcgcagaatctctcagcccccatcacatccgcttcgaggatgcagtcaaaccggcacgtcgtgtatattttaaaagacagcagcgctagaccggcagggaagggcgccatcatcggattcattaaggtgggttacaagaagctattcgtgttggacgacagggaagcccacaatgaggtcgagcctctctgcattcttgacttttatatccatgagtccgtgcaaagacatggacacggaagggagcttttccagtacatgttgcaaaaggagcgggtcgagccccatcagctggccatcgacaggccttctcaaaagctgctaaagtttttgaacaaacactataatttggaaactactgtgccgcaagtgaataatttcgttatatttgagggtttcttcgcgcatcagcacaggcctcctgccccctctctccgtgcgacaaggcactccagggctgccgcggtcgacccaaccccggccgctcccgctcgcaaacttccgcctaagcgggccgagggagacattaagccctatagttcgtctgatagagagttcttaaaggtggccgtcgagcccccttggccccttaatagggccccacggagagccacccctccagcccacccaccaccaaggtcctcgtccttgggcaactccccggaacgcggcccccttaggcccttcgttccggaacaggagttgctccgcagcctgagactctgtcctccgcacccaacggcgcgcctgctgctggccgctgatcccggaggaagtcctgcacaacgcaggcgcaccaggggcacccccccaggtctggttgcacaatcatgctgctactcccggcacggaggagtgaactcgagtagccccaacacgggcaatcaggatagcaagcagggggagcaggaaacaaagaaccgctcagcctcagaggagcaggccttaagccaggacggttccggagagaagcccatgcacaccgccccaccccaggccccagctccccccgcccagtcttggactgtggggggtgacatcctgaacgctaggtttataagaaacttgcaggaaagaaggagcaccaggccctggtag

SEQ ID NO: 26571 - DNA, 1002 bp, Artificial Sequence
  Description of Artificial Sequence: Synthetic coding sequence
atggaatttccttttgatgttgacgcactgttccccgagcgaatcaccgttttggatcagcatttgcgcccaccagccagaaggcctgggacaaccacacctgcgcgcgtagatctacagcagcaaatcatgaccattatagacgagttagggaaggcctccgcgaaggctcagaatctgtcagcaccaattacttcagcttccagaatgcaaagcaatcgacatgttgtctatatcctgaaggacagttctgctcggcccgccggcaagggggccattatcgggttcataaaagtgggttataaaaaactcttcgtcctcgacgatagggaagcacacaacgaagttgagccactttgtatcctcgacttctatattcatgaaagtgtgcagagacacggccatggcagggaattgttccagtacatgctgcagaaggaacgcgtggaaccacatcagctggcgattgataggcctagccagaaactcctgaaattcttgaacaagcactataatctcgaaacaactgtaccacaggtcaacaattttgttatatttgaaggcttcttcgcgcatcagcatcggcctcccgcgcccagtttacgtgctaccagacactccagggctgctgcggtcgaccctacacccgcagccccggcaaggaagcttccaccaaagcgcgcagaaggcgatattaaaccatacagttcatctgaccgcgagtttctgaaggtcgccgtggagcccccatggccccttaatagagcccctcggcgggcaacacctcccgcccatcctccccctaggagcagtagtcttggaaattcgcctgagcgcggaccactgcgtcccttcgtgcccgagcaagagctgctccggtccctcaggttatgccccccacatccgacagctaggctcctcttggccgctgatccaggcggtagcccagcacagagaaggaggacctccagcctgccaaggtccgaagaatctcggtactag

SEQ ID NO: 26572 - DNA, 933 bp, Artificial Sequence
  Description of Artificial Sequence: Synthetic coding sequence
atggaatttccatttgacgtggatgccttgttccctgagcggatcaccgtgctggaccagcacctgagaccccctgcccgtagacccggcaccaccacccccgcacgtgtcgatctgcagcagcagattatgaccatcattgacgaactaggaaaggcgtctgcgaaggctcagaatctctcagcccccatcaccagtgccagcagaatgcagtccaataggcacgtggtatacattctcaaggattcttcggccagacccgctggaaagggggccatcatcggctttatcaaagtgggctacaagaagcttttcgtcctcgacgacagggaagcccataatgaggtagaacccctgtgtattctcgacttttatattcacgagtcagtgcagagacacggccacgggagagagctctttcagtacatgcttcagaaggaaagggttgagccccatcagttagcaatcgaccgcccttcccagaagcttctaaagtttcttaacaaacactacaatctggagactaccgttcctcaagttaacaactttgttatcttcgaggggttttttgcccatcagcacccccctgccaggaagctgcccccaaaaagagcggagggagacattaagccatattctagctcagacagagaattcctgaaagttgccgtggaaccaccgtggcctctgaatcgcgctcctcgcagagccactccacctgctcacccaccacccagaagtagtagcctgggaaacagccctgaaaggggccctctgcgacccttcgtgccagaacaggagctgctcagatctctgcgcctgtgtcctcctcacccaaccgccaggttgctgctcgccgctgaccctggtgggtccccggcacagcgacggagaactagtagtttgccgaggagcgaagagtctcggtattag

SEQ ID NO: 26573 - DNA, 1266 bp, Artificial Sequence
  Description of Artificial Sequence: Synthetic coding sequence
atggagtttccatttgacgtcgatgctctgtttccagagcggataacagttctagaccagcatctccggcccccagccagacgccctggaacaaccaccccggctagggtcgatctgcaacagcagattatgacaatcattgatgagctagggaaggccagcgcaaaggcccagaacttatctgctcccatcacatctgcctcccgcatgcagagtaatcgccacgttgtgtatatcctgaaagacagtagcgctcgccccgcaggcaagggcgcaatcataggatttatcaaggttgggtacaagaagcttttcgtgttagatgatcgagaagctcacaatgaggttgaaccgctatgtattcttgacttctacattcacgaatccgtgcaacgacacggccatggtcgtgagctattccagtatatgctgcagaaagagagagtcgaaccccatcagctagctatcgacaggccttctcaaaaactcctcaaattcctgaacaagcactataatctagaaacaactgtgcctcaagtgaataacttcgtgatctttgaagggttcttcgcacatcagcaccgtccccctgcacccagtctccgcgccacacgtcatagtagagcagccgctgtggatcctacaccagcagctccggcccgcaagctgcctcccaaaagggctgagggggacattaagccgtatagctcgtccgatagagagttcttaaaagttgccgtagagcctccttggcctctgaatagggccccccgccgggctacacctccagcacaccctccacccaggtccagttcacttggcaattccccagaacggggcccccttcgtccatttgtccctgaacaggaactcctcagatccctgcggctgtgcccccctcatccaaccgccaggcttttactcgccgccgacccaggaggctcaccagctcaacggcgacgcacccgggggacgccaccaggtctggttgctcaaagctgctgttattctcggcatgggggagtcaacagctcatcacctaacacgggcaaccaggattcaaaacagggcgaacaggagacgaaaaacaggtccgcttcagaagaacaggctctatcccaggacggttctggggagaaacctatgcacaccgctcctccccaagcacccgccccaccagctcagtcctggacggtgggtggcgacatcttgaacgccaggttcataaggaatctgcaggaacggcgttcaactagaccctggtag

SEQ ID NO: 26574 - DNA, 1230 bp, Artificial Sequence
  Description of Artificial Sequence: Synthetic coding sequence
atgtggctgacttggcccttttgctttttaaccattacattaagggaagaaggagtttgtcatctcgagtcggtggatctccagcagcagataatgacgattatagacgagctgggtaaagcctccgcaaaagctcagaacctcagtgctccgatcacctccgccagtaggatgcagtctaatagacacgtggtttacattttgaaggattcatcagcacgccccgccggtaagggtgcgataattggttttataaaggtcggctataagaagctgttcgtgctagatgaccgcgaagcacacaatgaagtcgagccactgtgcatccttgatttctacatacacgaaagcgtgcagcggcatggccatggacgagaattgtttcaatatatgctgcagaaggagagggtcgagcctcatcagttggcaatagacagaccttcccagaaattgctcaaattcctcaacaaacactacaatttagaaaccacagtcccacaggtgaacaactttgtcatttttgaggggttcttcgcacaccagcatagacccccggcaccatccttgagggccacccgccattcccgggcagccgctgtggaccccacacccgcagcgccagcacgtaagcttccacctaagagagcagaaggtgacattaaaccttattccagctcagaccgggagttcctcaaggtcgccgtggaacccccttggcccctgaatagggccccccggcgagccacccctccagctcatccccccccgaggtcgagttcattgggaaactctcctgagcgcggacctcttaggcccttcgtgccagagcaagagctgttgagatcgctccggctgtgcccccctcacccaactgcacgtctgttgctggctgcggaccctggcgggagccctgctcaacgcagacgtactaggggcacgccccccgggctggtggctcagtcatgctgctactctcggcatggaggggtgaatagctcaagtcctaataccgggaaccaggattcaaaacagggggagcaggagacaaaaaaccgcagtgcttccgaggaacaagcactgtcccaagatggatccggcgagaaacccatgcacactgcacctcctcaagcaccggcacctccagcccagagctggacagttgggggggacattctgaacgctcgattcatcagaaatcttcaggaacgtaggagcacccgcccatggtag

SEQ ID NO: 26575 - DNA, 1266 bp, Artificial Sequence
  Description of Artificial Sequence: Synthetic coding sequence
atggagttcccattcgacgtagacgctttgtttccagagcggattaccgtgctggaccaacatttgagacctccagctagaagacccggcactaccactcccgcccgagtagacctccagcaacaaattatgacgattattgacgagctgggaaaagcatccgccaaggcccaaaatctgagtgcccccattaccagtgcaagcagaatgcaatccaaccgacatgtggtatacattctgaaagatagctctgcccgacctgcaggaaagggagcaatcataggtttcatcaaagtggggtataaaaaactcttcgtgctggatgaccgggaagcacacaatgaagtcgaacccttatgtattctggacttctacatccatgagagtgttcagaggcacgggcacggccgggagctgtttcaatacatgctgcagaaggagcgagtggagccacaccagctcgccatcgaccggccctctcagaagctgctgaagtttttgaacaagcattacaatttagaaactactgtgccccaggttaataacttcgtgatttttgagggcttcttcgcccatcaacacagacctccagccccaagtctgagggccacgagacactcccgggcggcagcggtggatcccacaccagcagctcccgcaaggaagctgcctcccaaaagggccgaaggggatataaaaccctattccagtagtgacagggagtttctgaaggtggcagtggagcccccatggcccctcaacagagcccctcggagggctaccccgcccgcccaccctcctccccgcagttccagtcttgggaactcccctgagagaggcccgctacggcccttcgtgcctgaacaggaattgctgagatcactccgcctgtgccccccccatccgaccgccagacttctgctcgcagccgaccccggtggctccccagcccagcgcaggcggacacgcgggacccctccgggacttgtcgcccagtcctgctgttatagccgtcacggtggggtgaactccagctcacctaacaccggcaaccaggacagcaagcagggtgagcaagaaacaaaaaaccgtagtgcaagcgaggagcaggcactaagtcaggacggatctggcgagaaaccaatgcacactgcacctccacaggcaccagcaccacccgctcagtcctggacagtcgggggagacatcctgaatgccagatttatccggaatctgcaggaacgccgctcaactcgcccttggtag

SEQ ID NO: 26576 - DNA, 903 bp, Artificial Sequence
  Description of Artificial Sequence: Synthetic coding sequence
atggagttccccttcgatgtggacgcactgttcccagagagaattacagtcctggaccagcaccttcgcccacccgctcgcagacctggtacgaccacaccggctcgggtcgacctgcagcagcaaatcatgacaatcatcgatgaactggggaaggccagcgccaaggcgcaaaacctctccgctcctatcacttccgcatctcgaatgcagtccaatagacatgtggtttatattctcaaggattccagcgccagacctgcgggcaagggcgccatcatcggcttcatcaaagtgggttacaagaagctcttcgtgctcgacgaccgagaagcacacaatgaagtagagccactatgcatcctggatttttacattcacgaaagcgttcagaggcacggacacggcagagaactattccagtatatgctgcagaaagagcgagtcgagccccaccagctggccatcgaccggcccagccagaagttactcaaattcttgaacaaacactacaatctggagacaacggtacctcaagtaaacaattttgtgatatttgagggcttttttgcgcatcaacaccctcctgctagaaagctgccacctaaacgggctgagggggatattaaaccatacagcagctcagatagagagttcctgaaggtggctgtggagcctccctggcctctgaaccgagccccacgccgcgctacgccccctgcacaccccccccccaggtcgagctccctggggaactccccggagagaggtcctcttcgaccttttgtgcccgagcaagagctgctaagatccctgcggctctgccctcctcatcctaccgccaggctgctgctcgctgccgaccctggaggaagccctgcccagcggaggcgcaccagatag

SEQ ID NO: 26577 - DNA, 933 bp, Artificial Sequence
  Description of Artificial Sequence: Synthetic coding sequence
atggagttcccattcgacgtcgacgccctgttccccgagcgtatcactgtgctcgatcaacacctgaggcctcctgccagaaggccaggaaccaccacacctgctagagtggacttgcagcagcagatcatgacaattatcgacgaactgggcaaagcttcagcaaaagcacagaatctgtctgcacctattacctcagcctctcggatgcagtcaaatcggcacgtggtttatatattgaaggactcaagtgctcgccccgcagggaagggggctatcattggttttattaaagttgggtacaagaagctgttcgttttggatgatcgcgaagcacacaatgaggtcgagcctctgtgcatcctggatttctacatacacgagagcgtacaacgtcacggacatggaagagagctgttccagtatatgttgcagaaagagcgggtagagccccaccagctagcaattgatcgacctagtcagaaactgttgaaattcctgaacaagcactataatttagagacaaccgtgcctcaggttaataattttgtaatatttgaggggttctttgctcaccagcatccgccggctagaaagctccctccaaaacgcgccgagggagacatcaagccgtactcatcgtccgaccgggagttcctgaaagtggccgttgaaccaccttggcccttaaatcgagcacccagacgcgccactcctcctgcccacccccctccccgctccagtagtcttggcaactctcccgaaaggggcccgctgaggccctttgtcccagaacaggagctgttacgcagtctgcgactctgtcccccacatcctaccgcgcggctgctgctggctgccgaccctggcgggagtccagcccagcggaggcggacaagctctctcccccgctctgaggaaagccgctactag

SEQ ID NO: 26578 - DNA, 1266 bp, Artificial Sequence
  Description of Artificial Sequence: Synthetic coding sequence
atggagtttccttttgatgtcgacgccctcttcccagagagaatcacagtactggaccagcatttgcggcccccggctcgaaggcccggcactactacaccagcaagggtggatttgcagcagcagattatgaccattattgatgaactcggcaaagcatccgccaaagcccagaatcttagtgccccgataacctctgcctccaggatgcagtcgaaccggcacgttgtctacatcctaaaagatagttccgcaaggccggccggcaaaggagctattattggttttattaaggttgggtacaagaagctcttcgttctcgacgatagggaagctcacaacgaggtggagccactctgtatcctggatttttacatccacgagagcgtgcaacgccatggacacgggcgagagctttttcagtacatgttacagaaagagagagtcgaaccccatcagcttgctattgaccggccctcacagaaattgctaaagttcctgaacaagcattataatttagagactacagttcctcaggtgaacaactttgtgatctttgagggcttctttgcccaccagcacagaccgcccgcaccaagtctccgagccacccggcactcccgggctgctgctgtcgatcccacccccgctgctccagccaggaagctgccccctaaacgtgctgagggtgatatcaagccatactcctctagcgatcgagaattcctgaaggtggccgtggagccgccttggcccttaaaccgggcaccaaggagggccacaccccccgcccatccgccacctcgctcttcttccctgggcaactcgcccgagcggggccctctgcgtcccttcgttcctgagcaagagctgctgaggtctctgagactctgccccccccacccaacagcacgactgctcctggctgcagatccaggaggaagcccggcccagagaagacgtactagggggacacctcctggattggtggcgcagtcctgctgctacagtaggcatggcggggttaactctagctcacccaatactggcaatcaggattccaagcagggtgaacaggaaacaaagaacagatctgcctcggaagagcaggccctatctcaggatggatcaggtgagaagcctatgcacaccgcacctccccaggcccccgccccaccagctcagtcctggaccgtcggaggcgacatccttaacgccaggttcatccgtaatctgcaggaaaggcgcagcactcggccgtggtag

SEQ ID NO: 26579 - DNA, 933 bp, Artificial Sequence
  Description of Artificial Sequence: Synthetic coding sequence
atggagttcccctttgatgtagatgccctgtttccagaaaggattaccgtgctcgatcagcatctccgcccccccgccagacggcccgggaccactacgccagcccgggttgatctgcagcagcagatcatgactatcatagatgagcttggtaaagcctccgctaaggcccagaacctgagtgcccccattaccagcgcctctcggatgcagagtaaccgccacgtggtttacatccttaaggattcttcggccagacctgccggaaagggagctattattggttttatcaaagtagggtataaaaagctcttcgtactggacgacagggaagcccacaacgaggttgagcccctgtgcattctggatttttacattcacgaatctgttcagcggcatggacatggccgggagctgtttcagtacatgttacagaaggagcgggtcgaaccccaccagctagccatcgatcggccatctcaaaagctgcttaagttcttaaataagcactataatttagaaactacggtgccccaggtcaacaactttgtcatctttgaggggttctttgcccaccagcacccccctgcacgtaagttgccacctaaacgagctgagggcgacatcaagccctacagtagctcggatagggagttcctgaaagtggcagtggagccaccatggccgttaaaccgagcgccaagacgcgccacccctcccgcgcatccgcctcctcggtctagctctttgggcaattccccagagcgcggccctttgcggcccttcgtgccagagcaggagctcctgcgaagtctccgcttgtgccctccccacccaaccgctagattgctgctcgctgccgaccccggagggagcccagcgcaacgtcgtcggaccagcagccttcctaggtccgaagagagtagatattag

SEQ ID NO: 26580 - DNA, 972 bp, Artificial Sequence
  Description of Artificial Sequence: Synthetic coding sequence
atggagtttccgttcgacgtcgatgccctattccccgagcgaatcacagtcttggaccaacatctcagacctccggcaaggagacccgggacaacaaccccagcgcgcgtggacctgcagcagcagatcatgactattattgacgagctcgggaaggcgtcagccaaggcccagaatttgtctgccccgattacttcagcgtcgcgaatgcagtcaaaccggcacgtcgtctatatactgaaagacagcagtgcgaggcccgccggaaaaggcgccatcatcgggttcattaaagttggctataagaagctgttcgtgttggatgatcgggaggcccacaacgaagtagagccgctgtgtattctcgacttctatattcacgagtcagtacaacggcatggtcatgggcgagagcttttccagtacatgctccagaaagaacgagtagagccccaccagctggctatcgataggccctcacaaaaactgcttaagtttctgaacaaacattataatttagagacaaccgttccacaagtcaataacttcgtgatcttcgagggcttctttgcccatcagcaccggccacccgccccttcccttagggctacgagacactccagagccgcagccgtggatcctacgccagcggcaccagctcggaagctgcctcccaaaagggccgagggagacatcaagccctactctagttccgatcgagagtttctgaaggtagccgtcgagcctccttggcctctcaacagagctccccgtcgagcaacacctcctgcccatcctccaccacggtcttccagtctgggcaacagccccgagcggggtcccctgaggccatttgtgccggagcaggagctgctacgctcactccgactttgcccgccgcaccctacagcaaggctcctcttggccgcagacccgggtgggtcccctgcccagaggcgtcggacccggtag

SEQ ID NO: 26581 - DNA, 1230 bp, Artificial Sequence
  Description of Artificial Sequence: Synthetic coding sequence
atgtggctcacatggcccttttgtttcttgactattaccctccgcgaagagggggtctgccatctggagagtgtcgacctacagcagcagattatgaccatcatcgacgaactcggcaaagcttctgccaaggcacagaacctttctgcccctatcacctctgcgtcccgcatgcagagcaacaggcacgtcgtgtatatcctgaaggattccagcgcaaggcccgccgggaagggtgccattattggctttattaaagttggctataaaaagttatttgtcctggacgatagagaagcacataacgaggtcgaacctctatgcatcctggacttttatattcatgaatccgttcagcggcatggccacggacgcgaactcttccaatatatgctgcaaaaagaaagagtggagccgcaccagctcgccatcgaccgccctagccaaaagctgttgaaatttttgaacaaacactataacctggaaaccaccgtaccgcaggtgaacaatttcgtcatttttgaagggtttttcgcacatcagcacagaccacctgctccttccctgagggccactcgccactcaagggccgcagcagtggatccaacccctgcagcacctgcccggaagctcccccccaagcgagctgagggcgatattaagccatactcttctagcgaccgcgagtttttgaaggttgctgttgaacccccgtggcccctgaacagggcaccccgccgggctacgccgcctgcccaccccccgccgcgatcgtcttctctgggaaatagcccagagagggggccactaagaccatttgtgcccgagcaagaactcctgcggagcttgagactttgcccgccacaccccactgcacggctgctgctagcggccgatcccggcggctcacccgcccaaaggcggcgcactaggggaacaccgccagggcttgtggcccagtcatgttgctattcacgccacggaggcgtgaatagtagttcgcccaacactggcaaccaggacagcaaacaaggtgagcaggaaaccaaaaaccgctccgccagcgaggagcaggcacttagccaggacggctcaggggaaaagcctatgcacacagccccaccacaggctcccgcccctcccgcccagtcttggacagtaggcggcgacatcctgaatgctcgtttcattcgtaatctgcaggaacggcgctccacacgcccatggtag

SEQ ID NO: 26582 - DNA, 903 bp, Artificial Sequence
  Description of Artificial Sequence: Synthetic coding sequence
atggagttcccctttgacgtcgacgccctcttccctgaaagaatcacagtacttgatcagcatctacgccctcccgctcgacgccccgggacaacaaccccagccagggtggacctgcagcagcagataatgaccattatcgacgagctcgggaaggcctctgcaaaagcccagaatctttctgctcctattacttctgcaagtcggatgcagtccaaccgccacgtcgtgtacatactgaaagatagcagcgcaaggcctgctggcaagggagccattatcggattcattaaggtgggatataagaaactctttgtactggatgatagggaagctcataacgaagttgaacctttgtgcattctggacttttatattcacgaatcagtgcagcgacatggacacggccgagaactgtttcagtatatgctccagaaggaacgtgtggagccccatcagctggccattgatcgcccctcccagaagctccttaagttcctgaacaagcactacaatttggagacaacagtacctcaggttaataattttgtcatctttgaaggtttcttcgcccatcaacaccctccggcccgaaagcttccccctaaaagagctgaaggagacataaaaccatactcctcctctgatagggagttcctcaaagtggctgtggaaccgccttggcccctgaacagggccccacgtcgagcaaccccgcctgcacaccctccaccgcgctcttcatctctgggaaactcccccgagcgggggcctctcagaccatttgtgccagaacaggagctgctgagaagcctgcgcctctgtcctccccaccctacagccagactgctgcttgctgctgatcctggcgggtcaccagctcagagaaggcgaacacggtag

SEQ ID NO: 26583 - DNA, 1002 bp, Artificial Sequence
  Description of Artificial Sequence: Synthetic coding sequence
atggaatttccattcgacgtagatgcactttttccggagcgtatcaccgtgctggaccagcacttgagaccacccgcgagaagaccaggcacaacgacgcccgccagggtggacttgcaacagcagatcatgaccattatcgacgaactgggcaaggcttcagccaaagcccagaatcttagtgcccccatcacgagtgcttctcgtatgcagtccaataggcacgttgtatatatactcaaggatagttctgcccgcccagccgggaaaggtgccatcattgggtttattaaggtgggatataagaagctcttcgtgctcgacgatagagaagcccataacgaggtcgagcccctctgtatccttgacttttacatccacgaatccgttcaaaggcacgggcatggccgcgagctgttccaatatatgttacagaaggagcgggtggagccccaccagctagcaatcgaccggccaagtcagaagttgcttaaattcttgaacaaacattataacctagaaaccaccgttcctcaggtaaacaacttcgtcatatttgaaggatttttcgcccaccagcatcgcccaccagcccccagcctccgcgccaccagacattcgcgggcagccgctgtggaccctacccctgctgcccccgcacggaaattgccgcctaagcgggcagagggtgacattaaaccctactcatcgtccgatcgcgagtttctgaaagtggcagtggagccgccttggccccttaaccgagcaccaagacgggcaacgcctcctgcccatcctcctccacgaagctcaagcctcggaaattctcctgagaggggacctctgcggccgtttgtacctgaacaggaactgttgcggagtctgagactatgccctccccaccccactgcaaggctgctacttgccgctgatccggggggatcgcctgctcagaggcgcaggacgagcagcttgcctcgctcggaagaaagcagatactag

SEQ ID NO: 26584 - DNA, 1002 bp, Artificial Sequence
  Description of Artificial Sequence: Synthetic coding sequence
atggagttcccatttgacgtggacgccctctttcccgagagaattaccgtcctggaccagcacttacgtcctcccgccagacggccagggacaacaacacccgcacgtgtcgatctccagcagcagattatgaccattatagatgagctgggaaaagctagtgccaaagcccaaaatctcagcgcccccattaccagtgccagccgcatgcagtccaacaggcatgtggtttacattctcaaggatagctctgcgcgaccagccggcaagggcgcaatcattgggtttattaaggtcgggtataaaaaactttttgtcttggacgacagggaggcccacaatgaggtagaacctctgtgtattctggacttctatattcatgaatcagtccaacgtcatggccatggccgggaactgttccagtatatgctgcagaaagagcgcgttgagccgcaccaactagccatcgaccggccgagccagaagctccttaaatttcttaataagcactataaccttgagacaactgtgcctcaagtgaacaatttcgtgatcttcgagggtttctttgcacaccagcaccggcctccggccccatcattacgtgcaacaaggcatagtcgggccgccgcagtcgacccgacaccagcagcccccgctcgcaaactccctcccaagcgggccgagggagatataaaaccctactcatcaagcgacagggaattcctgaaagtggctgtggaaccaccatggcctcttaaccgggcaccaagacgggctactcccccggctcatccccccccaaggtcttcctccctgggcaactcacctgagcgggggccgttgcgcccctttgtgccggagcaggagttgcttcggtcattacgcctgtgtcctcctcatcctacagcaagactgctcctcgccgcggaccccggaggaagccccgcacagaggcgccgtacctccagcctcccccgctccgaagagagtcgatactag

SEQ ID NO: 26585 - DNA, 1266 bp, Artificial Sequence
  Description of Artificial Sequence: Synthetic coding sequence
atggaatttcccttcgatgtagatgctctgtttcccgagaggattacagttctcgaccagcatctaagaccacccgctagacggccaggaactacaacaccagcgagggtcgacttgcagcagcaaatcatgacaattatagatgagctcggaaaggcctcagccaaagcccagaacctgagtgcacctatcacgtccgcttctcgaatgcaatctaacaggcatgtggtgtatatcctaaaagactcaagtgccaggcccgcaggcaagggagccataattggtttcatcaaggtcggctataaaaagttgtttgtgctggacgatcgcgaggcccataatgaggtcgagcccctgtgcatcctggatttttatatacacgaatcagtccaacgacacggtcatggacgtgagttgtttcagtacatgcttcaaaaagaacgcgtggaaccccatcagctggctatcgatcgaccaagtcagaagctactaaaatttctcaataagcattacaacctggagaccacagtccctcaggtgaataacttcgtcatttttgaggggtttttcgcacatcaacaccgtcccccagcccccagtctccgcgccaccaggcactccagggctgccgccgtggatcctacccccgccgctccagctcgcaagttgcctcctaagcgcgcggagggtgacattaaaccttactcttctagcgaccgagaatttctgaaggtggcagtggagccaccatggccgctgaacagagccccacgccgggctaccccacctgctcacccacctccgcggtcatcgagtctagggaactctcccgagcgcggccccctgcggcctttcgtccctgagcaggagctgctgcgtagcctcagattatgtcctcctcaccctacagctcggctcttgctcgcagcagatcccggaggctcaccggcacagcggcgtagaaccagaggcacgcctcccggactcgtagcgcaaagctgctgctactcaaggcacggcggcgtcaactcctcctctccaaataccggcaaccaagacagcaaacaaggcgagcaggaaaccaaaaatcgcagcgccagcgaggagcaagccctgtcccaggatggatctggcgagaagccaatgcacacagcccctccacaggcccctgcgccaccggcgcagagctggaccgtgggaggcgatatcttaaacgcccgcttcatccgaaacctgcaggagcgacggtcaacacgcccctggtag

SEQ ID NO: 26586 - DNA, 933 bp, Artificial Sequence
  Description of Artificial Sequence: Synthetic coding sequence
atggagtttccatttgacgttgacgcactcttcccggaacgcatcaccgtcctagaccagcacctccgcccccctgctaggcgacccggcacgaccacccccgccagggtggacctccaacagcagattatgacaataatcgatgagttgggcaaggcttctgctaaggcccaaaatctgtcagcaccaattaccagtgcctctaggatgcagtccaatcgccatgtggtgtacattctaaaggactctagcgcgcgcccagctggaaagggcgccatcattgggttcattaaggttggttacaagaaacttttcgtgcttgacgatcgagaggcacacaatgaagtggagcccctgtgcatcttagatttttacattcacgaatccgtgcagaggcacggccatggtagggagctctttcagtatatgctacagaaagagcgagtggaaccgcatcaactagctatcgaccgaccaagccagaagctcttgaaattcctcaataagcactataacttggagactaccgtccctcaagttaataatttcgtgattttcgaagggttctttgctcatcagcatccaccagcccgtaaactgcctccaaaacgagcagaaggggacatcaagccgtatagctcttccgatcgcgagttcctcaaggtggcggttgaacctccttggcccctgaaccgcgcaccaagaagggctacacctcccgcacaccccccaccgcgaagctcctccctcggaaactcccccgagcgtggaccgctacgcccattcgttccagaacaggagctcctgcggagcctgcgcctctgccccccccatcccacagcccggctgctcctggctgcggaccctgggggaagtccggcacagaggagacgcacctccagcctgcccaggtccgaggaatctcgatactag

SEQ ID NO: 26587 - DNA, 1002 bp, Artificial Sequence
  Description of Artificial Sequence: Synthetic coding sequence
atggaattcccattcgatgtggacgcattgttcccagagcggattacagtgctcgaccaacatcttcgtccacccgcaagacgtccagggacgactaccccagcccgcgtggacttgcagcaacagatcatgactatcattgacgagctgggtaaagcaagcgccaaggctcagaacttgtctgctcctatcaccagcgcttctcggatgcagagcaaccgacacgtggtctatattctgaaagatagtagcgctcggcccgccgggaaaggcgccataatcggattcattaaggtgggatacaagaaactattcgtgctggatgacagggaagcccataatgaagtggagccactatgtatcctggacttctacatccatgagtccgttcagcggcacgggcacggtagagagctgtttcagtatatgctgcagaaggagcgtgtcgagcctcaccaactggccatagacagaccttcccagaagctgttaaagtttctgaacaagcattataatctcgagaccacagtgccccaagtgaacaactttgtgatcttcgagggatttttcgcacaccaacaccggccacccgctccttccttacgggccacgcgccacagtagggctgccgccgtggaccccaccccagctgctcctgccagaaagctcccaccaaaaagggcagagggggacatcaaaccatactcttcctccgatcgtgagtttcttaaagttgctgtggagcccccttggcccctgaacagagcaccacggagggctacaccccccgctcacccacccccccgaagcagctccctgggcaatagcccggagcggggacccctgcgcccttttgtgccagaacaggaactgttacgcagcttacggctgtgtccgccccatccgaccgctaggctcctattggctgctgatcccgggggatctccagcccagcggagacggacaagcagtctgccaaggtcagaagagtctcggtactag

SEQ ID NO: 26588 - DNA, 1002 bp, Artificial Sequence
  Description of Artificial Sequence: Synthetic coding sequence
atggagttccctttcgacgtcgacgctctttttcctgaacgaattacagtactcgatcaacacttgcgacccccggccagaaggcccggcaccactacccctgcccgagtcgatttgcagcaacaaatcatgaccatcatagatgagcttggcaaagccagcgcaaaagctcagaacttatctgcacctattacctctgcgtctcgcatgcagagcaaccgccatgtggtctatattctgaaagatagcagcgcgaggcccgcagggaaaggcgccatcatcggatttatcaaggtgggctataagaagttatttgtactggacgatcgagaggcccacaatgaggtcgaaccgctctgtattctggacttctacatacacgaatctgtacaaagacacgggcatggtcgcgagctgttccagtacatgctccagaaggagcgcgtagagcctcaccagttagccatcgacaggccctcccaaaagctgctgaaattcctaaataaacactataatcttgaaaccactgtccctcaggttaataactttgttatcttcgaggggttcttcgcccatcaacacagaccacccgccccttcgctaagagcgacacgccattctcgagccgctgcggtcgatcccactccggcagcgccagcgagaaaactgccgccaaaaagagccgaaggagatatcaagccttattctagctcggatagagagtttcttaaagtcgccgtcgagccgccgtggcccctcaatcgcgcaccccgccgcgcgaccccaccagcacatcccccaccgcgcagctcatcactgggcaattctccagaacgcggccccctccggccattcgttcccgagcaggaactgttgaggtctcttcggctgtgtcccccccaccctactgctagactcttactggccgctgatcctggcggtagtcctgcccagagacgtagaacctcatctctgccaagaagcgaggagtcacgatactag

SEQ ID NO: 26589 - DNA, 972 bp, Artificial Sequence
  Description of Artificial Sequence: Synthetic coding sequence
atggaatttcccttcgatgttgacgcactgttccctgagcgtattacagtactcgatcagcatctccggccacctgctaggagacccggcaccaccactcccgcccgggtcgatttacagcaacagattatgactatcattgatgaactgggcaaagcaagcgccaaagcccaaaatctttctgctcccatcaccagcgcctctaggatgcagtccaaccggcacgtggtgtatatcctgaaagacagttcagccaggccggccgggaagggcgccatcattggatttattaaggtgggctacaagaagctgttcgtacttgacgatagggaggctcataatgaggttgagccactgtgcattctggatttttacattcacgaaagtgttcagcgacatggacacgggcgcgagctgtttcagtatatgcttcagaaggagcgggtggaaccccaccagctggctattgaccggccaagccagaagctcctcaagttcctgaacaaacactacaacctggagaccactgtgcctcaggtcaataacttcgtcatctttgaaggttttttcgcacaccagcatcggccccccgcaccctcattgagggccacccgacacagcagggccgccgcagtcgacccaacccccgctgccccggcacgtaaactgcctcccaagcgggcagagggggatattaagccttattctagcagcgaccgggaatttctcaaagtagctgtggaacccccttggccgctgaatcgagcaccgcgccgtgcaactccacccgcccaccctcctccgcgcagttccagtctgggaaacagtcccgaaaggggcccactcaggcccttcgtcccggagcaagagttattgagaagtctcaggctctgcccccctcacccaaccgcgagacttttattagctgcagaccccggagggtcacctgcccagcgtcggcggacccgatag

SEQ ID NO: 26590 - DNA, 1230 bp, Artificial Sequence
  Description of Artificial Sequence: Synthetic coding sequence
atgtggttaacctggcctttttgttttctgacaattacgctgagagaggagggggtgtgtcatctcgagagcgtcgatctgcagcaacagataatgaccattatcgatgaactggggaaagccagtgctaaggctcagaacttgagcgcccccataacctcggcgtcccgcatgcagagcaatcgccatgtggtctacatcctgaaggacagcagcgcccgccccgcaggcaagggcgccattatcggatttatcaaagttggatataagaaactatttgtgctcgatgatcgcgaagctcataatgaggttgaaccactgtgtattctggacttttatatccacgaaagcgttcagcgccatggccacggtcgggagctcttccagtatatgctgcagaaagagagggtggaacctcaccagctggccattgatcgaccatcacagaagctgttgaagttccttaataagcactacaaccttgagactacagtcccccaggtgaacaacttcgttatatttgaaggcttttttgcccaccagcaccgaccccccgccccaagcttgagggccaccaggcacagtcgggctgccgctgtagaccccacccccgctgccccagcacgcaaactgccacccaagagagctgagggtgatatcaagccctactctagctcagaccgggaatttctcaaggtggctgtggaacctccttggccgctcaatcgcgcgcctagaagggccactcctccggctcatcctccaccacgctcctctagcctgggcaactcgccagaacggggtcccctcagaccgttcgtgccagaacaggagctcctgcgctctctgaggctctgtccccctcacccaacagcacgactcttgctcgccgcagatcctggggggtcgcctgctcagcgccggagaacgaggggcacacctccagggctggtggcccagtcgtgctgctacagtcggcacgggggagtgaactcttcctcccccaacaccggaaatcaggacagcaaacaaggcgaacaggagaccaaaaatcgctcagccagcgaggaacaggcattgagccaggacggctcaggggagaagcctatgcacactgccccccctcaagcccctgctccccctgctcagagctggactgttggtggtgacattctgaatgcccgctttattcggaatttacaagaaaggcgctctactcgcccctggtag

SEQ ID NO: 26591 - DNA, 1197 bp, Artificial Sequence
  Description of Artificial Sequence: Synthetic coding sequence
atggaattcccctttgatgtcgacgcgctgttccccgaaaggattaccgtcctggaccagcatctgagacctcctgcccgccgaccaggcaccactactccggccagggtggatctccagcaacagattatgaccattatagacgagctcggaaaagccagtgcaaaagcccaaaatctgtcagcgccaatcacaagcgcctccaggatgcagagcaatagacatgtggtctacatcctaaaagactcctctgccaggccggccggaaaaggggcgatcattggcttcatcaaggtggggtataagaaactatttgtgctggacgaccgtgaggctcacaacgaagtcgaacctctgtgcatcttggacttttacatccacgagtccgtacagcggcacgggcatggtagggagctttttcaatatatgctgcagaaggagcgagtggagccccaccagctggcaatagatcgtccaagccagaagctgttgaaatttcttaataagcactataatctggagacaacagtaccccaggtgaacaacttcgtcatttttgaaggtttctttgcccaccagcatccaccggccaggaaacttccccccaaaagagcagaaggagatataaaaccttactcctccagtgatcgcgaattcctgaaggtagccgtggagcctccgtggccactgaatcgcgcacctcggcgggctaccccgccagcacaccctccgcctcgaagctcctctctgggcaattccccagaacgcggtccactgcggcctttcgtgcccgagcaagaacttctccgcagtttgaggctttgccctccacaccccacagctaggttgctgctcgccgctgatcccggaggcagccctgctcagaggcgcagaacaagaggaaccccccctggattagtggcccagagctgttgttatagccgtcacggaggagtgaatagttcctctcccaacaccgggaatcaggacagcaagcagggtgaacaggaaactaaaaatcgctccgcgtccgaagagcaagctttgtcccaggatggctcaggggagaaacctatgcacaccgcacccccacaggcccctgctccaccagctcagtcgtggacagtcggtggtgatatcctgaatgctaggtttatccggaacctgcaggaaaggaggtcaacacgaccttggtag

SEQ ID NO: 26592 - DNA, 1197 bp, Artificial Sequence
  Description of Artificial Sequence: Synthetic coding sequence
atggagttccctttcgacgtcgacgcccttttccccgagaggatcaccgtgctggaccagcatctcaggccgcctgctcggagacccggcacgactacgcccgctagagtggatctccaacaacaaatcatgacaatcatcgacgagctcggaaaggcctccgccaaagcacagaacctctccgcgcccattacaagcgcttcccggatgcaatcaaacagacatgtcgtatacatactcaaggattccagtgctcgccccgccggaaagggtgccattattgggttcatcaaagtgggatacaagaaactgttcgtgctggatgatcgcgaagctcacaacgaggttgaacccttgtgtattctggatttttatatccacgagagcgtccagcgacacggacacggacgagagctgttccagtacatgctccagaaggaacgagtggagcctcatcaactggctatcgatcggccatcacagaagttgctcaaatttctgaacaagcattacaatctggaaaccactgtgccacaggtgaacaatttcgtgatctttgaaggattttttgctcaccagcacccccctgcacgcaagctcccccctaaacgtgccgagggtgacattaagccctacagctccagcgaccgcgagtttctgaaagtggcagtcgagcccccttggcctctcaaccgagcccctcgccgtgctacacctcctgctcatccgccacccagatcttcctcgcttgggaactcaccggaaaggggccccctccggccattcgttcctgaacaggaattactgcggtctctgagattgtgtccgccacaccccaccgcacgcctcctccttgccgctgatccagggggcagcccggcgcagaggcgcagaacaagaggtacacctcccggtttggtggcacagtcctgttgttattctaggcacggtggggtgaattctagcagccccaataccgggaatcaagatagcaagcagggcgagcaggaaactaagaacaggagtgccagcgaggaacaagctctgagccaagatggctcaggcgaaaagcccatgcacacggctcctccccaggccccagctcccccagctcagtcgtggaccgttggaggcgatatactgaatgcaaggttcatcagaaatcttcaggagaggcgctccacccggccttggtag

SEQ ID NO: 26593 - DNA, 1197 bp, Artificial Sequence
  Description of Artificial Sequence: Synthetic coding sequence
atggagttcccctttgatgtagacgcattattcccggagcggattacagtgttagatcaacacttaagacctccagcgcgcagaccagggactacaaccccagcacgagtggacctgcagcagcaaatcatgacgataatcgacgaactgggcaaagcctcggccaaggcacagaatctgagcgcaccaatcaccagcgcctctcggatgcaatctaaccgacacgtagtctacattctgaaggattctagcgcacgccctgctggcaagggcgccatcatcgggttcataaaagtgggctataagaaactgtttgtgctggacgaccgggaggcacataacgaggtggagccactctgtatcctggatttctacattcatgagtctgttcagcgccatggccatgggcgcgagctgttccaatatatgctgcaaaaggagcgggtggaaccacatcagttggcaatcgatcgcccgtcgcagaagctgctgaaattccttaataagcattataatttagaaaccacagtgccccaggtcaacaatttcgtcattttcgagggattcttcgctcatcaacatcctcctgctcggaaactgcctcccaagagagccgaaggcgacataaaaccatactcctcttccgatcgggagttcttaaaggtggctgtcgaaccgccttggcccctgaatagagcccctaggagagccactcccccagcacacccaccaccgcgaagctcatccctcggtaactcccccgagaggggcccactgcgccctttcgtgcccgagcaggagctgctcaggtcactgaggctgtgtccaccccatcctactgccaggcttctgctggccgccgaccctgggggatccccggctcagagacgacgaacacgaggaactcctcccggcctggtcgcacaaagctgttgctacagcagacacgggggcgtcaattcatcttcccctaatacaggaaatcaggacagcaagcaaggtgagcaggagacaaagaaccggagcgcctcagaagaacaggcattgtcacaggacggatctggtgagaagccgatgcacactgcacctcctcaggcccccgcacctcccgcgcagtcttggaccgtgggaggggatatactgaatgcaaggtttatacgtaacctgcaagagaggcggagcactagaccatggtag

SEQ ID NO: 26594 - DNA, 1197 bp, Artificial Sequence
  Description of Artificial Sequence: Synthetic coding sequence
atggagttcccatttgatgttgacgctctcttccctgaacgcatcaccgtcctggaccagcatctccgtccccccgctcggcggccggggacaactactcctgctagggtggatttgcaacagcagataatgaccattatagacgagctcggcaaagcctctgccaaggcccagaatttaagcgctcccatcacctcggcatcacggatgcaatcgaataggcacgtcgtctatatcttgaaggacagctctgcgagaccagctggcaaaggtgctattattggattcatcaaggttggatataagaagttgttcgtgcttgatgatcgcgaggcacataacgaagtcgaacccctgtgcattctagacttctatatccatgaaagtgtgcaacggcatggccatggtagggagctttttcaatacatgctacagaaagagcgcgttgaacctcaccagcttgctatcgatcggccctcacaaaagctgcttaaattccttaataaacattataacctggagactaccgtgcctcaggttaataacttcgtgatctttgagggatttttcgcccatcaacacccaccagccaggaagctccctcccaaacgagccgaaggcgacatcaagccatattcctcaagtgatagggagtttttaaaggtagcagtggaacccccctggccactgaatcgcgccccccggagggccaccccaccagcacatccccctccaaggagcagcagcctcggcaacagccccgaaagaggacccttgaggcccttcgtgccagagcaggagctgctccgctctctgagattatgcccacctcacccaacagccagactactgcttgccgccgatcctggcggaagccctgcacagagaaggcgtaccagaggaaccccccccggactggtggcccagtcttgctgctattctaggcatgggggtgtgaacagttccagcccaaatactgggaatcaggatagcaaacagggcgagcaggaaacaaagaataggagcgccagcgaggagcaagctctgtcccaggatggtagcggtgaaaagcccatgcatactgctcccccccaggctcccgctccacctgctcagagctggacagtgggcggggatatcctcaacgcacgctttatcagaaatcttcaagagcggcgcagcacccgaccctggtag

SEQ ID NO: 26595 - DNA, 1197 bp, Artificial Sequence
  Description of Artificial Sequence: Synthetic coding sequence
atggagttcccgttcgatgtggatgcgcttttcccagaacgcataaccgtccttgaccagcatctgcgtcctcctgcccggagaccaggtaccacaacaccggccagggttgacctgcaacagcagatcatgacaatcatagacgagctggggaaagcctcggccaaggcacagaatctctctgctcctatcacatcagcatccaggatgcaaagtaatcggcacgttgtttacattcttaaggacagctcagctcgaccggctggcaaaggcgctatcatcgggtttataaaagttggctataaaaagttgtttgtgctcgatgacagagaggctcacaatgaagtcgagcccctgtgcattctggacttttatatacacgagtcggttcaacgacacggccatgggcgggaactgtttcagtatatgcttcagaaagaaagggtcgaacctcaccagctggcgatcgaccgcccctctcagaagctccttaaatttctcaacaaacactataaccttgaaacaacagtacctcaggtcaacaattttgttatattcgagggcttcttcgcccaccaacacccgcctgcccgcaaactgccaccaaaacgagccgagggggatattaagccatatagctcaagcgacagggaatttctgaaagtagctgtcgaaccaccctggccgctcaaccgcgctcctagaagagccacccccccggcccatccacccccgcggtcctcctccctcggcaattctcccgaacgaggacctctgcgccccttcgtccccgaacaagaacttctgagaagcctgcggctctgtcctccccaccctactgcgcgcctgctactggctgccgacccaggtggaagtcctgctcaacggagaaggactagaggtaccccacctggcttggtcgcacagagctgttgttacagcagacatggaggagttaacagcagcagtcctaatactgggaaccaggactctaaacagggtgagcaagagaccaaaaataggtctgcctctgaggagcaggctcttagtcaggacgggagtggagagaagcccatgcacactgcacctccacaggctccagccccccctgcccagtcctggactgtaggtggcgatatcctaaatgccaggttcatcaggaaccttcaagagagaagaagcacccgcccctggtag

SEQ ID NO: 26596 - DNA, 1197 bp, Artificial Sequence
  Description of Artificial Sequence: Synthetic coding sequence
atggaattcccgttcgacgtagatgcgctctttcccgagcgaatcaccgtgctcgatcagcacctgagaccccctgccaggagaccaggtaccaccacacctgctcgtgtggacctgcagcagcagattatgacaattatcgacgaactcggaaaagcgagtgcaaaagcccagaacttgtctgcccctattacaagcgcctcacgcatgcaaagcaaccgccacgtggtgtacattttgaaggattcctctgcacgacccgccggcaaaggagcgatcatagggttcataaaagtgggatacaagaagctgttcgtattagacgatagagaggcgcataatgaggtggagccactgtgtatacttgacttttatatccacgagtccgtccagaggcatggtcacgggagagaacttttccaatacatgctgcagaaggaacgagtcgaaccccaccagttggctatcgatagaccctcacaaaagttgttgaagttcctcaataaacattataatctggagactacagtccctcaggtgaacaacttcgtaatttttgaaggatttttcgctcaccagcatccccccgcgcgcaagctccctccgaagcgggccgagggtgatataaaaccttacagctcctcagacagggaatttttgaaagtagccgtagaaccgccgtggcctttaaatagggccccccggcgggccacacccccagcccacccacctccgaggagttcttcccttgggaattcacctgaacgcgggcccctccgaccattcgtgccggagcaggagctcctgagatccctgagactgtgccccccacatccgaccgcccggctcctgctcgcggcagacccgggggggtctccggcccaacgtaggaggacccgcggaacaccccccggtcttgtagcccagtcttgttgttattctcggcacgggggggtgaactctagttcacccaacaccggcaaccaggactccaaacagggcgaacaggaaaccaagaatcgcagcgcaagtgaggaacaagcgctgagccaggacggaagcggtgagaaacccatgcataccgccccccctcaggcgccggccccgccagcacagtcctggaccgtcggaggtgacatccttaacgccaggttcatccgcaatctgcaggagcgcaggagcacaaggccctggtag

SEQ ID NO: 26597 - DNA, 618 bp, Artificial Sequence
  Description of Artificial Sequence: Synthetic coding sequence
atgtcgtttgccactaagttcagtgactatttcttgctcatcgaagacaacgtgtttttcgcgcccaattttgtcacacacattcactccagagttaccacaatgaagtcgaatagttgggtgctgatggagttcagtaatatgggcttcttgggcaaactatttcatagtagggacctgcctctgctggctcattttctgctgcttttctacaaggagaagcccctcgactcactcatatcccattttcacactttgctggtgcaggagtcaccaatactatgcaggccttttcttttctattgccgtgtgagttataccgccttcgatcataaacagaaggcgacagccctccagaaaaagaatgccgacggcccaaataatccccccggcgctgtttttaccgatatgcaggtgagtgatgtgcacttcccctgggaagcatatactttggacgagagttttttttggactcataatatatcgattggaaaccatttgactgtgattctgaatcatcctgccaaccttagtcgtgttcaggttatgaccggtagcattgtggaatgggaagtccgtccgggagaaggggctggcggggccggactgccaacatag

SEQ ID NO: 26598 - DNA, 618 bp, Artificial Sequence
  Description of Artificial Sequence: Synthetic coding sequence
atgagttttgcaactaaattttccgactatttcttacttatcgaggacaacgtcttcttcgcgccaaacttcgtaacccatatccacagccgggtgactaccatgaagtctaactcgtgggttctgatggagtttagcaacatgggattcctcggtaaactattccactcccgcgatctaccactgctggcccactttcttctacttttctacaaggaaaaaccgcttgactccctgatttcacatttccatacattgctggtccaagagagtcccattctctgtcggccgttcctgttttattgcagagtttcctataccgcgttcgatcacaagcagaaagctaccgctctgcagaaaaaaaatgcggacggtcctaataatccacctggcgctgtgtttaccgatatgcaggtcagtgacgtgcacttcccctgggaagcatacaccctggacgaaagcttcttttggacccacaacatatccatcggaaatcacctgacggttattcttaatcacccagctaacttatcacgggtgcaggtgatgaccggttctatcgtagagtgggaagttaggccaggagagggtgccgggggcgcaggcctgccaacgtag

SEQ ID NO: 26599 - DNA, 6513 bp, Artificial Sequence
  Description of Artificial Sequence: Synthetic coding sequence
atgaaagatagcgaagggccccagcgaccacccctgtgctttctcagtactctgctcagccaaaaggttccggagaagagcgatgctgtgctaagatgcattataagtggacaacctaagccagaggttacttggtacaaaaatggccaggctattgacggatctgggatcatctcgaactacgagttcttcgagaatcagtatatacatgtgctgcatctttcttgttgtaccaagaacgacgccgcagtataccagatcagtgcaaaaaatagctttgggatgatatgttgttcagcatctgtcgaggttgagtgttcatcagagaacccccaactctcccccaatctggaggacgacagggaccggggatggaaacacgagacggggacccacgaagaggagagagcaaaccagattgatgagaaagagcacccttacaaggaggaggagtctatcagtcccggcacaccgcgctcagcagactccagcccatccaagtcaaatcacagcttgtccttgcagagccttggcaacctcgacatttcagtttctagttccgagaatcctcttggagtcaaaggaacacgccataccggtgaggcgtacgatcctagtaacactgaggaaatcgctaatggccttctctttctgaactcatcacacatctacgagaagcaggatagatgctgtcacaagaccgtccacagtatggcctctaagttcacagatggcgatctgaacaacgatggcccccatgacgagggactaagaagtagtcagcagaacccgaaagtgcagaaatacattagctttagcctgccactctcagaggcaactgcacacatttatcctggggatagcgccgtggcaaataagcaaccttctccacaactgtcctctgaggatagcgactccgattacgagctatgccctgaaataaccctaacttataccgaggagttctccgatgatgatttggagtacttagagtgctcggatgtgatgacagactacagcaacgctgtatggcagaggaatctgctcgggaccgaacacgtgttccttttggaatcggacgacgaggaaatggagtttggagagcattgcctcggtggatgcgagcatttcttatcaggcatgggctgcggaagcagggtgagtggggacgccggtccaatggttgcaacagcaggattttgcgggcatcacagccaaccacaggaagtgggtgtgcggtccagccgcgtatcaaaacacgggcctagcagcccgcagacaggaatgactctaatactgggcccgcaccaggatggaacaagttccgtcacagaacagggcagatacaaactgccaaccgcacccgaagcagcagaaaatgactacccaggaattcagggcgagacacgggattcccaccaggcccgtgaagaattcgcgtcagacaatcttctgaatatggacgaatctgtacgcgagacggagatgaagctgttaagcggtgaaagcgagaatagtgggatgagccaatgctgggaaaccgcagcggacaagcgtgtgggtgggaaggacctgtggagcaagcgcgggtccaggaagtccgctagggtgaggcaacccggcatgaaaggtaaccctaaaaagcctaatgccaatttgagagagagtaccactgagggcactctgcatctatgttcggctaaggaaagtgcagagccaccacttacgcagtctgacaagcgggaaacctcgcatacaacagccgctgccactgggagatcgtcacacgcagacgcccgcgaatgtgccatttccactcaggcggagcaggaagccaagacgctgcaaacctcaactgattcagtctctaaagagggcaacaccaactgcaagggagagggaatgcaggtgaatactctgttcgagaccagtcaggtgcccgactggtccgacccgcctcaggtgcaggtccaagagactgtcagggagacgatttcctgcagccagatgccggccttttccgaacccgcgggagaagaaagcccgtttactggtacaactaccatcagtttcagcaacttgggaggcgtacataaagaaaacgccagtctcgctcagcactcggaggtcaaaccttgcacctgcggccctcagcatgaagaaaagcaggatagagatggcaacattcctgacaacttcagagaagatctgaagtatgagcagagcatcagcgaagcaaatgatgagacaatgtctcctggcgttttctcaaggcacttaccgaaagacgcccgcgccgatttccgggaaccagtggctgtcagcgttgcttcccccgaacctacagacaccgctcttacattggagaacgtgtgtgatgaaccccgggatcgggaggccgtttgtgcaatggaatgcttcgaggcaggggatcagggaacatgtttcgatactattgatagtttggttggtcggcctgtcgataagtactctccccaggagatttgcagtgtggataccgagctggcggagggacagaacaaggtgtcagacttatgctcttccaacgacaaaaccctggaggtttttttccagacacaggtgagtgagacctccgtgagcacttgtaaaagcagtaaggatggcaacagcgtcatgtcacccctgtttacatccacttttaccctgaatatcagccatactgcctctgagggagcaaccggcgagaatctcgctaaggttgagaacagtacttaccccttggcatccacagtccatgcaggccaggagcagcctagtccttctaacagcggcggactggacgagactcagctcctcagttcagaaaataatccactggtgcagtttaaggaagggggagacaaaagtcccagcccatctgctgccgataccaccgccacccccgcctcctacagctctattgtttcttttccctgggaaaaaccgacaaccctgactgcaaataacgagtgcttccaggcaacgcgcgagacagaagatacctcgaccgtgactatcgcaacagaggtgcatcccgccaaatatctggccgtgtcaatcccggaggacaaacacgcagggggcaccgaggagcggttcccacgcgcatcccatgagaaagtgagccagttcccttctcaagtccagctggatcacatactcagtggcgccaccattaagagtaccaaggagttgctatgcagagcaccatccgtcccaggcgtccctcaccatgttctacagctgcctgagggggagggcttttgctctaattcccccctgcaggtcgataatctgtccggagataagtcacagacagtcgatcgggccgattttcgctcttacgaggaaaacttccaggagcgcgggtctgagacaaagcagggggtgcagcaacaatctttgtcccagcagggctccctttccgcccccgattttcaacagagtctgcccacaacctcagccgctcaggaggaacgcaatctggtgccaaccgctcacagccctgctagctcccgggagggcgcaggccagagatcaggatgggggactcgcgtctctgttgttgcggaaaccgcaggcgaagaagactcccaggctttaagtaacgtccccagcttatcagacattttgctcgaggagagtaaggagtaccgacctgggaactgggaggctggcaacaagctcaagattatcacactggaggcgagcgctagcgagatctggccgcccaggcaacttacaaactccgaatctaaggcctctgatggcggcctgattattcccgacaaggtctgggccgtccccgattccctgaaggctgacgctgtggtgcccgagctagcacccagcgagatcgcagcactggcccactctccggaagacgcagagtccgcactggcagacagcagggagtcacacaaaggggaagaacctaccattagcgtgcactggcgcagtctgagctctcggggcttctctcagccacgacttctggagagttctgtggaccccgttgacgaaaaagaactgtccgtgactgactccctatctgctgcctctgaaacaggtggcaaggaaaacgtaaataatgtgagccaggatcaggaggagaagcagctgaaaatggaccacactgcattctttaaaaagtttttgacatgtcctaagattctcgaatcttctgtggaccctattgacgagattagtgtgatagaatatacaagagccggtaagcctgagccctccgaaacaacaccacagggcgcaagagagggggggcagtctaacgacgggaatatgggtcatgaagccgaaattcagcctgccatcttgcaagtgccctgtctgcagggaacaatactgagtgaaaatcggatctctcgttcccaggagggcagcatgaaacaggaagctgagcagatccagcctgaggaggctaagacggccatttggcaggtgctgcaaccctctgaaggtggggagcgaatcccttcaggctgtagtatcggacagattcaggagagctcggacgggtccctcggagaggccgaacagtccaaaaaggacaaggccgagctcattagccccaccagccctcttagttcttgtttgccgataatgacacacgcctcactgggcgtagacacccataactccacaggccagatacacgacgtaccagaaaatgatatcgtggagccacgaaaacgccagtatgtgttcccagtgagtcagaagagaggaacaatagagaatgagcgcggaaagccactgccaagtagcccggatctaactagatttccatgcacatcgtcccctgagggcaacgtcaccgactttctgatatcccataagatggaagagcccaaaattgaggtactgcagatcggagagacaaagccaccttccagctcaagcagctcggccaaaaccctagcttttatatccggtgagcgggaactggaaaaggccccaaagctcctgcaagatccttgtcagaaggggactctcgggtgcgccaaaaaatcgagggaacgcgaaaagtcattagaggctcgcgccggaaagagccccgggacattaactgccgtaacaggctccgaagaagtgaagcgtaagcccgaagccccgggaagcgggcatcttgcagagggcgtgaagaagaaaatcctctctcgggtggccgcactgcgtctgaagctcgaggagaaggaaaacatccgcaagaatagcgcctttcttaagaaaatgcccaagcttgaaaccagtctgtcccacaccgaggaaaaacaagacccaaaaaaaccatcatgcaagcgagaaggacgggccccggtcctgctgaaaaagatacaggccgaaatgtttccggaacatagcggcaacgtgaagctgagctgtcaattcgctgagatccacgaagacagtaccatctgctggactaaagattcaaaatctattgcccaagttcagaggagtgctggagacaattccacggttagctttgcaattgtccaggcatcccccaaggatcagggtctgtactattgctgtattaagaactcatacgggaaagttaccgccgagtttaacctcaccgccgaggtccttaagcagctctcttctcgccaggataccaaagggtgcgaagagatcgaatttagtcagcttattttcaaagaggacttcctgcacgattcgtatttcggcgggaggttacgcgggcaaatcgctaccgaggagctgcactttggtgagggagtccatcggaaggcgttcagatccacggtgatgcatgggctcatgccagtattcaagcctgggcacgcttgcgtgctgaaagtgcataatgctatcgcttatgggacccgaaacaatgatgagctaatacagaggaattataaactggccgcgcaagaatgttacgtacagaacacagcccgctactatgccaaaatttatgccgctgaggcccagcctctggaaggcttcggcgaagtaccagaaataatacctatcttcctcatccatcgacctgagaacaacataccatatgccaccgtcgaggaggagctgatcggggaattcgttaaatattccatcagagatggtaaagagattaactttttaagaagagagtcagaggccgggcaaaaatgttgcacgtttcagcattgggtgtaccagaagacctccggatgtctcctcgttactgacatgcaaggggtcgggatgaagctcacggacgtgggcatagcgacactagccaaaggttataagggctttaagggaaattgttccatgacctttatagaccagtttaaagccttgcatcagtgcaataaatattgcaagatgctcggtctgaagtctttacagaacaataatcagaaacagaaacagccaagtatcggaaaatcaaaagtgcagaccaattccatgacaataaagaaggctggtcccgagactccaggggagaagaagacgtag

SEQ ID NO: 26600 - DNA, 1230 bp, Artificial Sequence
  Description of Artificial Sequence: Synthetic coding sequence
atgcggggggaacagggcgcagcaggggccagagttttgcagtttacaaactgcagaatcctgagaggggggaagctcttgcgtgaggacctgtgggtcagaggcggcaggatcctggaccccgagaagctgtttttcgaggaacgccgggtcgcagatgagcgcagagattgtgggggacgcatactggcaccaggatttattgatgttcagataaatggggggtttggcgtggacttcagtcaggcgacggaggacgtcggatccggtgtcgccttggtggcccgccgcattctgtcccatggagtgacttctttttgtcctacgttagtgacatctccaccagaggtgtatcacaaagtggtacctcagatcccagtcaaatcaggaggtcctcatggcgctggagtgctgggactgcaccttgaagggcctttcatttctcgggagaaaagaggcgctcatcccgaagcccacctgcgctcctttgaggctgacgcttttcaggatttgctagccacatacggacctctagataatgtgagaatcgtcactctggcccccgaattgggcagatctcacgaggtgatcagggccctaaccgcgagaggaatttgtgtctccctgggccattcggtagcggatctgagggcagccgaggacgctgtatggtctggggccacgttcattacacatctgttcaatgcgatgctgccctttcatcacagggaccccgggatcgtcggcctcttgactagtgatcggctgcctgctggccggtgcatcttttacggaatgatagcagacgggacccacactaacccggctgcgctcagaattgcccacagagctcacccacaaggcctggtgttagtgacggacgccatccccgccctggggctgggaaatggcagacatacactagggcaacaggaagttgaagtggatggacttacagcctatgtggctgggactaagactctatcaggtagcattgcccccatggatgtctgtgtgcgtcatttcctgcaggctacgggttgttccatggaaagtgcattggaggccgcctcattacacccagcccagctactcgggctcgagaagagtaaaggaaccctggattttggcgcggacgccgacttcgtagtcctcgatgattcactgcacgtgcaagctacttatattagtggcgaactcgtctggcaagctgacgccgctcgacagtag

SEQ ID NO: 26601 - DNA, 1320 bp, Artificial Sequence
  Description of Artificial Sequence: Synthetic coding sequence
atgaggggggagcagggtgccgcaggagcgagagtgctgcagttcacaaattgcaggattctaagggggggtaaactcctccgggaagacctctgggtgcggggcggccgcatcttggaccccgagaaactgttctttgaggagcgtcgggtagccgatgagcgccgggattgtggtgggcgcattttagctcccggtttcattgacgttcagatcaacggcggtttcggtgtggactttagccaggccaccgaagacgtgggttccggcgtggcgctagtggcgcgccgcatccttagccatggggtcacatcgttttgcccaacactggtgactagccctcctgaagtataccataaagtggtgccccagattcctgtaaaatcaggcggaccccacggagctggtgtgctgggactacacctggaaggcccattcatcagtagggagaagagaggagcccaccctgaagcgcatttgcgatctttcgaggcagatgcatttcaggacttgttggcgacctatgggcccctggataacgtacgcattgtgactctcgcccctgagctgggacggtctcacgaagtaatacgcgcattaacagcgagaggcatttgcgtgagcctcgggcactctgtagctgacctcagggccgctgaggacgccgtctggtcaggcgcgacattcatcacccaccttttcaatgctatgcttcccttccatcaccgcgatcccggaatcgtgggacttctgacatctgaccgcctgcctgccgggcgctgtatcttctacggcatgattgccgatggaacccacactaaccctgctgcattgcggatagcccatcgcgcacatccacagggactggtcctggtgactgacgctattccagcgctaggccttggtaacggaagacacaccctcggacagcaggaggtcgaggtggatgggctcactgcctatgtcgcaggcgagagaccggaccccctaggacctaggtcccagccagcttgtcaggttgcccacgaccctccgcgtgcctgccctctctgctctcagggcactaagacattgtccggatctatagctcccatggacgtttgtgtacgccacttcctccaagctactgggtgtagcatggaatcagcccttgaagcagcgtcactgcatccagctcagctgctcggtttggaaaaatctaaaggtactcttgatttcggagctgatgcggacttcgtggtgctggacgactctctgcatgtgcaggcaacttatatcagtggtgaactggtgtggcaggctgatgctgcccgccagtag

SEQ ID NO: 26602 - DNA, 1785 bp, Artificial Sequence
  Description of Artificial Sequence: Synthetic coding sequence
atgcgtggagaacagggagcagccggagcccgggtgctacaattcactaattgtcgcattctccgcggggggaagctgctgagggaggacttgtgggtccggggtggccggattttggaccccgagaaactgttcttcgaagagagacgagtcgccgatgagcggcgcgactgtggtgggcggattctggcccccggattcatcgatgtgcaaatcaacgggggcttcggcgtcgactttagtcaggcaaccgaggatgtgggctcaggtgtcgctctcgtggccagaaggatattgagtcatggcgtgacatcattttgtccaaccctcgttaccagcccacctgaagtgtaccacaaggttgtgccccagataccagtcaaaagcggggggccccacggtgccggggtgctcggcttgcatctggaaggaccctttatcagtcgcgagaagcgtggagcacacccagaggctcacctaaggagcttcgaggcagacgcattccaggatctactggccacctatggccctctggacaacgttcgaattgtcacacttgcccccgagctcggacgctcccacgaggtcatccgtgctcttactgccaggggcatctgcgttagcctggggcattctgtcgctgacctgagagccgctgaagacgccgtgtggtccggagcaacatttattacgcacctctttaacgcaatgcttccttttcaccaccgggaccctggaatcgtcggcctcctgacaagtgatcggttgcctgccgggaggtgcatcttctatggaatgattgctgacggcactcacaccaatcctgccgcgttacgaatcgcccatcgcgcccatccacagggtctggtgctagtaaccgatgccatcccagctctagggttggggaacggcagacacactctggggcagcaggaggtggaagtggatggccttaccgcatacgtggctggcgagcgaccagatcctctgggcccgcggtcccagccagcatgccaggttgctcacgaccctcccagagcatgtccactctgctcacagggaacaaagacgctctcagggagtatagccccgatggatgtctgtgtcaggcattttctacaagcaacgggctgctcgatggaatccgccttagaggcagctagccttcaccctgcccagttactaggtttagaaaaatcgaagggcacccttgattttggcgccgatgctgactttgtcgtgctggatgactccctgcacgttcaggccacttacatctctggcccagtcctggccgggtgtggagaccccgcttggtgctggagagccgtgtgggaggcaccagtgtgccccgctcaccccatatctgtcattctgccatcctctgtgagcccttggccatggcatacaccaatgtggcaaaccagagcggtaagactgcccgaacagctccgtggtggctgggccagcggggcacttctggccctccggacagctaccgttggctctgatgttcgcgattggtgttcccccaccagtggggtaatcgtgttgactttttctcccttcgagttttggggtgggtggcttccctccccacttctgacaggagctgtgttgggcactggtggaaccagactagctcttcctctcttcagtagtctgtgttgtaaagcgcaacttaggaaatgcctccaagtccaaagagatcggatggtttgggccccacccgttggacgggagcagccgggtaagaatcacttaccagggcaaggattggcctag

SEQ ID NO: 26603 - DNA, 933 bp, Artificial Sequence
  Description of Artificial Sequence: Synthetic coding sequence
atgggtaaaaggaggtgcgtgccccccctggagccaaaactggcagccggatgttgcggggtgaagaaaccaaagcttagcgggtcaggcacccatagccacggcaatcagtcgacaactgttccaggtagctcatccggccccctccagaatcaccagcatgtagactccagctctggtagagaaaatgtgtccgacttaacattaggacctgggaactcacctatcaccaggatgaacccagcatccggtgcactgagcccgctgccgcgcccgaatggaaccgctaacacaaccaagaatcttgtggtcaccgcagaaatgtgctgttactgtttcgacgtcctttactgccacctttacgggttccctcagccaaggctgccaagatttacgaacgacccctacccgctcttcgttacatggaagaccggacgggacaagagactgaggggctgcataggcaccttctccgctatgaacctgcactcaggtctgagagagtacacattgacgtcagccctgaaagactccaggtttccacctttaacacgagaggagttacccaaacttttttgttcagtatcactactcacgaatttcgaggacgcgtccgactacctcgactgggaagtgggagtccacggaatccgaattgagtttatcaatgagaaaggagtgaagagaacagccacctacctgcctgaagtcgctaaggaacaagattgggaccagattcagactattgattccctgctaaggaagggtggatttaaggcccctatcacatcagagtttcgcaaaaccataaaactgactcgttaccgatcagaaaaagtgacaatatcatacgctgaatatatcgccagccgacagcactgtttccaaaatggcactttacatgcaccccctctttacaaccattacagctag

SEQ ID NO: 26604 - DNA, 933 bp, Artificial Sequence
  Description of Artificial Sequence: Synthetic coding sequence
atggggaaaaggaggtgcgtgcccccccttgaacctaagctagcagcaggctgctgtggcgtaaagaagcctaagctgtctgggtccggaactcatagtcacggcaaccagtctacaacagtgcccggatcgagtagtggccctctgcagaatcaccagcacgtggacagctcctctggcagggaaaatgtcagcgatcttacacttggtcccggaaattcacccattacgcgaatgaacccagcgtccggcgcgctgtcccccctgccccgcccaaatgggaccgctaataccaccaagaacttagtggtgacagccgagatgtgctgctactgtttcgatgtgctctattgccacttgtacggtttcccacagccccgcttaccacggttcacgaatgacccctatcctctgttcgtgacatggaagaccggacgcgataagagactgcgcgggtgtatcgggacgtttagcgccatgaatctgcacagcggtctcagagaatacacattgacttcggcactgaaggacagcaggttcccaccactgacccgggaagagttacccaaactgttctgtagtgtgagtctattgacaaacttcgaggacgccagcgattacctcgattgggaggtgggcgtgcacgggattagaattgaattcataaacgaaaagggcgtaaaacgcaccgcaacttaccttccagaagtggccaaagagcaagattgggaccagatacaaacaatcgactcactgttgaggaaaggcggcttcaaggcccccatcacctcggaatttagaaagacaatcaagcttacacggtatcgctctgaaaaggtcacaattagctatgccgagtatattgcaagccggcagcattgcttccagaacggaacccttcatgccccccccctctacaatcactatagctag

SEQ ID NO: 26605 - DNA, 1728 bp, Artificial Sequence
  Description of Artificial Sequence: Synthetic coding sequence
atggatttcccaacaatcagcaggagtccctcaggcccccccgcgatggacctggaagggccgcgcgatatattggtcccctccgaggatctaacgcccgatagtcagtgggaccccatgccggggggccctggatctctgtctcgtatggagctggacgagagttccctccaggaattggtgcagcagtttgaagccctgccaggcgacctggtagggcctagtcccggcggtgcaccttgcccattgcatatagctactggccatggcctggcaagtcaggagattgctgatgcccacggactgctcagtgccgaagccgggcgggacgacctattaggcctgctgcactgtgaggagtgcccaccttctcagacaggcccggaggaacctttggagcctgcccctcgccttttacaaccacctgaggatcctgatgaggacagcgactctcccgagtgggtagagggcgcttcggctgagcaggaaggatcaagatcaagttccagtagtccagaaccctggctcgaaacagtccccctcgtgaccccagaggaacctcctgctggcgctcagtccccggaaaccctggctagctatcccgcaccccaggaggtcccaggcccctgcgatcacgaagatctgctggatggtgtcatctttggggcccgctatctcgggtctacacaattggttagcgagagaaatccacccaccagtaccagaatggcccaggcccgcgaagccatggaccgtgtgaaagctccagatggggaaacccagcccatgacagaggtggatcttttcgtgtctacaaagagaatcaaagtgctgacggctgactcacaagaggctatgatggaccatgctctacataccattagctacacggcggatatcgggtgtgtgctagttctgatggcacgccgacggctcgcgagaaggcctgctcctcaagatcacggcagacgactgtataagatgctgtgtcatgtattctatgccgaggatgctcaattgatcgctcaggctattggacaagcgtttgcagccgcctatagtcagttccttcgggagagcggaatcgatccgtcacaagtaggtgtgcatccgagtcccggagcgtgtcatctccataatggcgacctcgaccacttcagcaatagcgacaattgtagggaggtacatctagagaagaggaggggagagggcttgggggtggccctggtggaaagtggctggggtagtctgcttcccacagctgtaattgccaaccttctgcatggcggccccgctgaacggagcggggccctgtctattggagatagactgacagcgatcaatggcacttcgctagtggggttgcctctcgcagcttgtcaggctgccgtccgtgagaccaagtctcagacctcagtcacgctcagcatcgtgcactgcccccccgttactaccgctatcatacaccgaccacacgcacgggagcagctggggttctgtgtagaggacggaattatctgttccctcctgcgtggaggtattgcggaacgaggaggcatcagggtggggcaccgcattatcgaaatcaatggacaatcagtggtcgccacaccccacgctcgcatcatagagcttctgacggaagcttacggcgaggtacacatcaaaacaatgccagcagcaacttaccgcctactgactggacaggaacagcctgtatacttgtag

SEQ ID NO: 26606 - DNA, 2013 bp, Artificial Sequence
  Description of Artificial Sequence: Synthetic coding sequence
atgatcgcttcctgtttgtgctaccttttgctccccgcaacacgcctattcagagcgctctctgatgcattctttacatgtcggaagaacgtcttgctcgcaaactctagtagcccacaggttgaaggcgattttgctatggctccccgggggcccgagcaagaagaatgtgagggcctgttgcagcagtggagggaggaaggtctgagtcaagtgctgtcaacagcttccgagggccccctaattgacaagggactggcccaaagttcgctggcactcttaatggataacccaggggaggagaatgcggccagtgaggatcgctggtcttcacggcaactcagcgatttgcgggcagcagagaacttggatgagccgttcccggagatgctcggagaagagcccttattagaggtagagggagtggaagggtccatgtgggctgctatcccgatgcagtcagagcctcagtacgctgactgtgccgccttgccagtgggtgccctggctactgaacagtgggaggaagaccccgctgtgctggcatggtccattgctcccgagcctgtccctcaagaagaggcgagcatctggcccttcgaagggttaggacaactgcagcctcccgccgttgagatcccctaccatgagatcctctggagggagtgggaggacttttcaactcagcccgatgctcaggggcttaaggctggggatgggcctcagttccagttcaccctgatgtcctacaatatcttggctcaggacctgatgcaacagtcttctgagctctatctgcactgccaccctgacattcttaactggaattacaggttcgtcaatctgatgcaagagttccagcattgggaccctgacattttatgtttgcaagaagtgcaagaggatcactactgggaacagcttgaaccgtctcttagaatgatgggtttcacttgcttttacaagagacgaactggatgcaagaccgacggctgcgcagtatgctacaaaccgaccagattccgcctgttatgcgccagccctgtcgagtacttccgccccggactagagctgctgaatagggacaatgttggactagtgctgctgctgcagcctctcgtccccgagggccttggtcaggtgagtgtggcaccgctctgcgtggctaatactcatatcttgtataaccctaggaggggggacgtgaaactggcccagatggccattctgctggctgaagtcgacaaggtcgcgaggctgagcgatggctcccactgtcccattatcctgtgtggagatctgaattccgtgccagactctccattatataacttcatcagggatggagagctgcagtaccacgggatgcccgcatggaaggtcagtgggcaggaagacttcagccaccagctatatcagagaaaactgcaagcacccctttggccatcatctctggggattaccgactgctgccaatatgtcacctcatgtcacccaaagcgctctgagcgccgcaagtacggacgagactttctcttgcgctttagattctgttccatcgcctgtcaacgacccgttggattggtcttgatggagggcgtgaccgacacaaagcccgagaggcccgcaggatgggctgagtcagtgctggaggaggatgcttccgagctcgagcccgcattctctagaacggttggtacaattcagcattgcttgcacctgaccagtgtatatacccacttcctgccccagcggggtcggcctgaagtgaccacaatgcccctggggctgggaatgacagtggactatattttttttagtgccgaatcctgcgaaaacggcaatcggacagaccatagactctatagagacggcacgctgaagctgctcggacggctgtccctattatccgaagagatactttgggcagccaacggactgccgaacccattttgttcaagtgatcatctgtgcctgctggcgtccttcggcatggaggtaactgctccttag

SEQ ID NO: 26607 - DNA, 789 bp, Artificial Sequence
  Description of Artificial Sequence: Synthetic coding sequence
atgttccctcatcattccagatcgctaggaagagattggaccacgccatgggaaaacctgcaacggtgttgctggaaccgacatatctctagctgcatgcggtggcccggccattattctagggcaccatacccttatttcagcagtcgacactttagtctgaactggcgccccccttgcctgttcgagtcgcgtacccagttccagtactgcaactggagacctgacaacttatcacagaccagcttgattcacttgagcagctatgtgatgaatgcagaaggggatgagccatctagtaagcggcgcaagcaccaaggtgttatcaaacggaactgggagtacatttgcagccacgataaagaaaagactaagatcctgggcgacaagaacgtcgaccccaaatgtgaggattccgagaataaatttgacttttctgtcatgagctataatatcctgtctcaggacctgctcgaggacaatagccacctttatcggcactgccgcaggcctgtccttcactggagctttcgttttcccaacattctgaaggaaatcaagcactttgacgcggacgtgctttgtctgcaagaggtgcaggaggaccattatggagccgagatcagacctagtctggagagtctggggacaatgcagcttttcttttttttcttcttcttcgagacgggctcccacagcgtagcccagttagagtgcagcggaactattatggctcattacagccttaatctactgggatcttccaacccactgatctctgccagttag

SEQ ID NO: 26608 - DNA, 1128 bp, Artificial Sequence
  Description of Artificial Sequence: Synthetic coding sequence
atgtcttataacattcttagccaagacctcctggaggacaatagtcacctctacagacattgccgccggcccgttctacattggagcttcagatttcccaacattctgaaagaaataaagcacttcgacgcagatgtgttgtgtctgcaggaagtccaggaggaccattatggagctgaaatcagaccctctctggagtctctgggatatcactgtgagtacaagatgcgaaccggtcgcaagccggatggatgtgccatctgtttcaaacattcaaagttttccctgctgtctgttaacccagtagaattttttaggccagacatatctctgctagatagggacaatgtaggtcttgtcctgctgcttcagcccaagatcccatacgccgcatgtccggcaatttgcgttgcaaatacacatctgctgtataaccccaggcgaggagatatcaagctaacacagctcgccatgcttctggcagagatcagctccgttgcccaccaaaaagacggatcattctgcccgattgttatgtgcggagactttaacagtgtgcctgggtcgccgttatactcatttattaaggaggggaagctgaattatgaaggattaccaatcggtaaggttagcgggcaggaacaaagcagtaggggacagagaattctgtccattcccatatggccccccaacctcggaatttctcagaactgtgtgtacgaggtgcagcaggtcccgaaagttgaaaagactgactctgacctgacccagacacagttgaagcagacagaggtcctcgtaacggcagagaagctatcatctaatctgcagcaccacttttcgctgagcagcgtgtatagtcactactttcccgatacgggaatccccgaagtgactacctgccattctaggagtgcaatcaccgtcgactacattttttactcagctgagaaggaagacgtggctggacaccccggggccgaagtagccctggtgggagggctgaaattgctggcaaggcttagtttgttgacggaacaggacctgtggactgtgaatgggctcccaaatgaaaacaattccagcgatcacctaccccttctcgccaagtttcggttagagctgtag

SEQ ID NO: 26609 - DNA, 1635 bp, Artificial Sequence
  Description of Artificial Sequence: Synthetic coding sequence
atggaggcttggagatgcgtacgcaaaggatatggccactgtgttgttggtaggggtcgctatcccatgtttccccatcacagtcgatccttaggtcgggactggactactccttgggagaacttacaacgctgttgctggaatcgccatatctctagttgcatgagatggcctggacattattcccgggctccctatccttactttagttcccgtcatttcagcctgaactggcgacccccatgcctgtttgagtcaagaacccagttccaatattgtaattggcggcctgacaatctgtcacagacctcactgatccatttgagctcctacgtaatgaatgccgaaggcgatgaaccatcttccaaacgtaggaaacaccaaggggtcattaaacgtaactgggaatatatatgcagtcacgataaagagaagactaagatcctgggcgataaaaatgttgacccaaaatgtgaggattctgaaaataagtttgatttctctgttatgtcgtataatatcttgtcccaagatctgctggaggacaactcacacctgtacagacactgtcgcaggcctgtcctccactggtctttccgctttccgaatattctgaaggagataaaacactttgacgcagatgtgctgtgcctgcaggaggtgcaggaggaccactacggtgcagagatcaggccatccttggagtctctggggtaccactgcgagtacaaaatgcgtactggccgcaaacctgacggttgtgctatttgctttaagcactctaagtttagcctgctcagcgtcaatcccgtagaattctttcggccagatatcagcttgcttgatagggacaacgtcggacttgtgctactgctgcagcccaagataccctacgccgcatgcccagcaatatgcgttgccaatacgcacttgctctataatccccgccgcggggacataaagctcacccagcttgctatgctactcgcagagatttcttctgtcgctcaccagaaagatggcagtttctgccccatcgttatgtgcggggatttcaactcggtaccaggcagcccactttattctttcattaaggagggcaagctgaattacgagggtttgccgatcggcaaagtgtcaggccaggagcagtctagccgcggccagcgtatcctcagcatacccatctggccgcccaatctggggatctcacagaactgcgtctatgaggtgcagcaagtgcctaaggtagagaaaacagatagtgacctgacacagacacagcttaagcagaccgaggtcctggttactgcagaaaagttgtcgagtaatctccagcaccactttagcctctcctcggtgtactcccactactttccagacaccgggattcccgaggtgaccacctgccactccaggtctgcaattaccgtggattacatcttctactccgcggagaaggaagatgtcgccggccatcctggcgctgaggtcgccctcgttggaggcctcaagctgctggcgcggctttctctgctgaccgagcaggacctttggaccgttaacggccttcccaacgagaacaattccagtgatcatcttccactgttggccaagttcagactcgaattgtag

SEQ ID NO: 26610 - DNA, 639 bp, Artificial Sequence
  Description of Artificial Sequence: Synthetic coding sequence
atgtcttataacatcctgtcccaggatctcctggaggacaactcacatctgtaccggcactgcaggcggccggtccttcattggagttttcgtttccccaatattttaaaggaaattaaacactttgacgccgacgtcctttgtctccaggaagtgcaagaagaccactatggcgccgagatacgcccatctttagagtctttgggctaccactgcgaatacaaaatgagaacaggacgcaagcctgacggatgtgccatttgttttaagcattccaaattctccctactgagtgtaaacccagtcgagttcttccgcccggacatctccctgctggaccgggataatgtgggtctcgtgctactgctccagccaaagattccgtacgctgcttgtcctgcgatctgcgtcgcaaacacacacctgctctataatccccgaagaggggatattaagcttacacagttggctatgttgctggccgagatcagttccgtggctcaccaaaaagatggctctttctgtccaatcgtgatgtgcggggatttcaactccgtgccaggctccccgctctattccttcattaaagaggggaagctgaactatgaaggcctgccgattggtaagaccgtgatctag

SEQ ID NO: 26611 - DNA, 1257 bp, Artificial Sequence
  Description of Artificial Sequence: Synthetic coding sequence
atggagggcgttattaagagaaactgggagtatatctgttctcacgacaaggaaaagacaaaaatcttaggagataaaaatgtggacccaaaatgcgaggacagcgagaataaatttgacttctcggtgatgagttacaacatcctgtcacaggacctgttggaggataattcccacctgtaccgtcattgtcggaggccagtgctgcactggtccttcaggtttccaaatattctgaaggaaattaagcattttgacgccgatgttctgtgtctacaggaggttcaggaagaccattacggtgcggaaatcagacctagtttggagagtctgggctatcactgtgagtacaagatgcggaccggcagaaagccagatgggtgtgcgatttgtttcaagcattccaagtttagcctgctaagcgtcaatcctgtggaattttttaggcccgacattagtcttctcgatagggataacgtgggcttagtcctgctgctccagcccaaaattccttacgctgcttgccccgcaatatgtgtcgccaatactcatttgttgtacaatcctcgccgaggcgatattaagctgacacagctggctatgcttctggctgaaatttccagtgtggcccatcagaaggacggctcattctgtcccatagtgatgtgcggcgattttaatagcgtcccagggagccctctttacagcttcattaaagaggggaagctgaattatgagggtctgccaatcgggaaggttagtggacaggagcagagctctagaggtcagcgtatactgtctattccgatatggcctcccaatcttggcatctcccagaactgtgtatatgaggtgcaacaggtgcctaaagtggagaagactgatagtgacctgactcagacccagctgaagcagactgaggtattggtgacagcagagaaactgtccagtaacctccagcatcacttctcactaagtagcgtgtatagtcattacttccccgatactggtatacccgaggtcacaacatgtcactctagatccgcgatcaccgtggattacatcttttactcagctgaaaaagaagacgtcgcggggcatcctggggcagaggtggcactggtcggcggtcttaagttactggccaggctctccttactgacagagcaagacctttggaccgtgaacggcctgcctaacgagaacaacagctctgaccatttaccgctcctggctaagtttagactcgaactttag

SEQ ID NO: 26612 - DNA, 1128 bp, Artificial Sequence
  Description of Artificial Sequence: Synthetic coding sequence
atgtcctataatatcctaagtcaggatctactcgaggacaatagtcacctctatagacattgcaggcgcccagtgctgcactggagctttcgattcccaaacatcctgaaggaaattaaacattttgacgcagatgtactgtgtttgcaggaagtgcaggaggaccattacggggcagaaattcggccatcccttgagtcattaggctatcattgtgaatacaaaatgcggacagggcgtaaacctgatggatgtgccatctgtttcaagcactctaagttcagtctgctgtccgtaaacccggtcgagtttttccgcccagacatctctttgctggacagggataatgtgggtctcgtactgttgctgcagcccaaaattccttatgcagcttgtcctgctatatgtgttgctaacacacacctgctgtacaaccctcggagaggagatatcaaacttacacagcttgcgatgctgctagccgaaatctcttctgtggcccaccagaaggatggtagcttttgccctattgttatgtgtggcgattttaattccgttcctggctcccccctgtattcattcataaaggagggaaagctgaactatgaggggttacctatcgggaaagtgtctggccaggagcagtcctcgcgtggccagcgtatcctttcaataccaatttggcctcccaatctggggatctctcagaactgcgtatacgaggttcagcaggtgcccaaggtggagaagaccgactccgacttgacccagacacagttgaaacaaactgaagtgcttgtcaccgcagagaagttgtcctccaatcttcaacaccatttcagcctgtcctccgtttactcccattattttccagacaccggtattcctgaggtgactacttgccatagtcgctcagccattactgtggattatatcttctactccgctgagaaagaagatgttgcaggccacccaggggcggaagttgcattagtcggcggcctgaaactgttggcacgactgtctctcttgacagagcaggatttatggaccgtgaatgggcttcctaacgagaacaattcttctgaccacctgccactgctcgcaaagttcaggctggaactttag

SEQ ID NO: 26613 - DNA, 2520 bp, Artificial Sequence
  Description of Artificial Sequence: Synthetic coding sequence
atgagcgccggggatggactcaggagaggaaagagcgccagatgcggcctgaccttcagcgtgggacgcttcttccggtggatggttgacacccgcattagtgtccggatccatgagtacgcagccatctcactgacggcctgtatggagaatctggtggaagagatccgcgcccgcgtaatggcatctcattcaccagacggtggaggggcaggaggaggagaggtgagtgcggaagccctggagatggtcatcaacaatgatgctgaactgtggggggttctccagccatatgaacacttgatttgcggtaaaaatgctaacggagttctaagtttgccagcgtatttctcaccttataatggaggctccctgggccatgatgagagggcggacgcctatgcccagctcgaactccgcactctcgagcaatctctactggccacttgcgttggctccataagcgagctgtccgacctggtgagccgggcaatgcaccatatgcaaggacgccaccccctctgcccaggcgcttcacccgccagacaagcaagacaacctcctcagcctataacctggtcccctgacgcgctgcacacactgtactatttcttgcgctgcccgcagatggaaagtatggagaaccctaatctcgaccctccacgaatgacactcaataatgagcgtccatttatgctgctccccccattgatggagtggatgagggtcgcaatcacctacgccgagcataggagaagtctgacagtcgacagcggcgatatccgtcaggccgctagactcctgttgcccggcttggactgcgagccaagacagttgaagcctgaacattgcttcagctccttcagaaggcttgatgcccgcgcagccaccgaaaagttcaatcaggacctcggttttcgcatgctcaattgtggtaggaccgacctgattaaccaagctatcgaggctctgggtccggatggcgtgaatactatggatgaccagggcatgacacctctcatgtacgcctgcgctgccggtgacgaggccatggtacaaatgctgatcgatgccggagccaatctagacatccaggtccctagcaacagccctaggcatccatccattcatccagattcccgtcactggaccagtctgacattcgcagttttgcatggacacataagcgtcgtgcaactgcttcttgacgctggtgctcacgtagaaggcagcgccgtgaatgggggcgaagactcgtatgccgaaacccccttacagctggcctccgcggccgggaattatgagttggtctccctactcctgtctcggggtgcggatcctctccttagtatgctggaagcccacggcatgggcagctctctccatgaggatatgaactgtttttcacattctgcagcccatgggcaccgcaatgtgctgcggaaactgctcacacagcctcagcaggccaaggctgacgtattgagtctggaggagatccttgctgagggggtggaggagtctgacgccagttctcaaggctctggaagcgaagggccagttagattgtcaaggacccgaaccaaggcactgcaggaagccatgtactactctgccgagcatggctacgtggacataacgatggagctcagggctctcggtgtgccatggaaactacatatttggatcgaatctctaagaacgagtttcagccagagcagatactccgttgttcagtccttactcagagattttagcagtatacgagaggaagagtacaatgaggaactcgttacagagggtctccagctgatgtttgatatcctcaaaacatccaagaacgacagcgtcatccagcagctggctaccatattcactcactgctatgggtcctcacccatacccagcatccctgaaataaggaaaacattgcctgctaggctggaccctcacttcttgaataataaggagatgagcgatgttacctttctggtggaaggtaagctattttatgcacacaaagtcctgttggtgaccgcttccaaccgattcaaaacgcttatgacgaataagtccgagcaagacggcgattcatctaagactatagagattagtgacatgaagtaccacatattccagatgatgatgcagtacctgtactatggcggtacggaatccatggaaattcctaccaccgacatcttggaactcctgtcagccgcctctctgtttcagctggatgcactgcagaggcactgcgagatcctgtgttcccagacgcttagcatggagagtgctgtgaacacttataagtacgccaagatccacaacgctcctgaacttgcattattttgcgaaggattttttcttaaacacatgaaggctttacttgaacaagatgccttcaggcagttgatatatgggaggtcctcgaaagtgcagggactggaccctctccaagaccttcagaacaccctggcagagagagtacacagcgtctatatcacctctcgggtgtag

SEQ ID NO: 26614 - DNA, 3078 bp, Artificial Sequence
  Description of Artificial Sequence: Synthetic coding sequence
atggctggcacatatagctctaccctgaagacattggaggatttgaccctggacagcggctatggcgccggtgattcctgtcgctctttgtccctcagctccagtaaaagcaatagccaggctttgaattcatccgctcagcaacacagaggtgccgcgtggtggtgttactctggtagcatgaatagtcgacataactcatgggacacagtcaacacggttctccctgaagaccctgaagtggctgacttgttctcccgatgtccaaggctgcctgagctggaagagtttccttggacggagggtgatgtggctcgcgttctgaggaaaggcgcaggcgggcgtcgtctcccgcagttctcagccgaggccgtgaggcggctagcagggcttctgaggagagccctcattagggtggcacgcgaagctcagcggctgagtgttctacacgctaaatgcactaggttcgaagtccagtctgcagtgcggctcgtccactcatgggctttagccgaatcctgcgccctggcagccgttaaagcactctccctctactccatgtcagctggagatggtttaaggcgcggcaaatctgcacggtgtggtctgacgttttccgtcggtcgtttcttcaggtggatggtggatactcgtattagtgtacgcatccacgagtacgccgctatctccctcacagcttgtatggaaaatctggtggaggaaatacgcgcgagagtgatggcatcacacagtcctgatggggggggtgccgggggtggcgaggtgagcgctgaggccttggagatggtgatcaataacgacgccgagctgtggggagtactgcagccgtacgagcatctgatctgcggcaagaacgcaaatggtgttctgagcctcccggcatatttctctccatataacggcggatccttgggacacgatgaacgggccgatgcttacgcccagctggagctcagaactcttgaacagtctctgctagcgacgtgtgtcggtagcataagcgagctatctgaccttgtgtccagggcaatgcatcacatgcagggacgtcatccactctgccctggtgcctctccagcccggcaagccagacaacctccgcagccaatcacgtggtccccggacgccctgcacaccctgtactatttccttagatgtccccagatggagtccatggaaaatcctaatttggatcctcccagaatgacgctgaacaatgagagaccttttatgcttctcccccctttgatggaatggatgcgcgtggcaatcacgtacgctgagcataggcgaagtctgacagtcgatagtggagatatacggcaggccgcccgtttgcttctgccaggtctggactgcgagccgcgacaacttaaacccgaacactgcttttcctctttccgcaggctcgacgccagagctgctacagaaaaatttaaccaagacctagggttcaggatgctgaattgcggacgaaccgatcttataaaccaggccatcgaagctctgggccccgacggtgttaacacgatggacgaccaggggatgacccctctaatgtacgcctgtgccgccggagatgaggctatggtgcagatgcttatcgacgctggtgcaaatctggacattcaagtgccttccaacagtccccggcacccgtcaattcatccagatagtcgacactggacctcattaacctttgccgtattacatggtcatatttccgtggtccagcttttgttagatgccggtgcacacgtcgagggtagcgcagtgaatgggggtgaggatagttatgctgagacacctttgcagctggcctcagcagctggcaactacgagcttgtgtctctactgctgtcaaggggagccgacccacttctttccatgcttgaagcacatggtatgggaagtagcctacacgaagatatgaattgtttcagccacagcgccgctcacggccatagaaacgtactgcgaaagctgctgacccagccccagcaggcgaaagctgatgtcctgtctctggaagaaatcctcgccgaaggtgtggaagaatccgacgcaagtagccagggaagcggttcagagggaccagtgaggctgtctcggacacgcaccaaggccctccaggaagcgatgtactactccgcagaacatggctacgtcgacatcaccatggagctgcgtgctctgggtgtaccctggaaacttcatatatggatcgaatccttaaggaccagtttctctcagagccgctactctgtcgtgcagtcattgttgcgggacttttcttcgattagggaggaggagtacaacgaggagcttgtgaccgaaggccttcagctgatgttcgacatcctaaagacaagcaagaatgactctgtcatccagcagttagccacaatatttacacactgctatgggtcctccccaattcctagcatcccagagatccggaaaacgctgccagcacgccttgatccccatttcctaaataataaggaaatgtctgacgtgacgttcctggtggaagggaagctgttctacgcccacaaagttcttctggtaactgcttcaaatcgctttaagacactgatgactaacaagtctgagcaggatggcgactcaagtaagaccatcgagattagcgacatgaaataccacatctttcagatgatgatgcaatacctctactatggtggcactgagtccatggaaattccgactaccgacatcctggaattactgagtgcagctagcctctttcagcttgatgccctgcagagacactgcgaaatcctgtgctcacagaccctgtcaatggagagcgctgttaatacatacaaatacgcgaagatccataatgcccctgaactcgctctcttttgtgaggggttttttctgaaacacatgaaagctctgctggagcaagatgcttttcggcagttgatctacggcaggagctcgaaggtgcaggggttggatccacttcaagacctccagaacacactggctgagagagttcactcggtttacataacctctagggtgtag

SEQ ID NO: 26615 - DNA, 126 bp, Artificial Sequence
  Description of Artificial Sequence: Synthetic coding sequence
atgcaagaggagctggcatgggagactgacggtctgtgggacgaatgtgcaagccctgtctgtctggtccgacccctaacgaatcccccagacttgggaaagctccgcggacaagacccactgtag

SEQ ID NO: 26616 - DNA, 414 bp, Artificial Sequence
  Description of Artificial Sequence: Synthetic coding sequence
atgcaggagttgatcggcagaagggtgaacactcgggccaggaaccacgtgggcagggtcgctcttcattgggccgccggagctgggcatgaacaagccgtgagactgctccttgagcacgaggcagcagtcgatgaagaggacgccgtgggtgcactcaccgaagaaggaaatactgcattgcatttagcagccgggcgcggtcacatggccgttctgcagcgcctcgtagacataggcctcgacctcgaggagcagaacgctgaggggctgactgcgctccacagtgcagccggcgggtcccatccagactgcgtacaactgctgctgcgggccggaagcaccgtcaacgcgttgactcaggttgcccgaccgagccaggattgcggaaggctgctcgcagccgaaccttag

SEQ ID NO: 26617 - DNA, 1473 bp, Artificial Sequence
  Description of Artificial Sequence: Synthetic coding sequence
atgcaggaagagctggcctgggagaccgatgggctgctgccactggaaagacagttgcacgaagcagcgcggcagaacaacgtgggaaggatgcaggagcttattggcagacgcgtgaacactcgcgcaaggaatcatgttggtcgggtggccctgcactgggcagcgggtgcaggccacgagcaggccgtcagactcctactagaacacgaagctgccgttgatgaagaggacgctgtgggtgcactcacggaggctcgcctgtgctttgggatgaacgccctacttttgagtgcctggttcgggcatctacggatcctgcagattctggtaaattcaggggccaagatccactgcgaaagtaaggatggcctgactctgctccactgcgcagcccagaaaggacatgttccagttctcgcattcataatggaggatctggaggacgtagctctggatcacgtggacaagctgggaagaacagcgtttcatagggcggctgaacatggtcagctggacgctcttgacttcctggtcggctctgggtgcgatcacaacgtcaaggataaagaggggaacaccgccctgcaccttgcagcaggccgaggtcacatggccgtgctacagaggttggttgacattggactggatctcgaggagcagaatgccgagggtctgactgcactgcactccgctgcagggggctcccatcccgactgtgtccagcttctgctgcgggccgggtctaccgtgaacgcccttacccagaagaacctgtcatgcctgcattacgccgcattaagcgggtcagaagacgtcagtcgggtgctcattcatgctggaggctgtgccaacgtcgtcgaccaccagggcgccagtcctttgcacctagcagttcggcacaatttcccagctctcgttaggctgcttatcaactctgactccgatgtaaatgctgtcgataataggcagcagacccctctgcacctcgctgccgaacatgcatggcaggatatagcggatatgctcttgatagccggagtggacttgaacctccgcgacaaggatcacccaagcgatccttctggcaaaagcctgtcgttcaagcaagatcaccgacaagagacacagcagctacgttcagtcctatggagattggctagcagatacctgcagccaagggaatggaagaagctcgcgtactcctgggagttcacagaggctcacgtggatgccatcgagcagcagtggaccggaactcggagttatcaggagcatggacaccggatgttactgatctggttgcacggcgtggctacagccggtgagaatccaagcaaagccctctttgagggtctggtggccatagggcgccgtgacctggccggttggtcaaccatggccagatcccagctcaccgccacttctgcctctcgggtgcagatgattctggttccccagccacctgaatag

SEQ ID NO: 26618 - DNA, 1569 bp, Artificial Sequence
  Description of Artificial Sequence: Synthetic coding sequence
atgcaagaggaattggcatgggaaaccgacggacttctccctctagagcgccagctgcacgaagcggctcggcagaataatgtcggtaggatgcaagaattgattgggcgccgcgttaatactcgagccagaaatcatgtgggtagggtggctctgcactgggcagccggagccgggcatgaacaagcagttcgactgttgctggagcatgaagccgccgttgatgaggaggacgccgtcggggctctgacggaggcgcggctatgtttcggcatgaacgcccttctcctcagtgcatggtttggacacctcaggatcctgcaaattctggtgaactccggcgcgaagatacattgcgaaagtaaggatggcctgaccctgctgcactgcgctgctcagaagggtcatgttccagtgctggcttttattatggaggacctagaagatgtcgccctagaccacgtcgataagttgggccggactgctttccaccgggccgccgagcacggtcagttggatgcgttagactttttggtgggctctggatgcgatcataacgtgaaagataaggaaggcaacactgccctgcaccttgcagctggacggggccacatggccgtcctccagaggttggtggacattggactagacctggaggagcagaacgccgaaggcctgaccgcgcttcattccgccgctggcgggagccatccggactgcgtgcagctcttattgagagctggctcgaccgttaatgcactgacacagaaaaacctatcctgtctgcactacgcggctctgtccgggtcagaagatgtttcacgcgtcctgatacacgcaggtggatgtgcaaacgtggttgaccaccagggagcatccccgctgcacctcgccgtgcggcataactttcccgccttagtacggctgctgattaactcggactctgatgtgaatgcggtggataataggcagcagacacctcttcacctggccgctgaacacgcctggcaggatatcgccgatatgctgctgatcgccggggtggaccttaacttaagggataagcagggcaagaccgccctagcagtagcagtgaggagcaatcacgtatcactcgtggacatgattataaaggctgatcgcttttacaggtgggagaaggatcacccttccgatccgagcggcaaatccctctctttcaagcaagatcatcgccaagagacacagcagctccgctccgtgctctggagactggcttctcgctacctgcaaccacgagagtggaagaagctcgcctattcatgggagttcactgaggctcatgtggatgccatcgagcaacagtggaccgggaccaggagctatcaggagcacggtcaccgtatgctgctaatctggctgcacggcgtcgccaccgccggagagaacccatccaaagcactgttcgagggcctagtcgctataggcaggagagatttagcaggttggtccaccatggctagaagtcagttgaccgccacttcggcttccagagttcaaatgatcctcgtgccacagccacctgagtag

SEQ ID NO: 26619 - DNA, 1545 bp, Artificial Sequence
  Description of Artificial Sequence: Synthetic coding sequence
atgcaggaggaattggcatgggagacggatgggctgcttcctttggaaagacagctccacgaggcagctagacaaaacaatgtggggcggatgcaggaacttattggcaggagggttaacactcgtgcccggaaccatgtggggcgagtggctctgcattgggcagcaggggcaggccatgagcaggccgttaggcttctactggagcacgaagctgcagtggatgaggaagatgccgtaggagccctgactgaagctaggctgtgctttggaatgaacgctctgctcctctccgcatggtttggacaccttaggatcctgcagatccttgtgaactcgggcgcgaagatacactgtgagtctaaggacggcctaaccctcctgcactgtgccgctcaaaagggccatgttccggtacttgcctttatcatggaggatttagaggacgtggccctggaccatgttgacaagctaggacgaacagccttccaccgagctgcagagcacggccaacttgatgcccttgattttctggtggggtccggatgcgaccacaacgtgaaagacaaagagggtaacacagcgctccaccttgccgctggtcgcgggcacatggccgtgctgcagcgcctggtagatatcgggctggacctcgaagagcagaacgctgaagggctgaccgccctccatagcgcagctggaggttcgcaccctgattgtgttcagctgttattgcgagctggaagcaccgtgaatgcgctcacacagaaaaatctttcctgtctgcattacgcagccctcagtggctctgaggatgttagccgtgtgctgattcatgccggtggctgcgctaatgtggtcgaccaccagggcgcctcacctttgcatctggctgtgaggcacaactttcctgccctggtacggttacttattaacagcgattctgacgtgaatgctgtggataacaggcaacaaacacctctccacttagccgccgaacacgcgtggcaagacatcgctgacatgctcctcatcgcaggcgttgatctaaatttgagagacaagcagggtaaaactgccctggccgttgccgtacgttcaaatcacgtcagcctggttgatatgatcattaaagcagacagattctacagatgggaaaaagaccacccatccgacccatctgggaagtcgttgagcttcaaacaggatcatcggcaggagacccaacagcttaggagcgtgctgtggagattagcatcgaggtacctgcaaccgcgggaatggaaaaagctggcttactcctgggagtttactgaagcccacgtagacgccattgaacaacaatggaccggcacaagatcctatcaagagcatgggcacaggatgttgttgatctggctccatggagtggccaccgccggggagaatcccagcaaagccttgtttgaaggcctggtcgctatcggtagaagagacctggccgaaaatatcagaaagaaggccaatgctgccccaagcgctccccgacgttgcactgcgatgtag

SEQ ID NO: 26620 - DNA, 1200 bp, Artificial Sequence
  Description of Artificial Sequence: Synthetic coding sequence
atgaatgcgctgctattgtcagcttggttcgggcatcttaggattttacagatcttagtgaacagcggcgctaaaattcactgcgaaagcaaggatggcttgaccctgctgcattgcgctgcccagaaggggcacgtgcccgtgctggcattcataatggaggacttagaagatgtggctctcgatcacgttgataagcttggacggacagcatttcacagagcggctgaacacgggcagttggacgcactcgactttctagtcggttccgggtgtgatcacaatgtcaaggacaaagaaggtaatactgctctacacctggccgccggccggggtcatatggccgttttgcagcggctggtggacatcgggcttgacctggaagagcagaatgcagaaggcctcaccgctctccatagcgcggcgggaggctcccacccagattgtgtgcagctcctgctacgagctggttccacggtaaatgcacttacacagaaaaaccttagctgtcttcactatgctgccctgtcgggatcggaggacgtttctagagtcctgattcatgcagggggttgcgcaaacgtggtcgaccatcagggtgccagtcctctccaccttgcagtacgccataactttccagcacttgtgagactgctgattaacagcgattcagatgtcaacgccgtggacaacagacagcagacgccattgcacctcgccgccgagcacgcatggcaggatatcgcagacatgctgttaattgctggggtggacttaaacctgcgcgataaagatcaccccagcgacccatcaggcaagtctctctctttcaagcaggaccacaggcaagagacgcagcaactgagaagcgtgctgtggaggctggcctctcggtacttgcaacctcgggagtggaaaaaactcgcctattcatgggagtttaccgaagcccatgttgacgccatcgaacagcagtggaccggcacaagatcctatcaggagcatggacaccgtatgcttttgatttggctacacggtgtagctaccgccggggaaaaccctagcaaagcacttttcgaggggttagtagcgatcggacgtcgtgaccttgcaggctggtccaccatggcccgctcccagcttaccgcgaccagcgcctcccgcgtgcagatgatcttggttcctcagccacccgaatag

SEQ ID NO: 26621 - DNA, 546 bp, Artificial Sequence
  Description of Artificial Sequence: Synthetic coding sequence
atgaacgcactgctgctcagcgcatggttcgggcacctcagaatcttgcagattcttgtgaacagcggagccaaaatccactgtgagtctaaagacggcctaacgctcttgcactgcgccgcgcagaaaggccacgtgccagtcctggcgttcatcatggaggatctggaggatgtagctctagatcacgtggataagctgggccgaacggctttccacagggcggccgagcatggtcagctcgatgccctggatttcttagtgggctcaggctgtgatcacaacgtgaaggataaagaagggaatactgccctacatttggcagctgggcgtgggcatatggccgttttacagcggttggtagacattggcctggatttggaggagcagaacgccgaaggcctcactgctttgcattctgccgccggggggtctcaccccgactgcgtccagctcttgcttagagccggtagtacggtaaatgcactgacgcaggtcgcccgtcccagccaggactgcggcagactgcttgcggctgaaccatag

SEQ ID NO: 26622 - DNA, 270 bp, Artificial Sequence
  Description of Artificial Sequence: Synthetic coding sequence
atgcttggcggccttggaaagttagctgccgaaggcttagcacaccgaaccgagaaggcgaccgagggcgccatccatgcagtggaggaagtagttaaggaagtagtgggacacgcaaaggaaacaggagagaaggccatcgctgaggccattaagaaagcccaagaatctggtgacaagaaaatgaaagagataactgagaccgttactaacacagtgaccaacgctattacccatgccgcagagtccctggacaaattaggccagtag

SEQ ID NO: 26623 - DNA, 3270 bp, Artificial Sequence
  Description of Artificial Sequence: Synthetic coding sequence
atggggaacacaaccactaagtttcgcaaggcactgatcaacggcgacgagaacctcgcctgccagatttacgagaacaaccctcaacttaaagagtctctcgatcctaataccagctacggagagccttaccaacacaacactccgttgcattatgcggcccgacacggcatgaacaagatcctgggcacctttctgggacgtgacggtaatcctaacaaacgcaatgtgcataacgagacttcaatgcacctgctatgtatgggtccgcagatcatgatatctgagggcgccctgcatcctaggcttgcccggcctacagaagatgacttcaggcgagcggactgcttacagatgatcttgaaatggaagggcgctaagctcgaccagggcgaatatgaacgggctgctatagatgccgttgataataaaaagaacacgccactgcattacgccgcagctagcggaatgaaagcatgtgtggaactcctggttaagcacgggggcgacctttttgcagaaaacgagaacaaggacacaccctgtgactgtgcggagaagcagcaccataaagacttagcccttaacctggagtctcagatggtgttctcccgggatcccgaagctgaagaaatagaagctgaatacgcagcactggacaaaagagagccatatgaggggctccgcccccaggatctgagacggctgaaggatatgttaatagtagaaactgctgacatgctgcaggcacccctctttacagctgaggctttgctgcgcgcacacgactgggaccgagaaaagcttctcgaggcttggatgagcaacccagagaactgctgccagagatctggggtgcagatgcccactccgccaccctcgggttacaatgcatgggacacactgccttctcctaggacaccacgcacgactcgatcctccgtgacctctccagacgagatttctctgagtcccggcgatttggacactagtctttgcgacatttgtatgtgttccatctcagtgtttgaggatcccgtggacatgccttgcggccatgacttctgtcggggctgctgggagagtttcctgaatttaaaaatacaggagggcgaagcacataacatcttttgtccagcgtatgactgcttccagttggtcccagtggatattattgaatctgtcgtcagcaaagaaatggataaacgatatttgcaattcgacattaaggccttcgtggaaaataaccccgccattaagtggtgccccacgcctgggtgcgatagggcggtgagactcactaaacaaggtagcaacactagtgggtccgacaccctgtcattcccacttcttagggcccctgcagttgactgcggtaagggtcacttattttgctgggaatgtctgggtgaggcccatgaaccatgcgactgtcagacatggaagaattggcttcagaaaatcaccgagatgaaacctgaagaactggtcggtgtctctgaggcatacgaagacgcggcaaactgcctgtggctcctgacgaattctaagccatgcgccaactgtaaatcacctatccagaagaacgaaggatgtaaccacatgcagtgtgcaaaatgtaagtatgatttttgctggatatgtctggaagaatggaaaaagcactcatcgagcactggagggtattaccgctgcacacgctacgaagttatccagcatgtggaagaacagtccaaggagatgactgtagaggctgagaaaaaacataagcgctttcaggaactggaccggtttatgcactattacactcgctttaaaaaccatgaacattcttaccaactggaacagagactgctgaagaccgcgaaggaaaaaatggaacagctgagcagggcccttaaggagacagaaggagggtgcccagacacaacctttatcgaagatgcagtccacgtgcttctgaagacacgccgcatccttaagtgttcctatccctatggctttttcctggagcccaaatctacaaagaaggagatctttgaactcatgcaaacggacctggaaatggtcactgaggacctggctcagaaagtcaaccgcccctacctgcgtacacccagacacaaaattattaaggccgcatgccttgtacagcagaagagacaggagtttttggcatctgtggcacgcggcgtggccccagcggactcacctgaggcaccccgtcggtcatttgctgggggcacctgggattgggagtacctgggttttgcttcgcctgaggagtatgctgagttccagtatcgccgacgccatagacagcgccgccgcggtgacgtgcacagtctgctgagcaatcctccggacccagatgaaccttcagaatctacattggatattccagagggaggttcatcctccaggagacccggtacgtctgtagtttctagcgcatcaatgtctgttttgcactcctcaagcctccgcgactatactccagccagcagaagcgagaatcaggatagtctgcaggctctctctagtctggacgaggacgacccaaatatcttactggctatccagctgtctctgcaggagagtgggttagcattggacgaggaaacgcgggatttcctgtctaacgaggcgagcctgggagccatcgggacatctctaccctcccggctcgattctgtgcctagaaacactgattccccacgggccgccctatcttcttccgaacttctggagctgggcgattcactcatgcgactgggagccgaaaatgatcccttcagcactgatactctgagtagtcatcccctgtcagaggctcgctccgatttctgtccaagctcaagcgatcctgatagcgccggtcaagatccaaatattaatgataacttgcttgggaatattatggcctggtttcacgacatgaacccccagtctatcgccttgattccgccagcgacaacagagatcagcgccgatagccagctaccttgtattaaagatggcagtgagggagtaaaagacgtcgaactggtgttgccagaggacagtatgtttgaggacgcctctgtcagcgagggaagagggacccagattgaagagaacccacttgaagagaacatcctggcaggagaggccgctagtcaagccggcgactcaggaaatgaggccgcgaatcgaggtgacggatcagacgtgtcctctcagacaccccaaacaagtagcgattggttagagcaagtacatctcgtatag

SEQ ID NO: 26624 - DNA, 405 bp, Artificial Sequence
  Description of Artificial Sequence: Synthetic coding sequence
atgggtaataccaccacgaaatttaggaaggcgctcataaatggtgacgaaaacctagcctgccagatttacgagaataacccgcagttaaaggaaagcttagatcccaacacgagctacggcgaaccctaccagcataatactccgctgcactatgccgcccgccacggcatgaacaagatcctgggtacattcctcggccgggacggtaatcccaacaagcggaatgtgcacaatgagacaagcatgcatctgctctgtatgggcccccaaattatgatctcggagggcgcacttcaccctcgactggcccggcctactgaagatgatttcaggcgggctgattgcttgcagatgatcctcaaatggaaaggtgccaagcttgaccagggagagtacgagtag

SEQ ID NO: 26625 - DNA, 1947 bp, Artificial Sequence
  Description of Artificial Sequence: Synthetic coding sequence
atgctttggccacgtctcgctgcagccgagtgggctgccctcgcttgggaactcctcggggcatcagtactgctgattgccgtgcgctggctggtgagacgcctggggcccaggcctggtggtcttgggcgatctggtacgccagtacctcctccatctgcggctgccgccccagccagcggcgagatgaccatggacgccctccttgcacggctcaagctccttaaccctgatgatctccgtgaggaaatagtaaaggctggcctgaaatgcggaccaattacaagcaccacgagattcatctttgagaagaagctggctcaagcgctgcttgaacagggaggcagactcagcagtttttaccaccatgaggctggggtgaccgcgctttcacaggatccccagagaatcctcaagcctgccgagggaaacccgaccgatcaggccggattctctgaggaccgggatttcggctactcagtcgggcttaacccccctgaggaggaagcagttaccagcaaaacatgcagcgtgcctccaagcgatactgatacttacagggcaggcgccactgcgagcaaggaacctccactctattatggagtgtgcccagtatacgaggatgtgcccgctagaaacgaacggatatatgtgtatgagaacaaaaaggaagcactgcaggcggtgaaaatgattaaaggatcgcggttcaaagcctttagcactcgggaagacgcagaaaagttcgcacgtggcatttgcgattattttccctctccctcgaaaactagcctccccctgagcccagtcaagaccgctcccctgttcagcaacgatcgcctcaaggacggcctctgtttatctgaaagcgagacagttaacaaggaaagagcaaacagctataaaaaccctaggacacaggatctaaccgccaagcttcggaaagccgtggagaagggagaggaggacactttttcagatctaatttggagcaaccctagatatttaattggctccggcgataatcccacaatcgtgcaagagggatgccgttataatgttatgcatgtggccgctaaagaaaatcaggcctcaatctgtcagttgaccttagacgtacttgaaaatccggactttatgcgtcttatgtatcccgacgacgatgaggccatgctgcagaagcggattcggtatgtcgtggatctctacttgaacacacccgataagatgggttacgataccccgcttcacttcgcctgtaagttcggtaatgccgatgttgtgaacgtactgtcctcccatcatctgattgtcaaaaattcccgcaataaatatgataagaccccagaagatgttatatgcgaacgctctaaaaacaagagcgtggagctgaaagaacgtattagggagtatctaaaaggccactattatgttcctctgcttcgagcggaggagacttcaagcccggtcataggtgaattgtggagtccagaccagaccgccgaagcatcacatgtctctagatacggggggtctcccagagatccagtcctgaccttaagagcctttgccggaccactatctcctgcaaaagccgaggactttagaaaactctggaagacaccccccagagagaaagccggtttcctccatcacgtgaagaaatccgatcccgagcgcggattcgaaagagtggggcgcgaactggcccacgagctgggatacccatgggttgagtattgggaattcctgggctgttttgtggatttgtcttcccaggaggggctgcaaagattggaagagtatttgacccagcaggagatcggcaagaaggcacagcaggagacgggtgagcgtgaggcctcttgtagagataaggcaactacttccgtagagatgcggttccatcgaattgaccaggcagggttggagctcctcactagctag

SEQ ID NO: 26626 - DNA, 2817 bp, Artificial Sequence
  Description of Artificial Sequence: Synthetic coding sequence
atgttgtggccgcggctcgccgcagcagaatgggccgctcttgcctgggagctactaggggcaagcgtgctcctgattgcagttcgctggcttgtccgcaggctgggaccacgacctggagggctaggaaggagtggaaccccagtcccacccccatcagcggcagctgcgccagcttctggcgagatgactatggatgcgctacttgcccgtcttaaactacttaatccggacgacctgcgagaggaaattgtgaaggcaggcctgaaatgcggacctataacaagtaccactaggtttatcttcgagaagaaactggcccaggccttgctggagcagggcggccgactcagctcgttttaccatcatgaagctggggtgaccgctctctctcaggacccccagcggattcttaagcccgctgagggcaatccaactgatcaggctgggtttagcgaggatcgggacttcgggtattccgtgggattgaatccgcctgaggaggaagccgtgacctcaaagacatgctcagtcccaccctcagacacagacacctatagagccggagctactgcgagtaaggagcctccactgtattacggcgtatgccccgtatatgaggacgtccctgcgcggaacgagcgtatttatgtatacgagaacaaaaaggaggctttacaggccgtgaaaatgataaagggcagccgtttcaaggccttctccacaagagaagatgccgagaagtttgctagagggatttgcgattactttccctcaccaagtaagacaagtttgcctttatccccagtgaagactgcccctctgttttccaatgaccgattgaaggacgggctgtgtctcagcgaaagtgagacagtgaataaggagcgtgcaaacagttacaagaacccacgtacgcaggatctcacagccaagcttagaaaggcagttgaaaaaggggaagaagatactttctccgatttaatttggtccaatcccagatatttaattggttccggtgacaaccctaccatcgtgcaggaaggttgtaggtacaacgtgatgcatgtggccgccaaggaaaatcaggcctctatatgtcagctgacgctcgatgtcttggagaatcccgactttatgcgtctcatgtatcctgacgatgatgaagcgatgctgcagaagcgtatccgctacgtggtggacctgtacctcaataccccggacaagatgggctatgatacaccacttcactttgcttgcaagtttggaaacgcagacgtcgttaatgtgctttcaagtcatcacttgatagtcaagaacagccggaacaagtatgacaaaacccctgaagacgttatatgcgaaagaagcaaaaacaaatccgtcgaactgaaagaaaggatacgcgaatatctgaaaggccattactatgtgcccttgttaagagcggaggaaacctcttctccagttatcggggaactgtggtcaccagaccagacagctgaagccagccacgtgtcacggtacgggggaagccctcgcgatcccgtgctcacccttagggctttcgcaggaccactaagtccggcgaaggctgaagactttagaaaattatggaaaactccgcctagagaaaaggccggctttctgcaccacgtaaagaagagcgatccagagcggggatttgaaagggtggggagagagctggcccatgaattgggatacccttgggtggagtactgggagttcttagggtgtttcgttgacttgtcctcacaggaaggactacagcggttagaggaatacctgacacagcaggagatcggtaaaaaggctcagcaggaaacaggagagagggaggcttcgtgtagggataaagcaaccacctctgggagcaacagtatttcagtccgtgcttttctggacgaggacgacatgtcgcttgaggaaataaagaaccgacagaacgccgctagaaacaacagcccccccacagtgggtgccttcggacatacaagatgcagtgcctttcctctagaacaagaagctgaccttatcgaagccgccgagcctggcggcccccactctagcaggaatggcctttgtcaccccctcaatcactcaagaacccttgccggcaaacgacctaaagccccccggggggaagaggctcatctccccccggtcagcgacctgacggttgaatttgacaaactgaatctgcagaacatagggcgcagtgtgtctaagactcctgatgagagtactaagacaaaagaccagatcttgactagtagaattaacgcagtggagcgcgaccttcttgagccctcccctgcagaccaacttggcaacgggcatcgtcgtaccgaaagtgaaatgtccgctcgcattgcaaaaatgtctctgagcccatctagtccgcggcacgaagaccagctggaggtgacccgggagcccgcgcgccggctgtttttgtttggagaagaaccctccaaacttgaccaggacgtgttagctgccctggaatgcgccgacgtagatccacatcagttcccagccgtgcacagatggaagagcgctgtgctatgttatagtccatccgaccgacagtcatggccatcacccgctgttaagggacgattcaaatctcagctacccgacttaagtggacctcactcctactctccaggaaggaattctgtcgctggaagcaatccagccaagcccggcttgggatcaccgggaaggtatagcccagtgcatggcagtcagctgcggaggatggcccgtctggccgaactggccgccttgtag

SEQ ID NO: 26627 - DNA, 2631 bp, Artificial Sequence
  Description of Artificial Sequence: Synthetic coding sequence
atgacaatggacgcccttttggcgcggctgaaattactgaatcccgacgacctaagagaggagattgtgaaagctggcctaaaatgtgggcccatcacgtccaccactcgattcatcttcgagaaaaagctggcccaggcactgttggagcaagggggacggctgtccagcttttaccatcatgaggcaggcgtaaccgccctgtcccaagatcctcaacgcatactcaagccggctgaaggtaaccccacagaccaggctggattttcagaagatcgggattttggctactccgtcggcctcaatccccctgaagaggaagcggtaacttctaaaacctgttctgtgccaccgtcagacacggacacttatagggctggcgccacagcctctaaggaacctccactgtattatggcgtgtgccccgtatacgaggatgttcctgctcgaaatgagcgcatatacgtatacgaaaataagaaggaggcactgcaggccgtcaaaatgatcaagggaagcaggttcaaggccttcagcaccagagaagatgcggagaagtttgcgcgggggatatgtgactatttcccctcgcctagcaaaacctcgctgccccttagcccggtgaaaacagcccctcttttcagcaacgaccggctgaaggacgggctttgcctgtcagagagcgagacagtcaacaaggagcgggcgaacagctataaaaacccacggacacaagatctgacagcaaagcttaggaaagctgttgagaagggagaggaagatacattctccgacctgatctggtcgaaccccagatacctgattgggtctggagataaccccacgatcgtgcaggaggggtgtcgatataatgtcatgcatgtggccgccaaggagaaccaagcatccatctgtcagctcactctggatgtcctcgaaaacccagatttcatgagactgatgtaccccgatgacgatgaggcaatgttacaaaaaaggatccggtacgtggtcgatctgtatctgaatacccccgataagatgggttacgatacccccctgcattttgcatgtaaatttgggaatgcagacgtggtgaacgtcttaagctcacaccatctgattgtgaagaacagtagaaacaagtacgacaagacgcctgaggatgtcatttgcgagaggtccaagaataaatctgtggaactaaaggaaaggattagagagtacttgaaaggacattattatgttcccttactgagggccgaagagaccagctcgcctgtaataggagaactgtggtctcctgatcagaccgccgaagctagccacgtgagtaggtacggcgggtctccccgcgatcccgtactcacgcttagggcctttgctgggcccctgagtccagcaaaggctgaggacttccgcaagctgtggaagacccctcctcgagagaaagctgggttcctgcatcacgtcaagaagtcagatccagagcgaggcttcgagcgggtgggacgggaacttgcccatgagctgggttatccatgggtggaatactgggaatttcttggatgcttcgttgacctgagctctcaggagggactccaacgtcttgaggagtatctcacacagcaggagattggcaaaaaggcacaacaagagacaggcgaaagggaggcgtcctgcagagacaaggcaacgacttctggcagcaacagcatctcagtcagagcatttctcgacgaggacgatatgtctcttgaggagataaagaataggcagaatgcagcccgcaataatagtcctcccaccgtgggagcttttggccatacccgttgcagcgcgttccctctggagcaggaggctgacttgatcgaggccgcggagccaggagggccgcatagctcacgaaatggtctctgccatcccttgaatcatagccgcacacttgcagggaagagacccaaggctccacgcggagaggaagcccacctcccccctgtgtcagatttgactgtagagttcgacaagcttaacctccagaatattggccgcagtgtttccaagacccccgacgagtccacaaaaaccaaggaccaaatactcacttcccggatcaacgcagtcgaacgggatttgctcgagccatccccagccgaccagttgggaaacggtcaccggcggacagaaagcgaaatgagtgctcggatcgctaagatgtccctaagcccctcgtccccgcggcacgaagatcagctggaagtcactagggaaccggcgagaagactgttcctcttcggggaagagccttccaagctggaccaggacgttttggctgcgttagagtgcgcagacgtggatcctcaccaattccccgctgttcatagatggaaatcggctgtcttgtgttactccccctccgacaggcagtcttggccgtcacctgccgtcaaggggcgcttcaagtcccagcttcccgacctgagtggcccgcacagctacagccccggacggaattccgttgctggcagcaatcctgccaaacctggactagggtcacctgggcgctactcgccggtgcatggaagccagctgcgtcgcatggccagactggccgaattagcagcactctag

SEQ ID NO: 26628 - DNA, 2826 bp, Artificial Sequence
  Description of Artificial Sequence: Synthetic coding sequence
atgtatcaaggcgagtttggcctcaatatgaaactcggctacggcaaattcagttggcctactggcgagtcatatcatgggcagttttatagagaccattgccatgggctcggaacatacatgtggcctgacggttctagctttaccggcacattctatctctcacacagagaggggtacggaactatgtatatgaaaacccggctcttccagggcctgtataaggcggaccagagattcggccctggggtcgagacctaccctgacggctcccaagatgtcggtttgtggttccgagaacagttaatcaaactgtgtacacagatccctagcggcttctccctcctgcgttacccagaattctcttcctttattacccacagtcccgcgaggattagtctctctgaggaggaaaagacagagtggggcctccaggaaggccaggaccctttcttctacgattacaaacggttcttgcttaatgacaacctgactctgcccccagagatgtatgtgtacagtaccaactctgatcatctcccaatgacctccagctttcggaaagagttggatgctcgtatatttttaaacgaaatccctccattcgtcgaggacggggagccgtggttcattataaacgaaacacccctcctggtgaagatccagaagcaaacatataaatttcgtaataagcctgcccacacaagttggaacatgggcgctatcctggaaggcaaacgctccggcttcgccccgtgcggaccgaaggagcaactttctatggagatgatccttaaggcagaggaggggaaccacgagtggatctgtaggattctcaaggataacttcgcctctgctgacgttgcagatgccaaaggatacactgtgttagctgccgccgcaactcactgtcataatgatatcgtgaacttgttactggattgtggagccgatgttaacaagtgtagtgatgaaggcctgacagctctgtccatgtgtttcctgcttcactatcctgcccagtccttcaaaccaaatgtagcggagcggacaattccggaaccccaggagcccccaaagtttccagtggtgccaattctgtcatcatctttcatggacaccaacctggagtctctgtattatgaggtgaatgttccatctcaaggctcctacgaactgcgacccccacccgctcctctgttgttacccagggtgtctggcagtcatgagggaggacacttccaggatacaggccagtgtggcgggtccatcgaccatagatcatcttcccttaaaggagactctccactggttaaaggcagtctgggacacgttgaaagtggtctggaggatgtcctgggcaacactgatcgaggtagtctgtgttccgcagaaacgaagttcgaaagcaatgtttgtgtgtgcgatttctcgattgagttgtcacaggccatgctggagcgctccgcccagagccattcactgctgaaaatggcatctccttcaccctgcaccagctcctttgacaagggcaccatgcgccggatggcattaagtatgatagaacgtcgcaagaggtggcgcactattaaacttctactgcgaagaggggcagaccccaacctttgttgtgttccgatgcaagttctttttctagctgtgaaggcaggggacgttgacggagtccgattactcttagagcatggagcgcggacagatatctgcttcccacctcagctgtcaactcttacgcccttgcatatcgctgcggccctcccgggtgaagagggagttcagattgtcgaacttctgctccacgcaattaccgatgtggacgcaaaggcgtctgacgaggatgatacgtacaagccaggtaaactggacctgcttcccagcagccttaagttgagcaatgaaccagggcccccccaggcctattattccaccgacactgctctgcctgaggagggaggacgaacagcgctccacatggcttgtgaacgcgaagacgataacaaatgtgctcgtgacattgtcagactcctgctgtctcacggggccaatcctaacctgctgtggtcaggacatagcccattgagcctgagtatcgcctctggcaatgaactcgtagtgaaagaactgctaacgcaaggtgctgaccccaatttgcccctcaccaaagggctcgggtccgctctttgtgtagcttgcgatttaacctatgagcaccagcgcaatatggatagtaaactcgcgttgatcgaccgcttaatcagtcatggtgccgatatccttaagccagttatgcttcgccagggagagaaagaggcagttggcactgccgtggactacggctatttccgtttttttcaggaccgacgcatagcgcgctgtcctttccacactcttatgcctgccgagcgggaaacattcctagcaagaaagaggctgttggagtatatgggactgcagctgcgccaagcggtcttcgctaaggagagccagtgggatccaacatggctgtacttatgcaaacgcgccgaactcattccttctcacagaatgaaaaagaaaggccctagcctgcccaggggactagatgttaaggagcagggtcagattcccttttttaagttctgctaccagtgtggacggtcaataggcgtgaggctcttgccatgtcccagatgttacggcatcttgacatgctccaagtactgcaagaccaaggcctggacagagtttcataagaaagactgcggcgacctcgttgcgatcgtcacacagctggagcaggtgagcaggcgccgcgaagaatttcaatag

SEQ ID NO: 26629 - DNA, 2154 bp, Artificial Sequence
  Description of Artificial Sequence: Synthetic coding sequence
atggagggcgcccatgcatccctgagcctggaggatgaagtgagtggcgctggctcccggcagcggccactggaagggaaaggcggtgagacccccgccgccgaagaacctggcagtctgaagaactatgccgtatttgctacacgcgatgtgagcgctgccccagaaaaagaagaggaagaggctgaggggccactgcgcgcccaggacctgcgggaaagctacatccagttagtgcagggagtgcaggagtggcaagatggttgcatgtaccagggagagttcggattaaatatgaaactgggctatggcaaattctcatggccaactggcgagagttaccacggccagttctaccgagatcactgccatggattggggacatatatgtggcccgacggatcgtcattcacaggaaccttctatctgtcccacagagagggatacggcactatgtatatgaaaaccaggctttttcagactcattgccataatgatattgtgaatctgttgctcgactgcggagccgacgtgaacaagtgctctgacgaaggcctgacagctctgtccatgtgcttccttctccattatcctgcgcaatcatttaaaccaaacgtggctgagcggacaataccagaaccacaggagcctcctaagtttccagtcgtcccaattctgtcgagcagctttatggataccaatcttgagtctttgtactatgaggtgaacgtgccctctcagggcagctatgaactgcgcccccctccagcccctttgttgctcccacgcgtttccggttctcacgaaggggggcacttccaggatactggccaatgtggagggagtatcgaccaccgctcatccagcctcaagggagattcacccctagtgaagggaagtctaggtcacgtcgaatcaggccttgaggatgtgctggggaacaccgataggggaagtctatgttccgccgagaccaaatttgagagtaatgtgtgtgtctgtgattttagtattgagctgtcccaggcaatgctggaacggagcgctcaatctcattctctgttaaaaatggcttccccttcaccctgtacaagcagcttcgacaagggcacaatgaggcgcatggcactgagcatgatcgagaggcgcaagcggtggaggactattaagttgttgctccgaagaggggcagaccccaacctgtgctgcgtccccatgcaggtgctctttctcgcagtgaaggcgggcgacgttgacggcgtccgccttctgttggaacatggtgccagaactgacatatgttttccaccccagctgagtacactcacacctttacatattgccgccgccctgcccggggaggaaggtgtgcagattgtggagctgctattgcacgccatcactgacgtggatgccaaggcatccgacgaggacgatacgtacaagcctgggaaggttgtaaaagagcttttaacccagggcgctgatcctaatctgcccctgactaaaggacttggtagcgccctgtgcgttgcctgtgatttaacttatgaacaccagagaaatatggattctaagctggctcttatcgaccggctcatttcccatggcgccgacatactgaagccagtcatgttacgacagggcgaaaaagaagctgtgggcactgctgtcgattacggctactttcgtttcttccaggacagacggatcgcacggtgccccttccacacacttatgccagccgagcgtgaaacgtttctcgctcggaaacgcctgctagaatatatgggactgcagctgagacaggcggtgttcgcaaaagagagtcagtgggaccctacctggctctacctctgcaaacgagccgagttaatccctagtcacaggatgaaaaaaaagggaccgtcattgcctcggggactcgatgtgaaggaacagggtcagatccctttcttcaagttctgctatcagtgcgggaggtccatcggcgtgagacttcttccctgccctcggtgttatgggatcctaacttgctctaagtactgcaagacgaaagcatggacagagtttcataagaaagactgcggggatctggttgccattgtcacgcagctcgagcaggtctcacgccgcagagaagagttccagtag

SEQ ID NO: 26630 - DNA, 2136 bp, Artificial Sequence
  Description of Artificial Sequence: Synthetic coding sequence
atgtatcaaggcgagttcggattaaatatgaagctgggatacggaaagttctcttggcccactggagagtcgtaccacggtcagttttacagggatcattgccacgggttgggcacctacatgtggcccgatgggagctctttcaccgggacattttacttgtcacatagggaaggctatggaactatgtacatgaagacgcgtctgttccagacccattgccacaacgacattgtcaatctacttctggattgcggggcagacgtgaataaatgtagcgacgagggccttactgcactgagtatgtgttttttgctgcattatccagctcagtcctttaaacccaatgtcgccgagcggactatcccagaaccccaggagccgccgaagttccccgtagttcccatccttagtagtagtttcatggacactaatctggagtcactttactatgaggttaacgttcctagtcaggggtcatatgagctccgtccgccaccagcccccttactcctccctagggtgtccgggagccacgagggcggacactttcaggatacaggacagtgcggcggtagtatcgatcaccggtcatcatcactcaaaggggacagtcccctcgtcaaaggaagcctggggcacgtcgaatccggccttgaggacgtgctgggaaacacagataggggaagcctctgctcggccgaaaccaagttcgagagtaacgtctgtgtatgtgacttttcaatcgaactcagtcaagctatgctcgaaaggagcgctcaaagccacagtctcttgaagatggcaagtccttccccgtgtacatcaagctttgacaaggggacaatgcgccgaatggcgttgtctatgatcgagcgccgcaaacgatggcggaccattaaactgttgctgcggaggggagccgatcccaacctgtgttgcgttccgatgcaagtgctgttcctcgcagttaaggctggggatgtagacggcgtgcggcttttgttagagcacggtgcccggaccgacatctgtttccctcctcagctgagcactctgacacctcttcatatcgcagcggcgctgcctggggaggaaggcgtccaaattgtggagctgctactgcacgctattacagacgtggacgcgaaagcgagtgacgaagacgacacttacaaaccgggaaagcttgatttactgccttcctctttaaaactctctaatgaacctggccctcctcaggcctattactcaacagataccgctctgccagaggaaggcgggcggactgctctgcacatggcctgtgaaagggaagacgacaacaaatgtgcacgcgatatcgtgcgtctactgttgtcccatggcgctaatcctaatttgttgtggtccggccatagcccgctgagcctttctattgctagcgggaatgagttggttgttaaagaactcctgacgcagggcgcagaccccaatctgccgctgacgaagggcctggggagcgcactctgcgtggcctgtgatctcacatatgagcaccagcgaaatatggatagtaaactggcgctcattgacaggctgatctcacatggtgccgacatcttaaaaccagttatgctaaggcaaggggagaaggaagccgtgggtactgcggtagactacggttacttccgcttttttcaagacagaagaatcgcgcggtgccctttccatacactgatgccggccgagcgagagacgttccttgcaagaaagcgcctcctcgagtatatggggcttcagttgcggcaggccgtttttgccaaagaatcacaatgggatccaacctggctttacttatgtaagagagcagaactgatcccgtcacatagaatgaaaaagaaaggcccatctctcccacggggccttgatgtgaaggagcagggccagatccctttctttaagttctgctatcagtgtggaagatctataggcgtccggctgttgccttgtcccaggtgctacggaatcttgacctgttctaagtactgcaagaccaaggcctggacggaattccataagaaagactgcggggacctagtggctattgtgacccaactggagcaagtctcccgacggagggaggaattccagtag

SEQ ID NO: 26631 - DNA, 2826 bp, Artificial Sequence
  Description of Artificial Sequence: Synthetic coding sequence
atgtatcaaggtgagtttggactaaatatgaaactcgggtacggtaagtttagctggcctacaggcgaaagctatcacggacagttttatagagatcactgtcacggactaggaacatatatgtggcccgacggatcctcttttacggggacgttctatttgagtcatagggaagggtatggaacaatgtatatgaagacccgcctgtttcagggcctttacaaggccgaccaacggttcggacctggcgtggagacctatcctgacggatcccaggacgtagggctttggttccgggagcaacttattaaactctgtacccagatcccgagcggatttagcctcttgagatatccagaattcagctctttcattacacacagccccgctaggatcagcctgtccgaggaagaaaaaacggaatgggggctacaggagggtcaggatccattcttttacgattacaagcgctttctactgaacgacaatttgacacttcctccagagatgtacgtatacagcacaaattccgaccacctgcccatgaccagctcatttcgtaaagagctggacgccagaatattcctaaatgaaattccaccatttgtcgaagacggcgagccttggtttattatcaacgagaccccactccttgttaagatccagaaacagacttataaatttagaaataagcccgctcatacatcatggaatatgggggctattctggaaggcaaacggtcgggcttcgccccctgcggtccaaaggaacaactatcaatggagatgatcctgaaggccgaggaggggaaccatgaatggatttgcagaatactcaaagacaactttgcatcagcggacgtggcagatgctaagggctacaccgtccttgctgccgccgccacccattgtcacaatgatatcgtgaatttattgcttgattgcggcgcagatgttaataagtgtagtgacgaaggactgacagccctgtcgatgtgcttcctgctgcactatccagcccagtcatttaaacctaatgttgcagaaagaacaatccctgaacctcaggagccccccaagttccctgtagtccctattctaagcagtagcttcatggacacaaacctagaatctctgtactacgaagtaaatgttcctagtcagggttcctacgaactcagaccgccccctgcccctttactgttgccaagggtgagcgggtcacacgagggggggcacttccaagacactggacagtgtggaggtagcatcgatcaccgctcttcgtcacttaaaggagattcccccctcgtaaaagggtctttagggcatgtcgaatccggcctggaggacgtattgggtaacaccgatagggggagcctatgcagcgccgagaccaagttcgagagcaatgtgtgcgtgtgcgatttcagcattgaactgtcccaggccatgctggaacgctccgcccaatcccactcactcctcaagatggcgtccccttctccatgcacaagctcctttgacaaaggcacaatgaggagaatggcattgagcatgattgagaggcgcaagcgctggcgcacaatcaaactgctgcttagacggggagcagatccaaacctgtgttgcgtgccgatgcaggttttgtttctggccgtcaaggctggcgacgtggacggggtgcgcctgctgctggagcacggagcacgtactgatatttgctttcctccccagctcagtactctgacccctcttcatattgccgcagccctgcctggggaggaaggggtgcagattgtggaactgctactccatgccattactgatgtggacgcaaaagcctcagatgaggacgatacctataaacccggcaagctcgacctcctgcccagctcattaaagttgtccaatgagccaggaccaccccaagcttattactccacagatacagccttgcccgaagagggtggccgcactgcactccatatggcttgcgaacgagaagacgataataaatgcgcccgggatattgtgaggctcctgctcagtcacggtgccaaccctaacctcttgtggagtggccactcccccctctcactcagtatcgccagtggtaacgagctagtggtgaaggaattgctcacgcagggtgccgacccgaacctgccgctgactaaaggcctgggaagtgccctgtgcgtggcctgcgacctgacatacgaacaccagagaaacatggactcaaaactggctcttatcgacaggctgatctcccatggcgctgatatcctgaagccggttatgttgcgtcaaggggaaaaggaggcagtggggacagccgtcgattacggatacttcagatttttccaggatcgccggattgctagatgtccattccataccctcatgcccgccgaaagggagactttcctcgcacggaagaggctgcttgagtacatggggcttcagttgcggcaggctgtgttcgctaaggaaagccagtgggatcctacatggctgtatctgtgtaaacgggcagagctgataccatcccatcggatgaaaaaaaagggaccctccttgcctagaggtttggatgttaaagaacaagggcagatccccttcttcaagttctgctaccagtgtgggcgatcgattggcgtgcgactgctgccatgccctagatgctatgggatattgacttgtagcaagtattgtaagacgaaggcatggaccgagtttcataagaaggattgcggtgatttggtggctattgttacgcagttggaacaggtgagtcgccgcagggaggaatttcagtag

SEQ ID NO: 26632 - DNA, 1320 bp, Artificial Sequence
  Description of Artificial Sequence: Synthetic coding sequence
atggaaggggctcacgccagtctgagcttagaagacgaagtgagcggggcggggtcaaggcaaagacccctggaaggaaaaggcggggagacccctgctgctgaagagccaggctccctgaagaactacgcagtgttcgctacccgagacgtctcggccgcacccgagaaagaagaggaggaggcagaggggccgcttcgggcacaggacttgcgagagtcctatattcagctggtccagggggtgcaggagtggcaggacgggtgcatgtaccagggggagttcggccttaacatgaagcttggctatggaaaattttcatggcccacaggagaatcttaccacgggcagttctatcgcgatcattgtcacggactgggtacgtacatgtggccagacggatcttcctttacaggcacattctatctgtctcatcgggagggttacggaactatgtacatgaaaactcggctttttcaaacccactgccacaacgatattgtgaatctcctgttagactgtggggctgacgttaacaagtgttctgatgaaggactgactgccctgtccatgtgcttcctcttgcactatccagctcagtccttcaagcctaacgtggctgaacgtacaatcccagagccccaggagccacccaaattccccgtcgttcccatcctcagttcttcattcatggatacaaatcttgagtcactgtattacgaagtgaatgttccctcacagggatcatatgagcttcgcccgccgcccgccccgcttctactgccaagggtttccggttcacacgaaggtgggcattttcaggacaccggccaatgcggagggagcatcgatcaccgcagttccagcctgaaaggagattcgcctctggtcaagggctcacttggccacgtggaaagcggcctggaggacgtgttaggcaatacagataggggctcactgtgcagcgcggaaaccaagtttgaatccaacgtctgtgtctgcgatttttccattgagctgagccaggctatgcttgagcggtcagcgcaaagtcactctcttctgaagatggcgagcccatctccttgcacttcatccttcgacaaaggcacgatgcgcagaatggccctgagtatgatcgagcgccggaaacgctggcggaccataaaactgctgttacgacgcggtgcagacccaaatctttgttgcgtccccatgcaggtgctattcctggccgtcaaggctggcgacgtggacggggtccggctcttgctggaacacggcgctaggactgacatttgcttccccccacagtgttag

SEQ ID NO: 26633 - DNA, 225 bp, Artificial Sequence
  Description of Artificial Sequence: Synthetic coding sequence
atggagggtgctcacgccagtctctccctggaagacgaagtcagtggagcagggtccaggcaacgccctttggagggaaagggaggggagaccccggccgccgaggagcccggatctttgaaaaactatgccgtttttgctacaagggatgtgagtgccgctccggaaaaagaagaagaggaagcggagggccctttgcgcgctcaggacttgcgggaatcttag

SEQ ID NO: 26634 - DNA, 684 bp, Artificial Sequence
  Description of Artificial Sequence: Synthetic coding sequence
atgtaccagggcgaattcgggctcaacatgaagctgggttatggcaagttcagttggcccacaggcgagtcctatcatggccagttctacagggaccactgtcatggcctcggaacttacatgtggcccgacggatcctcctttacaggaacgttctatctctcacatcgggaggggtacgggacgatgtatatgaagaccagactgtttcagggtctctacaaagcagatcagaggtttggacccggggtggaaacttaccctgacggttcccaggacgtgggattatggtttagggagcagcttataaagttatgcacgcagattccgagcggatttagcttattgagataccctgaattttctagcttcattacgcattcacccgctcgcatttctctgtctgaggaagagaagactgagtggggcctgcaagaaggccaggatccctttttttacgattacaagagatttctgctcaatgacaacctcacacttccccccgagatgtacgtgtattcgactaactctgaccacttgccgatgacctcaagcttccggaaggagctcgacgcaaggatctttctcaacgagatacctcccttcgtggaagacggggagccgtggtttataattaacgagactccgctgcttgttaagatccaaaaacagacatacaagtag

SEQ ID NO: 26635 - DNA, 1020 bp, Artificial Sequence
  Description of Artificial Sequence: Synthetic coding sequence
atgagggatgtaagcgccgcccccgagaaggaagaggaggaggccgaggggccattgagggcacaggatctaagggagtcctacatacagcttgtgcaaggtgtgcaagagtggcaggacgggtgcatgtatcagggcgaattcggcctcaatatgaaactcgggtatggcaaatttagttggcccactggtgagtcgtaccatgggcagttttaccgagatcactgtcacggcctggggacctacatgtggcccgatggaagttccttcacaggcacgttttacctgagccaccgagagggttatggcactatgtacatgaagacccgcctatttcaaacacactgtcataacgatatagttaatcttttgctggattgcggtgctgacgtcaataagtgctctgacgaaggcctgactgcccttagtatgtgcttccttctgcattatcctgcccaaagctttaaacctaacgtcgccgagaggacaattccagaaccacaggagcccccaaagttcccagtggtgcccattctatcaagctcatttatggataccaacctggagtccctgtattacgaggtcaacgttccctctcagggctcctacgagcttcgaccgccacccgccccccttctcctaccacgagtgtccggaagccacgaagggggccacttccaggacactggacagtgtggaggatccatagaccacaggtcaagcagtctcaaaggcgactcacctctggtgaaaggttctcttggacatgtggaatccggcttagaggatgttctgggcaatactgaccgtggcagcctatgctctgccgaaacaaaattcgaatccaacgtctgcgtctgcgatttcagcatcgaactgagccaagcgatgttggagcgctcggctcaatcccactcactcctgaaaatggcgtccccgtcgccatgcacgtcttcattcgacaagggaaccatgcgccgcatggccctgtcaatgatcgagagttgttccctactgtag

SEQ ID NO: 26636 - DNA, 741 bp, Artificial Sequence
  Description of Artificial Sequence: Synthetic coding sequence
atgtatcagggtgagtttgggctgaacatgaagctggggtacggaaagtttagttggcctactggagagtcatatcacggtcaattctatagggatcattgtcacggccttggaacttacatgtggcccgacgggtcttcctttaccgggaccttctacttgagccatagggagggatacggtaccatgtacatgaagactaggctgttccaaggcctgtacaaggctgatcagcgattcggtcctggcgtggaaacgtaccccgatgggtctcaagacgtggggctatggttccgggagcaactgatcaagctgtgcactcagattccatcagggttttctctgctcagatatcctgagtttagctccttcataactcactcccccgcgcggatatcgctttccgaagaagagaagactgaatggggccttcaggaggggcaagatcccttcttctatgactacaaaaggttccttcttaatgacaatttgaccctcccaccggaaatgtatgtgtatagtacaaactcggatcacctccccatgacctccagcttccgcaaagagcttgacgcacgcattttcctgaacgagatccctcctttcgttgaggacggcgaaccatggtttattattaacgaaacaccactcctggtgaagatccagaaacagacctacaagtttagattgacagccacaacgactctctctactttctcgtggactgtcggtcccacgtag

SEQ ID NO: 26637 - DNA, 1326 bp, Artificial Sequence
  Description of Artificial Sequence: Synthetic coding sequence
atggttcacataaagaagggcgagctcactcaagaagaaaaggaactgctagaggtgattggtaaggggactgtgcaagaagcgggcacactgctgtccagcaaaaacgtgcgtgtcaattgccttgacgagaatggaatgaccccactgatgcacgcagcctataagggcaaactggatatgtgtaaactgcttcttcggcacggcgcagacgtgaattgtcaccaacatgaacacggctatactgccttgatgttcgcggccctatccggcaacaaagacatcacatgggtcatgctcgaggcaggggctgagactgacgttgttaattccgttggaaggactgccgcccagatggccgcatttgttggccaacacgattgcgtgaccatcattaataacttctttccgcgcgaacggctagattattacacaaaaccgcaagggttagacaaagagcctaagctacctccaaagctcgcaggaccactgcataaaattatcactactactaatctacatccggtaaagattgttatgttggttaatgagaatcccctgttaacggaagaggcggctttgaataaatgctatcgcgtgatggacctgatctgtgaaaaatgtatgaagcaacgagacatgaatgaggttctagcgatgaagatgcattacatcagttgcattttccagaagtgcatcaacttcctgaaagatggggagaataagctggataccctgattaagagccttctcaaaggaagggcaagtgacgggttccccgtgtaccaggagaaaataattcgcgagagtattaggaaattcccctactgcgaagccaccctgctacagcagctcgtccgcagcattgcaccggtggagattggttccgaccccacagcattctctgtgttaacccaggccatcactggccaagtggggttcgtggacgttgagttctgtactacatgtggagagaagggggcttctaaacgctgctccgtgtgcaagatggtaatttattgcgaccagacttgtcagaaaacacactggttcacccacaaaaaaatctgcaagaatctgaaagacatttacgaaaaacagcagctggaggccgctaaggagaagaggcaggaggaaaaccacggaaaactggacgtgaactctaactgtgtgaatgaagagcagcccgaggcggaggtggggatctctcagaaggattctaatcccgaggacagtggcgagggcaagaaggagtcccttgaatccgaggctgagctcgaaggactccaagacgcccccgcgggcccgcaggttagtgaagaatag

SEQ ID NO: 26638 - DNA, 1290 bp, Artificial Sequence
  Description of Artificial Sequence: Synthetic coding sequence
atgttgatgtcctggtctcccgaggaatgtaaaggacagggagaaccactcgacgatagacaccctctgtgcgctagactcgtggagaagccttctagaggaagtgaggaacacctcaagagcgggcctggtcctatagtgacaaggacggcttccgggcctgcattggctttttggcaggccgtgctagcaggcgacgttggatgcgtgtctaggatccttgccgactcctctaccggactggctccagattccgtgttcgatactagtgacccagagcgctggagggactttcgctttaatatccgcgccttgagattatggtctttgacatatgaagaggagttgacaactccgctgcatgtggcagccagtagaggacataccgaggttctccggctgctgctgcgccgaagagcacggcctgattccgcccccggaggacgtaccgcactacacgaggcctgcgcagcaggacacacagcatgtgtgcacgtgctgctggtggccggggcagacccaaacatcgctgatcaagatggaaagcgccccctgcacctgtgtcgggggccaggtactctggaatgcgctgaattgctgctgaggtttggagcgcgagtcgacggtagaagtgaggaagaagaggagactccacttcacgttgctgctcgcttgggccacgtcgaactggccgacctgctcctgcgtagaggggcctgtcccgacgctcgcaacgctgagggctggacgcctctcctggcagcctgcgatgtgagatgccagagtattacagatgcagaggcaacaacagcacgctgcctccagctgtgctcactgctgctgtcagcaggggcagacgccgacgctgccgaccaggataagcagagaccattacatctggcctgccggagagggcatgctgcggtagtcgaacttttattgagctgcggagtcagcgctaatacaatggactacggtggacatacccctctacattgcgctctccagggtcccgccgctgcactcgctcagagtccagagcacgttgtgcgcgccctcctcaatcacggcgcagtccgagtttggccaggagcacttcccaagaagcaccagaggttttatagctcattgttcgccctggtaaggcagccgcggtcccttcaacatcttagccgttgtgctctccgctcccatctcgaaggcagtctccctcaagcactgccccgccttcccctacccccgaggctcctccgttatctccaattggattttgaaggggttctgtattag

SEQ ID NO: 26639 - DNA, 1359 bp, Artificial Sequence
  Description of Artificial Sequence: Synthetic coding sequence
atgccttggggaaaaaacagtagtccacattggggccatcatctcgggtgcctcccttccgcacccgcctgcagaatctggagaccgcattcccggcctgcatgggagcccccaaggcccagccccctgctttgccaagatatggccctgcagaatgctttgtacactggagatctcgcccggctgcaggagcttttccccccacattccaccgcggatcttctgctagagagccgggccgccgagcctcgatggagcagccaccagaggggcctgtggagcttaacttatgaggaggagttgaccaccccgctacacgttgccgcttccagaggtcacaccgaagtactgcgactactcttgaggagacgggcccgacctgactccgcaccaggcgggcgaacggctctgcacgaggcttgcgccgccgggcacaccgcctgcgtccacgtgctgttggtcgctggggctgatccaaatattgccgatcaggacggcaagagacctcttcatctgtgtaggggccctggtacactcgagtgcgctgaactgcttttgcgcttcggcgcccgggttgatggacgcagtgaagaggaggaggaaaccccgctccacgtcgcagctagattgggccatgtcgaactggcagacttgctccttcgaagaggagcatgtcctgacgcgcgcaacgccgaaggttggactcctttgctggctgcctgcgatgtcagatgtcagtcaatcactgatgcagaagccactaccgcccgttgcctgcagctgtgctcactgttactgtccgcgggcgccgatgcagacgccgccgaccaggacaaacagagacctctgcatctggcatgccgccggggacacgccgccgttgttgagttgttgctgagctgtggggtctcagctaacaccatggattacggcggtcacacaccacttcattgtgccctgcagggacctgctgccgcacttgcacagtcacccgagcatgtcgtcagagccctcctcaaccacggcgcggtgcgagtctggcctggggcgttaccaaaagtcttggagagatggtcaacttgtcctaggaccatcgaggttctgatgaacacatactcagtggtccaattgccagaggaggctgtgggactggtgacaccagaaacattgcagaagcaccagcggttctatagcagtctgtttgctctggttcgacagcctcggtccctccagcatctgtctagatgcgctctccgttcccacctggaagggagcctccctcaggctctgcctcgattacctctgcctcctcggctactacgatacttacagctcgactttgagggcgtgctctactag

SEQ ID NO: 26640 - DNA, 1404 bp, Artificial Sequence
  Description of Artificial Sequence: Synthetic coding sequence
atgcttatgagctggtccccggaagagtgcaagggacaaggagaacccttggacgacagacatccactctgcgcaaggcttgtcgagaagccgtccaggggatctgaagagcacctgaagagcgggccggggccgatcgtgacgagaacagcctccgggcccgctctggctttctggcaggccgtgcttgccggcgacgtgggctgtgtaagccgcattctagccgactccagcactgggctcgccccagactccgtgttcgacacttccgacccagagaggtggagagatttcagattcaatattcgagcgctgcggctgtggtccctgacttatgaggaagaattgacaactcccctgcacgtggcagcctctcggggccacaccgaggttctcaggctgctgcttaggcgcagagcacgccccgattcagcacctgggggacgtacagcactccatgaagcttgcgccgctggtcacaccgcttgtgtccacgttctgttagtcgccggtgccgatcctaatattgcggaccaggacggcaagcggcctcttcacttgtgccgtggacccggcacactggagtgtgctgagcttctgctgcgcttcggagcacgggtcgatggtcggtcagaggaggaagaggagacccccttgcatgtcgccgcccggctcggccatgtcgaactggccgacctcctactcagaagaggcgcctgccctgatgcccggaatgcagaaggttggacaccacttctggctgcgtgcgatgttcgttgtcaatcaatcactgatgcggaggcgactacagctagatgcttgcagctgtgctccctgctcctctcagctggcgctgatgccgacgctgccgatcaagataaacagcgacccttgcacctggcctgtcgtaggggacacgccgcagtggtcgaattactcctctcttgtggagtgagtgctaataccatggattatggaggtcatacccccctgcattgtgcgctgcagggccctgctgctgccctggcacaaagccctgagcacgtggtgagggccttgctgaatcacggcgcagttcgtgtatggcccggagccttgcctaaagtgctcgagaggtggtctacctgccctagaacgatagaagtactgatgaatacttatagtgtggtccagcttccagaggaggctgtgggtttggttactccggagaccctacagaaacatcagcggttctattcatccttgttcgcgctggtgcgacagccccgctctttgcaacacctgagccgctgcgcactgcggtcgcatctggagggatccctaccccaggccctgccccgcttgcccctcccccccagacttttgcggtacctgcagcttgatttcgagggagtcttgtactag

SEQ ID NO: 26641 - DNA, 1539 bp, Artificial Sequence
  Description of Artificial Sequence: Synthetic coding sequence
atgaggggacaggtcagcctaggcgcttgggatacaggtgccttttgtttgtcagtgttcccttcatgctcactgagtctgagtctccccctcgcttatactagtcctcctccacactccccgtttcccgcccacatgctcatgtcatggagccccgaggagtgtaaggggcagggtgagccactcgatgaccggcatccactctgcgctaggctggttgagaagccctccagaggaagtgaggaacacttaaaatctgggccaggaccgatcgtaactcgcaccgcatctggacctgccctggctttttggcaggccgtcctcgctggggatgtgggatgcgtgtctcgcatattagccgacagctctaccggactcgcacccgactccgtcttcgatacatctgaccccgagcgatggcgagacttcaggttcaatattcgcgcgctccggctgtggtcattaacatacgaggaagaacttaccacgcccttgcacgtggcagcctcacgcggacacacggaagtattaagactcttactgagacgccgagctcggccagattccgcacctggtgggcgcacagctttgcacgaagcctgcgccgccggacacaccgcctgcgtccacgtgctgctggtcgccggcgcagatcccaacattgctgatcaggacggcaagcgacctttacatctttgcagagggcctggtacacttgaatgcgctgagcttctgctccgctttggcgctcgcgtggatggcaggagcgaggaggaggaggagaccccactgcacgtcgcagcccgattggggcatgtggagcttgcagacttattgcttaggaggggcgcttgccccgacgcacgaaacgccgaagggtggacccctttactggctgcctgcgacgtaaggtgccagagtataacggatgctgaagctactaccgctcggtgcttacagctgtgcagtctgcttctgagcgcgggtgccgacgcagacgccgccgatcaggacaagcagaggcctctccatctggcgtgtcggcgcggacatgccgccgtagtcgagctgctgctgtcttgcggagtcagcgcgaatactatggattatggggggcacacacctcttcattgtgcactgcagggcccagctgctgctcttgctcagtcgccggaacacgttgtcagagcacttctcaatcatggagccgttcgtgtgtggccaggggccctgcccaaagtgctcgaacggtggagtacatgccctaggaccatcgaggttctgatgaacacatattcggtcgtacaattgcctgaagaggccgtgggacttgttaccccggagacgcttcagaaacaccagagattctatagctccctgttcgccttggtcaggcagcccaggagtcttcagcacttgtctcgctgtgccctgaggagtcacctggagggcagcttgccgcaagctctgcccagactgccactgcccccgaggttactccgctacttgcagctggattttgagggagtgctgtactag

SEQ ID NO: 26642 - DNA, 1425 bp, Artificial Sequence
  Description of Artificial Sequence: Synthetic coding sequence
atgcgcgggcaggtgagcctgggcgcctgggataccggggccttttgcctctccgtttttccatcatgttcccttagcttgagcctgcctctggcctatacgtctcccccaccacactctccattccccgcccacatgctcatgtcatggagtccagaggagtgtaagggacagggggaacccctggacgacaggcaccccctgtgtgctcgccttgtcgaaaaacctagccgcggaagtgaagagcatcttaaatcaggaccaggcccgattgtgactagaacagcctccggccctgcactcgctttctggcaggccgttctggccggggatgtgggctgcgtttcccgtattctcgccgactcctccactggactcgcgccagacagcgttttcgacacctcggatccggagagatggcgggatttccggttcaatattcgagcgttgcgtctgtggtccctgacctacgaggaggaacttacaacccccctccacgtagcagcgtcacgggggcacacagaggtactgaggctcctgttgcggcggcgcgctagacccgactctgctcctggcggccgcacagctctgcacgaggcttgcgctgcagggcataccgcttgtgtgcacgtgctactggtggccggtgctgatccgaatattgcagatcaggacggcaagcgacctttgcacttgtgccgagggcctggcaccttagagtgcgcagaactgctgctccggtttggggcacgcgtggatgggaggtccgaggaggaggaggagacacctctgcacgtcgctgctcgtctcggtcatgtagaactggccgatcttctactgcgaagaggcgcatgcccagatgctaggaatgcagaggggtggacgcctctgctggcagcttgcgacgtcaggtgtcagtcaattactgatgcagaagcaaccaccgctaggtgtctgcaattgtgctctctactgctgagcgcgggagcagacgctgacgcggcagatcaggataagcaaaggccattgcacttagcttgtagacgtgggcacgctgctgtcgtggaattgcttctgtcctgcggtgtaagtgccaatactatggactatgggggacatacgcctctgcactgcgctctgcaagggcccgccgcggctctcgctcagtcccccgaacacgtggtacgcgccctgctcaaccatggtgccgtgcgggtttggccaggggcgctccccaaaaaacatcagcgcttctactcctctctctttgcacttgtacggcagcccaggagcctgcagcatttatcacgttgcgctctgagaagccatcttgagggttcccttccccaggcactgccccggctgcccctgcccccaagactgctccggtatctgcagttagatttcgagggcgtgctgtattag

SEQ ID NO: 26643 - DNA, 861 bp, Artificial Sequence
  Description of Artificial Sequence: Synthetic coding sequence
atgagaatcgtactacagctcgcgaagatgaacctgatggacataacgaagattttttccctactccagcctgataaagaggaggaggacacagataccgaggaaaaacaggctttaaaccaggctgtgtatgataatgacagttacacactggaccagctgcttaggcaggagcgctacaaaaggtttatcaattctaggtctggttggggcgtacctggtactcccttacggctcgccgcgagctacggacatttgtcttgcctacaggttctccttgcccatggcgccgatgtggactccctggatgttaaggcacagacgcctttgttcacagctgtgtcccacgggcatctggattgcgtgcgagttttgctagaggcaggtgctagtccaggtgggtcgatttacaacaactgctcccccgttctcactgccgctcgagacggggcggtagctatcctgcaggagctcctcgatcatggcgctgaggcgaacgttaaggccaaacttccggtgtgggccagcaacatagcaagctgcagcggcccgctatacttggccgcggtatacggtcacttggactgcttccgattacatcacaattgtgagccagaatacattcagcttctgatcgatttcggagccaacatatacctgccttctttgtccctggatttaacctcccaggatgacaaagggatcgcactgctcctgcaggctcgcgccaccccacgcagcttactctcccaggtccggttagttgtgagacgggcgttgtgtcaggccgggcagccgcaagctatcaatcagctcgatatcccacctatgctgattagctatctgaaacaccagctgtag

SEQ ID NO: 26644 - DNA, 957 bp, Artificial Sequence
  Description of Artificial Sequence: Synthetic coding sequence
atgcgcattgtgctccagttggccaagatgaacctgatggacatcaccaaaatttttagcttacttcagcctgataaggaagaggaggacacagataccgaggagaaacaggccctcaatcaagcggtgtacgacaatgacagttatacattggaccaactgctccgccaggaaagatacaaaaggttcatcaattctagatccggatggggtgttcccgggactcctctccgccttgccgccagctacggtcacttgagctgtctccaggtgctcttagcacacggggctgatgtggatagtcttgacgtgaaagcacagactcctctattcacagccgtgtctcatgggcacctcgactgtgtgcgggtccttctagaggccggagcatctcccggcggatctatctacaataactgttctcccgtgctcacagctgcgcgggatggcgctgtcgccattctgcaggaactcctggaccatggcgcggaggcgaatgtaaaagccaagctacccgtgtgggcttccaatatcgccagctgttccggaccattatacttagcagcagtgtacgggcacctcgattgctttaggctgctgttactccacggcgcggaccctgactacaactgtacggatcaaggtctgctcgctagggtccccagacccagaaccctgctggaaatctgccttcaccataactgcgaaccagagtatatccaactgttaatcgattttggagctaacatatacctgccgtcactgtccctggatcttactagtcaagacgataagggaattgctcttttgctccaagcgcgggccactccaaggtcgttgctgtcccaagttagattggtagtgaggcgcgcactttgccaagccggacagccccaggcgataaatcaactagacatacccccaatgttgataagctatctgaagcaccagctttag

SEQ ID NO: 26645 - DNA, 930 bp, Artificial Sequence
  Description of Artificial Sequence: Synthetic coding sequence
atgaacttaatggacatcacaaagatcttttccctgctccagccagacaaggaggaggaagacactgacacagaagagaagcaggctttgaatcaagccgtgtatgacaacgatagctacacgctagaccagctgttgcgacaagagaggtacaagcggtttataaactcaaggagtggatggggcgtccctggcaccccactgcggctcgccgctagctacgggcacctgagctgcctgcaggtgctcctggctcacggcgcagacgttgatagcttggatgtcaaggctcagacccctctgtttacagcggtcagtcacgggcacttggactgtgtgcgagtccttctggaggcgggggccagcccgggcggctctatttacaacaactgcagtcctgtgttaactgcggcacgcgacggggcagtcgccattctccaggagttgttagatcacggtgcagaggctaacgtcaaagccaaactacccgtatgggcaagcaatatcgcttcctgttccggccctctgtacttggcagcagtgtacggtcacctggattgttttcgattgctgttgttgcatggtgcagacccagactataactgcacagaccagggacttctggctagggtccctcgacctagaacactcctcgagatctgcttgcaccataattgcgagccagagtatattcagttgctaatcgactttggagcaaatatctatctcccatctctctcactggacctgacctcacaggatgacaaaggcatcgctctgctgctccaggccagggcgaccccgagatcccttctgagccaggtgcggttggtggttcgtcgggctttgtgccaggctggacaacctcaggccatcaatcaattagacatccccccaatgctgatttcctacttaaagcaccagctttag

SEQ ID NO: 26646 - DNA, 1764 bp, Artificial Sequence
  Description of Artificial Sequence: Synthetic coding sequence
atggataattatacaagcgacgaagacattgatgaggatttcgacacccagcttataattcagcaaagcctccaggacatctataagcccggcacggcccagcacgcacccaaggacgaaagtcttcactcgtttctgtccgcggactataagaaaattgtggaaactatcgaaaaagtgggaaaagaagacgccctaagccatctcaccaaatatcattcagccttcggcgaggctgatgagatcggctggattcctttacacaaagctgcagtgcagctgaaccgaaaaatccttgagattacgctaagcgccagcgatccatcattgtgggagcagacaacacataacggtgaaacacccctcttcctagctgtttctagctgtcttctcgaaaatgccacatttctgctgctcaatgggtgtaatcccaatgcaaagaatttcgagggaaactcaccgctgctggcagccgtcctccgcgactgttacgatatggcagcgctccttataaattacggagccgatgtgaatctccggtgtgctaacgagagaactgcactgcacgaagctgctaaactagggcgcgaagatatggtcaaactgatgctggtaagcggggctcaccccgatccccagtctacatacggttttacgcccctggcattggccgcgcaatcagggcatactgaaatcatggagatgctcctgcggaaagggaagattttctgcctcgccagcgacagtagctctattctcctcgaagcggcctccggaggcaacccggatgccgtggctctgctactagagtatggggccgatgccaacatcccaaagaattctggccatctccccatccacgtggccgccgaccgtggacaccttctagccctcaagattctaatcccagtgactgaccttgccgctatcaagcagtctggcatttccccagtccactgtgccgccgctggcgcacatccacagtgtcttgagcttctgattcaggcgggcttcgatgtgaacttcatgctcgaccagaggatcaacaagcactacgacgatcatcgaaagagcgccctgtacttcgcagtttctaactccgatctgagctccgtcaagctgctgctgtccgctggagccctgcccaatcaggaccccgtcaactgtctccagattgcactaaggatgggcaactacgaactcatttcacttcttctccgccacggagccaatgtcaactacttctgccgggttaacccgctccactttccctcagccctccaatacaccctgaaagacgaggtgatgctccggatgctgctgaattacggttatgacacggaacgctgcttcgattgtccacacggagataaggttcaccccagctatacagtggaaggatggacctccactgtcattaaagacactaagttttgcgaagtgattacactgagctggctgcagcacttgtccggcaaagtggtcagggtgatgcttgactacgtggatcaagtgagaatttgtagcaagctaaaggcagtgctgcagaagcaggggatctggtccgaaatccattttattctcactaacccaaggagcctgaaacacctttgtcggcttaagatccggaagtgtatgggccggctgcatcttcggtgccctgtctttatgtcatttctgcccctgccaaatagattaaaggcttatgtattgtacaaagaatatgacctttacggccaggggatcttcacaggcacatggtag

SEQ ID NO: 26647 - DNA, 1272 bp, Artificial Sequence
  Description of Artificial Sequence: Synthetic coding sequence
atggcagctctgctcatcaattatggcgcggatgtcaacctgagatgtgccaatgaaagaaccgcactgcatgaagcagcaaagctgggccgcgaggacatggttaaactaatgcttgtgtctggtgcccatcccgacccccagagcacatacggcttcacacctctcgccctcgccgcacagtctggacatactgagataatggaaatgctactgcgaaagggagccaacgcccacggacaagcttccgatagctcaagtatccttttagaggcagccagcggagggaatcccgacgccgtggctctattgcttgagtatggcgccgatgcaaacattcctaagaattcaggccatctgcctattcatgtcgccgctgataggggtcatctgcttgctcttaagatcctgattccggtgacagacttggctgcgattaagcagagcgggatatctcctgtgcactgcgcggcagcgggtgcccatcctcagtgcctagaactgttgatccaggcaggcttcgacgtaaacttcatgctggatcaaagaataaacaaacactacgacgatcataggaaatcagcgctctacttcgcggtctcgaattccgacctgagtagtgtgaagttactgctctcggctggcgccctgcctaaccaagacccagttaactgcctgcagatcgctctgcggatgggtaactacgaactcatttctttgctgctccgccatggggctaatgttaactatttttgtagagtcaatcctctgcacttcccatccgccctccaatacaccctcaaagatgaagtgatgttgcgtatgctattgaattacggatacgatactgaacgctgcttcgattgcccgcatggcgataaagtccacccgagctatacagtggagggatggacctctacagtcatcaaagacaccaaattctgcgaagttatcactttgtcttggctgcagcacctgagcggcaaagttgtgcgtgtgatgctggattatgttgatcaggtgcgcatttgtagcaagctcaaagccgtcctgcagaaacaaggtatctggtcggagatacactttattctcacgaacccaagaagcttaaagcacctttgccggctcaaaatccggaagtgtatgggtcggcttcacctgcggtgccctgtattcatgtcctttctgccgctccccaacaggctcaaagcttacgtcctgtacaaagaatacgacctttacggccaagggatattcactgggacctggtag

SEQ ID NO: 26648 - DNA, 1764 bp, Artificial Sequence
  Description of Artificial Sequence: Synthetic coding sequence
atggataattacacctctgatgaagacattgacgaggatttcgacacacaactgattatacagcagtctctgcaggacatctacaagccggggacagcccagcatgctcccaaagacgagagtcttcattcttttctctcagcagactataaaaagatagtagagaccattgaaaagggcaaggaagacgcactcagccacttgaccaaataccacagtgcatttggtgaagctgacgagataggttggatcccacttcacaaggccgctgtgcagctgaatcgaaagatcctggaaatcacactaagtgcttccgatcctagcctctgggagcaaactactcacaacggggaaacgccactattccttgccgtgtcaagctgcctcttggaaaatgcaacgtttctcctgctgaacgggtgtaatcctaatgctaaaaactttgaagggaactctcccctactggccgctgtgctgagggactgctatgacatggcagctctgctgattaactacggggccgatgtcaacctgagatgcgccaatgagcgcacagcgctgcatgaagctgctaagctgggcagagaggatatggttaaactgatgctggtgtccggggcacatcccgacccacagtcaacatatggattcacacccctcgcgttggcagcacagagcggccacactgagataatggagatgctgctgcggaaaggggccaacgctcacggtcaggctagcgattctagctccatcctgcttgaggcagcctctggtggcaatcccgatgccgtggctctcctgttagaatacggagccgatgcaaatatacccaaaaattccgggcacctgccaattcacgtcgccgctgatcgcgggcatttactagccctgaaaattctgatacccgtgacagaccttgccgcgatcaaacaatcagggatctcccctgttcattgtgcggccgcaggcgcccacccacaatgcctcgagctattgattcaagccgggttcgacgtgaactttatgctggatcagcggatcaataaacactatgatgatcaccggaaaagcgctttgtatttcgcagtgagtaatagtgacctgtcttcagtgaagctcctactatccgctggggcattgccaaaccaagatccagtcaattgcctccaaattgcactacgcatgggaaactatgaattgatatcactgctcttacgacatggggccaacgtcaactatttctgccgtgtgaacccgctccactttccttccgctctgcagtacacgctgaaggatgaagtgatgttgcgtatgcttcttaactacggctatgacaccgagagatgctttgattgtccccatggcgataaagtgcacccttcatacacagtcgaggggtggacatccactgtgatcaaggataccaagttttgtgaggtcattacacttagctggctccagcacttgtctggtaaagttgtgcgcgtaatgctggattatgtcgaccaagtcagaatttgctccaagctgaaggccgtcctgcagaaacaggggatctggagtgagatccattttattctcaccaatccccgctctcttaagcatctctgtaggctgaagatacgcaagtgcatgggccgcctgcacctgcggtgccccgttttcatgtcatttctgcccctacccaataggcttaaggcctacgttctttataaggaatatgacctctacggccagggcatcttcacagggacgtggtag

SEQ ID NO: 26649 - DNA, 1767 bp, Artificial Sequence
  Description of Artificial Sequence: Synthetic coding sequence
atggataccaacgatgaccccgacgaggatcacctgaccagctacgacattcaactgtctatccaggagtccattgaagcaagcaagacagcactatgtcccgagcggtttgtccccttatctgcccaaaataggaagcttgttgaagcgatcaaacaggggcacatccccgaactccaggaatacgttaaatacaagtatgccatggatgaggccgacgagaaggggtggttcccgctccatgaagctgtcgttcaacctattcagcagatcctggagattgtgctcgatgcatcatacaagaccctttgggagttcaagacatgcgatggggaaaccccattgacactggctgttaaggcaggactcgtggagaacgtgagaaccctattggagaaaggcgtttggcccaataccaagaatgataagggcgaaacgccgttactaatcgctgttaaaaagggatcatacgacatggtgtctacattgataaaacataatacaagcctggatcagccttgcgtcaaaaggtggagcgcaatgcatgaggccgctaagcaggggcgaaaggatatagtggctttgttattgaagcatggtggcaatgtgcacctacgtgacggattcggggtcactccactgggcgtggccgcggagtacggacactgtgacgtgttagagcacttgatccacaaaggaggtgatgtgctagccctagccgatgacggcgcctccgttctatttgaagccgccggcggaggaaatcccgactgcatctctctactgcttgaatacggtggtagcggcaacgttccaaacagagccgggcatctgcctattcacagagccgcctatgagggccattatttagctctcaagtaccttattccggtgacctcaaaaaatgccatcaggaagtccggcctgacgcccatccatagcgccgcagatggacaaaatgcacaatgcctggaactgctgattgagaatggtttcgacgtgaataccctccttgctgaccatatctcccagtcatacgatgacgagaggaagacggccctgtatttcggggtcagtaataacgacgtgcactgtaccgaggtgctactggccgccggagcggatcccaatctggacccattaaactgtctgctcgttgccgtgcgggccaacaactatgagatcgtccggctactgctctcacacggtgccaatgtgaactgctactttatgcacgttaatgataccaggttccctagtgtcatccaatacgcacttaacgatgaggtgatgctgcgcttgttattgaataacggctaccaggtggagatgtgtttcgactgcatgcacggcgacatcttcgggaactctttcgtctggtctgaaattcaggaagaggtactgccagggtggacctcctgcgtgataaaagataatccattctgcgagttcatcaccgtcccctggatgaagcaccttgtgggtcgagtcacccgcgtcttgattgactatatggattacgtgcccctgtgcgccaaactaaagagcgccctcgaagtccagcgggagtggcccgaaatcagacagatcctcgagaatccctgtagtctgaaacatctgtgccggttgaaaatccgccggctgatgggactccagaaactgtgtcagcctgcgtccgttgagaagctgccacttcctcctgccatacaaaggtacatactctttaaggaatacgacttgtacgggcaggagctgaagctgacatag

SEQ ID NO: 26650 - DNA, 1767 bp, Artificial Sequence
  Description of Artificial Sequence: Synthetic coding sequence
atggacactaacgacgacccggatgaggaccacctaacttcatacgacattcagctgagtattcaggaaagtatcgaggcaagcaagaccgctctttgccctgagagatttgtgccattgagtgcgcaaaaccgaaaactggtcgaagctatcaagcagggccacatccccgagctgcaagaatacgtgaagtataaatatgcaatggatgaggccgatgaaaagggatggtttccactgcatgaggctgttgtgcaacccatacagcagatcttagagatcgtgctagatgcttcctacaagactttgtgggagttcaaaacttgcgatggggaaacacctctcacattggccgtaaaggcaggtctggtggagaatgttcgaacactgctggaaaagggtgtgtggcctaatacaaaaaacgataagggtgaaacccccctcctaatcgctgtaaagaaaggttcttacgatatggtatccaccctgatcaagcacaatacgtctctggaccagccctgtgttaagcgttggtctgccatgcacgaggctgctaagcagggccggaaggatatcgtcgctctgctgctgaagcacgggggcaacgtacacttgagagatggattcggagtgaccccgttgggagttgccgctgagtatggccattgtgacgtgctcgagcacctcattcacaagggcggcgatgtcctagcccttgctgatgatggggcctccgtgctttttgaggctgcagggggaggcaacccagactgtatctcgctacttctcgagtacgggggcagtggaaatgtgcccaacagggccgggcatctgcctatccatagggctgcctatgaaggccactatctagccctgaagtatttgatccccgttacctcaaagaacgccattcgaaaaagtggacttacccccattcatagtgcggcagacggccaaaatgctcagtgtctggagctgctgatcgagaacggctttgatgtcaacactctgcttgccgaccacatttcacagagctatgatgacgagcggaaaacggcactgtacttcggcgtgagcaacaacgatgtgcactgcaccgaagtccttttggccgctggagccgaccccaacctggacccactgaattgtctgcttgtggctgtgagagctaacaattacgaaattgtgcggcttttactatcacacggtgctaacgtcaactgttattttatgcacgtaaacgacacgcggtttccctctgtcattcagtatgcactgaacgatgaagtcatgctcaggctccttttgaataacggctaccaggtggagatgtgttttgactgtatgcatggtgatatctttggtaactccttcgtctggtcggagatccaggaggaggttctccctggatggacctcttgcgtcattaaagataatcctttctgcgaatttatcaccgtaccctggatgaaacatctggtgggccgtgtgacacgcgtgctgattgactacatggattatgtcccactgtgtgctaaactgaagtccgccctggaggtgcagcgggagtggcccgagatccggcaaattttggagaacccatgtagtctcaagcacctatgcagactgaaaataagacgactgatgggattacagaagctgtgtcaacccgcctccgtcgagaagttaccactacctcccgcgatccagagatacattctgttcaaggagtacgatctttatgggcaggaactgaagctgacctag

SEQ ID NO: 26651 - DNA, 294 bp, Artificial Sequence
  Description of Artificial Sequence: Synthetic coding sequence
atggacacaaacgacgatcccgacgaggatcacttgacctcctatgacattcagctgagtattcaggaatccatcgaggcctccaagacggcgttatgtcccgaaaggttcgtccctctgtccgcccagaatcgaaagctcgtggaggccatcaaacagggccacattcctgagctccaggagtacgtgaagtacaagtatgccatggatgaagctgatgagaagggttggttcccgctccacgaagccgtggtgcagccgatccagcaaattctcgagatcgtgcttgactag

SEQ ID NO: 26652 - DNA, 726 bp, Artificial Sequence
  Description of Artificial Sequence: Synthetic coding sequence
atggacacgaatgacgacccggacgaagatcacctgaccagttatgacattcagctgtctatccaggaatccatcgaggctagcaagacagcactttgtccagaaaggttcgttcctttaagcgcccagaatcgaaagctggtcgaagccatcaaacagggccatatcccagaactccaggaatatgtaaagtataaatatgcaatggacgaggcagacgagaagggatggtttcctttacatgaagctgtcgtgcagccaattcagcagattctcgaaatcgtcctggacgcctcgtataaaaccctgtgggagttcaaaacctgtgacggggaaacacctttgaccctggctgttaaagctggcctggtggaaaatgtccgaaccctcttggaaaaaggcgtctggccaaatacaaagaatgacaagggggagacacctctgcttatcgcggtcaagaaggggtcctatgatatggtgagtacccttatcaagcataacacatctttagaccagccttgcgtgaagcggtggtctgctatgcacgaggcagcgaagcagggtaggaaagacatcgtggccctgctccttaaacacggcggcaacgtgcaccttcgcgatgggttcggggtcaccccgctcggtgttgccgccgaatacggacactgcgacgtacttgaacatttgattcacaaggggggcgatgtgctggctctggctgactag

SEQ ID NO: 26653 - DNA, 1767 bp, Artificial Sequence
  Description of Artificial Sequence: Synthetic coding sequence
atggatactaatgacgatccagacgaggatcaccttaccagctacgacatccagctctctatccaggagtcaatcgaagcaagcaagaccgcactgtgtcccgaacgatttgttcccctgtcagcacagaacagaaagctagtggaagctatcaaacaggggcacatcccggagctgcaggaatatgtcaagtacaagtacgccatggatgaggcggacgagaaggggtggtttcccctgcacgaagccgtcgtgcagccaattcagcagattctggaaatcgtattggacgcctcatacaaaaccttgtgggagttcaagacatgcgatggggaaaccccattaacacttgcggtgaaggccgggctcgtggagaatgtgcggacactgctggaaaagggcgtctggcccaataccaagaatgacaagggagaaacacctctgcttatcgccgttaaaaagggctcctacgatatggtgtccacactgattaagcataataccagtctcgaccaaccatgtgtaaagcgttggtcagccatgcacgaagcagcgaaacaaggtagaaaggacatcgtcgccctgcttctgaagcacggggggaacgtccatttgcgagacggcttcggtgtgacgcctttaggtgtcgctgcagagtacggccactgcgatgttctggaacatttgatacataaggggggggacgtgctcgcccttgccgatgatggcgcatcagttcttttcgaagcagctgggggagggaatcccgattgcatctcacttctgctggagtacggcggctccggtaacgtgcccaatagagctggccacctgccgattcaccgcgccgcttacgagggacactatctggccctgaagtatctgatacccgtgacgagtaaaaacgcaattcgcaaatccgggctaacgccaatccactctgccgccgacgggcagaacgctcagtgcctcgagctgctgatagaaaatggctttgacgtaaacactttgcttgccgatcatatttcgcagagctatgatgatgagcggaagacagctttgtacttcggcgtaagcaacaacgacgtccattgcacggaggtcctcctagctgcaggggccgacccaaacctcgacccattgaactgcctcctggtagccgtcagagccaacaattacgagatcgtgcgactcctgctttctcatggggctaatgtcaattgttactttatgcacgtgaacgatacacgattcccttctgtcattcagtatgccttgaacgatgaagttatgctaagactgttactcaacaatggttatcaggtggagatgtgttttgactgtatgcacggagatatttttggaaattccttcgtgtggtccgagatacaagaagaagtgcttcctggatggacctcatgtgtaatcaaggacaatccattttgtgagtttatcacggttccctggatgaagcacctggtgggccgggtgaccagagtgctaatagactacatggactacgtgcctctgtgcgccaagctcaagtcagcactggaagtccagagagagtggcctgagatcaggcagatcctagagaacccctgctctttgaaacacctgtgcagactcaagattagacgcttgatgggtctacagaagctctgccagcctgcgtcagtggagaaactgccactgcctccggccattcagcggtatatcctgtttaaagagtatgatctgtatgggcaggagttaaagttgacatag

SEQ ID NO: 26654 - DNA, 1767 bp, Artificial Sequence
  Description of Artificial Sequence: Synthetic coding sequence
atggatacgaacgatgatccggatgaggatcaccttacctcatacgacattcagttgtctatccaagagtccattgaggcctctaagaccgctctgtgccctgagcggttcgtccctctctctgcacagaaccgcaagctagtggaggctatcaagcaggggcatattcccgagttgcaggaatatgttaagtataaatatgccatggacgaggccgatgagaagggatggtttccgctgcatgaggccgtggttcagccaatccagcagattctggaaatcgttcttgatgcaagttacaaaactctgtgggaattcaagacctgcgatggtgagaccccactgaccctggccgtaaaagcgggtctggtggaaaacgtgcgcaccctgctggaaaaaggcgtctggccaaatacgaagaatgacaagggggagacacctctactgatagcggtgaaaaaaggttcatacgacatggtaagcacgctaattaagcataatacaagcctcgatcaaccctgcgtcaagcgctggtctgccatgcatgaagcagcaaaacagggcagaaaagacattgtagcactgcttttaaaacacggaggaaatgtgcatctgcgcgatggttttggcgtgacccccctcggggtggcggccgagtatggacactgcgacgtgcttgaacacctgattcacaaagggggtgatgttctagctctggcggacgacggagcatcggtgctttttgaggctgcaggggggggtaacccggattgtattagcctcctcttagaatatggcggaagtgggaatgtgcctaaccgggcgggacatctgcccatccatcgggcagcatatgaaggtcattatcttgcactgaaatatctaattcctgttacctcaaaaaacgccatccgcaaatcagggcttactccaatacattccgcagcggatggacagaatgcccagtgtctggaactgctgatcgaaaatgggtttgacgtcaacacccttctggccgatcacatcagccagtcctatgacgacgaacgtaagacggcattatatttcggagtcagcaacaacgatgtgcactgtaccgaggttctgctcgctgccggtgcagaccccaacctagacccactaaattgcttactcgtcgccgtgcgagcaaacaattacgagatcgtgaggctgcttctttcccacggtgccaatgtgaattgctactttatgcacgtgaacgacaccagattcccttcagtcatccagtacgctcttaacgacgaggttatgttgaggctgttattgaacaacggttaccaggttgagatgtgcttcgactgtatgcatggcgatatttttgggaactccttcgtttggtcagagattcaagaggaggtcctcccgggctggaccagttgcgtcataaaagataatcctttctgcgaattcatcactgtgccatggatgaagcatctcgtgggcagggtgacaagggtgctaatcgattatatggactatgtgcccctctgtgccaaattaaagtccgctctggaagtccagcgggagtggcctgagattcggcagattcttgagaatccgtgtagcctgaaacacctttgcagacttaagatccggcgcctcatgggactgcagaagctgtgccagccggcatctgtggagaagctgccgctcccacctgccatacaacgatatatccttttcaaagagtacgatttgtatgggcaggagctgaagctgacttag

SEQ ID NO: 26655 - DNA, 1767 bp, Artificial Sequence
  Description of Artificial Sequence: Synthetic coding sequence
atggacaccaacgacgacccagatgaagatcatctgacctcttacgacatccagctcagcatccaggaatccatcgaggcatcaaaaacggccctgtgtcctgaacgattcgtgcccttgtccgctcaaaatcgcaaactggttgaggcgatcaaacaaggacacattcctgaactccaagaatacgttaagtataagtacgccatggacgaagcggatgagaaaggctggttccctctccatgaggccgtcgtgcagcctatccaacagattctagagattgtgctcgatgcatcctacaaaactctgtgggaatttaagacatgcgatggagaaactcccttaacattggcagtcaaagctggcctagttgaaaacgtccgaacattactcgagaaaggagtatggcctaatacaaaaaatgacaaaggcgagaccccgctgcttatagctgtgaaaaagggatcttatgatatggtgtcaaccctcattaagcacaatacctcacttgaccaaccgtgtgtcaagaggtggtctgctatgcacgaggcggccaaacagggcagaaaggatatcgtcgcactccttctcaagcatgggggcaacgtgcacctgagagatggcttcggggtgacacctctaggcgtcgccgccgagtacggtcactgtgacgtgctggagcacctaatccacaagggaggcgacgtgctggcgcttgccgatgacggtgctagtgtgttatttgaagctgcggggggggggaatccagattgtatcagcttattactcgagtatggaggttccggcaatgtgccgaacagggccgggcacttgccaattcatagagctgcatacgaaggccactatctggctctgaaatacctgattccagttacctctaagaacgctatccgtaagagtgggctgactcctatacacagtgcagctgacgggcaaaacgctcaatgcctcgagttgctcattgagaatgggttcgacgtgaatacgttgctggcggatcatatatcccagtcttacgatgacgagcgaaagaccgctctctatttcggcgtgagcaacaatgatgtgcattgcacagaagtcctgctggcggccggagcagacccaaacctggaccctctgaattgcctgctcgtggcggtgagggctaataactacgagatcgttcgccttctgctaagtcacggtgcaaacgtcaactgctattttatgcacgttaatgatacccgattcccctctgtcattcagtacgcgctgaatgatgaagtgatgctacgtctgctgctgaataacgggtatcaggtagagatgtgttttgactgcatgcacggggacatcttcggcaacagcttcgtctggagcgaaattcaagaggaagttttgccgggctggacttcatgtgtcatcaaagataatcctttttgcgagttcattactgttccttggatgaaacatctagtcggtcgcgtgacaagggttctgatcgactacatggactatgtccctctgtgtgcgaagttaaaatctgcactggaggtccagcgagaatggccagagatacgccagatcttagaaaatccctgctcactcaaacatctgtgccgcctgaaaattcgacggctaatggggctacagaaactgtgccaacccgcctccgtcgagaagctgcctctcccaccagctatccagcgctatatcctattcaaggagtacgatctttacgggcaggagctcaagttgacctag

SEQ ID NO: 26656 - DNA, 750 bp, Artificial Sequence
  Description of Artificial Sequence: Synthetic coding sequence
atgaaacagccatcaaaggccgaatatggacactgtgatgtgctggagcacctgattcacaagggaggagacgtgctcgccctggctgacgatggggcctccgtcctcttcgaggccgctggcgggggcaaccccgactgtatatctctgctcctcgaatatggtggttccgggaacgttcctaacagagcaggccatctcccgatccatagagcagcctatgaggggcactacctggccctcaaatacctgatccctgtgacatctaaaaatgccatccgtaagagtgggttgaccccaatccattcagccgcagatggccagaatgctcagtgtctggaactgctgatcgagaacggcttcgacgttaacacccttctggccgaccatatttcccagagctacgacgatgagcggaagaccgctctgtattttggcgtatccaacaacgacgtgcactgcacagaggttttactggccgccggggctgatcccaatctggatccacttaactgtctgctggtggctgtgcgagccaacaattatgaaattgtgagactcctcctgtctcatggcgccaatgttaactgttatttcatgcatgttaatgatacccggttccctagcgtcatacagtacgctcttaatgacgaagtcatgctgcgattgttgctgaacaacggctaccaggtggagatgtgctttgattgtatgcacggtgatatctttggaaacagcttcgtgtgttag

SEQ ID NO: 26657 - DNA, 1362 bp, Artificial Sequence
  Description of Artificial Sequence: Synthetic coding sequence
atggcgcgcgagactttcccgttcacctcttccatgctgcgatccctccggctgcagcaagaatggttggagtgggaggaccgacgcagagctgccgcccagcagtgccggagtaggagatgtccatcttcccccagagcccgcctgacccggcctcaccggtcttgcagagatccagcagtgcaccaggcccttttcagcgggaacctgcagcaggtgcaggctctgtttcaagacgaagaggctgcgaatatgatcgtggaaacagtgtcgaaccagctggcctggagcgctgagcaagggttctgggtgcttactccgaagacaaaacagacagcccctctggctattgccaccgctagagggtatactgattgtgccagacacctgattaggcaaggggcggaactcgatgccagggtgggaggccgggctgcccttcacgaggcatgcgcccgcgcccaattcgattgcgtcagactcctcctgacatttggtgcaaaggcaaacgtgctgacggaagagggcaccacgcctcttcatctgtgtaccattccggagagtttgcagtgtgcaaagttactcctcgaggccggcgcaacagtgaacctagctgccggcgaaagtcaggagactccactgcacgtcgcagcagcaagggggctagagcagcatgtcgccctgtacttggagcacggggcggacgtgggcctgaggacctctcagggggagactgccctgaataccgcctgcgcgggagccgaaggtcctggttcttgtcgtaggcaccaagctgccgctagacgcctgttggaggctggcgccgacgcgcgggctgctggccgaaaacgacacacccctcttcacaatgcctgcgccaacggttgcggcggcctggccgaacttctgctcaggtatggggcaagagccgaggtcccaaacggagctggtcatactccaatggattgcgctttacaagctgttcaggactcgccaaattgggagcccgaggtacttttcgcagctctgctggattacggagcacagccagtgcggccagagatgctaaaacactgcgcaaatttcccacgcgccttagaggtgctactaaatgcctatccttgtgtgcctagctgtgagacttgggtagaggcagtgcttcctgaactgtggaaagagcacgaagcattttatagctcggccctatgcatggtgaatcagccaaggcaattgcaacacttggcccgactggccgtcagggctcgcctggggagtaggtgtagacagggagccacacgcctccccctcccacccctgctgagggactatcttctcctccgtgtagaagggtgcatccagtag

SEQ ID NO: 26658 - DNA, 888 bp, Artificial Sequence
  Description of Artificial Sequence: Synthetic coding sequence
atgtctaaatctactaagctgtgcgggaaaacttcttgtcccagatccaacatattttgtaacctgctcgataagattgtgaaaagaccctccttgcagttcctcggacagtgggggtaccattgttacgagcctcggatttaccgatctctggctaagattctcaggtatgtggacctggacggattcgatgcactgcttacagactatatcgctttcgtggaaaagagcggataccgttttgaggtgtcctttaacctcgacttcaccgagatttgcgtaaacacaatcctctattgggtgttcgctaggaagggcaaccctgactttgtagagctgctgttaaagaagacaaaggactacgtgcaggatcggagctgcaaccttgcactcatatggagaacctttactccagtctattgccctagtccactttcagggattactccgctgttttacgtcgcacagactcgacagagcaacatattcaaaatcctgctacagtacgggattctcgagagggaaaagaaccccattaacatcgtgctgaccatcgtgttatatcctagccgggtgcgcgtgatggttgatcgggaactggccgacattcacgaagacgccaaaacctgtctggttttatgcagcagagtgctctcggtcatcagtgtcaaagagattaaaacacagcttagtctaggcaggcaccctatcatctctaactggtttgattacatccctagcacgcggtacaaggatccatgtgaactgctccacctttgtaggctcacaatccgtaatcagttgttgactaacaatatgttaccagatggaatctttagtctcctgattccagcacgcctccagaattacctcaacctggagatttag

SEQ ID NO: 26659 - DNA, 1314 bp, Artificial Sequence
  Description of Artificial Sequence: Synthetic coding sequence
atggaacgccagcctggcccagtgcgaggcaagttacaaatcttccagaagacagagaaggatccacaagctagggcgggatcccctgttcaggaataccacaccgctttggtggcaggagacctggaccacttgaaaccattgatggatcagttttttcaagacgccaacgtggtttttgagatcaacaaagatgagatggagtggcaggtcaaatccccggcgacatttgggctctctggactttggacactcgaatataaaagagagcttacgacccccttgtgcattgcagctgcccacgggcataccgcatgcgtgaggcacctgctcggtcgaggcgcagaccccgacgcctcccccgggggccgcggcgctcttcacgaggcgtgtcttggggggcacactgcttgtgtgcgcttactcttgcaacacagggccgaccccgacctcctatcagccgagggtttggccccgctacacctgtgcaggaccgccgcatccctgggctgtgcccaggccttgctcgagcatggcgccagcgtgcagcgtgtgggcggaacaggcagggatacccctctccacgttgccgcgcagcggggcctggatgaacacgcgaggctttatctgggtcgtggagcccatgtcgacgccaggaacgggcggggagagacagcactgtctgccgcctgtggagccgctcgtcggccagatgagcacggaaggtgcttgaggttgtgtgcactcctgcttcggaggggggctgaagccgatgcgagggacgaggacgaacggagccccctccataaagcttgtggacatgcgtcacattctttggcccgacttctcctgagacacggtgcggacgcaggcgctctggattatggaggtgcaagccctctgggcagggtgctgcaaacggcctcgtgtgccctccaagcctccccccagagaacggtacaggccttgctcaatcatgggtctcccacggtgtggcccgacgctttccccaaggtgctcaaaacgtgcgcctccgtgccagctgtgattgaggttctcttcaactcgtaccctcagctctgcctctctgagagctggaaagaggtgattcccgaggaagtcttccagatgcacaagccattctatcagtcactattcgccctggccctgacacctagatgccttcagcatttgtgcagatgcgcacttcgccgcttgttcgggaagcgctgctttgatctcatcccactgctgcccctccccaagccactgcaaaattaccttctcctagaaccccagggggtactgcattag

SEQ ID NO: 26660 - DNA, 1401 bp, Artificial Sequence
  Description of Artificial Sequence: Synthetic coding sequence
atgtcgaacagtgattatcttccggactacccactgaactccgatttggtgaaacggctcaagtccgcgctcgacgccaaagatgaagaacgcgtcagagacctcatttgcaccgaaattacgcctgtcgacgctgtcatcgagcttgccaatgacgactggatgaaagatccaagcgcgcagctgcctacgggtatgctcttaggcgatctggaccatctaaaaccgctgatggaccagttctttcaagacgcaaacgtagtgttcgagattaacaaagacgaaatggagtggcaagttaagtccccagcgacattcggactgtcaggattgtggacacttgaatataagcgggaactgaccacccctctctgtatcgccgcagcccatggccacactgcttgcgttcggcacctgctgggtaggggcgccgacccagacgcatctcccgggggccggggcgcactgcacgaagcctgcttgggtgggcacacagcgtgcgtaagattgctgttgcagcatcgagccgatcccgacctgctgagcgctgaagggctggccccattacatttgtgccgcacagccgcttcactcgggtgtgcgcaggctctgttagaacacggggcaagtgttcagagggttggggggacggggcgtgatacaccgcttcacgttgctgcccaaagagggttggacgagcatgcacgtttgtacttgggccgaggtgctcacgtcgatgctagaaacggcaggggtgaaaccgcgctcagcgcggcttgcggagctgcaagaagaccagacgaacacggcaggtgcctgagactgtgcgcactgctgctgaggcggggagccgaggctgatgctcgcgacgaagacgaacgatctccactgcacaaagcttgcgggcacgcctcccactctcttgcgcggctcctactgcgccacggcgcggacgccggagccctggattacggaggggcctcccccctcggacgagtgctgcagacagcatcgtgcgcactacaggcaagccctcagagaactgtgcaagctctgttaaatcacggcagtccaaccgtgtggcccgatgcattccccaaggttttaaaaacttgtgctagcgtgcctgccgtcatagaagtgctgtttaactcttatccacaactttgtctgagcgagtcatggaaggaggtgatacctgaggaggtgttccagatgcataaaccattctatcagagccttttcgctctggccctcacccctaggtgcctccaacacctgtgccgctgcgcactcaggagattgttcggcaaacggtgttttgatctcattcctcttcttcccctacctaaacctctccagaattacttgctattggaacctcagggagttctacattag

SEQ ID NO: 26661 - DNA, 990 bp, Artificial Sequence
  Description of Artificial Sequence: Synthetic coding sequence
atgtcagtactggaggagaaccgcccgtttgcccagcagctcagcaacgtatactttaccatcctgtctttattttgtttcaagctgtttgtcaaaataagtctggccatcttgagccacttctatattgtcaagggcaaccgcaaagaggccgcccgcattgctgccgaattttacggtgttactcaggggcagggctcttgggcggacaggtcccctctgcacgaagctgcatcacaggggcggctcttagcccttcgtactctcctctcccagggctacaatgtgaacgccgtgaccctggatcacgttacaccactgcacgaggcgtgtttaggcgatcatgtcgcatgcgcgagaactttgctcgaggcaggggccaacgtgaatgccataaccattgatggcgttacgcccctgtttaacgcttgttcccagggctctcctagctgtgccgaactgcttctggagtacggcgccaaggcccagctcgaaagctgcttgccctcacctacgcacgaagccgctagtaagggacatcatgagtgcctggatattcttataagctggggtatcgatgtcgaccaagagattccacatctggggacccccctgtacgttgcctgtatgtcccagcagttccattgcatctggaagcttctctacgccggggccgatgttcagaaaggaaagtactgggatacccccctccatgccgccgcgcaacaatcctccaccgagatcgtgaatctgcttctggaatttggggcagacattaacgctaagaacactgagttgttgcggcctatcgatgtggcaacttcaagcagcatggtggaaagaattctattgcagcacgaagccaccccaagctcactctatcaactgtgccgtctttgcatccgaagctatatcggcaagcccaggttgcacctcattccccagctgcagctgcctacgttgttgaagaatttccttcagtatcggtag

SEQ ID NO: 26662 - DNA, 63 bp, Artificial Sequence
  Description of Artificial Sequence: Synthetic coding sequence
atgagcgtgttggaggagaatagacccttcgcccaacagctctctaatgtgtatttcacctag

SEQ ID NO: 26663 - DNA, 957 bp, Artificial Sequence
  Description of Artificial Sequence: Synthetic coding sequence
atgcttcaccaccattgccgccggaatcccgaattgcaggaagaactgcagatccaggctgccgtcgccgccggggatgtgcacaccgtgcgtaaaatgctggagcagggatactcgcctaacggaagggacgccaacggctggacattgctgcattttagtgccgcaagagggaaggagcggtgtgttagggtcttcctggagcacggcgccgatcccacagttaaggacctgattggtggtttcacagctttgcattacgccgctatgcatggacgggcgaggattgcccgactgatgttggagtcagagtaccggagcgacatcatcaacgccaaaagtaacgacgggtggactcccttacacgttgctgctcattacggcagggactcgtttgtgagattgctcttggaatttaaggccgaagtggatcctttaagtgataaaggcacaacaccgctgcaactggcgattatccgagaaagaagtagctgcgtcaaaattttactggatcataatgcaaacatcgacatccaaaacggatttctgctaaggtacgcggtcataaagtccaaccattcatactgtagaatgttcctccagagaggagctgatactaacctgggcaggctcgaggatggccagacacccctacacctcagcgcactgagagatgacgtgctctgcgcccgtatgctgtataattacggcgccgacaccaacaccaggaactatgaaggtcagactcccttggcagtctccataagcatctcgggcagcagtcgaccttgcttggatttcctgcaagaggtcacccggcagccgcgtaacctgcaagatttgtgtaggatcaaaatacggcaatgcataggcctgcagaacctcaagcttcttgatgagctccccattgctaaggtgatgaaggactacctaaaacacaagttcgacgacatctag

SEQ ID NO: 26664 - DNA, 825 bp, Artificial Sequence
  Description of Artificial Sequence: Synthetic coding sequence
atgctccatcatcattgcagacgaaatcccgaattgcaggaggaactgcaaattcaggccgccgtggctgcgggagacgtgcacaccgtgcgcaaaatgctggagcagggctatagtccgaatgggagggatgcgaatggctggacgctgctacatttctcggccgcgagaggaaaggagcgttgtgtgagggtgtttctcgagcacggagcagatcccacagtgaaggacctcatcggagggttcactgccctgcactatgccgccatgcacggccgcgcccggatcgcgcgcctgatgctcgagtccgagtatcgaagcgacatcatcaatgcaaagagcaatgacgggtggacacctttgcacgttgccgctcattatgggagagatagtttcgtgaggctccttctagagttcaaggctgaggtggatcccctgtccgacaaggggactacacctcttcaactcgcaattataagggagcgcagttcctgtgtcaaaatactactggatcacaatgcaaatatcgacatccagaatggcttcttactgaggtacgcagtgatcaagtcgaatcactcctactgtcggatgttcttgcagcggggcgccgataccaacctcggcaggctcgaggacggacagacaccattacatctcagcgcattacgagatgacgtgctgtgcgctagaatgctgtacaactacggggccgatactaacacccgcaattacgaaggacaaactccgcttgccgtgagcatctctatcagtgggagcagtaggccatgtcttgattttttacaggaggtcacctccatgtag

SEQ ID NO: 26665 - DNA, 759 bp, Artificial Sequence
  Description of Artificial Sequence: Synthetic coding sequence
atggacggaaaacagggtgggatggacggttcgaagcccgcaggcccgagggatttccccggaatcagacttctgtcaaatcctctcatgggcgatgccgtgtctgattggtccccaatgcatgaagccgctattcacggacatcagctgtctctaagaaatctgatcagtcaaggctgggccgtaaacatcatcactgcagaccatgtcagtcctcttcacgaggcatgtctggggggtcatctgtcctgtgtgaagatcctgttaaagcacggagcccaagttaacggggtgaccgctgattggcacacaccactgttcaatgcatgtgttagtgggagttgggattgtgttaatctgctgctgcagcacggtgccagtgtgcagcccgagtcagatctggcttctccgatacatgaagccgcccggcgggcctacgggggcaatatcgatcataaaatctctcacctgggtactcccctataccttgcctgcgagaaccaacagcgggcctgcgtcaaaaagttactggagtccggggctgatgtcaatcagggaaagggccaggattctccacttcatgcggttgcacgaactgcctctgaagagcttgcttgtcttctgatggactttggcgcggacacccaggcgaaaaacgcagaaggtaaaaggcccgtcgagttagtaccacccgaatcccctttagctcagctgttcctggagagggagggtgcttcccttcccaaaccaaaaccctag

SEQ ID NO: 26666 - DNA, 789 bp, Artificial Sequence
  Description of Artificial Sequence: Synthetic coding sequence
atggacgggaaacagggagggatggacggatccaagcctgcaggacctcgcgatttcccggggatccggctgctttccaacccattgatgggagacgctgtgtctgactggagtcccatgcatgaagctgcaatccacgggcaccaattgtctctccgcaacctgataagccaggggtgggctgtaaacatcatcacagctgatcatgtgtcccctctacacgaggcgtgtctgggtggccacctctcttgcgtgaagatccttcttaaacacggtgctcaggtgaacggcgtcacagccgattggcatacgcccctgttcaatgcatgcgttagtgggtcctgggattgcgtgaacttgctgttacagcacggagcgagcgtgcaaccagagagcgacttggcctctccaattcacgaggcggccagaagaggccatgttgagtgcgtcaacagcctgattgcctatggagggaatatcgaccacaaaatttcacatctgggcacacccctgtaccttgcctgcgagaaccaacagcgcgcttgcgtcaagaaattgttggagtctggcgcagatgttaaccagggcaaaggccaggactccccactgcacgctgtcgcacgtactgcgtcagaagaacttgcctgtttgctcatggatttcggcgcagatacacaagcaaagaacgccgaaggtaaacggccagttgaacttgtcccccctgagagtcccttagcacaactattcctcgaacgggaaggagcctcgctacctaaacccaagccttag

SEQ ID NO: 26667 - DNA, 885 bp, Artificial Sequence
  Description of Artificial Sequence: Synthetic coding sequence
atggatgggaagcagggcggaatggatggctctaagccagccggtccacgagactttccaggcattcgcctgctgagtaacccactgatgggagacgccgtaagtgattggagcccaatgcacgaggctgctatccatggacaccaactctctctgcgcaacttaattagccagggatgggccgtcaacatcatcacagccgaccatgtctccccccttcacgaagcatgccttggaggccatttgagctgcgtgaagatcctgctgaagcatggagcacaggttaatggggtgactgcagattggcacacccctctctttaacgcatgcgtgtctggcagctgggattgtgtgaatttgctcctgcaacacggggcatccgtccagccagagtccgatttagccagtcccatccacgaagcagctaggcgtggacacgttgaatgcgtcaatagtctcatcgcctatgggggcaacattgaccacaagatctcccatttaggtacccccttgtatcttgcctgcgagaatcaacagcgcgcttgcgtgaaaaagctgctcgaatcaggcgcagatgtgaatcagggtaaaggccaggacagcccgcttcacgccgttgcgcgcaccgcaagcgaggaactggcctgtctacttatggatttcggggcggacacccaggccaaaaacgccgagggtaagagaccagtggaacttgtaccccccgaatctccgctggctcagttgttcctggaacgcgagggaccccccagcctgatgcaactttgtagacttagaattagaaagtgctttggaatccagcagcaccataaaataactaagcttgtgctaccagaagatttaaaacagtttctcctccacctgtag

SEQ ID NO: 26668 - DNA, 789 bp, Artificial Sequence
  Description of Artificial Sequence: Synthetic coding sequence
atggatggaaagcagggaggcatggacggctctaagcctgcgggtccccgcgattttcccggaattcggttactatcgaatccactcatgggcgacgcagtgagcgattggtcacctatgcatgaagccgccattcacggacaccagctaagtttgagaaacctgattagccagggatgggccgtcaatatcatcactgcggaccatgtctccccgctgcacgaagcatgtctgggggggcatttgagctgcgtaaagatcttgttgaagcatggcgcacaagtgaatggagtgacagccgattggcacacccctctgttcaacgcctgtgtctctggaagttgggactgtgtgaacttgcttctgcaacacggcgcatcagtgcagcccgagagcgatttggcaagtcctattcatgaggctgcacgtaggggccacgtggagtgcgtgaactccctgatcgcttacggcgggaacattgaccataagatttctcacctggggaccccgctgtacttagcttgcgagaaccagcagagagcttgcgtcaagaagctactcgagtccggcgctgatgtgaaccagggtaaaggacaggatagccctctgcatgctgtggctaggacggccagcgaggagctcgcctgtcttttgatggattttggcgccgatacacaggcaaagaatgctgaggggaagcgccctgtggagcttgttcccccagaaagcccactcgcccagctgttccttgagagagagggagcatcacttcctaagcccaagccctag

SEQ ID NO: 26669 - DNA, 1971 bp, Artificial Sequence
  Description of Artificial Sequence: Synthetic coding sequence
atgagcgaactctcagatgaggcctctgaacccgagctccttaatcgcagcttgtctatgtggcacggtctgggaacgcaagtcagcggtgaggagctcgatgtcccactggatcttcacactgctgcttccattgggcagtacgaggttgttaaagagtgcgtgcagaggcgggagttggatctgaataagaagaatggtggaggctggacccctctgatgtatgcctcttacatcggccatgacaccattgtccacctcctgcttgaggcaggcgtgagcgtaaatgtgcccacccccgagggtcaaacacccctgatgctagcaagttcctgtggcaatgaaagcatcgcatactttctgttgcaacagggcgcagaactggagatgaaagatatccagggctggacggcactctttcactgcacaagtgctggacaccaacacatggttcgcttcctgttggacagtggagctaatgctaatgtccgcgaacctatctgcggattcacaccgctcatggaggccgccgccgccgggcacgagataatcgtacaatatttcctcaatcacggagtgaaggtagacgcccgggaccattcgggggccactgcaaggatgctggctaagcaatatggtcatatgaagatcgtggccttgatggacacgtacagcccttcactgcccaaatcactttacagatccccagagaagtacgaagatctctcttcctccgacgaatcctgtcccgcgccgcaacgccagaggccctgtcgcaaaaagggcgtgtccattcacgagggcccaagagccctggccagaattactggcatcggactgggcggcagagccccccgaccccggtacgagcaggcaccaccacgtggttacgtgacctttaattcttcaggtgagaatcctctagaagaggaagggctgtgctgccgtgacgtgacttcccccatcaatgaacgagatgtggagtcgtcatccagctcttcctcccgggaggaacatgctttctgtgcgaacctgggtcctgtgcaatcctcgagcagctcagagggtctggccagagctcagggcctttcatcagaggctagcgtagagtccaatgaagattcagaccacgcgtgcaaatccagtgcccgtaaacaagccaaatcctatatgaagacaaaaaatccggactcccagtggccaccacgcgcagccacggatcgagaggggttcttagccgaatcttcacctcagacacaacgcgccccatattccggcccacaggacctcgccgccctgcttgagcagatcggatgtcttaaatacctccaggtcttcgaagagcaggacgtcgacctgaggatattcctcacgctgaccgaatctgatctgaaagagatcggtatcaccttgttcggcccgaaacggaagatgaccagcgcgattgccaggtggcactccagcgcacgacctcctggggatgccctcgagcttgcctatgccgatagactcgaagcggagatgcaagagttagccattcagctgcataagcgctgtgaggaggtagaagcaactcgcggccaagtgtgccaagaacaggaattgcgggcagtagtggagtcctgtctgctggaacaggatcgcgcacgggaggacttgcaagcacggctgagggagacgtgggctctcgccagagatgctgccctcgtgttagaccaactgcgtgcatgccaggccgagctgtcaagccgggtcagacaggatcagccccccggggcagctaccttggggctagctgtccctccagccgattctaagggatggcaagcctcactgcaagccatgagcctccctgaactctctggagccttggaggatagagtccgagagatgggtcaagctttgtgcttagttacccagtcgctggaaaagttacaggtgcttaatggaaagaagtggagggaaacttag

SEQ ID NO: 26670 - DNA, 1584 bp, Artificial Sequence
  Description of Artificial Sequence: Synthetic coding sequence
atgaaggacatccaaggatggaccgcactctttcactgcacttctgccggtcatcagcatatggttaggtttttgctcgactctggcgcaaatgcaaatgttagggagcctatctgcgggtttacacctctgatggaagccgcggccgcagggcacgagatcatcgtccagtattttctgaaccatggggtcaaggtcgatgctcgggaccactctggcgcaaccgctcgaatgcttgctaaacaatacggtcatatgaagattgtggccctgatggatacttactcccccagcttgcctaagtctctttatcgcagccctgagaagtatgaggatctcagctcttctgacgaatcctgtcccgccccacaaaggcagaggccatgccgtaaaaaaggggtctctatccacgagggaccccgggcgctggcccggataacaggaattgggctgggggggagagcaccaagaccgcgctacgagcaggcacctcctcgcggatatgtgacgtttaacagtagtggcgaaaatccacttgaggaagagggcttatgctgtcgagatgtcacgtcgccaattaatgagagagatgtggagtcttctagcagttcatcatcaagggaggagcacgctttctgtgctaacctcggtcccgtacaatctagttcctcctcggaagggcttgctagggcccaggggctgtcctccgaggcctcagtggaatctaatgaggactctgaccacgcttgcaagtcttctgctcggaagcaggctaagagctatatgaagacaaaaaaccctgattcacagtggcccccccgggcagccaccgatagggagggattcctcgccgagagttccccccagacccagcgcgcaccctattccggcccgcaggacctggcagcacttttagagcagatcggctgcttgaagtatctgcaggtcttcgaggagcaagacgtggatctgcggatcttcctgacgctgactgagtccgatctgaaagaaattgggattacactctttggacccaaacgtaaaatgacctcggccatcgcaagatggcattcgtcagccagaccaccaggggatgcactagaactggcctacgcagatcgcctcgaggccgagatgcaggagcttgctatacaactgcacaaacgatgcgaggaggtagaggctaccaggggccaggtgtgccaggaacaggagcttcgggctgttgtggaatcctgcctgctggagcaggatagggctagagaggatcttcaagctcgactgcgagagacctgggcgttagctcgagacgcagcgctcgttttagaccagcttcgggcatgtcaggcagagctgagctcccgagtgcgccaggatcagccgcccggcgcggctacgctcggcctggccgtgcctcccgccgattctaagggctggcaggccagcctccaagccatgagtctgccggagttgagtggcgcactggaagatagagtccgggagatggggcaagccctctgcctcgtcacccagtcactggaaaagcttcaagtactaaatggaaaaaagtggcgtgaaacctag

SEQ ID NO: 26671 - DNA, 921 bp, Artificial Sequence
  Description of Artificial Sequence: Synthetic coding sequence
atgctggccaaacaatacgggcatatgaaaatcgtggccctcatggacacttattctccgtctttgccaaaaagcctgtaccggagtcctgagaagtacgaagacttgagcagcagcgacgaaagctgtccggccccccaacgccagcgcccttgccggaagaagggggtgtctattcacgaagggccacgcgcacttgctagaataacgggcataggtttgggcggccgagctcctaggccacggtacgagcaggccccccccagaggctatgtgacattcaactcttctggcgaaaaccccctagaagaggagggactatgttgtagggatgtgactagtccgattaatgaacgcgacgtcgagtcatcgagtagttcctcatcccgggaggagcacgccttctgtgccaacctagggcccgtccagagttcttcatcctctgaaggtctggcacgggcccagggactgagcagcgaggcatcagtggaatccaacgaagattcagaccatgcctgcaaaagctctgcgagaaagcaagcaaagtcgtacatgaaaaccaaaaatcctgacagtcagtggcccccacgagctgccaccgacagggaggggttcttagctgagagcagcccccagacccagagggcaccatactcaggaccgcaggtgagacccctggtaaagctagaagtaaccctgcgagatggaacattctgcgacctcggcggtatgtgctgtgtgtatgatgtccctggggcagctaggcgcactgagtggagatggcacccacacgggttgctgggctctactggcagccagcctgcgccttggcttgcagcgccactgcaaagattctatagtgtgccgctgcatggcaaagatctgtcaccttgctttccttattggtcatggcccccgtag

SEQ ID NO: 26672 - DNA, 1275 bp, Artificial Sequence
  Description of Artificial Sequence: Synthetic coding sequence
atgcgcattttcatcgcattcgaagggagcttcgaaccattcgacgtgtcagctgatgagaccgtcgaagttgtcaagcttatgataaaggactactttcacatcccattgtctgaagataagcaaggtcggaggtaccttgagctgatgtacgctggggcggcgctgaaagacagctggagcctggcggacgttggtatttcattctgcagtactctgaagtgcttcgtcaaggaggaggacaagcctaccctctatgttttcaatgcagtgacccaggatactatgccagtgatggaaagtattagcctcttggacaaaaccgtatccgacctgcggaccttagtcacgttacgctgcggccttccagtgagcgtatattgcttacgcactccccgcgggcttgaaatgtacgattgtaatacactaaaggactatcaaaccgacatcggaacaacactcagattagacgtgtgggacggttggaaagagttcctaatgggctgcctgctcgggcaaaaactcaaagtgcagcgctacctctcgaaagaaggccccgtgcttaagtaccagaagagagtggctctctacatagcagcattttgcgggtatattgaactgacggaatgggcactcaagcagggagcacggccacacgaggctgttggtgtgcatccctacagagcttggtgtcacgaggccttgcacgccgacgtcagtaaatgtccgattcacgctgcagcagaagcgggacagctcctaattcttaaagctttcgtgaactactccgtcttgtgcctggagtgcaaaaacgccgccggtcaaacccctctgactattgtcttcaagcataagcataaagactgcgtgctgtacctgctctctaaaatgtggagtactgttagttttcccaagataagcgttccaatgagaatctacatcaagatcaaacagtggatcttgcgggcccagtcacacagcctgcacaaatcccagttctgcggcgctcgcgtgtttggcgctaaggtcggtgacactgtcatggtggatggttttacaaagcctaaaatgacctcaaaatcatggcacaaagccgggaactcagacagtcagtcgattgtactgaaattgccgtctctcagtaaacagacagcatcttcgaagccagtgaaccccctggccatttcccagcctgacactagaaagcaagctctgaagtttcacccgttaaagggcgagagcccaaaggccgataagtcttcaggtattatgtag

SEQ ID NO: 26673 - DNA, 1635 bp, Artificial Sequence
  Description of Artificial Sequence: Synthetic coding sequence
atgagaatctttattgcattcgaaggatccttcgaacctttcgatgtgagcgcggacgagactgtggaggtggtgaaactgatgataaaagactactttcacatcccattgagtgaggacaaacagggcagacgatacctggaattgatgtacgcgggagccgccctgaaagattcctggagtttagccgacgttggcatttctttctgttccaccctcaaatgcttcgtgaaggaagaggacaagcccaccctctatgtgttcaacgccgtaacccaggacacgatgccggtcatggaaagtatctcattgctggataagactgtcagtgatctgcgtacgttggtgacacttcggtgcggactgcccgtgtccgtatactgtctgaggacacctcgtggtttggagatgtatgattgcaatacactgaaagactatcagaccgatatcggcactacactgaggctggatgtctgggatggctggaaggaatttctgatgggttgcctcttggggcagaagctgaaagttcaacggtacctttcaaaggaaggtcccgtcctcaagtatcaaaaaagggtggctctctatatcgcagcattctgcggctacattgagctgacagagtgggcacttaagcagggagcccgcccacacgaagctgtgggtgtccatccttatcgggcctggtgtcacgaggcactgcatgcggatgtgagcaaatgtccaattcacgctgccgccgaagcgggccaacttctgattctgaaggcattcgtgaactactcagtcctctgtcttgagtgcaagaacgccgcgggacagacaccattgaccatcgtgtttaaacacaagcacaaagattgcgtgctgtacctgctgtcaaagatgtggagtactgttagcttccccaagatttcggtgccaatgcgcatttacatcaagatcaagcagtggatcttgagggcacaatctcactccctacacaagtcccaattctgcggagccagggtgttcggtgctaaggtgggggacaccgtcatggtggacggtttcactaagcccaaaatgacctctaagagctggcataaagctggaaattccgattcacagtcaatcgttctgaagttgccaagtttgagtaagcagaccgcgtcttccaaaccggttaatcctctggctatcagtcaacctgataccaggaaacaggccctaaagttccacccgcttgtgaatgcatcctcgttttccgagctgcagaaacatcagcagcagaatcagaagaaaattactgccaccgccagaaagaaggagaaactgatcaaaaacacatatctaccacaagtccctctacccccggtgtcacgggttgggtactcgcacccctcatttttttacgccacacccagcgcggattttcttctgaagtcctcattcagttcttttcttgagcacagcgggaaaacaccctgggaaaatgcgatttactgcctcgctgtcgccagtgcctttaaggaaaaaaggtggttacagcagctcgagatcgcaagagtcctcgcaaagaaatccatatcgaacttgactactagggggggactcacggcttgcgagaatagccttgaaaccgttctgtag

SEQ ID NO: 26674 - DNA, 2181 bp, Artificial Sequence
  Description of Artificial Sequence: Synthetic coding sequence
atgagtccagcgccagatgccgctccagcccccgcctccatctcgcttttcgacttgagtgcagatgcaccggtctttcaggggctatccctggtgtctcacgcccccggggaggcactggcccgcgccccgagaaccagttgctctggctctggcgagcgagaaagcccggaaaggaagttgcttcagggacccatggatatctctgagaagctgttttgcagcacttgcgaccagaccttccagaaccatcaagagcagagggagcactataaactcgactggcatcgatttaatctgaagcaacggctgaaagacaagcctctccttagtgccctcgacttcgaaaaacagagctcaactggcgatctgtctagcatcagcgggagcgaggactccgacagtgcatctgaagaggatctgcaaacactcgatagggagcgcgcgacctttgaaaagttatccagaccacccggcttttatccccaccgggtcctcttccagaatgctcaaggccagttcctgtacgcttataggtgtgtgctgggcccacaccaggaccctcccgaagaggccgagttactcctccagaacctgcaaagccgggggccgcgagactgtgtcgtcttaatggctgccgcgggccatttcgctggggcaatcttccagggacgtgaggtcgtgacccacaagacattccacaggtatactgttcgcgccaagcgcggaacagcccagggtctccgtgacgcaaggggaggcccaagccatagcgccggcgccaacctcaggcgctataacgaagcaacgctctataaggatgtcagggacctcctggcaggcccgagctgggctaaggccttagaggaggctggaacaatcctgctgcgggccccccggtcgggccgatcccttttcttcggaggaaaaggcgctccactccagcgaggtgaccctcgtctctgggatattcctctggccacaaggcggcctactttccaagagttgcaaagggtgctgcataagttgaccactcttcatgtctacgaggaggatcctagagaggcggttcggttgcactcccctcagacgcactggaagactgtcagagaagagcgtaagaaacccacagaggaggagattagaaagatatgtcgggacgagaaggaggccttaggacagaacgaggaaagcccaaagcagggaagcggctccgagggcgaagatgggtttcaagttgagttagaactggttgagcttaccgtgggtacactggacttatgtgagtctgaagtccttcccaaacggaggcgtaggaaacgcaataaaaaagagaaatcgcgggatcaagaggccggcgcacacagaactctgctgcagcagacacaagaggaagaaccttccactcagtcgtcccaagcggtggccgcaccactggggcctttgctcgacgaagcgaaagcgcctggacagcccgaattgtggaatgccttgctggcagcatgcagggcaggcgacgttggggtgctcaagcttcagctcgctcctagtcccgccgacccgagggtgctctcactactcagtgctcctctaggatccgggggcttcacactcttgcatgccgctgccgccgccggacgcggatctgtagtgcggctactgctggaggccggagccgatcctactgtgcaggattcccgagcccgtcctccttacacagtggccgctgataaatctacacggaacgaatttaggcgcttcatggagaaaaaccccgacgcctatgactacaataaggcgcaagtcccgggccctctcacacctgaaatggaagctaggcaagccacaaggaaacgcgaacagaaagctgctcggaggcagagggaggaacagcaacaacgccagcaagagcaggaagaacgcgaaagggaggagcagaggcggtttgctgcgctgtccgatagggaaaagcgcgctctcgccgcagagagaaggctagcggcccagctcggtgcacctacaagtccaattccagattcagctatcgtgaatactcggagatgctggtcttgtggggcctccctccagggactaaccccttttcactatttagatttcagtttttgttcaacgcggtgcctgcaggatcaccgtagacaagctgggcgaccctctagttag

SEQ ID NO: 26675 - DNA, 2181 bp, Artificial Sequence
  Description of Artificial Sequence: Synthetic coding sequence
atgagccccgcccctgacgctgctcccgcccccgccagcatttcgctgtttgacttatctgctgatgccccagttttccaagggctgagcctggtctcccacgccccgggcgaagctctcgcccgcgcaccccgaacctcttgcagtggatccggcgaacgagagtccccagagcgcaagctcttgcagggtcctatggacatcagtgagaagctcttctgctctacctgcgaccagaccttccagaatcaccaggaacaacgagaacattataagctggattggcacagatttaatttgaagcaacgactgaaggacaagccgttgctgtctgcactggattttgaaaagcagtctagtaccggagacctgagtagtatcagcggatcagaagatagtgactccgcaagtgaagaagacctacagaccttagatcgagagagggcaaccttcgagaagctcagcaggccacccggtttttatccacacagagttttattccaaaatgcccaggggcagttcctgtatgcttacagatgcgtcttgggaccccaccaggacccgcctgaggaagctgagctgttgctgcaaaatttacagagccgcgggccacgggattgtgttgtccttatggcagctgctggtcactttgctggagcaatctttcaaggtcgggaagtcgtgactcataagaccttccacagatacacggtccgcgccaagagaggcaccgcccagggcctgcgggacgccagaggtggtccatctcactccgccggagctaacctgaggcgatataatgaggctaccctttataaggatgtccgggacttgctggccgggccctcctgggccaaagctttggaggaagctggaactattctcctgagagccccacgttctggtcgctccctgtttttcggtgggaagggtgcacccctgcaacggggggacccccggctctgggatattcctctggccacccgcagacccaccttccaggagttgcagcgggtgttgcataagttaacaacactccatgtgtacgaagaggacccccgcgaggcagtcagactgcactccccccagacccattggaaaaccgtgcgcgaagaaaggaaaaaacctacagaggaggagatccgtaagatctgccgggatgagaaggaggccttggggcagaatgaagaatcccctaaacaaggcagtggctccgaaggtgaggacggcttccaggtggaactggaacttgtcgagctcacggtagggacactcgacctttgcgagtctgaggttttgcctaaacgtagaaggcgaaaacggaataagaaggagaagtccagagaccaggaagctggggcacatcgcactctgttacagcaaacgcaagaagaggaaccctcgacacagtcttcccaggccgtggccgccccccttgggccactgctggacgaagccaaggcgcctggccagcccgagctctggaatgctctgcttgctgcatgtcgggccggcgacgtcggcgttttgaagcttcagttggcgccaagccccgctgatccgagagtcctctcgctgttgtctgccccgctggggagtggtggcttcactttattacatgcagctgccgccgccggccgcggctcagtagtgaggctccttttagaggcgggcgctgaccctacagttcaagattcccgcgctcgccccccttacactgtcgccgcggataagtctacaaggaatgaatttcggaggtttatggagaaaaaccctgatgcgtatgactataacaaagctcaggtgcccggccccctaacacccgagatggaggctaggcaggccactcgcaaacgggagcagaaggccgcaagacgacagagagaggaacagcagcaacggcagcaggagcaggaagagcgtgaacgtgaagagcagcggcgcttcgccgccctgtctgatagggaaaagagggcactcgccgcagaacggcgactggccgctcagctcggcgctcctacatccccaatcccggacagcgccatagtgaatactcgcagatgttggtcctgtggcgcttctctgcaggggctgacgccattccactacctagactttagcttttgtagcactcgatgcctgcaggaccacagacggcaagctgggcggccatcatcctag

SEQ ID NO: 26676 - DNA, 273 bp, Artificial Sequence
  Description of Artificial Sequence: Synthetic coding sequence
atgagccccgccccagatgcggctcccgctccggcgagcatctctctgttcgacctgagcgcggacgctccagtgtttcagggcctcagcctcgtgtcccacgcacctggtgaagcccttgctagggcacccagaacttcctgttccgggtcaggagaaagggaaagcccggagcgaaaattgttgcagggacctatggatatttcagaaaagttattttgcagtacatgcgatcagacattccagaaccaccaggagcaacgggaacattag

SEQ ID NO: 26677 - DNA, 423 bp, Artificial Sequence
  Description of Artificial Sequence: Synthetic coding sequence
atgagccctgcaccagacgccgctcccgccccggcgagcatcagcctcttcgatctctccgctgatgctcctgtctttcaaggtctttctctcgtgagtcatgctcccggagaagctttggccagggcaccgcgcacctcatgcagcggatcgggggaacgggaatctcccgaacgtaagctcctgcagggccctatggacattagcgaaaagctattctgttctacctgcgatcagactttccaaaatcaccaagagcagcgcgagcactacaagttagactggcatcgtttcaacctgaaacaaagattaaaagataagcccctgctgagtgctttagatttcgagaagcaaagttccaccggtgacctgtcatcaattagcggttcggaagactccgactccgcatctgaggaggattag

SEQ ID NO: 26678 - DNA, 1263 bp, Artificial Sequence
  Description of Artificial Sequence: Synthetic coding sequence
atgagtgcagcgggcgctggggccggggttgaggccggtttttcgtcagaggagctcctgtctctgagatttccactgcaccgcgcttgccgcgacggcgatctcgcgacactctgttctctgctccagcagactccgcacgctcacttggcgtcagaggactcgttctatgggtggactcccgtgcattgggctgcacactttggcaaactggagtgcttggtacagctggtacgggcgggcgcaactctcaatgtttctactacacgatatgctcaaacccctgctcatatcgccgcgttcgggggccaccctcagtgcttggtgtggttgatccaggcaggagccaatatcaacaaaccagattgtgagggcgaaacaccaatccacaaggccgctcgcagcgggtccctcgagtgcataagcgcactggtggctaacggtgctcacgtagatctgaggaacgcctcggggctgaccgccgcagacattgcacagactcaggggtttcaggagtgcgcacagtttctcctgaatctccagaattgtcatttaaaccatttctataacaacgggatcctgaacgggggccatcagaatgtttttccaaaccatataagtgtcggaacaaacaggaagcgatgcttagaagactctgaggattttggagtcaagaaggcaaggacagaagcacagtcgctcgacagcgcagtcccactcactaatggagataccgaggatgacgcagacaaaatgcacgtcgacagagagttcgccgtggtaacagacatgaaaaacagtagctctgtatctaacactctgaccaacggctgcgtcattaatgggcacttggatttcccatccacaacacccctgtctggcatggaaagccgcaacggacagtgcctgaccgggactaacggtatctccagtggcttggcacctggccaaccgttcccatcatcacagggctcactgtgtatcagcggtacggaagagcctgaaaagacactgcgggcgaaccctgagctctgcggttccctgcacctgaacggatctcccagctcttgtattgcttctcgaccctcatgggtcgaggacataggagataacctgtactatggccattaccacggctttggggacacggcagaaagcattcccgagctcaacagcgtcgttgaacatagcaagtcagtgaaggtacaggaaagatacgacagtgctgtcctcggaaccatgcacctgcaccacggctcttag

SEQ ID NO: 26679 - DNA, 663 bp, Artificial Sequence
  Description of Artificial Sequence: Synthetic coding sequence
atgagtgctgccggcgccggagctggcgtggaagcaggattctcttcggaagaactgctctctctgcgctttcccctgcaccgcgcctgcagagacggcgacctggccacactgtgcagtttgctgcaacagactcctcacgcccacctggccagcgaggactccttctacggctggacaccagtgcattgggctgcgcattttggaaagctggaatgtttggtgcagttggtccgagccggcgccaccctgaatgtcagtaccactcggtatgctcagacaccagcgcacatcgcagcattcggcggccaccctcagtgtctggtttggctgattcaagctggcgcgaatatcaataagccagactgcgagggcgagactcccattcacaaagccgccaggtcgggctctcttgagtgtatatccgctttggtggcaaacggcgctcatgtggaattcatctctcagtcatctgtccacagctgcctgcccggcgaactccagcatggagttacattcgatccctctgtgcttattcagtgtttgaagcccgagaaatgtcagtggccggattcaagtcgccactgtactaacccgggctttccacgggtctgcccggtgtcgctggaacccccggagctaagcagcgagcccttcctgtag

SEQ ID NO: 26680 - DNA, 1557 bp, Artificial Sequence
  Description of Artificial Sequence: Synthetic coding sequence
atggtgcagctggtgctccagtaccgagactaccaaagggcgacacagaggctagcaggaatacccgagcttctaaataagcttcgccaggcgcccgatttctacgtagaaatgaagtgggagtttacttcttgggttccgctcgtttcaaaaatgtgtcccagcgacgtatatcgtgtgtggaaacgtggcgaaagtctgcgcgtggatacaagcctcctgggttttgagcacatgacatggcagcgaggacgccgaagctttatttttaagggccaggaggcaggcgcgctggtcatggaggtggaccacgatcggcaggtggtgcacgttgagactcttggcctgactctccaggagcctgagacccttctcgccgcaatgaggccaagtgaagagcatgttgcctcaagactgacctctccaatcgttagcacccaccttgacacaaggaacgtagctttcgagcggaataagtgcgggatctggggctggaggtccgagaagatggagactgtaagtggttacgaagctaaagtgtactctgcgaccaatgtggagctagttacacgcaccaggacagagcacttaagtgaccaggataaatcaagatccaaagctggaaagacaccttttcagagtttcctaggaatggctcagcagcatagctcccacacgggcgcccccgtccagcaagctgcaagtccaacaaatccaacagcaataagccccgaggagtacttcgatcccaactttagcctggagtcccgtaatattgggcggcctatcgaaatgtcttcaaaggtgcagagattcaaagcaacactgtggctcagcgaagagcacccactatccttaggcgatcaagttacaccgatcatcgatctcatggccatcagtaatgcccacttcgctaagctgcgcgactttatcacccttagattaccacctggcttcccagtcaagatcgaaattcccctctttcatgtactgaacgcaagaatcacattttccaatttgtgcggctgtgacgaacctctgagttcggtatgggtcccagcacctagttccgctgttgcagcctccggcaatcccttcccatgcgaagtggatcccaccgtgttcgaggttcccaatggctattccgtgttgggtatggaaaggaacgagcccctgcgcgatgaggacgatgacttacttcagtttgccatccagcagtccctgctggaagctggaaccgaggctgagcaggtgacagtttgggaagccctgacaaatacaaggcccggcgctaggccgccacctcaggccacagtctatgaagaacagctgcaactggagcgcgcgcttcaggagtccttgcaactgtccacagagccgagagggccaggctctccacccagaactccgcctgcaccagggcccccaagcttcgaagagcagctcagactggcgttggaacttagtagccgcgagcaggaagagcgcgagaggcgcgggcaacaggaggaagaggatcttcagagaatcctgcaattgagcctcaccgagcactag

SEQ ID NO: 26681 - DNA, 1557 bp, Artificial Sequence
  Description of Artificial Sequence: Synthetic coding sequence
atggtgcagctggtcctccaatacagagactaccagagggcaacccagaggctcgcagggatcccagaactgctcaataagctacggcaggcaccagatttctatgtagaaatgaagtgggagtttacctcttgggttccactcgtgagcaaaatgtgcccgtctgacgtgtaccgcgtttggaagcggggggaaagtcttagagttgacactagtctcttaggcttcgaacatatgacctggcagagagggaggcggtctttcattttcaagggccaagaggccggggccttggttatggaggtggatcacgacagacaggtggtacacgtggagacccttggcctgacactccaggagcccgaaacattactggctgctatgcgcccaagcgaggaacacgtggccagtcggctcacatcacctatcgtgtcgactcatcttgatacaaggaacgttgcctttgagcgaaacaaatgtggcatatgggggtggcgtagtgagaagatggagactgtgtccgggtatgaagctaaggtttacagtgccaccaacgtggaattggtgaccaggacgaggactgagcacctgagcgaccaagacaaaagtcgctcgaaggcagggaagactccgttccaatcctttttgggcatggctcaacagcattcctcacacacaggcgcccctgtacagcaggctgcttctccaacaaaccccacggccatctctcccgaagaatatttcgatccaaatttctctctcgaaagtcggaatattggacgcccaatcgaaatgagctccaaagtccaaagattcaaggccaccttatggctgagtgaggagcacccactctccctaggcgatcaggtgacaccaatcatcgacctcatggccataagtaacgcacatttcgctaaactgcgcgatttcatcaccctgagactgcctccagggttcccagtaaagattgaaataccgctgtttcatgtactaaacgctcgaatcactttctccaatttgtgtggatgcgatgaacccctatcgtccgtctgggtaccagcgccgtcgagcgccgtggcagcgtccggcaacccctttccgtgcgaagtagacccgacggtgttcgaggtgcctaatggatattctgtgttggggatggagagaaatgaacccctccgtgacgaagatgacgatctactgcagttcgcgatccagcagtcacttttggaagctgggacagaggctgagcaggtgaccgtttgggaggcacttaccaacacgaggccaggcgccagacctccgccacaggccactgtatacgaggagcagctacagctcgaacgggccctacaggagtcactgcagcttagtacagagccaaggggccctggttccccgccccgcacccccccagcaccaggtcctccctcgttcgaggagcagctgaggctggcgttagagttgtcttctcgggagcaggaagaaagagagcggcgcgggcagcaggaagaagaggacctgcaacgtatccttcaactctcactgacggagcattag

SEQ ID NO: 26682 - DNA, 1818 bp, Artificial Sequence
  Description of Artificial Sequence: Synthetic coding sequence
atggccggccctgggccaaccttcccgcttcatcgcctggtttgggctaaccgccacagagaactcgaagctgcactccacagccaccaacacgacatagagcaggaagatccccggggcagaactccgctggagcttgcggtttccttgggcaacctggagtccgtgagagtcttgttacggcacaacgccaacgtgggaaaggagaacagacagggatgggccgttctgcaagaggccgtgtccaccggcgatcctgagatggtgcagctggtgctgcagtatagggattaccaacgagccacccagaggctggccggcattcctgaactgctaaataaactgaggcaggcgccagatttttatgtagaaatgaagtgggaatttacaagttgggtccctctggtgtctaagatgtgcccgagcgatgtctatagagtgtggaagcgaggcgagtcactgcgggtggacacatctctgctcggattcgagcatatgacgtggcagcgaggaaggaggtcttttatattcaaaggacaggaggccggagcactggttatggaagtggatcatgatcggcaggttgtccatgtcgagaccctcggattgaccctccaggaaccagaaacgttacttgctgccatgcgtccatcggaagagcatgtggccagccgtcttacatctcctatcgtgtcaacccaccttgacacgcgaaacgtcgcttttgaacgcaataagtgtggcatttggggctggcggtccgaaaaaatggagactgtgagcggttacgaagcaaaagtatatagcgcaacaaatgtcgagttggtcactcgaacgcgaaccgaacaccttagtgaccaggataaaagcaggtctaaagccggtaaaacacctttccagtctttcttgggcatggcccagcagcactcatcacacacaggcgcccccgttcagcaagcagcttctccaactaaccctaccgcaatatccccagaggagtatttcgaccctaacttctcccttgagtctcggaacatcggaaggccaattgaaatgtccagcaaggtccagcgcttcaaggccacgctgtggctgagcgaggagcaccccctcagcctcggagatcaggtgacgccaatcattgacctcatggccattagcaacgcgcattttgccaagctgcgcgacttcatcactttgcgcctgccacccggatttccagtcaagattgagattcctctgttccacgtgctgaacgctcgcattacgttctctaacctctgtgggtgtgatgagccgctgagttcagtctgggtcccagctccatcttccgcagtggccgcctctggcaatcccttcccctgtgaagtcgaccctaccgtgtttgaagtgcccaacggctactctgtcctcggcatggagaggaatgaaccactgcgcgacgaagacgacgatctcctgcagttcgccatacaacagtccctgctagaggccgggaccgaggctgagcaggtgacagtctgggaggcacttacaaacaccaggccgggtgcccgtccacccccgcaggcgaccgtttacgaagagcagttgcaattggaaagagccctccaggagtcactgcagctgtctaccgagccccgaggcccaggcagtcctcctaggacaccaccggccccaggtcccccaagttttgaagagcagttgcggctggccctcgagttgtcatctcgcgagcaggaggagagagagcggcgtggccagcaggaggaggaggacctgcaacgaattctgcagcttagtctgactgagcactag

SEQ ID NO: 26683 - DNA, 1557 bp, Artificial Sequence
  Description of Artificial Sequence: Synthetic coding sequence
atggttcagctcgtactgcaatacagagactaccagcgtgccactcagcggctcgcgggcatccctgagctgctaaataagctcaggcaggctcctgatttctacgtggagatgaaatgggagtttacaagctgggtcccactggtttctaaaatgtgcccttccgatgtgtatcgggtctggaaaagaggtgagtcactgagggtcgacacgagtctgctcgggttcgagcacatgacctggcaacgggggagacgctcgttcatatttaaaggacaggaagctggcgctctggtcatggaagtagaccatgacagacaggtcgtacacgtcgagactctgggtctcacactgcaagaacccgagaccctcctggcggccatgagacctagcgaggagcacgtcgcttccagactaacatcacccatcgtgtctacccatctagacacaagaaacgtggccttcgaaaggaataaatgcgggatttggggttggcgaagtgagaaaatggagactgtgagtggctacgaggcgaaggtgtattcagcaaccaacgtggagctcgtgacacggaccagaaccgaacacctatctgaccaggataagagcagatccaaggcaggcaagacccctttccagtcctttctaggaatggcccagcagcactcgtcccataccggggctccagtccagcaggccgcctccccaactaatcccaccgcgatttcccctgaggagtattttgaccccaatttttcgctagaatctcggaatatcgggagacctatcgagatgagtagtaaggtacaaagattcaaggccactctgtggcttagcgaggaacaccccctgtcgctaggcgatcaggtgaccccgatcatcgatcttatggccattagcaacgcccacttcgctaaactgagagactttataacactcagacttcccccaggattccccgttaagatagaaattcctctgtttcacgtcctcaacgctcgaataaccttctcaaatttatgcggctgtgacgagcctctctctagcgtgtgggtgcctgccccgtcctccgcagtggctgctagcgggaatcccttcccttgcgaagtggatcccactgtattcgaagtcccgaatggctactctgtgctgggcatggagcgaaacgagccactgcgcgatgaagatgatgacttgctgcagttcgccatccagcagagcctcctggaagccggcacggaagcagaacaagttacggtgtgggaggcgctgaccaacacccggccgggtgcacggcccccccctcaggcaactgtgtatgaggaacaacttcagctggagagagctcttcaggagagcctgcaactgagtaccgaaccacgcggacctggcagccccccacgcacacctcccgcccccgggccacctagctttgaggagcagctgcgcctcgcacttgaattatcatcccgggagcaggaggagagagaaagaagaggccagcaggaagaggaagatctgcagcggattctgcaactctctttgacagagcattag

SEQ ID NO: 26684 - DNA, 768 bp, Artificial Sequence
  Description of Artificial Sequence: Synthetic coding sequence
atgagttgtggtagactaggacggttcaaagccaccctgtggctatctgaagaacatcccctatccctgggggaccaggttacccccataatagatttaatggccatcagcaatgcccacttcgccaaactgagggacttcattacactgaggctaccgccaggattccccgtcaagattgaaattccattgttccatgtcttgaatgcgcgcataacattctccaatttgtgcggttgtgatgaacctttgagctctgtttgggtgcctgccccttccagcgcggtcgctgcaagcgggaacccgtttccctgcgaggtggacccaactgtgtttgaggtgcctaacggttactcagttctgggcatggaaagaaacgaacccttacgcgatgaggatgatgacctgctccaattcgccattcaacagagtctactggaagccggaactgaggctgaacaggtcacggtgtgggaggcattgacaaacacccggcccggagctaggcctcctccgcaggcaaccgtatacgaagaacagctgcaactggagagagccctccaagagagcctgcagctgtccaccgaaccaagggggcccggctccccaccccggacccctcccgcacccgggcccccatcgttcgaggagcagctgcgcctggcgctagagctgtccagccgcgagcaggaagagcgggaaagaaggggtcagcaggaggaggaggacttgcagaggatcctccagctcagcctaaccgaacactag

SEQ ID NO: 26685 - DNA, 1011 bp, Artificial Sequence
  Description of Artificial Sequence: Synthetic coding sequence
atgaaaccaaagtcgagagaggtggaacggcggctcacctcacctgtcatcaacacaagcttggatactaagaacattgccttcgagaggaccaagtccggattttggggttggagaacagataaggccgaggtggtgaatggctacgaagctaaagtttataccgtgaacaatgtaaatgtgataaccaaaatccggacagagcatttaacagaggaggagaagaagaggtataaggacaggaacccactggaaagtctgttagggacagttgagcaccaattcggcgctcagggtgatctgacaacagagtgtgcaactgcaaataacccgactgccatcacacctgacgagtatttcaatgaggagtttgatcttaaggatcgcgatataggacgaccaaaagagctgactatccggacacagaaattcaaggcaatgctgtggatgtgtgaagagtttcctctgtccctggtcgaacaggtcatacccataattgatctgatggcccggacatccgctcactttgctcggttgagggattttataaaactggaattccccccaggattccccgttaagattgcttcccatatcactaatttcgaggtagaccagagcgtgtttgagatccccgaatcctactatgtgcaagataacggtagaaacgtacatcttcaagacgaagattacgagatcatgcagttcgccattcagcagagtcttcttgagagcagccggtcccaggaattgagcgggccagcctccaatggaggtatttctcagaccaacacatatgatgcccagtacgaacgggcaattcaggagtccctgctgacatccacggagggtttatgtcctagcgctctctcagagacatcacgttttgacaacgacctgcagcttgcaatggagctgagcgcgaaagaactggaggaatgggagctccggctgcaagaggaggaggcagagctgcagcaggtactgcaactgtccctgactgacaaatag

SEQ ID NO: 26686 - DNA, 1773 bp, Artificial Sequence
  Description of Artificial Sequence: Synthetic coding sequence
atgtcgtctgcgtgtgatgccggagaccactaccccctgcacttgctggtctggaaaaacgattatcgccaactagagaaagaactgcagggacagaacgtcgaggccgtggacccccgcgggagaaccctgctgcatcttgccgtgagcttgggacacctcgaatccgcacgggtcctgctgagacataaagctgatgtgactaaagagaaccggcagggctggactgttctccatgaggcggtgtcaacaggggatcccgaaatggtctatacagtgctgcagcaccgcgactatcataacacatcgatggcccttgagggggtgcctgaactcctccagaagatcctggaggccccggatttttacgtgcagatgaagtgggagtttaccagctgggttcctctcgtgtcacggatctgtcccaatgacgtctgtcgcatctggaaatccggcgcgaagctgcgcgtggacatcactctcctaggatttgagaatatgagttggatccggggccggcgaagtttcatctttaaaggcgaggacaattgggccgaactgatggaagtcaaccatgacgacaaggtggtgacaacagaaaggttcgacctgagccaggagatggagcggcttactcttgatctgatgaaaccgaagtcacgggaggtggaacgaagactaacaagtccagtgataaacaccagcttggatactaaaaatatagccttcgagcgaacgaaaagtggcttctggggatggaggactgacaaggccgaggtagttaacggttacgaggctaaagtgtataccgtgaacaatgtaaacgtgatcaccaagattcggacagagcatctaacagaggaagaaaagaagcgctacaaagcggacagaaatccgttggaaagcctcctggggacagtggaacaccagtttggggctcaaggcgaccttaccacggagtgcgctaccgcgaataacccaaccgcaatcactccggatgagtacttcaacgaggaattcgacctaaaggatagagacattggacgcccgaaagagctaacgattagaacgcagaagttcaaagccatgctgtggatgtgtgaagagtttcctctgtccctcgtggaacaggtgataccaataattgacctcatggcccgtacttcagctcattttgcccgacttagggatttcatcaaactagaattccctccaggtttccctgttaagatcgagattcccctcttccacgttcttaacgcacggattacctttggaaacgtaaatggttgctccacagctgaggagtccgtttcgcagaatgttgagggaacccaggctgatagtgcatctcacatcacgaacttcgaggtggaccaatctgtcttcgagatccctgagtcttactatgtacaggataatggccgcaatgtgcacctacaggacgaggactatgagatcatgcagttcgctatccagcaaagcctactagagtctagccggtcccaagagttatccggacctgcatccaacggggggatctcccagacaaatacatacgacgctcagtatgagagagcaatacaagaaagcctgttaacatccacggagggtttgtgtccaagtgcactctcggagacatcccgatttgacaatgacctgcagctggctatggaactgtcagccaaagagcttgaagaatgggagcttcggttacaggaagaagaggcagagctccagcaggtgctgcagctttctctcacagacaaatag

SEQ ID NO: 26687 - DNA, 1881 bp, Artificial Sequence
  Description of Artificial Sequence: Synthetic coding sequence
atgattcccgccaatgctagtgcacgtaagggaccagagggcaagtacccgctccactatcttgtgtggcacaacaggcatcgtgagttagagaaggaggtaagagcgggacaagtggatatcgaacagctggaccctcgaggaagaaccccgctccacctcgccacaactctcggtcacctcgagtgtgcacgcgtgctcctggcgcacggcgcagatgtgggaagggaaaatcgtagcggctggacagttctccaggaggcggtgtcaacccgggatctcgagctcgtgcagttagtgcttcggtacagagactatcagcgtgtggtaaagaggctggctgggatccctgttttgttggagaagctccggaaggcacaggacttctacgtggaaatgaagtgggaattcactagttgggtccccctcgtgtcaaaaatctgcccttccgacacttataaggtatggaagtccggccagaacctgagggtggacaccaccctcttgggatttgaccatatgacatggcagcgcggcaatcggtctttcgtctttagaggtcaagatacgtccgctgtcgttatggaaatagatcatgaccgaagagtcgtttacacggagacccttgccctagctggacaagaccgcgaactactcttggccgccgcacagcccaccgaggagcaggtactgtcccgacttacggcaccggtggtgaccacacagcttgacacaaagaatatttcattcgagagaaataaaaccgggatactcggctggcgctctgaaaagactgagatggttaacggatatgaagcaaaagtgtatggggcgagcaatgtggagctgataacaagaacgcgcactgagcacctcagtgaacagcacaaaggcaaggtgaaggggtgcaagactcctttgcagagctttctggggatcgcagaacaacacggcggaccacagaacggcactctgatcacgcagaccttgtcacaagcaaaccctacagcaatcaccgctgaggagtactttaaccctaactttgagctgggaaatcgggacatgggccggcccatggagcttactaccaagactcagaagttcaaggctaaactgtggttgtgcgaggagcacccactgagcctttgtgagcaggtggcaccaatcattgatctaatggccgtctctaatgctctgttcgctaagctgagagacttcattacccttcgtctgccacctggtttccctgtgaagatcgagattccgatttttcacatcctgaacgctcgaattactttcggcaacctaaacggctgcgacgagccggttccctccgtgcggggcagccccagcagcgaaactccctccccaggatccgatagctcctctgtctcctcttctagttctaccacatcttgccggggctgtgagatctcgccagcactattcgaggcgcctaggggctattcaatgatgggaggccagagggaggctgccacgagagatgacgatgatgacctactccagttcgccatccagcaatctctcctggaagctggatccgaatatgatcaggtgactatctgggaggccctgaccaactctaagcctgggactcatcccatgagctacgagggtcgccgtcaggatcgaagcgccccccccacccctcaacgtcagcccgcacctcctgcatctgttcccagcccacgcccttcctccgggcccggctccgggggccatgtattcaggtcatacgacgaacagctaagactggcaatggagctctcagcgcaagagcaagaggaacgacggaggagggctcgccaagaggaggaggaactcgaacgtattcttaggctttcactgacagagcagtag

SEQ ID NO: 26688 - DNA, 915 bp, Artificial Sequence
  Description of Artificial Sequence: Synthetic coding sequence
atggctcagcctggggatcctcgacgcctatgcagactagtccaggagggaaggcttcgcgctctcaaagaagaactccaggcagcaggtgggtgtcccgggcccgccggagatactctgctgcactgcgcggctcgccacggtcatagagacgtattggcatacctggccgaggcatgggggatggatatcgaggcgaccaaccgagattacaagcgacccctccatgaagcagccagtatgggacaccgagactgcgtgagatatcttttgggaagaggcgctgctgtcgattgtttgaaaaaagctgactggacccccctgatgatggcatgtaccaggaagaaccttggcgtgattcaggaactggtagagcacggggccaatcccctactaaagaataaagacgggtggaactcatttcacattgcttcgcgcgaaggcgatccactaatcctccaatatctcttaactgtctgcccaggcgcctggaagaccgagagcaaaatcaggcgaacaccgttacataccgccgccatgcacggacacctggaagctgtgaaagtgctgctgaagaggtgtcagtatgagcccgactaccgagacaattgcggagtgactgcactcatggacgccatccaatgtggccacatcgacgttgcccgacttcttcttgacgagcacggcgcctgtctgtctgccgaggatagtctgggagcccaggcccttcatcgtgcggcagtcactggtcaagacgaggctattcggttcctcgtctctgagttgggggtcgatgtggacgtgcgggcaactagcactcatcttacagctctgcactatgctgccaagccctgtatatggcctgtgcaggtctcaacctggcccgtacctagcttcagttgtagcagagactag

SEQ ID NO: 26689 - DNA, 1086 bp, Artificial Sequence
  Description of Artificial Sequence: Synthetic coding sequence
atggcccagcccggcgacccaaggcgcctgtgtcggctcgtgcaggaaggtcgcttgcgcgctcttaaggaggaactgcaagctgccggagggtgccctggccccgctggagacacactgctgcattgtgctgctcgacatggacatagagatgtgctggcctatctggctgaggcctggggcatggacattgaggccacgaaccgggattataaacggccactgcacgaggcggccagtatgggacacagggactgcgtccggtacttgctgggaagaggggccgccgttgactgcctgaaaaaagccgactggacaccactgatgatggcctgtacccgcaaaaacctgggagttattcaggagcttgtagagcacggggccaacccactcctgaaaaataaagacggatggaactcattccatatcgcttctagggagggtgatcctctgattttgcagtacctgttaaccgtgtgtcccggagcctggaaaaccgagtcaaaaatacgccgcacacctctgcacacagccgcaatgcatggtcatctagaagccgtgaaggtgctgctgaagcgttgccagtatgaacctgattaccgagacaattgtggggtgacggctctcatggacgccatccagtgcggccacatcgatgtggcccgcctgcttcttgatgaacatggcgcctgtctgagcgccgaggactctctgggagctcaggctctgcacagggccgctgtgactggccaggacgaagcaataagatttctggtctccgagctgggagtggatgtcgatgtaagggcaactagcactcatcttaccgcactgcactacgccgctaaggaaggacacacctccaccattcagaccctactgtcactcggcgcagacattaactccaaagatgaaaagaaccgctcagcccttcacttggcttgcgctggacagcatctcgcatgtgctaaatttctgttacagtctggcttaaaggacagcgaagatattactggcaccttggctcaacagctgcccaggagagctgatgtcctgcagggttctggccatagcgctatgacttag

SEQ ID NO: 26690 - DNA, 1086 bp, Artificial Sequence
  Description of Artificial Sequence: Synthetic coding sequence
atggcccagcccggagaccctcggaggttatgcagactcgttcaggagggtaggctgagagcgctaaaagaagagctgcaggctgccggtgggtgtcctgggcctgctggcgataccttgctgcattgcgccgcccggcacgggcaccgcgatgtcctggcctatctggccgaggcgtggggtatggatatcgaagcgacaaatcgtgattataagaggcctctccatgaggctgcttcaatgggccatagagattgcgtccggtacctgctgggaaggggggctgcggtggactgcctgaagaaagctgattggactcccctgatgatggcctgcactagaaagaacctcggggttatccaagagctggtggaacacggcgctaaccccctcttgaaaaataaggacggctggaactcctttcacatcgcttccagggagggagatcccctcattttgcaatatttgctaacagtgtgcccaggagcttggaagaccgagtctaagatccgcaggacacccctgcatacagcggccatgcacggccacctggaggccgtcaaagtcctgctaaaaaggtgccagtacgagcctgactatcgtgacaactgcggtgtgaccgcgctgatggacgcaatccagtgcggacacatagatgtcgctcgcctacttctggatgaacatggggcctgtctttctgccgaagacagcctgggtgcccaagctttacaccgtgccgcggtgactggacaggatgaggctattcgctttctagtgtcagagctcggagtggatgtcgatgtaagagctacaagcacccatttgactgctctccattacgccgccaaggagggccacacatctaccatccagactctgctctcactcggtgctgatataaatagcaaggatgagaaaaataggtcggcactgcatctggcctgcgcagggcaacatttggcatgtgctaagttcttgttgcagtctgggctgaaggattccgaggacatcacggggaccttggcccaacagctccccagacgtgctgatgtgctacaaggaagtggccacagtgctatgacctag

SEQ ID NO: 26691 - DNA, 618 bp, Artificial Sequence
  Description of Artificial Sequence: Synthetic coding sequence
atgaagacagcttacgaagaagtcactaccgagctggaggagtttaaggaagccttcgcaggcgcagttaaagccaacaattccatgagcaagaagctgatgaagtccgataaaaagattgctgtaatctccacgaagttattcactgagaagcaacgtatgaaatactttctgtcaaccctgcccacacggcccgagcccgagctgccatgcgtggagaatcttaatagcatagagctgaacaggaaatacatcccaaagacagctatccgaatacctacgagtaatcctcagacctcaaacaattgtaagaacttcttgacagagatggaacttgatcgggtggagcagattatcaccgggacaaaaaaaagcttcgccatgttgtccacttgctctcggctgctttcatttgtggagtcaactgctccgcgaaaacatagacgcgctctgcccataatgagatcactcgttcctaaccgccggacgacagtagcttctacagagtcaagaacaaacaggccagggggagtaaggtcccctgggcttcagctagaagggacatctaccctgcaatgggaacaggggcccattgcccaccctagacacagatgttag

SEQ ID NO: 26692 - DNA, 654 bp, Artificial Sequence
  Description of Artificial Sequence: Synthetic coding sequence
atgaagacagcctacgaggaagtgaccaccgagctggaggaatttaaggaggcctttgccggcgcagtgaaggcaaataacagtatgtccaaaaaactgatgaagtccgacaagaaaatcgctgtgatatccactaaactgtttaccgagaagcaaagaatgaaatatttccttagtacgttgcccactcggcctgaacccgagttaccctgtgtggaaaacttaaattctatcgagctgaaccggaagtacattcctaagaccgctattaggatcccaacttctaacccccaaacatccaacaactgtaagaatttcctaaccgagatggaactcgaccgagtggagcagattatcacggggacaaaaaagtcattcgcgatgttgagcacctgttcccgactcctgtcctttgttgaaagcacagccccaaggaagcaccgacgggccctgcctatcatgaggtcattggtcccgaaccgcaggactaccgtggcatccaccgagatgagccagctgctgtacaaaggggtgcctttccaaagccgaacaaatcgtcccggaggcgtgaggagccccgggctgcagctggaaggaacaagcacactgcagtgggagcaggggccaatcgcacatccccgccaccgctgttag

SEQ ID NO: 26693 - DNA, 2979 bp, Artificial Sequence
  Description of Artificial Sequence: Synthetic coding sequence
atgaggaagttgttttcatttggacgaagactgggacaggctctgctatccagcatggatcaagaatacgctggaccgggttatgatattcgggattgggagcttaggaagatccaccgtgccgccattaagggcgacgctgccgaagtggaacggtgcttgacacggcgtttccgcgaccttgacgcacgggatagaaaggatcggactgtgctccatttggcatgcgctcatggtagagttcaggtggttaccctgctcttgcaccggcggtgtcagatagacatttgtgacagacttaaccgaacaccgctgatgaaggctgtgcactcacaggaggaggcttgcgccattgtgcttctagagtgtggcgctaatccaaacatcgaggacatttatggcaatacggcactgcactacgcagtttacaataagggaacgtcattagctgaacggcttctttcccaccacgccaacatagaggccctcaacaaagaaggcaatactccgctgctgttcgccatcaactcccgccggcaacacatggtggaatttctactgaagaaccaggccaatattcacgccgtggataacttcaagcgcacagctctgattctggccgttcagcataatctcagctccatcgttactcttttgttgcagcagaatataaggatatcttctcaggacatgttcggccagacggctgaggattacgctctgtgcagcgatttgcggagcatccggcagcagatcctcgaacacaagaacaagatgttaaagaaccatctgcgcaatgataatcaagagaccgcggcaatgaagcccgctaatcttaaaaaaagaaaagaaagagctaaggccgagcacaaccttaaagtggccagcgaagagaaacaagaacgactgcaacggtcagaaaacaaacagccccaggatagtcaatcctacggaaaaaaaaaagatgctatgtatggcaattttatgctcaagaaagacatagccatgcttaaagaggaactgtacgccattaaaaatgacagcctcagaaaggagaagaagtatatccaagaaattaaatccattacagaaatcaatgctaattttgaaaagtcggttcggctgaatgagaaaatgattacaaaaaccgtggccagatattcacagcagctcaacgacctcaaggctgaaaacgcacgcctaaattccgagcttgaaaaggaaaagcacaataaagagaggttagaggccgaagttgaatcactccactcatcgcttgctacagccataaatgaatataacgagatcgtagaacgcaaagatctggaactggtcctgtggcgcgccgatgatgtttcaaggcacgagaagatggggtccaatatcagccagctgaccgataaaaatgagcttctaacagaacaggtccataaagcccgcgttaaattcaataccctaaagggtaagttacgcgaaacacgcgatgccctgcgggaaaagacacttgctttagggagcgttcaactcgatctgagacaggcacagcacaggatcaaggaaatgaagcagatgcacccgaacggtgaggccaaagaatcacagtccataggcaaacagaacagcttagaggagaggatccggcagcaggaactcgagaaccttctgctagaaagacagctcgaagacgctagaaaggaaggggataataaggagatagtgattaatatccaccgcgactgcctggaaaacggcaaggaggatcttcttgaagagcgtaacaaagaactcatgaaagaatacaattacctgaaggaaaaactattgcagtgtgagaaagaaaaagcggagcgggaagtgatcgttcgggaattccaagaggaattggttgatcatttgaagacgttttctattagcgaatcacctctagaaggaacgtctcactgtcacattaacctgaacgaaacctggacttctaaaaagaaattgttccaagtggaaatccagcccgaggaaaagcacgaggagttccggaagctcttcgaactcatatcactccttaactacaccgccgatcagattcgaaaaaagaaccgcgaactggaggaagaggctaccgggtacaaaaagtgtcttgagatgactatcaatatgctcaacgctttcgccaacgaagacttttcttgtcatggggatctgaacaccgaccagcttaagatggacattcttttcaagaagctcaaacagaagttcaacgacctggtagcggaaaaggaggctgttagcagcgaatgtgtgaacctggcaaaggataacgaagtcctgcatcaggaactgctgtctatgcggaatgttcaggaaaagtgtgaaaagctcgaaaaggataaaaagatgctggaggaggaagtgcttaatctgaaaacacacatggagaaggatatggtggagctgggcaagctgcaggaatacaagagcgaactcgacgagagagccgtacaagagatagaaaagctggaggagattcacctccagaagcaggccgaatacgagaaacaactggaacagttgaataaagataataccgcttctttgaagaagaaggagctgacactcaaggacgtagaatgtaaattcagcaagatgaaaactgcctatgaggaggtgactactgagttagaggagttcaaggaagctttcgcgggtgctgtgaaggccaataattcgatgagtaagaaactgatgaaaagcgataaaaagattgccgtgatttccacaaaattattcacagaaaagcagcggatgaaatatttcctttctaccctgcccacccggccagaaccagagctgccctgtgtggagaacctgaattcaatcgagctcaaccggaagtacatccccaagacggcaatacgaatccctacctcaaacccccagacatcaaataattgtaagaacttcctcacggaggtcttgttatgttag

SEQ ID NO: 26694 - DNA, 3036 bp, Artificial Sequence
  Description of Artificial Sequence: Synthetic coding sequence
atgcgcaagctcctttcatttggtcggcgcctaggccaagccttactcagctcaatggaccaggagtacgcggggagaggttatcatattcgagactgggagctccgcaaaattcatcgggccgccattaagggggatgccgccgaagtagaacattgcttaactcggcgatttcgtgacctcgacgttcgtgatcgaaaagacagaactgtgctccatctcgcttgcgcacacgggagggtgcaggttgtgacgttgcttctggacaggaaatgccagataaacatttgtgatagactcaaccgcactcctttgatgaaggcagtgcattgccaggaggaggcatgcgccattattttgttgaaacggggtgccaacccaaatattaaagacatatatgggaacaccgccctccactatgctgtatataacgaaggaacaagtcttgcggaacgcctgctgtcccaccacgccaacatagaggccctgaacaaggagggcaacactccgctgctgttcgcaatcaacagtaggagacaacacatggtcgaatttctgcttaaaaatcaggctaatatccacgctgtggataattttaagaggactgctctgattctggctgttcagcacaacctaagctccatagttacgctcctgttacagcagaatatacacatttctagccaggatatgttcggtcagacagcagaggattatgccttttgttgtgatctgcgttccatccagcagcagattctcgaacacaagaacaagatgctgaagaatcacttgaggaatgacaatcaggagaccgctgccatgaaaccggagaatcttaagaagagaaagaaacggaagaagttgaagaaaaggaaggagggggccaaagctgaacataaccttaaagtcgcttctgaggagaaacaggaacgtcttgagagatcagagaacaaacagccccaagacagccaatcatacggtaagaagaaggacgagatgttcggcaatttcatgttgaagcgggatatcgcaatgctcaaagaagagctgtatgccatcaagaatgacagccttaggaaggagaagaagtatatccaggaaataaaaagcataaccgaaataaatgctaattttgagaagtccgttagattgaacgaggaaatgataaccaagaaagttgcccagtactctcagcagctgaacgacctgaaagccgagaacgcccgactcaacagcaaacttgaaaaagaaaagcacaataaagaacgcttggaggcagaggtagagagtctacattctaacctcgcaaccgcaatcaatgaatataacgaaatacttgagcggaaagatctggagctggtgttgtggcgcgcagatgatgtgtcaagacacgagacgatgggcagcaacatctctcagctgaccgacaagaatgagctactgacagagcaggtgcacaaagcacgcgtcaaatttaatactctgaagggaaaacttcgagagacccgtgatgcacttcgggagaagacgcttgctctggagagtgttcagctagaccttaaacaggcccagcaccgtatcaaagagatgaagcaaatgcatccaaacggagaggcaaaggaaagtcaatctatcggcaagcaaaatagtagcgaagaacggatcagacagcgggaactcgaaaatctactcctggagcggcagctagaggacgcacggaaggaaggcgataataaagagattgtgatcaacatccaccgggactgcctcgagaatggtaaggaggacttactcgaggagcgtaacaaggaacttatgaacgaatacaattatctgaaagaaaagctgctacagtatgagaaagaaaaggctgagcgggaagttatcgtccgcgagtttcaagaggaactggtggaccacttgaaaaagttctccatgtcggagtcgcccctcgaggggacctctcattgccacatcaatctggacgaaacttggacatcgaagaaaaagctattccaggtggagatacaacccgaagagaagcacgaggagttcaggaaagtttttgagctgataagcctactgaactacacagctgaccagataagaaagaaaaaccgagagttggaagaggaggctactggatataaaaaatgtctagaaatgaccatcaatatgttgaacgcttttgctaacgaggatttcagctgccacggtgatctgaacaccgatcagttgaaaatggatatattattcaagaaacttaagcagaaattcgatgatctaatggcagagaaagaggccgtttcttccaagtgcgtgaacctggctaaggataacgaagtcctgcaccaggagcttctctcaatgggcaaggttcaggagaagtgcgagaagcttgaaaaggataagaaaatgctggaagaaaaagtgcttaacctcaagacacacatggaaaaagatatggttgaattaggaaaggtacaagaatataaaagcgaattggatgaacgggcaatgcaggctatcgagaaactcgaggagatccatctccaaaagcaggccgagtacgaaaagcagctggagcagctgaataaggacaataccgcgagcttaaaaaaaaaggaattgacactgaaagatgtggagtgtaagtttagcaaaatgaagaccgcttatgaggacgttactacagaactggaggaatacaaggaggcgttcgccgtcgccttgaaagcaaactccagtatgtccgagaaaattactaagtccgacaagaagatcgccgttattagcacgaagttgtttatggagaaggaacggatggagtatttcttgtccactctgcctatgcgccctgatcccgagctaccatgcgtagagaacctgaatagtatcgagctgaatagaaaatatattcccaagatggccatccggattccaacaagcaacccccaaaccagtaataattgcaaaaacagcctcactgaacttcttcttcgatgggctctggcacccatctactttctgctgtag

SEQ ID NO: 26695 - DNA, 1206 bp, Artificial Sequence
  Description of Artificial Sequence: Synthetic coding sequence
gagaaggagaaggcagagagggaggttattgtgcgtgaattccaggaagagttggtcgaccaccttaagaaattctctatgtccgagtccccacttgaggggaccagccactgtcatattaatttggacgagacctggaccagcaagaagaagctgttccaagttgagatacagccagaagagaagcacgaggagttcaggaaagtcttcgagctcatcagtctgctgaactacacagctgatcaaattcgtaaaaagaaccgggaactggaagaagaggctaccggctataagaaatgccttgaaatgaccattaacatgcttaacgcttttgccaacgaggacttttcgtgccatggtgacctaaacaccgatcagctgaagatggacatcctctttaagaaactgaaacaaaagtttgatgacctcatggcagagaaggaggcagtttcatctaagtgcgtcaacttggcaaaagacaacgaggtcctacaccaagaattgctatctatggggaaagttcaggaaaaatgcgagaagctcgagaaagacaagaagatgctggaagagaaggttctcaaccttaagacccatatggaaaaggacatggttgaattaggtaaggtgcaggaatataagtcggagctcgatgaaagagccatgcaggctatcgagaagctggaggagattcacctgcagaagcaggccgagtacgagaagcagctcgagcagcttaacaaggacaacacagcctcattgaaaaaaaaggagttgactctgaaggatgtcgaatgcaagtttagcaagatgaagacagcgtacgaagatgtgacaaccgagttagaagaatataaagaagctttcgcagtggctctgaaggcgaactcttcaatgagtgagaaaattaccaagagcgataaaaaaatcgccgttatcagcacaaagcttttcatggaaaaggagaggatggagtatttcttatctaccctcccgatgaggcctgatccagagctcccctgcgtcgagaacctgaactccatcgagctaaaccgaaaatacattcctaaaatggcgatccggatcccaactagcaatccccaaacatctaacaattgcaaaaacagcctcacagagatggaactagactgtgccgagcagatcattacagagaccaagaagtccatgctgcccaagtgcattaactag

SEQ ID NO: 26696 - DNA, 2472 bp, Artificial Sequence
  Description of Artificial Sequence: Synthetic coding sequence
atgaagttgttcggcttcggaagccggagaggacagacagcgcaaggctctatagaccacgtatacaccggctccgggtatcgaattcgcgatagcgagttgcagaaaatccatcgtgcagccgtaaaaggtgatgctgccgaagtcgagcgctgcctggcccggcgtagtggggacctcgacgcgttggacaagcagcatcggactgccttgcatctggcatgcgcgtcaggtcacgtccaagtggtgaccctcctggtcaacagaaagtgtcaaatcgacgtgtgcgataaggagaacagaactccactgatccaggcggtacattgtcaggaagaagcttgtgctgtgattctgctggagcatggagccaaccccaacctgaaagatatatacggaaatacagctctgcactacgccgtctatagcgaatcaacctctttggcagaaaagctgctgtcacatggagcccacatcgaagcccttgacaaggacaacaatactcctctgctcttcgctatcatttgtaagaaagagaagatggtagaatttctcctgaagagaaaggccagtagccacgcagtcgatagactgcgccgctccgccctaatgcttgccgtctactatgacagcccaggcatagtgaatatactgttaaaacagaatatcgatgttttcgcacaagatatgtgcggaagagacgcggaggactatgctataagccaccacctgaccaagattcagcaacagatcctcgagcacaaaaagaagatcctcaagaaggagaagtcggacgtaggctctagtgacgaaagtgcagtttcaatattccatgaactcagagtggactccctgcctgcatcagatgacaaagacctgaacgttgcgactaaacagtgtgtgcctgagaaagtgtctgagcccctgccaggatcatcccatgagaaaggcaataggattgtcaacggccagggtgagggacccccggcaaagcacccttctctgaagccatccactgaagtggaggatcccgctgtgaagggagccgtccagcgaaagaatgtacagacactgcgagcggaacaggcccttcctgtggcatctgaggaagaacaagaaagacacgagcggagcgaaaaaaagcagccccaggtgaaagagggcaacaacaccaacaaatcagagaagatccagctgtcagagaacatctgtgacagtacgtcgtctgctgccgccgggagactgactcagcagaggaagattggcaaaacttacccacagcagtttcccaaaaagctgaaggaagaacatgacagatgcacactaaagcaggaaaatgaagagaaaaccaatgtgaacatgttgtataagaagaaccgggaggaattggagcgcaaagagaagcaatacaaaaaggaggtcgaggctaagcagttagaacccactgtacaatctctggagatgaagtccaagactgccaggaacacccccaaccgcgatttccacaatcacgaagagatgaagggactgatggacgagaattgtatcttaaaagccgatattgccatcctgcgccaagaaatctgcaccatgaagaacgataacctagagaaggagaataaataccttaaagatatcaaaatcgtgaaagaaacaaatgccgctttggagaaatatatcaaactgaacgaggaaatgattacagagactgcattcagataccagcaagagttgaacgacttgaaggcagaaaacacccgcctgaacgctgagttattaaaagagaaggagtccaagaaacggcttgaggccgatatcgagtcttaccagtctcggctcgctgcagccatatccaaacattccgagagtgttaaaaccgagcgaaatcttaagctcgcgctggaaaggacccgagacgtctccgtgcaggtggaaatgagcagcgctatctcaaaggtgaaggatgagaatgagttcctgaccgaacagttgtctgaaactcagattaagttcaatgctctgaaggataagtttagaaagacacgggattcccttcgcaaaaagtccctggcccttgaaacggttcagaacgacctgagccaaactcagcagcaaacccaggagatgaaggagatgtaccaaaatgcggaggcaaaagtgaataattctactggaaaatggaactgtgtcgaggagagaatttgccatcttcagcgcgaaaatgcctggctggtacagcagctggatgacgtacaccagaaagaggatcataaggagatcgtgacaaatattcagagggggttcattgagtcgggcaagaaggacctggttcttgaggaaaaaagcaaaaagctgatgaatgagtgcgaccatctgaaggagagtctatttcaatacgagcgcgagaagaccgagggtgtggtatcgataaaagaggataaatactttcagacatcacgtaaaaagatctag

SEQ ID NO: 26697 - DNA, 2472 bp, Artificial Sequence
  Description of Artificial Sequence: Synthetic coding sequence
atgaagctgtttgggtttggcagtcgtagggggcagactgctcaggggtcaatcgaccacgtatacaccggctccggataccgtatacgggacagtgagctgcagaaaatacatagagctgcagtgaagggagatgccgctgaagtcgagcgctgtctggccagaaggtcgggcgacctcgacgccctggacaaacagcaccgaactgctctgcacctggcctgtgctagtgggcacgtacaggtagtgacccttcttgtgaacaggaagtgccagatcgacgtatgtgacaaggagaaccgaacaccactcattcaggccgtgcactgccaagaagaagcttgtgcagtgatcctcctcgaacatggagctaatcctaacttgaaggacatctatggaaatacggccttgcactatgctgtgtattccgagtcaacatcactagccgagaaactactctcccacggggctcacatagaagccttggacaaggacaataacacacctctcttattcgctattatatgtaagaaagaaaagatggtcgagttcctgcttaagaggaaagcctcctcgcacgccgttgataggctccgcaggagtgcgctaatgcttgcagtctattatgactcacctggaattgtcaacatactgctgaagcagaatatagacgtctttgctcaggacatgtgtggaagagatgctgaggattacgcaatcagtcatcacctgaccaagatacaacagcaaatcctggaacataagaagaaaatattaaaaaaggaaaagtctgacgtgggatctagtgacgagtccgcagtgtcgatttttcacgaactgcgagtcgattccctgcctgcgagtgacgacaaagatctgaatgtggccacaaagcagtgtgtccccgaaaaggtttccgagcccctgccaggaagctcccacgagaaaggcaaccgcattgtaaacgggcagggtgagggcccccccgctaaacacccgagcctgaagccttccactgaggtggaagaccccgctgtgaagggggccgtccaacggaagaacgtccagactctgagagctgagcaggctcttcccgtggccagtgaagaggaacaggagcgtcacgagaggtccgaaaagaaacagccccaggtgaaggagggaaataataccaacaagtccgaaaagatccagctctcagaaaatatttgcgacagcacatcctccgccgcagcgggacgcctgactcagcaaagaaagattggcaagacttaccctcagcagtttcctaaaaagttaaaggaggaacacgatagatgtaccctgaagcaggaaaacgaagagaaaacaaatgtaaatatgctctataaaaagaaccgcgaggagctggagcgaaaagaaaagcagtacaagaaggaagtagaggccaaacagctggaaccgaccgtgcagtcactggagatgaagtctaagacggccagaaatactcccaatcgagacttccataatcatgaggagatgaagggtctcatggatgaaaattgcatcctcaaagcggacatcgctatccttcgtcaggaaatttgtactatgaagaacgataatctcgaaaaggagaataagtacctgaaggatataaaaatcgtcaaggaaaccaacgctgccctggaaaaatacattaagctcaatgaggaaatgataacagagaccgctttcagataccaacaggagctcaactacttaaaagctgagaatactaggctgaacgccgagttgctgaaggagaaagagtcaaaaaagcgcctcgaggccgatatcgaatcttatcaatccaggctggccgccgccatcagcaaacattccgagagtgtgaaaactgagcgaaacttgaaactggccttagaacgcactagagatgtcagcgtgcaggttgagatgtccagtgccataagtaaggtcaaagacgaaaacgaattcctgacagaacagctgtcagagacgcaaattaaatttaacgccctgaaggacaagttcaggaaaacccgggattccttgagaaagaaaagtctagctctagaaaccgtccagaacgatctcagccagacccagcagcaaacccaggaaatgaaggaaatgtaccagaacgccgaggcaaaagtgaacaatagcacaggcaaatggaactgtgtggaggagcgcatttgccatctccagcgggaaaatgcctggctggtgcagcaactcgatgacgtgcatcagaaggaagatcacaaggagatcgtaactaacattcagcgtggatttattgagtccggcaaaaaggacctagtcttggaggagaagagtaaaaaactgatgaatgagtgtgatcacctcaaagaaagcctcttccagtatgagagggaaaagaccgagggcgtggtgtctatcaaagaggacaagtactttcagacctcccgcaagaccatttag

SEQ ID NO: 26698 - DNA, 2472 bp, Artificial Sequence
  Description of Artificial Sequence: Synthetic coding sequence
atgaagctatttggcttcgggtcaagaaggggtcagacggcccaggggagcatcgaccacgtctacacaggttctggataccgcattagagactcagaactgcagaagatacatcgtgctgcagtaaaaggcgatgccgcagaagtcgagcggtgcttggctagaaggtctggagagcttgatgcccttgataagcagcacaggactgccttacacttggcttgcgccagtgggcacgtacaggtcgtaacccttcttgttaataggaagtgccaaatagacgtctgcgataaggagaacagaacccccttgatccaagcggtgcattgtcaggaagaagcttgcgcagtcatcctcttggagcacggcgccaacccaaacttaaaggacatctatggaaacactgctctccattatgcggtgtattctgagtcgacgagcctcgcagaaaagctgttgtcccacggagcacatattgaagccctcgacaaagacaacaacacccctctcctattcgcaataatatgtaagaaggaaaaaatggtcgaattcctgctcaaaaagaaagcctcctcacacgcagtagatcgattaagaaggagtgctctcatgctggctgtctattacgactcaccagggattgtcaatattttgctgaagcagaacattgatgtctttgcccaggatatgtgtggaagagatgctgaggactatgcgattagccaccatttgaccaagatccagcagcaaatcctggaacacaagaagaaaatattgaaaaaagaaaagtcggatgtgggatcctctgacgagtctgctgtgtccatctttcatgagttacgtgtggattctctgcccgccagtgatgataaggatttgaatgtcgccaccaagcagtgtgtgccggagaaagtttccgagcctctccccggtagttcccatgaaaaagggaaccggatcgtcaacggacagggtgagggaccacccgccaagcaccctagtcttaaaccatctacggaagtggaagatccagctgtaaagggcgcggtgcagcggaagaacgttcagacactccgcgctgagcaggccctccctgttgccagcgaggaagaacagcagcggcacgaacggtcagagaagaaacagcctcaagtaaaggaagggaataatactaataaaagcgaaaaaattcagctaagcgagaacatctgcgatagtacatcaagcgcagctgctgggcgcctgacccagcagcgcaagattggcaagacgtacccccaacagtttccaaagaagctcaaggaggagcacgaccgatgtaccctgaagcaggaaaatgaagagaagactaatgtgaatatgctttataagaaaaaccgcgaagaactcgagcgtaaggaaaaacagtacaaaaaggaagtggaggccaaacagctggaaccgaccgtgcagtctttagagatgaaaagcaaaacagcccgtaacacacctaattgggactttcataaccatgaagagatgaaagggctgatggatgaaaattgcattctgaaagctgatatagccattctgcggcaggagatttgcactatgaagaacgacaatctcgaaaaggagaacaagtatttgaaggacatcaagatagtgaaggaaaccaacgctgctctggaaaagtacattaagctgaatgaagagatgattacagagaccgcatttcgttatcagcaagaactgaacgacttgaaagcagaaaacactcggctgaatgcggagctcctgaaagaaaaagaaagtaagaaacgcctggaggcggacatcgaaagctatcagtcacggttggccgcagctatatccaagcacagcgaatctgttaagacagagaggaatctcaagctagctttggaaagaacccaggatgtctccgtgcaggtggagatgtcctcagctataagcaaagtaaaagacgaaaatgagttcctgaccgagcaactgtccgaaacacagatcaaattcaacgcgctgaaggacaagttccgtaagacgagagatagtctgaggaaaaagtccttggccctcgaaactgttcagaacaatctctctcaaacacagcaacagactcaggagatgaaggagatgtaccaaaacgcagaagcaaaagtgaataattcgacaggaaagtggaattgcgtcgaggagcgcatatgtcatctgcagagagagaacgcctggctggtgcaacaacttgatgatgtacatcagaaagaagatcacaaggagatcgtgaccaatattcagcggggattcatcgaatcggggaagaaggattttgtcctggaagagaagagtaagaaactgatgaatgagtgtgaccaccttaaagaaagcctgtttcagtatgagcgcgaaaaaacagaagtcgtcgtgtccattaaggaggataagtacttccaaaccagcaggaagaaaatttag

SEQ ID NO: 26699 - DNA, 576 bp, Artificial Sequence
  Description of Artificial Sequence: Synthetic coding sequence
atgggcatcctgtatagcgagcctatctgtcaagctgcctatcagaacgacttcggccaggtgtggcggtgggtgaaggaagactcttcctatgccaatgtccaagatggatttaacggcgacacaccacttatttgcgcatgccgccggggtcacgtgagaatagtatccttcctcctgcgccgtaatgcgaatgtgaatctgaagaatcagaaggagcggacttgtctccactatgctgtcaagaaaaaattcaccttcatcgactatttgcttatcattttgctgatgcctgttctcctcattgggtacttccttatggttagcaaaaccaagcaaaacgaagctctggtgagaatgttgcttgatgccggagtagaagttaatgctacagactgctacggttgcacagccctccactatgcgtgcgagatgaaaaatcagagccttatccccttattgctcgaggcccgggccgacccaacaatcaaaaacaaacatggtgagagctcactggacattgcgcgaaggcttaagtttagtcaaattgagctgatgcttaggaaagctttgtag

SEQ ID NO: 26700 - DNA, 3711 bp, Artificial Sequence
  Description of Artificial Sequence: Synthetic coding sequence
atgcagccagctgcctgtgccggcgagggcgctggtccccctgccccacgtccacctcatcctcccggcgataaagttcgaagaggaagaggcggtgctccctctctgtctccacaaccacctgccccatatctgggactgcctatcccaagcaggggtggcgggggttggcgcggcggacaaggcggcggaggcgggacaagagagggcggcacagggagggccggtggtgcaggctcctctggatcagcccaaccaaggccaccagccgcccctagaggcccatcacgcccctccggcagaagactgctcctggaacccagagcccctcccgcgccacgcgcacctgacgccatgaagcagttatgcctttgtgcggctgcctcgttcgcaagccaggactggggcaaatcagatgaaaggctattgcaggccgttgagaacaacgacgcgccaagggtggcagccctgattgctagaaaaggattggtcccgaccaagctagatccggagggaaagagtgctttccatctggcggccatgcgtggcgcagcgtcatgcctcgaggttatgattgcccacggatctaatgtgatgtcagccgatggtgcgggctacaatgctctgcacttagctgccaagtatggccacccacaatgtctgaagcagctgctccaggcaagctgcgtggtagatgttgtggactcctcgggttggactgccctacaccacgcagctgccggcggatgtctcagctgttccgaggtgctctgcagctttaaggcacacttaaacccgcaagaccgcagcggagccacgcctttgatcattgcagcccaaatgtgccacaccgatctgtgtcgcctgttgctccaacagggtgcggcagctaacgaccaggacctgcaggggcggactgcactcatgctcgcctgcgaaggagcttcacccgaaacggtcgaggtgttgcttcaaggcggcgcccaacctgggataacagatgctctgggccaggacgctgcacactacggtgcattagctggagacaagctgatcctgcacctgctccaggaggcagcacagcgcccgtcacccccaagcgcgcttacagaagacgatagcggcgaagccagctcacagaattccatgtcaagccacggaaagcagggtgcgcctaaaaagagaaaggcacctccaccgccggcaagtatccccatgcccgacgaccgcgatgcatatgaggagatagtgcgtctgcgacaggaaaggggcaggctcctccagaagattcggggtctggaacagcacaaagagcgtcgtcagcaagaatccccagaagcatcatcactccatatcctggaaagacaggtgcaagagctccagcagctgctagtggaaagacaggaagagaaagagtctttaggcagggaggtagagtcccttcagagtcggctcagcctgctggaaaacgagcgcgaaaataccagctacgatgtgacaactctgcaagacgaagagggagagctgccagacctgcctggggcagaggtgctcctctctcgacagcttagcccgtcagctcaggagcaccttgcatctctccaggagcaggtggccgtgctcaccagacaaaatcaagaactcatggagaaagtgcagattctcgaaaattttgagaaggacgagactcagatggaggtcgaggctctggctgaggtaatcccactagcactttacgattccttgagggcagaatttgatcagttaagaagacaacatgccgaagccctgcaggccttacgccagcaggagacaagagaggtgccccgggaagagggggcagcctgtggggagagcgaggtcgcaggagccactgcaaccaaaaacggccccacccatatggagcttaacgggtccgtcgcccctgagactaaggtgaatggagccgagaccattgacgaggaggctgccggcgacgagaccatggaggctcggaccatggaggccgaggctactggagctgaagctactggtgctgaagctaccggcgctaaggtcaccgaaacaaagcctacaggcgcagaagtgagggagatggaaacgactgaggaggaggcgaatatggaaaccaaaccaactggggcgcaggccaccgatactgagacgactggggtcgaagctatgggcgtggaagccacaaaaacaaaagcagaagaggcggagatgcaggcttatggggtgggagctggccaggccgaacctccagtgaccggcacaacaaatatggaagcaacaggatcacgcgccacagggatggaaagcactggggtgtcagccaccggagttgaaaatccaggtgtcgaagccaccgtgccagggatctcagctggtccaatattgcatcccggtgccgccgaagctagtgagaaactgcaggtggagctcgaaacacgtattagaggactggaggaggcccttcggcaacgggagcgcgaggcagcagctgaacttgaagctgccttaggaaaatgcgaagccgctgaagcggaggccggcagactacgggagcgcgtccgggaggccgagggctcaggggcctcaggcggcggtggaggcgatactacccaactccgcgccgccctggaacaagcccgtgaagacctacgagaccgcgacagtaggttgagggagctggaagcagcaagtgcctgtctggacgaagcacgggcttcacggctgctcgcagaggaagaagcccgcggcctcagagcagagttggcccagagggaggaagcacgcctggagcagagtcgcgagctggaagtgctcagagagcaactggccactgctagggctacaggggagcagcagcgcaccgccgctgctgagctgggccgcgccagagatgccgccgaagccagggtggctgaactgcctgccgcatgtgaggaggcccggcagggtctcgctgaactgagagaagcatcagaggcactacgccagagcgtggtaccagctagtgaacaccggaggctgcaagaagaagccctggagctgagaggcagagcagcatctctggaacaggaggtagtagctacaggcaaggaggctgcacgactgcgtgccgagcttgagcgggagcgggtgtgtagcgttgcgctgtccgagcatgagagaatcgttgggaccctgcaggcaaacgtcgctcaattggagggccagctcgaggagctcgggagacgccacgagaaaacaagcgctgaagtttttcaggtgcagcgtgaagcactgttcatgaagagtgaaagacatgccgccgaggcacaactagccacagcagaacagcaattaagaggtcttagaaccgaggcggaacgggcgcgacaggcccagtcaagagcccaggaggccctcgataaggcaaaagagaaagacaagaagatcactgagctctcaaaagaggtgtttaacttgaaagaggctttgaaagaacagcccgccgctctagctacacccgaagtggaggcccttcgggatcaggtgaaggacctccagcagcagcttcaagaggccgcccgagaccatagctctgttgttgcactatacagatcccacctgttgtacgcaatccaagggcaaatggatgaagatgtgcagcgaatactctcacaaatactccagatgcagcgactccaggcccaggggagatag

SEQ ID NO: 26701 - DNA, 3441 bp, Artificial Sequence
  Description of Artificial Sequence: Synthetic coding sequence
atgaagactctacgggcccgatttaaaaaaaccgaactaaggctgagtcccacagatctcggcagctgtccaccctgtggcccatgccctattcctaagccagcagcgcgggggcgaaggcagtcacaagactggggaaagtctgacgaacgcctccttcaggcagtcgagaataatgatgcacccagggtggcggccttgatagctcggaaaggtctggtccccactaaattggacccagagggaaaaagcgctttccatttggcagccatgaggggagcagcgagttgccttgaggttatgattgcccatgggtccaacgttatgtccgccgacggagccgggtataacgcgctgcacctggcggcaaagtacggacacccacagtgtctcaagcaactgcttcaggcctcctgtgtggtcgacgtggtagactcctccgggtggaccgcccttcaccatgccgctgccggaggatgcttgtcttgttccgaagttttgtgtagcttcaaggcccacttgaatccccaggaccgaagcggagcaacccctctcataatcgccgctcaaatgtgccacactgatctttgcagattgttgcttcagcagggggcggcagctaatgaccaggatcttcaaggcaggaccgcgttaatgctcgcttgcgagggggcatcaccagagacagtcgaggtactgctgcagggtggcgctcagccgggaattaccgatgctctggggcaggatgctgcccattatggtgccctagcgggagacaagctgattttgcatctgctgcaagaagcagcacagagaccctcgccacccagcgcgctaaccgaggacgactctggcgaagcctcgtctcagaactccatgtccagtcacggaaaacagggggcgcctaagaagcgaaaggcccctccgcctcccgcctctatcccaatgcctgatgaccgcgatgcttacgaggagatagtgcgtttacgacaagaacggggacggctccttcaaaaaatccgggggctcgaacaacataaagagcgacgccaacaggaaagtccggaagcctcctctctacacatattggaacgccaggtccaggaactccagcagctgttggtggaaagacaagaggaaaaggagtccctggggagagaggtggaatccctacagagtcgactgtccttgctggagaatgaacgggaaaatacctcatatgatgttactaccttacaggatgaagagggtgagctcccagacttacctggcgccgaagttcttctttcacgccagctttccccaagcgcacaggaacatctggcctccttgcaggagcaggtggctgtactgacacggcagaatcaagaactgatggagaaggttcagatcttggagaacttcgaaaaggatgagactcaaatggaggtcgaggccttagctgaagtcatcccactggccctgtacgattcccttcgcgccgagttcgaccaactgagaagacagcacgctgaagcgttacaggctctcaggcagcaggaaactcgcgaagttcctcgagaggagggggccgcgtgcggcgagtcagaggtcgcaggagctaccgccaccaaaaatggacccacccatatggagctgaatgggagcgtagctcctgagaccaaggtgaacggtgctgaaaccatagatgaggaggccgctggcgacgagaccatggaggcacggactatggaggctgaggcaaccggggctgaagcgacgggagccgaagctaccggcgccaaagttactgagaccaaacctacaggtgctgaagttcgagagatggaaacgacagaggaggaggcgaatatggaaactaaaccgacgggagctcaggctactgacactgagacaaccggggtggaggctatgggcgttgaggcaacgaaaaccaaggcagaggaggccgagatgcaggcctatggggtaggggctgggcaggccgagcctcctgtgaccggcactaccaacatggaagccactgggtcaagagcaaccgggatggaatccaccggtgtctctgctaccggggttgagaatcctggggttgaagccactgttccaggaatcagcgccggaccgattttgcatcctggcgccgctgaggctagcgagaagctccaggttgaattggaaactagaattcgcgggttagaggaggctctccgccagcgtgagcgcgaggctgcagctgagttggaggccgctctcggtaagtgcgaagcggctgaggctgaggccggtagactcagggagagggtccgagaggcagagggatccggagcctctgggggaggaggaggagatacgacccagctgagggcagccctagagcaggctagggaggatctgcgcgacagggattctcgcctccgggagcttgaggctgcttctgcctgcctcgatgaggcccgagccagccgactcctggcagaagaggaggcgcgcggcctgcgagcagaactggctcaaagggaagaggcacgactcgaacagagtcgagagctggaggtgctcagagaacaactggccaccgcacgtgctacaggcgaacaacagcgaaccgccgccgctgagctaggtcgagcaagagacgccgccgaggccagggtggccgagcttccagctgcatgcgaggaagcgaggcaaggcttggcagagctccgcgaagcgtccgaggctcttcggcagtcggtggtccccgctagcgaacaccgtcggctgcaagaggaagctctcgagctgagggggcgagcggcttcactggagcaagaggttgtagcaactggcaaggaggcagctcgactgcgggccgaactggaaagggagcgggtgtgttctgttgcactaagtgaacatgagcggatcgttgggacgttgcaagctaacgttgcccagttggagggccagctagaggagctcgggcggaggcatgaaaagacctccgccgaagtgtttcaagtgcaaagggaggcactcttcatgaaatccgaaaggcatgcagcggaagctcaattagcaactgccgagcaacagctgagaggcctccgaacggaagccgagagggctcggcaggcccaatctcgggcgcaggaggccctggacaaagcgaaagagaaggataaaaagatcactgaactcagtaaggaagtgtttaatcttaaagaggctctaaaggagcagcccgcggcactggctacccccgaggtggaggccctgcgtgaccaggtgaaggacctccagcaacagctgcaggaggcagctagggatcacagtagcgttgtggccctgtaccggtctcatcttctgtatgccattcaaggacaaatggatgaagacgtgcagcggatcctctctcagatactccagatgcagcgactgcaggcccagggacggtag

SEQ ID NO: 26702 - DNA, 3441 bp, Artificial Sequence
  Description of Artificial Sequence: Synthetic coding sequence
atgaagaccctcagagcccggttcaagaagacagagctgcggctgtctccaacagacctggggtcttgccccccctgcggcccctgtcccattccaaaacccgccgccaggggcagacgacagtcccaagattggggtaaaagcgatgaacggttactccaggccgtcgagaataacgacgctccccgcgttgccgcacttatcgctcggaaaggcctcgtgcccaccaagctggatcccgaaggtaagtccgcgtttcatctagcagcaatgagaggcgcagcttcttgtctcgaagtgatgattgcccacggatctaacgtcatgagcgcagacggagccgggtacaatgcacttcacctggccgctaagtatgggcatccccagtgcctgaaacagctcctgcaggctagctgcgtggtggacgtggtggactcctctggctggacggccctgcaccatgctgctgctggtgggtgcctgtcctgttccgaagttctctgcagcttcaaggcacacctcaatccacaggaccggtcaggtgcgacccccctgattatcgccgcacaaatgtgtcatactgacctttgtcgcctcttgctgcaacaaggcgctgccgcaaacgaccaggatctacaggggagaacagccctgatgctggcatgcgaaggtgcctctccagagacagtcgaggtgctgctgcagggaggagcacaaccaggcatcactgacgccctgggacaagatgccgcccactatggggcgctggcaggcgacaagctgatcctccatttgctacaagaggctgctcaacgcccctccccaccaagcgccctgacagaggatgactccggtgaggcctcctcccagaactcaatgtcctcacacggcaaacaaggagcccccaaaaagcggaaagctcctccccctccagcatccatccccatgcccgacgatagagacgcatatgaagagatagtccgactgcggcaggagcgaggacgtttgctgcagaaaatacggggtttagaacagcataaagaaaggcggcagcaggaatctccagaggcttctagtcttcacatcctggaacggcaggtgcaggagcttcagcagctgctcgtcgaacggcaagaagagaaagaaagtcttggaagagaggttgaatcactgcagtcacgactgagcctgctcgaaaacgaacgagagaatacatcatatgacgtgacgactctgcaagacgaagaaggtgaactcccggacctgccaggtgcagaagttctcttatctaggcaacttagcccctccgctcaagagcacctggcatccttgcaagagcaggtcgccgtcctcactagacagaaccaggagttgatggaaaaagttcaaatcctggagaactttgagaaagacgaaacccagatggaagtggaggctcttgcagaggtcatccctttggccttgtatgacagcctccgcgcagaatttgaccagctgagacgccagcacgctgaggctctccaggcacttcgccagcaggaaactagggaagtgccacgggaagagggcgcagcatgcggtgaatccgaggttgcaggcgcaacggccaccaagaatggccccacacatatggagctcaatggatcagtcgcccctgagacaaaagtgaatggagcagagacgattgacgaggaagctgccggcgacgaaaccatggaagcacggactatggaagcagaggcgaccggcgcggaagctacaggagcagaagcgaccggcgcaaaggtgacggagaccaaacccacaggagccgaggtcagggaaatggaaaccactgaggaggaagccaacatggaaactaaacccaccggggctcaggctaccgacaccgaaacaactggggtcgaagctatgggggtcgaagctacaaaaaccaaggccgaagaggccgagatgcaggcttacggcgtgggggcaggtcaagccgagcctcctgttactggaaccactaacatggaggcgaccggtagccgggccaccggtatggaatccacaggcgtatccgccaccggtgtggaaaatccaggagtagaagccaccgtgccaggtataagcgcagggcctatactgcatccaggggctgcggaagcatcagaaaaactgcaggttgaactcgagactcgcatcagggggctggaagaggccctcaggcagcgggagagagaggctgccgccgagctagaagcagctttgggaaagtgtgaggcagccgaggccgaagccgggcgactgcgcgagagagtccgggaggcagagggcagtggggcgtccggcgggggaggcggggacaccacacaactgagggccgctctggaacaggccagagaggacctccgcgatcgcgactcacgcctgagagaactggaagcggcgtctgcctgtcttgacgaggctcgggcatccagactgcttgcggaagaagaggctagaggcctgagggctgaactggcccaaagagaggaagcccgattggagcagtccagggagctggaagtcctgagggagcagttggcaactgcaagggccacgggtgaacaacagcgaacagctgctgctgaactgggccgggcgagagatgctgctgaagcccgagtcgctgaactgccagctgcttgcgaagaagccagacagggactggctgagcttagagaagcctccgaggccctcagacagtcagtcgtgcccgcttccgagcacagacggcttcaggaggaggccctcgagctgcggggccgggctgcatccctggaacaggaagttgtggcaaccggaaaggaggcggccagactcagagcagaacttgagcgcgagagggtgtgcagcgtggccctctctgagcacgaacgcatcgtcggaacattgcaggctaacgtggcccagttagaaggtcagctcgaagaattaggacggaggcatgagaaaacaagcgccgaagtttttcaggtccagagggaagctctctttatgaaatccgagcgtcatgcagccgaggcccagctcgcgacggccgagcagcagctgcgcggactcaggactgaggcagaacgggcacggcaggctcagagtcgagctcaggaggccctggataaggcgaaggaaaaggacaagaagattactgaactgagtaaagaggttttcaatctgaaggaggccctgaaggagcaaccggccgcactggccacgcccgaagtggaggctctgagagaccaagtgaaggacctgcagcagcagctgcaggaggctgctcgggaccacagtagcgtggtggctctctacaggtcacacctcttgtatgctatccaaggccagatggatgaggatgtgcaacgaattctctcacagattctgcagatgcagaggctgcaggctcaagggaggtag

SEQ ID NO: 26703 - DNA, 807 bp, Artificial Sequence
  Description of Artificial Sequence: Synthetic coding sequence
atggaagaaaacagtttccagaaggaaaccccattagctaatgctgccttttgggctgcccgcagaggaaatctggccctgctcaaactgctgctcaattccggcagggttgacgtggactgtcgcgacagccacggaacaacactactcatggtcgccgcgtatgctgggcatatcgactgcgtccgcgaactcgtgctgcagggtgcagacattaacctgcaaagagaaagtggaactactgccctgtttttcgccgcccagcagggccacaatgacgtagtgaggttcctttttggtttcggcgcctccacagagtttcgaacaaaggacgggggcacagcactgctcgcggcgtctcagtacggtcacatgcaggtggtggaaacattgttgaagcatggcgccaacatccacgaccagctctatgacggcgcgacagctttgtttttggccgcacaagggggatatctggacgtcatacggctcctcttagcctcgggcgcaaaggtgaatcagccaagacaggatgggaccgcgcctctgtggattgctagccagatggggcattctgaggtggtcagagtgatgcttcttcgcggagctgaccgggacgccgcccggaacgatggcacaactgccctgctgaaagccgccaacaaaggctataacgacgtcatcaaagaattgcttaaattctcccccacgctaggcattctgaaggctaacgagttaccagccgaacttacaaagaacgagcgcattctcagactcctaagatccaaagagggtcctaggaagagctag

SEQ ID NO: 26704 - DNA, 906 bp, Artificial Sequence
  Description of Artificial Sequence: Synthetic coding sequence
atgtgccggatgtctttcaagaaagagacccctctggctaatgcagcattctgggccgctcgtagaggaaatctggcgctgctgaaactgctcctcaatagcggaagggtcgacgtcgactgcagggacagccatggaacaacccttctgatggtcgctgcctatgctggccacatcgattgtgtccgagaactggtcctgcaaggggcagatataaatctccagagagaaagcgggactaccgcactcttttttgctgcccagcaggggcacaatgacgttgtccgcttcttattcgggttcggcgcatctaccgaatttcgcactaaagacggcgggactgcactgcttgcagcatctcagtacggccacatgcaggtggtggagacattacttaagcacggcgctaacattcacgaccaactgtatgatggagctaccgccttgttcctggccgcccaaggcggatatctagatgtcatacgtctgctgctggcatcaggggctaaggtgaaccagcctaggcaggatggcaccgccccactgtggattgccagccagatgggacactctgaagttgtgagggttatgcttctaaggggcgccgacagagacgctgctcgaaacgatggaactaccgctctgctgaaggctgccaacaagggatacaatgatgtgataaaggagctcctgaaattttcccccactctcggaattctcaagaacggaacatcagctctgcacgctgccgttctcagcgggaatataaagaccgtcgccctcctactagaagccggggccgaccctagtctgagaaataaggcgaacgaactgccggccgaattgactaagaacgagcgaattctgcgactgcttcggtcaaaggagggtccaaggaaaagttag

SEQ ID NO: 26705 - DNA, 906 bp, Artificial Sequence
  Description of Artificial Sequence: Synthetic coding sequence
atgtgcaggatgtcttttaagaaggaaacccctctggccaacgcggcgttttgggctgctagaagagggaatctggcccttttgaaactactcctgaattcgggtagagtggatgtcgactgcagggacagccatggcaccacactgctcatggtcgctgcttacgcgggtcatatcgattgtgtgcgcgagcttgtcttgcaaggtgccgacatcaacctccagcgggaaagtggaacgacagcacttttctttgccgcgcagcagggtcataatgacgtggttcgcttcctgtttggatttggcgctagcaccgaatttaggacaaaagacggtggcacagccctgctggcagcttcgcagtacggccacatgcaagtggtagaaacacttttgaaacacggggccaacattcacgaccagctctacgacggagctacggctctgttcttagccgcacaggggggataccttgacgtaatccgcttgctcctagcaagcggcgcaaaggttaatcagcctaggcaggacggcactgcacctttgtggatcgcatcacagatggggcactccgaggtcgtgcgcgtcatgttactgcggggtgctgatcgggacgcggctcggaatgacggcacaaccgcactcctgaaggctgccaacaaggggtataacgatgtgattaaagaattgttaaagttctctcccacccttggaatcctgaagaatgggacctccgctcttcatgccgctgtgttatcgggaaacattaagaccgtagcccttcttcttgaggccggcgccgacccatctttgcgcaacaaagcaaacgaacttcctgcagagctgactaaaaatgaaagaattttacgcttgctgaggagcaaggagggcccccggaagagctag

SEQ ID NO: 26706 - DNA, 2439 bp, Artificial Sequence
  Description of Artificial Sequence: Synthetic coding sequence
ccctgtaaaaccttgctgcaaaacgatgtgtgcctgcctaaggcgacccaccagaaggaattcgacacattaagcggaaagttggaggtctatttttgccctatcggaatgctgactaatacaaaaacccaaaagacacccaagcctagcgtcattccatttcagagcaaacacgactttcttctcgagtcaccagataaggatggtttacttaaaccaacctgtgggagaaaggtctccctgcctaacaaggcgctcgagctgaaggatcgtgagactctgaaagcggagtccccggataaggatgggttgctgaagcctacctgtgtgcggaaggtgagcctccccaacaaggctttggaactgaaggacagagagacactcaaagccgcacaaatgttcccaagtgaatctaagcagaaagatgatgaagaaaattcctgggactttgagtcctttcttgaagccttgttacagaacgacgggtgtctgcccaaagccacacatcagaaagaattcgatacactgagtgggaagcttgaggagagtccggataaagacggcttgttgaagccaacatgcggaatgaaaatcagcctgcccaataaggccctggagttaaaggaccgtgagacctttaaagccgaggacgtctcatccgttgagagcacgtttagcttatttggtaagcctacaaccgagaacagtcaatccaccaaagtggaagaggacttcaacctcactacaaaggaaggagccaccaaaaccgtcaccggccagcaagagcgcgacattggaataattgagcgggcaccacaggaccagaccaacaaaatgccaacatcagagttgggacggaaagaggatacaaaaagcacctccgattcggaaattattagtgtttcggacacgcaaaactacgaatgtctcccagaagccacatatcaaaaagaaattaagaccacaaacgggaaaatagaggaaagtccggaaaagcctagccatttcgaaccagcgacagaaatgcaaaattctgtgcctaataaggggctcgaatggaagaataagcagaccctccgagccgattctacaacactgagtaaaatcctggatgcactcccctcgtgcgagagaggccgcgaactgaagaaggacaactgcgagcagattactgcaaaaatggagcagaccaagaacaaattttgtgtgttgcaaaaggagctttcggaggctaaagagattaaaagtcagctcgagaaccagaaggctaaatgggaacaggagctgtgctcggttcgtctgacccttaaccaggaagaggagaagcgccggaacgtcgatattctgaaagaaaagattcgccctgaggaacaattacgtaaaaaactggaggtgaagcagcaactggaacagaccttacgcatacaggacatcgagctgaagagcgtgacctcaaatctcaatcaagtgagccacacacatgaaagcgaaaacgatctgtttcacgaaaattgcatgctgaagaaagagattgccatgttgaaactggaggtggccacattgaagcatcagcatcaggtgaaggaaaataagtactttgaggacattaagatattacaagagaaaaatgcggagctccagatgacgctgaaactaaagcagaagaccgtcactaaacgggcaagccagtaccgcgagcagctaaaagtcttgacagcagagaatactatgctgacttctaagctgaaagaaaagcaagacaaggaaattctcgagaccgagatcgagagtcatcacccgaggctggcatcagctttacaggatcacgatcagtccgtaacttcgagaaaaaaccaggagctcgcattccactcagccggcgatgcccctttgcagggaataatgaacgtggatgtgtcgaacacaatctacaacaatgaggtcctgcatcagcccctatatgaagcacagcggaagagtaaatcccccaaaataaaccttaattatgccggcgatgatctcagagaaaacgccctcgtgtcagaacatgcccaacgagacagatgtgagacacaatgccagatgaaaaaggccgagcacatgtatcaaaatgagcaggacaacgttgataaacacactgaacagcaggagtctttggaacagaagctgtttcagttggagtcaaagaacaggtggctgagacagcaattggtatacgcccacaaaaaggtgaacaaatctaaggtcactatcaacatccagttccccgaaatgaagatgcagcggcacctgaatgagaaaaacgaggaagtcttcaactatggcaatcatctgaaggagcggattgaccagtacgagaaggaaaaagccgagagagaagtgtcaattaagaaatataaatacttcagtaacttcctcaaggagtctggactcgggtag

SEQ ID NO: 26707 - DNA, 2361 bp, Artificial Sequence
  Description of Artificial Sequence: Synthetic coding sequence
aatgcttgggatttgaactcattcctcgagaccctgctgcagaacgatgtctgtttacccaaagcaacccatcagaaggaattcgataccctttccgggaagctcgaagaatctccggataaggacgggctgctgaaaccgacctgtggtcgtaaggttagtctcccaaataaggcactggaactaaaggaccgggaaaccttaaaagctgagagccccgacaaggacggcctgctgaagccaacctgtgtgcgtaaggtgtcccttccaaacaaagccctggaactgaaggacagggagactttgaaggctgcacagatgttcccctcagaatctaaacagaaagacgacgaggagaatagctgggatttcgagagcttcctggaggccctcctacagaatgacgggtgcttacctaaagcaacccaccagaaagaattcgacactttgtccgggaagctcgaagagtctccagacaaggacggcctccttaagcctacatgcggcatgaaaatatccttgcccaacaaggctctggagttaaaggacagggaaacctttaaggcagaagacgtgtcgagcgtggagtcaaccttttctctgtttgggaagcctaccacggagaactcccagagtaccaaagtcgaggaggactttaaccttaccacaaaggaaggtgcgaccaaaactgttacaggtcagcaggaaagagatatcggcatcattgaaagagctccacaggatcagaccaacaaaatgcctacatcggaactggggaggaaagaggacaccaagtcaacgagtgactccgagattatctccgtatcagatactcagaattacgaatgcctgccagaagctacataccagaaggagataaaaacgacaaacggtaaaattgaagagtctcccgaaaaacctagccacttcgaaccagctacggagatgcagaacagtgtgccaaacaaaggtctggaatggaaaaataagcagactctgcgcgctgactctacaactctgtccaagatccttgatgcactccccagttgcgagcggggacgcgaactgaagaaagacaattgtgagcagatcaccgcgaaaatggaacagaccaagaacaagttttgtgtgctccaaaaagagctgagtgaagctaaagagataaagtcacagctcgagaaccagaaagctaagtgggagcaggaactatgcagcgtgcgccttaccctgaaccaagaagaggagaaaagaagaaacgtagatattttaaaagagaagatacgccctgaagaacagctgcgcaaaaaacttgaggtgaaacagcagctggagcaaacattgaggatccaggacattgagcttaaatccgtcaccagtaaccttaatcaggtttcgcacacgcatgaatcggaaaacgatctattccacgagaattgcatgctcaagaaggaaatagccatgcttaaattggaagtcgcaaccctgaagcatcagcaccaagtgaaggaaaacaagtatttcgaggacattaagattttgcaggaaaaaaacgccgagttacagatgaccctgaagcttaagcaaaagacagtgactaagcgggcatctcagtaccgggagcagttaaaagtgctaaccgccgagaacaccatgcttacctcgaaactgaaggagaagcaagacaaagagatcctggaaaccgagatcgaaagtcaccacccgaggttggcgagcgctctccaagatcacgaccagtccgtaacatccagaaaaaaccaggagctagcctttcactctgcaggggatgctccactacagggaattatgaatgtggatgtgagcaacactatctacaacaatgaggtgctacaccagccgctttacgaggcccagaggaaatctaaatcacctaaaataaatcttaattatgcaggcgatgatctgagggagaatgcactcgtgagtgagcatgcgcagagggaccgttgtgagactcagtgtcagatgaaaaaagctgaacacatgtatcagaacgaacaagacaacgtcgacaaacacacagaacaacaggagagcctcgagcaaaagctgttccaactggagtcaaagaaccggtggctcagacaacagctggtatatgcccacaaaaaagtgaacaaatcaaaagtgaccatcaatattcaattccctgaaatgaaaatgcagcgacatctcaatgaaaagaatgaggaggtgtttaattatggtaaccaccttaaggagcgaatagaccagtatgaaaaagagaaagccgaacgcgaggtctcaataaagaagtataagtacttttcaaatttcctcaaagaaagcggattgggatag

SEQ ID NO: 26708 - DNA, 4179 bp, Artificial Sequence
  Description of Artificial Sequence: Synthetic coding sequence
atgaagcgcttgcttgccgccgcaggcaaaggcgtgcgggggcccgagcccccaaacccattttcagaaagggtgtacacggaaaaggactatggcaccatctatttcggggatctcggaaagatacacaccgctgcatcgcgtggacaagtacagaagttggagaaaatgaccgtgggcaaaaaaccagtcaatctcaacaaaagggatatgaagaagcggaccgcattgcactgggcctgcgtgaatggacacgctgaggtggtgacgttcctagtggatcgcaaatgccagctaaacgtcctggatggcgagggtcgcaccccattgatgaaggcgttacaatgtgagagagaggcttgcgccaacattttgatcgacgccggtgctgacctgaactacgttgacgtctacgggaacactgccctgcactacgctgtgtatagtgagaacctcttaatggtggccacgctgttgtcgtatggtgccgtaatcgaagtacaaaacaaagccagcttaacaccactcctgctggccatacaaaagcgttcaaagcagacagtcgaatttctcctcactaagaacgcgaatgcaaacgcgttcaatgagagcaagtgtacagcattaatgctagccatttgcgaaggatcttccgagattgttggaatgctattacagcaaaatgtcgatgtattcgctgaggatatccatgggatcacagcagaacggtatgctgctgcctgcggggtcaattacatccaccagcagctgctggagcatattagaaaactgccaaagaaccctcaaaatacaaaccccgagggtaccagcacaggcacccctgatgaggccgccccgctggccgaaaggacgcccgatacggcagaaagccttctcgagaagactcccgatgaggcagctcggcttgtggaaggcacttcagccaaaattcagtgcttgggtaaagcaacgtctgggaagtttgaacaatcgaccgaggagacacctaggaagatcttaagacccacaaaagagacatccgagaagtttagttggcccgccaaagaaagaagtagaaagattacatgggaggagaaggagacatccgttaaaacagagtgcgtggcgggagtaaccccaaacaagacggaagttctggaaaagggcacgtctaatatgatagcatgtccaacaaaagagacctcaaccaaggccagtactaacgtagatgtgagctccgtggaaccaattttctccctgttcggcacacgtacaatcgaaaactcccaatgtactaaagtcgaggaggatttcaacctcgcaaccaagataatatcaaagtctgctgcccagaactacacctgcctgcccgacgctacctatcagaaagacatcaaaaccattaatcataagatagaggaccaaatgttccccagcgagtcgaagagggaggaggatgaagagtattcctgggacagcggcagtctgtttgaatcttccgcgaagactcaggtgtgcatcccagagtcaatgtaccagaaggtcatggaaattaaccgtgaggtcgaagagctccctgagaagcctagcgccttcaagcctgccgtggagatgcagaagactgtacccaataaggcctttgaactgaaaaacgagcagacactgagagccgcacagatgttcccttcggagtccaagcagaaggatgacgaggagaacagctgggatagtgaatctccgtgtgagacggtctcacagaaggatgtctacctcccaaaagctacacaccagaaagagtttgatacgttaagcggcaagctcgaggagagtcctgtgaaagacggcttgctcaagcccacctgcggtcgaaaagtttcccttcctaacaaggctctcgaactgaaagacagagagacattcaaagcagagagccccgataaagatggcctgctcaaacctacatgcggaagaaaagttagcttgccaaacaaagccctcgaacttaaagacagagagacccttaaagccgagagtccagataatgacgggctcttgaaacctacatgcggtcggaaagtaagcctacccaacaaggctctggagctgaaagatcgggagactttcaaggccgcacaaatgtttccaagtgagagcaaacagaaggatgatgaagagaacagctgggattttgagagttttctcgagacactcttgcagaacgatgtgtgtttaccgaaggctacccaccagaaagaattcgacacactgagcggaaagctcgaagagtcccccgataaagacgggctgctgaagcccacttgcggaatgaagatttcactgcccaacaaggccctggagctgaaagatagagagacattcaaggcggaggacgtttccagcgtggaatccaccttctccttatttggtaagcccactacggaaaatagtcagagcaccaaggtggaagaagacttcaacctgactactaaagaaggggccacgaaaacagtgactggccagcaagagagggacatcggaatcattgaacgcgccccgcaggaccagactaacaaaatgcctacgtccgaactaggtagaaaggaggataccaaatctacaagcgacagcgaaatcatttccgtttcagacacccagaattacgaatgcctcccagaggctacatatcagaaagagattaaaacgacgaatggcaaaatcgaagaatctccagagaaaccatcccactttgaacccgctactgaaatgcagaactccgttcccaataagggtctggaatggaagaacaagcagacactcagggctgactccacaaccctgtcgaaaatcctggatgccttaccttcgtgcgaaaggggtagggagctgaaaaaggataactgcgagcaaatcacggcgaagatggaacagacaaaaaataagttctgtgtgctgcagaaggagttgtccgaggccaaagaaatcaagtctcaattagaaaaccaaaaagcaaagtgggaacaggaactgtgcagcgtgaggctgaccctgaaccaggaagaggaaaaacgcagaaatgttgacatcctgaaagagaagatccggcctgaagaacagctccggaagaaattggaggtcaaacagcagcttgagcagaccctgcgaattcaagacatcgagcttaagagcgtgacctcaaatctgaatcaagtcagccacacacacgagagcgagaacgacttatttcatgaaaactgcatgctgaaaaaggaaattgccatgttgaaactggaagtcgcgacactcaagcaccaacaccaggtaaaagaaaataaatacttcgaagacatcaagattctgcaggaaaagaatgcagaattacagatgaccctgaagctcaagcagaagaccgtgacaaaacgggccagccaatacagggaacagctcaaggtgttgacagccgaaaacacaatgctgacctcaaaactcaaagaaaaacaggataaagagattctggaaacagagattgaaagccaccatcctaggcttgcttcagctctgcaggatcatgatcaatcagtgacgagtaggaagaatcaagagctggcctttcactctgctggagacgcgcctttacagggaataatgaacgttgacgtcagcaacactatttataataatgaggttcttcaccaacctctgtacgaggcccagcggaaaagcaaatccccaaagataaatctaaattatgcgggtgatgacctgagagagaacgccctcgtgagcgagcacgcacaacgggatcgatgcgagacacagtgccagatgaagaaggccgaacacatgtaccagaatgagcaggacaacgtcgataaacacaccgaacagcaggagagtctggagcagaagctcttccagctcgagtccaaaaatagatggcttcgccagcagttagtgtacgcacataaaaaggtcaataagtcaaaagttacaatcaacatccagttccctgagatgaagatgcagagacatctgaacgagaagaacgaggaagtcttcaattatggtaaccacttaaaagagagaatcgaccagtatgagaaagagaaagccgaacgggaggttagcataaagaaatacaagtatttctccaacttcctgaaggagtcgggactgggctag

SEQ ID NO: 26709 - DNA, 1860 bp, Artificial Sequence
  Description of Artificial Sequence: Synthetic coding sequence
atgaagagacttctcgcggccgcggggaagggcgtgagagggcctgagcctccgaatcccttctctgagcgggtatataccgagaaggactacggtactatttacttcggagatctcggaaaaatccatactgccgcctctcgaggacaagtccaaaagctggagaagatgacagtggggaaaaagcctgtcaatctgaacaaacgcgacatgaagaagagaactgccctccattgggcttgtgtgaacggccacgccgaagtcgtgacttttctggtggatcggaagtgtcagctgaatgtactagatggcgagggacgcactccgctcatgaaagcacttcagtgcgagcgcgaagcgtgcgcaaatattctcatcgatgccggggccgacctcaattatgtagatgtttacggcaacacggcccttcactatgctgtgtactcggagaatctactgatggtggcgactttgctcagttacggggccgtgatcgaagtacagaataaggccagtctcacccccttactcctggctatccaaaaacggagtaagcagaccgtagaattcctcctgacaaagaacgccaacgctaacgcgttcaacgagagtaaatgcactgcattaatgctcgccatctgcgaaggatcgagcgaaatcgtcgggatgctgcttcagcagaatgtggacgtctttgctgaggatatccatggcatcacagcagagagatatgccgcagcttgcggagttaactacattcaccagcagctgctggaacatattaggaagctgcctaaaaacccccagaacaccaaccctgaaggtacgagcaccggtacaccggatgaagcagctcccctggcagagcggaccccagatacggcagagtcactgctggagaagacccctgacgaggcagccagattggttgagggcacaagcgctaagatccagtgcctcggtaaagctacttcaggcaagttcgaacaatcaacagaggagacaccccgcaaaattctgaggccaaccaaggaaacctctgagaagttctcctggcctgccaaggaacggtccagaaagatcacctgggaagagaaagagacaagtgtcaaaaccgaatgcgttgccggcgttacgccaaacaagacggaggtgttagagaaagggaccagcaatatgatcgcttgtcccacaaaggaaacatcaaccaaggcttctactaatgtagatgtctcttccgtggagccaattttcagtctgttcgggacacggacaattgagaattcacagtgtacaaaggtggaggaggattttaaccttgccacaaaaatcattagtaaatccgccgcgcagaactatacctgcttacccgacgcgacttatcagaaggacattaagactatcaatcacaagatagaggatcaaatgttccctagcgaatccaaaagagaagaggatgaggaatattcctgggacagcggaagcctatttgaatcctctgccaagacacaagtctgtattccagaatctatgtaccagaaggtgatggagatcaacagagaggtggaagagctgcccgagaaaccttccgccttcaagcccgcggtggagatgcagaaaaccgtccctaacaaggcattcgagcttaagaacgaacagaccttaagagcagcacagatgttcccaagtgagagcaagcagaaggatgacgaagagaactcttgggacagtgaaagtccatgcgagacagtcagccagaaggacgtttacctgcctaaagccactcatcagaaggaattcgacacgttatcagggaaattagaggcttacctctggaaggaatctttctcttccaaatag

SEQ ID NO: 26710 - DNA, 5622 bp, Artificial Sequence
  Description of Artificial Sequence: Synthetic coding sequence
atggaggagggagtgcaggcacctgattgggacagcgacgagacagtcatcgaggggtccgtgaccgagtcggatttggaagaaaaggagctgccatggaggcgcctcttgtttgatcaggacgcttccttaaaaagcgagttttccctgcacccagacacacgggggatgtgtaaaggcatgccaagtcctgagatacagctgggcttcaaacttcgcgaggacctgcaggagcagatgaataagaacaaaatgatgccagtccttagtgaggacacgatactccaaagtcaggacgaaacagagcgcaaccaggctctcctgcagactaggaaaaattgctcgatgtttattgggagtttccggcagtctgggctgagtctgaaccaccaaaacatcgaaggtcctgaggccgagtcacccgaagtcctgccccacattgaaaaggaactatccgagggacgggatagccccgaagtctccctgctgtccggtacagccatcacagtctccgatactgtcgccgtcaaagaaacaagtctagtggagcctgagaaaatcctggcggctcctaacaccttttttgaacctcgaaaagaggtcaccatgactatgacatcggaagaaaccaaagacgaggagagcagtctggaaacttttgtgtccgccctggaaagcctgctgactagccccgagagtacgcaagaagaacggttgttcgagctggtcagtgacttcgatcgcaaagaactgatgaaccctttgtccgactccctgagtagcatctcgatccccttaaacagctggagcgcttgccatagggaccttctggaagatgccaaagatgatgcgctgccagcggaactgctggaggctctcaacacgctaagcgaagctaaggtcgaaacgatttgtcatcgtaaagagggaggaagctcactgatcgccaggaacgagtgcttggaagtcgagtttaatacctcacagacaaacgaggactgtacgcagattgcagaaacattacaggatcctaatccctcaggcctgcagacacttgcccatcagaacatcactagttgcgagccactgagtaataagcggaattctaattcagtgaccaactcaagcgatcaggaaacagcctgtgtgctgagacggtcaagtaggctggaaaaactgaaggtttcacgtgacgctaagtatagcgaccacatgtataaaatgcctgagaagatactcccaaagattctggggtgtgaagacctgactaataacaactctagtgctcagaatttccgcatgcaggatccagctcttatgattgacggtaaggaaaaaaacatgcactccgccagattcaaaaatggcaagcaaataagaaagaatgagcagttttctggcaaaaaagagaaaatgaaggtaaacaagatttccttgcattctatcaatcggcggaatatttttggtgaaaatctagtgtataaggctgccctgcacgatgatgccgatctggttcatcactgcattaaaaaaggcggcaatgtgaatcagccctcatatgctgggtggacagcactccacgaggcgtccgtgggaggattctatcgcaccgcaagcgagctactgaagggcggcgcagacgtcaacatcaaaggactgtatcagattacccccctgcatgatgcagtgatgaatggccactacaaagtggcagaactgttgctgctgaatggcgctgacccgctcttccggaacgatgatggcaagtgtgccttggatgaagcaaaggacctgtgcatgaaaagactgctggagcgatacataccaaaacatcagaaatgcttaaccagcgcgcaacgaagtagtatcgatcctctggatatcgaagacgtttaccagcataaaaagcccaaattcagttccaaatcccacatatggcacgtgtacaatgagaattcgaaccggcaaaagctggagcacgtgaaggtgaacaagggcagcaaagcctcattgttcatcaacaaggaggacgtttacgagtattaccagaaggatcccaagaatactaaattcggtaagtcaaaacacaaacagagcaccttggatcagatatattctacgggtctgcgcaaaggaaacctgcacaacgtgaaggaccccaacactaatgttccgaaaggcatagggcgcagaaagacacaacacaagcgcacccaggtcgacgatgtggattgtaatccccggaagatactggccgtgagcccctctcgacgaattaataggcttgtgacctaccagcagcatatcccggagactcacaatgatctgccggaggaactatgcgaaccttccagcttaactctaagttcgctaaggaacggacttgacagcagcaccgaggcctgctcagtatccaaggaaaagcacatacagaacttagatcttagtgactcccaggaggtccaatgcctggaattagaaagtgttgaccagactgaggctgtgagtttccctgggttactgctgcacaaagagattaaactgccggtggtcaccaccgataaacagccccatacactgcaggaacagcatcacgttctgtacaagtctcatgagaacagtaacctcgttcccaaggatgagcgctttaataaatgggagaatagcttcttgtcttttgtgaaggagaacagcgataatgacgacgacgatgactgcagcacatccgagaaagcaattacgagtaaaaaagtgctctgctccaccggagggaagaagcattacaactttaaagagaaccttaccaacaagaaggagatgggcttccagcaattccttctctctgaggaccatcttagccaggaaaatgaactgaaggcagtaagcctaactaccctgcccgagcaggaagccgtcaatttcagctatagcgataatgctgtgatcagtgaacacgtggccaattatgaacagtgtatctttggaccttccttcgaccactcgaatggcaatcctgagcaaaattctctggcatgtatgcgcactcttctcacgcacgaagcctcaaaactgaccaatcatgttgaactgtttaagaagccgcaggattatattccgagggctcccacgtttctgatgaatcagaccgacactcatatcgttgagaaaatggcaaagaactgtgacactgagcgcaattacattgacagggaccagaagattatttactctaacgagcctctaagcattgtcgcacatagccaagtgatagagacaacaaaagtggagaagcggaggcagaaccatctcgagagcgagacaatccacaacattgactcccactccaccgacaacatgagcaaggaattggccaatatatcgaagctgtctcagcgggaaaaaaaagagattagtcacaagcctggcatgaaagccggccgcatcaacaaacggaacgcacggggagagtcccagcttcacctggctgtgagacggggcaacttgccgctggtgaaggctttaatcgagtccggcgccgacgtgaatctcaatgacaacgcgggctggactccattacacgaggctagtaatgaggggagcatcgatattattgttgagttgcttaaggccggagccaaagtgaactgtgagaatatcgacggcatcctgcctctgcacgacgcagtagctaacaatcatcttaaagccgcagaaatcttgctgcagaacggtgctaacccaaaccaaaaggatcagaagcagaagagtgcgctcgatgaagcagacgacgaaaaaatgaaggagctcctgcgtagctacggcgcaatcgagacggtgaacagggacgagtctgacgctattgtgaatgagaagatccctgccgtgagatccaaaagacataaacagtgtttctgtgatgatggtaagaccatcgattcttctagtctgagccatcaagagagaagccgagagtcattatctgtccatcagactctgagcgcaatcttacaggatatagaggagaagcaggagtatttgctggaatttgagatacgcaatccggaagacgcagagcagtatattgaaaagatgctgaaaataaagaagataatggataacgtcttggcaaaacagaaagctgagcgggacgacctcgccaagaagtaccgggtctcaatcgaatcattcaagcacggcgccctgcgagagcagctagccaatctcgccgcaagacaaaaatcgctgttggtggttgccaagaaacagaagaaaatcagcctgaagatccaaaactgcagaaatgtgaccagcttaccatgtctgagccttaggaagcttccaccccgatccgagatcagcagtgaaaaagattcccaggagctcacctccctcgaaaacctggaacacccacagtcgggctccctgtcccctgtgtctgggagcatgcaggaaactcagctttctttggaaacctggaactacagtcaaaataccaatatctgtctcaattcagaggcggtgcgacgcggggagttctctggaaacgatatgaactccaaacaaaatggaagtgactgtactttagatggatttcctaagagccgccattccgatggcactgaaaagaacaagttgccaagtcagccggtggccttcatcggccagacagagtactcccagaaggagaacgaccttactgaagcaaccgacaaggaccacgaattttatgtgtcaagcccagtcatcggcaagctgaacatcagtgaaaccgcatctgttttagcggaaaatgccgcccacccgtccaatattatctgtgatcaggatctgagcaactacgatcctaagcgcggaaaccgtaagacaagcagccagcagtcacctacaggggcgtccgaaagcttggcgcaccagggcatcgccgtgctggggagtgacaccgtccatcagatgaagccatatttgaaaaagtcggtgtcagtagtgccctgtgccgacgattcccaaatctcgtccagctcaggctcaggacagcaggatacaatcaagaaagcgctgaactacagcactgcaccaaagaagaagtgtattcaaattaaagatttgatcctgttgggccggatcaatcctggaaacaacatactggagttcaagacccaggaaaccactcataaggcttccatcttgttaaacggtaaattgaaagtggaatcggggcaaatctataaaaaccctgtcacatggttgaaggatctattaggcggaaattcttacgtgacttggaattacgcctggtccaaggtgacttatctgggcaaggaattgctcaggtacgtgagcgaagacgccccaattctgcccgaacccaactcggtgcctcagcagtaccagccgtgcttgcccgaggtagcctgtttagacgacccagtgcaggagcccaataagagcatgttcgaaaagactaagtttgggcaagggacttcccgcgaaagcatgcaatcctccccgagatacctgcagatcaacgagatattactcatctcggaccaggagtttttgccatgccatattatggaccaacattggaagttttgcgtggaatgtgaagaactcacgccttag

SEQ ID NO: 26711 - DNA, 819 bp, Artificial Sequence
  Description of Artificial Sequence: Synthetic coding sequence
atggtggcctgctaccacggtttccagtctgtggtggccctccttagccattgcccctttctggatgtgaatcagcaggataaaggcggtgataccgcgcttatgctggccgcacaggctgggcacgtacccctagtcagcctgctgctcaactattacgtcgggctcgatttggagaggcgcgatcagcgagggctgaccgcacttatgaaggcagccatgagaaatagatgcgaatgtgtggccactctgcttatggccggagctgatctgaccgccgtagaccccgtgcgcggcaagacagccctggaatgggcagtcctgaccgactcctttgacaccgtatggcggatccggcagctattgagaagaccacaggtagagcagcttagtcagcactataagcccgaatggcctgctctgtcggggctcgtagcccaagctcaggctcaagcccaggtggcgcctagtctactagagaggcttcaggccactctctctctgccatttgcccccagccctcaggaaggcggagtactcgatcacctggtgactgctacaactagcctggcatcaccttttgtgactaccgcttgccatacactgtgccctgaccaccctcccagcctcgggacgcggtcaaagtctgttcctgagctgctggtgccggccgaggcacagagtttcaggacgccaaaatccggcccatcgagcttggccatccccggcgctcaagaccgtgaggaggaaacagggggaggggggcagaacgggacagaggtcggggaggatggcatcgggcaagcagggaatagatag

SEQ ID NO: 26712 - DNA, 612 bp, Artificial Sequence
  Description of Artificial Sequence: Synthetic coding sequence
atgaaggccgcgatgagaaaccggtgcgaatgcgtggcaacactcctcatggctggggctgacctcaccgcagtggaccccgttcgaggcaagacagcactggaatgggctgtcctgacggatagcttcgataccgtgtggcggatcaggcagcttctgaggcggccacaggtcgagcagctctcgcagcactacaagcccgagtggcccgctctgtcgggactggtggcccaggctcaagcccaggcacaagtggcaccatccttactggagcggctccaagcaactctgtcgctaccgtttgcaccctcccctcaggaaggaggtgtcctggatcacctggttaccgctaccacttccctggccagcccttttgttacgaccgcttgtcatactctctgccccgatcaccccccgtcacttgggacccgatcgaaaagcgttcccgagctgctggtcccagcagaggcacagtccttccggaccccaaaaagcggaccctcttcgctcgcaatccctggagctcaggaccgagaagaggaaacaggcgggggtgggcaaaacggcacagaggttggtgaggacggcatagggcaggctgggaatcggtag

SEQ ID NO: 26713 - DNA, 1485 bp, Artificial Sequence
  Description of Artificial Sequence: Synthetic coding sequence
atggttcttttggcaggaaccgggccagaaggcggaggggctcgatgcatgactccgccccccccgtctccgcccagaggggcacaggtggaagaagaccctgcagactatgaagagttcgaagacttctccagcctgcccgacacacgctccatagcctctgacgattccttctatccatttgaggatgaagaggaacacggcgtggagtctgccgagagcgtccccgagggagtgcccgaatccgtgcctgaaactgctaccctgctccgtgcggcatgtgcaaataatgttgggctcctgcgtaccctggtgcgccgtggggtgtccgtcgaagaggcacaggagacagatcgcaatggccgaactggcctaattgtggcgtgttatcacgggtttgtggataccgttgtggctttggccgagtgcccacatgtcgatgtcaattggcaggactcagagggtaacactgcacttatcacagcagcacaggctggtcacgccataatcacaaactatttgttaaactactttccaggcctggacctggagcgcagaaatgccttcgggtttacggctctgatgaaggccgcgatgcaggggcggaccgattgcattagggctcttatgttagccggggcagatgtccacgctcgcgatccaagaaggggaatgagtccacaagaatgggctacttacactggcagggtagacgccgtcaggctcatgcaacggttacttgaaaggccttgcccagagcaattctgggagaaatatcggcctgagctgcctccacctcccgaagcagcgcgtaagcccgccgggagtaagaattgtctgcagcgcttaaccgactgtgttctctctgtactaacgcctagaagtgtcagagggcccgaggatggcggtgtgctggaccatatggttagaatgacaacatctctgtacagcccagcagtcgccatcgtgtgccagaccgtgtgccctgagtctccaccttctgtcggtaagagacggcttgccgtgcaagagattctcgcagcacgtgcagcacgcgggccacaggcccaggaggaagacgaggtaggcggagcggggcaacgaggtcgaacaggccaggaggacgccgacagtcgagagggcagcccgcgagccggcctgcctcctgccttgggaagcagaggcccggccgcccctgctccacgaaaggcatccctcctaccactgcagcgcctccgcagacgaagtgtgcgccccggcgtggttgttcctagggttcgggtttctaaagctccagccccgacctttcagcccgaaaggccagcacgtaaaggctccactaaggattccggtcacctgcagattcccaaatggagatacaaagaggccaaagaagagaaacgcaaagctgaggaggccgagaaaaagcgtcaggcagaagcgcagaaggaacggaggaccgccccttggaaaaagcgaacctag

SEQ ID NO: 26714 - DNA, 1491 bp, Artificial Sequence
  Description of Artificial Sequence: Synthetic coding sequence
atgctgcataccgagggacacgccctcctcagagctgtgggacagggcaaactgaggcttgctcggctcttgttagagggtggtgcttatgtgaatgaaggtgatgctcaaggagaaacagcgctcatggccgcttgcagggctaggtacgacgaccctcagaacaaagcgcggatggtacggtatctgctcgagcaaggagcagatccaaatatagcggatagactcgggagaacagcactaatgcatgcctgtgctgggggaggtggtgcggccgttgcgagcttattactggctcatggagcagatcccagcgttagagatcacgctggtgctagcgctctcgttcacgccctggaccggggcgatagggaaactctggcaacattacttgacgcttgcaaagccaagggcactgaggtgatcattattaccactgacacatctccaagtggaactaaaaagacacgacagtatctgaactcccccccatcgcctggagtggaagacccagcccctgcctcacccagcccgggattctgcacgtctcctagcgagattcagttgcagacggccggaggaggcgggaggggaatgctctccccccgcgcgcaggaggaagaggagaaaagggacgtttttgagttcccgctgcctaagccaccagatgatccatcccccagtgaacctctgccaaaaccgccccgccatcctcctaaacccttaaagaggcttaactccgagccctggggcctcgttgcccccccacagccagtgccgcccacagagggtcggccagggatcgaaagacttacagccgagttcaacggtcttactcttaccggcaggcctcggctctcccgacggcactcgactgagggccctgaagacccacctccatgggcagagaaagtcacttcaggtggaccactctcgcgccggaatacggcccccgaagcgcaggagtccgggccaccctcgggactgagacagaagctgagccggatggaaccggtggagctcgacacccccgggcatctatgtccagacagccccgaatccagccggctgagcctagagaggcgcaggtattcagcctcacccttgaccctcccacccgccggttcggcgcctagtccaaggcagagccaggaatccctgcctggcgcggtctcccccctttccggacggcgacgaagcccggggctcctcgagagacggggctccggtactctgctgctggatcacatcagtcagaccagacctggatttttgcctcccctgaatgtgtctccccatcctcccattcctgatattcgccctcagcctggcggcagggctccctccctccccgcgcccccctatgccggagctccgggaagcccccgcacaaaacggaaactggttcgacgacactccatgcagaccgagcaaatacggctgctcgggggcttccaatctttggggggccccggggaaccgggtcggtag

SEQ ID NO: 26715 - DNA, 1608 bp, Artificial Sequence
  Description of Artificial Sequence: Synthetic coding sequence
atgatggacgacgacacggagttgcggactgacgggaactcactccttaaggctgtttggcttggacgtcttcgattgacgcgcctgttgttggaaggtggggcgtacataaacgagtctaatgataagggggaaaccgccctgatggtagcatgtattaccaagcatgtcgatcagcagtctatctcaaagtccaagatggtgaagtacttgctggacaatcgagccgatcccaacatccaagataaaagcgggaaaaccgctttaatacatgcgtgtattcgccgggctggcggtgaggtggttagtctgcttcttgagaacggcgctgacccgagcctggaagacaggacgggggcatcagcactggtttacgcaataaacgcagacgacaaggatgccctgaaacatctgttagacgcctgtaaagccaaaggaaaggaagtaatcatcatcactactgacaaatcctcctcaggcaccaagaccacaaagcaatacttgaacgtcccaccaagccccaaggtggaagataggcatagtcccccattgtgcgcttccccctctgatatcgaactcaaagccctgggcctggattccccccttaccgagaaagaggatgatttcttctcactgcaggctgggcatccttcctcttgcaatacaagcaaggccgtgaacgagccaggctcacctactagaaaggtgagtaaccttaagcgagcccggttaccacaattaaagcgcctgcagtcagagccttgggggctgatcgcaccatcggtcctcgccgcgtccacgagacaggacgaaacccacggcgcctccaccgacaacgaggtgatcaaatcgatctcggacatctcatttccaaaacggggaccactcagcaggactaactccatcgattctaaggaccctactctcttccataccgtgacagagcaggtgctcaagattcctgtgagctccgcaccagcaagttggaaggcagcctacgagaagggtcaagctccccatcctagactcgcccggagagggacacttccagttgatcaggaaaagtgcggtatggggccgtccggaccaagcgcattaaaagagccagcctccctcaaatggcttgagaatgatctgtatgatctcgatattcagcccggccccgatcctccaaactcaatcagccttgaaagcggtaagggcccactggatcgtaagaagcttaactcgtctcacctgtctttgttccacggatccagagaatcgcttgacacagtcccaagtacgagcccctcctccgctcgtaggcggcctccacatctcttggagaggcgggggagcggtactttgcttctggatcgtatctcccatacccgacccgggtttctgccaccacttaacgttaatctcaaccctccgatcccagatatccgttcaagctccaaaccctcatgtagcctggccagtggactcaaatctatggtccctgtggccccttcttctccgaaacgagtggatctgagatcaaagaagaaactcctgcgaagacatagtatgcagatcgaacagatgaagcagttatcagatttcgaggagattatgacatag

SEQ ID NO: 26716 - DNA, 3006 bp, Artificial Sequence
  Description of Artificial Sequence: Synthetic coding sequence
atgaaacgcatcttttcctgttcgtctactcaggtggccgtggagaggtggaacagacatgaccagaaattgttggaggctgtacacaggggcgacgttgggagggttgctgccctggcgagccgcaagtctgcgaggcccacaaagctggacagtaacggtcagtctccctttcacttggcagcaagtaaaggtctgacagaatgcctgaccatcctactggcgaatggggcggatattaacagtaagaacgaagacggttctacagcattgcatttggcgacaatctcttgccaaccccaatgtgttaaagtcctacttcagcatggtgcgaatgaggatgctgtcgatgcggaaaacagatcgccactgcactgggccgcctcttccggctgcgccagcagcgttctccttctgtgtgaccatgaggcattcctggacgtgcttgacaatgacggtcggaccccgctgatgattgcctccctcggaggtcatgccgccatctgctctcagcttcttcagcgcggcgctcgcgtgaatgttacagacaaaaatgataagagcgccttgatcttagcctgtgaaaaagggagcgccgaggtggccgaactgttactcagccacggcgccgacgcaggcgctgtggattctactggacatgacgccttacactacgcgcttcatacccaggacaaagcattatggagacacctccagcaggctctcagccgcagaagaaggggcggtcagagattagtgcagcaccccgatctggcgtcccaggccagcccaagcgagcctcaagccgggagcccgcccaaatcctcttggagggctgaacccgaggaagagcaggaggaaaaggaggatgaagacccctgctcagaagagtggagatggaagtacgaggaggagcgacgcaaggtggtgcgtcttgagcaagagctcgtacagaaaaccgaggagtgcaaaacccaggcagcagcctatctggaccttgagaaccagataagggaacaggcccaagaactgggggtgctgctgagttgggaaccgagagctagtgggaaacaaggcagcagcctgaggcccgggggcgatggtatggaacaggggtgccctaaagatctgctggccgagagcacacaggaacttaagaagcaacaacaggccgctgcaaccgtgaatccagttttagctcctaagaaggccgaggatagtgcacctggaaagatccagtacgaagtacatgggagatctcagcccgaagagcaagggccacctcagagtcccgccagtgaaaccatcaggaaggcaacaggccagcagctaactacaaacggtgcccagactttcggaccagatcacgccgaccaactccctgccgggcagaaagaaagcagccaagtcctgggtgtggaacccggaggtaccgtagctgagcctgtgggccctgcagccatgaatcagctgcttttgcaattacgcgaggagttagccgccgtctggcgggaaaaggacgccgcaaggggggctctatccaggccagttatggaaggtgccctggggacaccacgtgcggaggcggctgctgctgcttgggaaaagatggaagcccgccttgagcgagtgctcgcaagactcgagtgggctaaagctgggctgcaagtgaagcctgaagtgccaagccaggaatctagggagggggccctaaaggctgcaccagggagcatcaagcaggacgaagagaaggagaaacgtgtcccaggagcccgcggagagccgcttggagcgttaggtggggaaaaagcgctaggtgggctggctaagggccagcttgagaaggagatgagtgtgcttaggctttccaacagcaacctcctcgaggagcttggcgagttaggacgagaacggcagagactccagcgggaactgcagagcctgtcccagagactgcaacgggagtttgtgcctaagcctgaagcacaggtccagcttcagcagcttcgccagtcagttggactgctgacaaatgaattagccatggaaaaagaagctactgagaagctgcgaaagctgctcgcgtcccaatcctcaggcctacgggggttgtgggattgcctgccagcagatttggtaggagaacgatccgcccagagtaaagccgccgaatcacttgaagagttacgagcatgtatttccacattagtcgatagacacagagaggcccagcaggttctggcccgcctgcaggaggagaatcaacagctccgaggtagcctcagcccctgccgtgagcccggaaccagcctcaaggcaccagctagcccacaggtcgctgctttggagcaggaccttgggaaattggaggaagaattacgggccgtacaggcaaccatgtctgggaaatcgcaggaaatcggcaagctcaaacagctcctgtatcaggcaactgaagaagtggcagaactcagggctcgtgaggctgcgtccctgaggcagcatgagaaaaccagaggcagtttggtggcccaggcacaggcctggggacaggagctgaaagcattgctcgagaagtataacacagcatgcagggaagtcgggagactgagggaagctgtcgccgaggagagacggcgaagcggggatcttgctgctcaggccgcggagcaagaacgtcaggcctcagaaatgcggggacggtcagagcagtttgagaaaaccgcggaactgctgaaggaaaagatggagcatctaattggagcctgccgcgacaaagaggcaaaaattaaggagttactgaaaaagctggagcaactgtccgaggaagtgctggctataagaggggagaatgctcgtctggcgttgcaactgcaagatagtcaaaagaaccacgaagagatcatttccacatatagaaaccacttgctgaacgctgccaggggctacatggagcacgaggtctataatatactgctccagattttgtccatggaggaggagtag

SEQ ID NO: 26717 - DNA, 2733 bp, Artificial Sequence
  Description of Artificial Sequence: Synthetic coding sequence
atgaagcggattttctcgtgtcagccccaatgtgtgaaggtactcttacagcacggagcgaacgaagacgcagtggatgccgagaatagatctcctctgcactgggctgcttcttcagggtgtgccagcagtgtcctgctcctttgcgatcacgaggctttccttgacgtgttggataatgatggcagaaccccgctgatgatcgccagcctggggggccatgccgcaatatgttcacagctcttgcagcgcggggcacgtgtcaacgtcactgataagaacgataagtctgccctcatcttggcttgtgagaagggatctgccgaagtggctgaactgctgctgtcacacggcgcggacgccggcgccgtcgactccactggacatgacgctctgcattatgcattgcacacccaggataaagccctctggcgacatcttcagcaggccctctctcggcgtcggcgtgggggacaaaggttggtgcaacaccccgatctcgcctcgcaggcatcaccttctgagccacaagcgggctccccccccaagtcttcatggcgtgcggagcctgaagaggagcaggaagaaaaagaagacgaggatccatgctcagaagaatggaggtggaaatacgaagaagagaggagaaaggtggtacggctggagcaggagctggtccagaaaactgaagaatgcaaaacacaggccgcagcttacctggatctcgaaaaccagattagggagcaggcccaggagctcggcgtccttctgtcctgggagccccgtgccagtggtaaacagggatccagcctacgccctggcggcgatggcatggagcaaggctgccccaaggatctcctggccgaaagcacacaggaacttaaaaagcaacagcaggcagccgcaacggtgaatccagtgctcgcccccaaaaaggctgaggactctgcccctgggaaaatccagtacgaagtgcatggcagaagccaacccgaggagcagggccctccccagtcacctgcttcggagacaatccggaaagcgactgggcagcagctcacaacaaatggtgcccaaactttcgggccagaccatgcggatcagctgcctgctggccagaaagagtctagccaagttctaggagtcgaacccggaggcaccgtcgccgagcctgtggggcctgcagccatgaatcaactgctactgcaactcagagaggagctagcagctgtgtggcgcgaaaaagatgctgcccgcggagctctcagccgtccagttatggagggggctctcggcacgccccgggccgaggctgccgctgccgcatgggaaaagatggaggcccgattggagcgggtgcttgcacgcctcgaatgggcaaaggccggcttacaggtcaagcccgaggtgccttctcaggaatcgagggagggggccctcaaggctgcccccgggagcatcaaacaggatgaggaaaaggaaaagcgcgttcctggggcccgcggcgaacctctcggagccctgggaggtgagaaagcgttagggggcctcgctaagggacagctggagaaggaaatgagcgtgctgcgcctgagtaacagcaacctcctggaggaactgggggaacttggtagagaacgacaaaggctacagagggaactgcaatccctaagccaaaggctccagcgggaattcgtccccaaaccagaagcccaggtgcagttgcagcaactaagacagagtgtgggactcctgactaacgagctggccatggaaaaagaggcgacagaaaaactccgcaaactgctcgcctcccagtcttcaggtctgagaggtttgtgggattgcttacccgccgatttagtaggcgagagaagcgcccaatcaaaagccgctgagagcttagaggaactgcgggcatgtatttcgaccctcgtggacagacaccgggaagctcagcaagtgctggccaggctgcaggaagaaaaccagcaactcagaggtagtctgagcccttgtcgcgagcctggaacgtcattgaaggcacctgcaagtccacaagtcgcagcgcttgagcaagatctgggaaagttggaggaggagctgagggctgtgcaggcaaccatgtcaggaaagtctcaggaaattggaaagttaaagcaattactgtatcaggccacagaggaagtcgcggaactgcgggcccgggaagctgcttcactgcggcagcacgagaagacacggggctcactggtagcccaggcacaggcctgggggcaggagctcaaagccctgctcgagaaatacaacaccgcttgccgtgaggtcggacgcctccgcgaggcagtcgccgaggagcggcgacggtccggggatctggcggcccaggctgcggagcaagagcggcaggcctctgaaatgagaggaagaagcgagcagttcgagaaaacggctgagctgctcaaggagaagatggagcatctgatcggtgcttgcagagataaagaggcaaagatcaaggaactccttaaaaagctggagcaactctcagaagaggtcctggccatccgcggagagaatgcccgcctggcattacaactgcaagacagtcagaagaaccacgaggaaatcattagcacttataggaatcacctactgaacgccgcgcggggttatatggagcacgaagtgtacaacattcttctgcaaatcctatctatggaagaagaatag

SEQ ID NO: 26718 - DNA, 414 bp, Artificial Sequence
  Description of Artificial Sequence: Synthetic coding sequence
atgaagcggatattttcctgctcttccactcaagtggccgttgagaggtggaatcgtcacgaccagaagttgttagaggctgtacaccgcggagacgtgggccgcgtggcagctctcgcttcaagaaagagcgcccgtcctaccaaactggattccaatgggcaaagcccatttcacttagccgcttcgaaagggttgacagaatgcctcactatcctactggccaacggagcagatataaattccaaaaacgaagacgggtcaactgccctgcatctcgccacaattagctgtcagccccagtgtgtcaaagtcctgctacagccacccctggccgtaccacaagtttgtagctgttgtgtgaccaccaagccatcatggacgtgctggattatgatggacgtgcatccctag

SEQ ID NO: 26719 - DNA, 489 bp, Artificial Sequence
  Description of Artificial Sequence: Synthetic coding sequence
atggaggacgggaagagggaacgatggccaactttaatggagcggttgtgtagcgatggtttcgcctttcctcagtacccaatcaaaccttaccatctgaaaagaattcaccgcgccgtgttgcacggcaatcttgagaagctgaagtacctcttacttacctactatgatgccaacaagcgcgatagaaaagagcgcaccgcattgcacctggcatgtgctaccggccaacccgaaatggtgcacttactggtgtcaaggcggtgtgagttaaatctctgcgaccgcgaggacaggacaccgctcattaaagccgtgcagctccggcaggaagcctgcgccactctgctcctccagaacggagctaatccaaacatcactgacttttttggaaggacagctttgcattacgcagtgtataacgaagacacatcgatgatcgagaaactgctgagtcacgggacaaacattgaggagtgtagtaagtag

SEQ ID NO: 26720 - DNA, 384 bp, Artificial Sequence
  Description of Artificial Sequence: Synthetic coding sequence
atgctactccagcagcaactggacgacgccaggaacaaggctgataaccaggaaaaagccattctgaacatacaggcccgctgtgacgcccgcgtccagaatttgcaggcagagtgtcgcaaacacaggcttctgctggaagaggataacaagatgctcgtgaatgaactcaaccattccaaggagaaggaatgtcaatacgagaaagagaaagctgaacgtgaggtcgccgtccggcagcttcaacaaaagagagatgacgtgctgaacaaagggtctgccactaaggccctcctcgacgcctcgtcaagacattgcacgtacctggagaacggaatgcaggacagccggaaaaagcttgatcaaatgcggagccaagcctag

SEQ ID NO: 26721 - DNA, 1041 bp, Artificial Sequence
  Description of Artificial Sequence: Synthetic coding sequence
atggaggatggaaagcgggagcggtggcccactttgatggagcgcctatgttccgacgggttcgcctttccccagtaccccatcaagccgtatcacctgaagcggatccatcgagcagtcctacatgggaatctggaaaagctcaagtatctcctcctgacttattatgatgcaaacaaaagggatagaaaagagaggaccgctctccacctggcttgtgcaaccgggcagccagagatggtgcacctcctggtgtcaagaaggtgtgagctgaacctgtgtgaccgtgaggaccgcacccccctgatcaaggctgttcagctgcgccaagaggcctgtgctacgctgctgttgcaaaacggcgccaacccgaatatcaccgatttcttcggaaggacggctctgcattacgccgtatacaatgaggataccagcatgattgagaagttgctgtcacacggaacaaacatcgaggaatgctcgaaatgtgaatatcagcccttgttattcgctgtgagtaggcgcaaagttaagatggtggaatttttgttaaagaagaaagccaatgtcaacgccatcgattacttggggaggtccgcgttaatccacgcagtcacccttggggagaaggacatcgtcatcttactcttacagcataatatcgacgtcctgtcccgagatgcctttagaaaaatcgccggcgattacgctatagaagctaagaaccgtgtgatctttgacctcatatatgagtacgagaggaaaaggtatgaagatttacctatcaacagcaatccagtatccagccaaaaacctcctacccttaagggtaccagtgatgaagaggattcagtgctgggcattgcaagagagaacaaagatggtgagaagtcacgtacagtgtctagtgagaagccacccggtttaaaagcttccagtgctgaaaaggacagcgtgcttaatatcgcaaggggcaaaaaggacggagagaaaactaaaagagttagctcccgcaagaaaccctcattagaggccacatag

SEQ ID NO: 26722 - DNA, 5826 bp, Artificial Sequence
  Description of Artificial Sequence: Synthetic coding sequence
atggaggatggaaagcgggagaggtggccgaccctcatggagcggctgtgctctgatggttttgcattcccgcaataccccataaaaccatatcatcttaagagaatacacagggctgtgctccacggcaacttggagaaactaaagtatctgttgctgacttattacgacgctaataagagagatcgcaaagagcgaaccgctctgcacctggcttgcgccaccgggcagcctgaaatggtgcacctgttggtgtcaaggcggtgtgagctgaacttatgcgatcgagaggaccggaccccgctgatcaaagcagtgcagcttcgtcaggaggcatgtgccacccttctgttacaaaacggtgccaaccccaatattactgactttttcgggcgcactgctctgcactacgccgtgtacaacgaagatacatccatgatagaaaagctcctttcccacggaacaaacatcgaggagtgctcaaagtgtgaataccaacccctcttgtttgccgtttccaggagaaaggtgaaaatggtggagttcctgctcaagaaaaaagctaatgttaacgccatcgactacctaggtagatctgctctcatacacgctgtcaccctcggagagaaagatatagtgatcctgcttctgcagcataatattgacgtattgagccgggacgctttcagaaaaatcgctggtgactacgctattgaagcgaagaaccgcgtgatcttcgatctcatatatgagtatgagcggaagcgatatgaagacctgcccatcaactctaaccctgtgagctcacagaaacagcccgccctgaaagcaacctccggaaaagaggacagtatcagtaatattgcgaccgagattaaagatggacagaagtccgggacggtctcgtcacagaaacagccagcattgaaggatacttcggacaaagacgacagcgtaagcaataccgcaactgaaattaaggatgaacagaaatctggcacggtgcttcccgctgtcgaacagtgtctgaacagatccctgtaccgacctgatgcagtggcccagcctgttaccgaaaacgaatttagcctggaatcagagattattagcaagctttatatcccgaagaggaagatcatttcaccaaggagtattaaagacgtgctgccacctgtggaagaagccgtagaccgatgcttgtacctgttggaccggtttgcccagcccgtgactaaggataaattcgccctcgagtccgaaaatatcagtgagccctattttaccaatagacgcaccatctcccagcagagcgcagagaatctcgatgctgcatgcggtatagacaagacggagaatgggaacatgtttgaggaccaaaacgtggacaaggagggaaaagctctgcccgcaaccggacagaaagctaacgtgtcacccgaacaacccccactttttactcataccgtcaaagaccgcgaccacatctccacacgtttcctcggagggatggacagtctgaccagcagcgaagagtcgtcagagcggccaccactctcaactttgacactgaaggaggctgacccttcttcgaaagcggctatgcggaggaaggatagcccaccacccggtaaagtgagctcacagaaacaaccagctgaaaaggctacttctgatgataaggactccgtgagcaatattgccacagaaattaaagagggacctatatccggaactgtgtcatctcaaaagcagccagcagagaaagctaccagcgacgagaaagacagcgtgagtaacattgccactgagatcaaaaagggccaacagtctggcactgtgtcaccacagaagcagagtgcctggaaggtaatattcaagaagaaagtgtctttactaaacatcgctaccaggatcatgggcggcggcaagagcggtacagtgtctagccagaaacagccagcaagtaaagctacaagcgacaaaacagattctgcattgaacatcgcgacagagatcaaggatggactccagtgtggcacggtgtcaagccagaagcagccagcactcaaagccaccacagatgaagaggacagcgtttccaacattgcgactgaaatcaaggacggcgaaaaaagcgggacagtgagttctcagaagcaaccagctttgaaagcaacgaccgatgaggaagacagcgtgagcaacatcgctacggaaataaaggacggggaaaagagcgggacggtgtcatctcagaaacagccggctctgaaagccactacagacgaaaaggatagcgtatccaacatcgccaccgaaatcaaggacggagagaagtccggcactgtaagctctcaaaaaccccccgccctcacagctacgtccgatgaggaaggctctgtgctgagcatcgcccgcgagaacaaagatggcgaaaaatctcggacggtttcttctcgaaagaaacctgctctcaaagccacctctgacgagaaggattctttcagtaacattacgaggggtaagaaagatggggaaatctcaagaaaagtctcaagccaaaaacccccaactctaaaggggaccagcgacgaggaggattcagtcctgggtatcgcaagggaaaacaaggacggtgagaaaagccgcaccgttagtagcgagaagccgcccggattgaaagcctcatctgcggagaaagatagcgtcctcaacattgcacgcggcaagaaagatggcgaaaaaaccaaacgagtatcctcccgaaagaaacccagcttagaggcgacctctgatgagaaggactccttctcgaatattactcgcgaaaaaaaggatggcgagatatctcgtaaagtttcttcacagaaaccacctgcgctcaaaggaacctctgacgaagaggattcagtgctgggaattgcccgagagaacaaggacggggagaagagcaggacggtgagcagcgagaaaccccctggacttaaggctacgagtgacgaaaaagactctgtgctgaatatagcacgaggtaagaaggacggcgagaaaactaggaccgtgtcatcacaaaagccacccacattaaaggccacctccgacgaagaagacagcgtgctctccattgccagggaaaacaaggacggtgagaaatctcgaacagtctcctccgagaaaccctccggactgaaggcaacgtccgccgagaaagattcagtgctgaatattgcacgcggcaagaagtatggggaaaaaaccaagcgtgtatcttctcggaaaaaacctgccctgaaagctactagcgatgaaaaggattcagtgctctatattgcacgggagaagaaagatggcgagaagagccggactgtgtccagtccaaaacaacctgccctaaaagccatctgtgataaggaggattcagtgccaaacatggctacagagaaaaaggacgaacagatcagcggaaccgtgtcctgccagaaacagcccgctctgaaagccacctccgacaaaaaggattccgtcagcaacattcccacagagatcaaagacggtcagcaaagtggaaccgtcagcagtcagaaacaacctgcctggaaggcgaccagtgttaagaaagattcagtaagtaatatcgctacggaaatcaaggatgggcagatacggggcaccggcatccttgagtatacatttaatgtgatgtttgatcagattgaggaaaaatttacaagtttgaataaaagcgccggcgtaagccctcaaaagcaatccgcccaaaaggtgattttcaagaaaaaggtcagtctcctcaatatcgccactagaatcaccggggggtggaaatccgggacagagtatcctgagaatttgcctactctgaaagcaactatcgaaaacaaaaacagcgtgctgaatacagcaactaaaatgaaagacgtacagacctcaactccggctgaacaagatttggagatggcatcggagggagaacagaaaagactggaggagtatgagaataaccagccacaggttaagaaccagatccatagtcgtgatgacctggatgacatcatacagtctagccaaacagtcagcgaggatggtgatagcctgtgttgcaactgcaagaacgtcattcttcttatcgaccaacatgagatgaagtgtaaagattgtgttcacctgttaaagataaaaaacacattctgtctgtggaaaaggcttatcaaattaaaggataaccattgcgaacagcttagagtgaaaatccggaaactgaagaataaagcctctgttcttcagaagaggatttcagagaaagaggagattaagagtcaacttaaacatgaaattctggaactcgaaaaggagctatgtagcttgcgctttgccatccaacaggaaaagaagaaacgccgtaacgtggaagaggtccatcagaaggtgcgagaaaaactgaggatcaccgaagagcagtatagaattgaggccgatgtaactaaaccgatcaagcctgcacttaagtcagctgaagtggaattgaagaccggaggaaataacagcaatcaggtgtcagagactgacgagaaagaggacctcttgcatgaaaacaggctcatgcaagacgaaattgcccgactgagactggaaaaggacaccatcaagaatcagaatctggaaaaaaagtacctcaaagattttgaaattgtcaagagaaagcacgaggacctacagaaagcccttaaacggaatggagaaaccctggctaagacaatagcctgctactccggccagcttgctgcattaacggatgaaaacaccaccctacgctctaagctggagaaacagagagagtctcggcagcggttagaaacagagatgcagtcttaccattgtcgcctgaacgctgcgcggtgtgaccacgaccaatcacacagcagtaagagggatcaggaactcgccttccaaggtactgtggataagtgccgacacctgcaggaaaacctgaactctcatgtgttgatcttatcactccagctttccaaggcagagtcgaagtcccgcgtgcttaaaactgaactacattatactggagaggcccttaaagaaaaagcactggtctttgaacatgtacagtccgagctcaaacagaaacagagccagatgaaagatatcgaaaaaatgtataaatcaggctacaatactatggagaaatgcatcgagaagcaggaacggttttgccagttgaagaagcagaacatgcttctccagcaacagctggacgatgctcgaaacaaggctgacaaccaggagaaggccatccttaacatacaggcacgctgcgatgcgagagttcagaacctgcaggccgagtgtaggaagcatcgactgcttctggaagaggacaataaaatgttggtgaacgaactgaaccactctaaagaaaaggaatgtcagtatgaaaaggaaaaggcagaacgtgaagtagctgtgcgtcaactgcaacaaaagcgggatgatgtccttaataagggatcggctactaaagccctgctggacgcatcctcgcgccactgcacctacctagagaacgggatgcaggattcgcggaagaagctggatcaaatgcgcagtcaattccaggaaatccaggaccagctgactgccacaattcgttgcacaaaagaaatggagggcgatacccagaagctagaagttgagcacgttatgatgcggaagattataaagaagcaggatgaccaaatcgaaagactggaaaaaatcttacaacacagctctctaatgctccaggtgtttgagagctag

SEQ ID NO: 26723 - DNA, 930 bp, Artificial Sequence
  Description of Artificial Sequence: Synthetic coding sequence
atggaggacggcaaacgcgagcggtggcccacactcatggagaggttgtgctcagacggctttgcattcccacagtacccaatcaagccttaccaccttaaaaggattcatcgtgccgtgctccacggaaatcttgagaagctaaaatacctgttgctgacttactacgatgctaacaagagagataggaaagagcgaacagcactgcatctggcatgtgccactggacaacctgagatggtgcatctgctggtgtcccgaagatgcgaattaaatttatgcgatagggaagacagaacccccctcattaaagccgtacagttaaggcaggaagcttgcgcaacactgcttcttcagaacggtgccaatcccaatatcaccgatttctttggccgaaccgccctgcactatgcagtgtacaacgaggacaccagcatgatagaaaaacttctttcccacggcaccaacatagaggagtgctctaagtgtgagtaccagcctctcctctttgccgtgagcagaaggaaagtgaaaatggtcgaatttctgcttaagaagaaagccaatgtgaacgcaattgattacttgggaaggtccgcacttattcatgccgtcacactcggagaaaaagacatagtaattcttctgctgcaacataacatagatgtcttaagcagagatgcttttagaaaaattgctggcgactacgccatagaggccaaaaaccgggtaattttcgatctgatttatgagtatgagagaaagcgctacgaggatctgccaattaactccaacccagtgagcagccagaagcaaccagccttggccacggaacaggactcaatgtcgaaaatcaagaagaggaagctgatcgtgatgaaaaaaaagtccatggtcatccagagatttctcgtgaccttttgcaaatag

SEQ ID NO: 26724 - DNA, 5826 bp, Artificial Sequence
  Description of Artificial Sequence: Synthetic coding sequence
atggaggatggcaagcgcgagcgctggcctacgctaatggagcgcctctgttctgatggttttgccttccctcaatacccaatcaagccttatcatttaaagcgcattcaccgggccgtcctgcatggaaatttggagaagctgaagtatttattgctaacatattatgatgcaaacaaacgcgataggaaggagagaacagctctgcaccttgcctgcgccactggccaaccagagatggttcaccttctcgtctcgaggcgctgtgaactaaatctgtgtgatcgcgaggaccggactcccctcatcaaagcagtacaactgagacaggaggcttgcgcaaccttgctccttcagaacggcgctaaccccaacatcaccgactttttcggccgaactgctctccattacgccgtttataatgaggacacatcgatgatcgaaaaactgctgtctcacggaactaatatcgaggaatgttcgaagtgcgagtatcagcccctcctgtttgctgtgtctcgcaggaaggtgaagatggtggagtttctcctcaagaaaaaggcaaacgttaacgcaatagactacctggggcggagcgccctgattcacgccgtcacacttggtgagaaggacatcgtgatacttctccttcaacacaatattgacgtgttgagtcgagacgcatttagaaaaatcgccggagattacgcaattgaggctaagaacagagtaatctttgacctgatctatgaatatgagaggaaaaggtacgaggatctgccaatcaatagcaatcccgtgtctagccaaaagcagcccgctctgaaggccacttctggaaaagaagacagcatatccaacattgcaaccgaaattaaggatgggcagaaatctggcacagttagcagtcaaaaacagcctgcactcaaggacactagcgataaagacgattcggtgagcaatacagcgactgaaattaaggatgaacagaagtccggtactgtgctgcccgcagttgaacagtgcctgaacagatccctataccgccccgatgcagtggctcaacccgtcactgaaaacgaattcagtttggaatctgagattatcagcaaattgtacattcccaagcgcaaaataatttctccacgcagcatcaaagatgttctgccaccagtcgaagaagccgtcgacagatgtctatatcttctggacagattcgcacagcccgtgaccaaggacaagtttgcattggagtcagaaaatataagtgagccttattttaccaatcggaggaccatttcccagcagtctgccgagaatctggacgctgcctgtggtattgacaaaaccgagaacgggaacatgtttgaggaccagaacgtggataaggaaggaaaagccctccccgccaccggtcaaaaggctaacgtgtctcccgagcagccacctttgtttacacacacggtgaaagatagagatcacatctccaccagatttctcgggggcatggattctttaacctcgtctgaagagagcagtgagcgcccaccattatccacgttgacactgaaagaggccgacccttccagtaaggccgcaatgaggcgaaaggactctcctccgcccgggaaagtctcttctcagaaacagcctgctgaaaaagcaacctctgatgacaaagactcagtgagcaatattgccaccgaaattaaagaggggcccataagcgggactgtcagctctcagaagcaacccgccgaaaaggccactagcgatgagaaagatagtgtgtctaacatagctaccgaaatcaagaagggacagcaatctgggaccgtttccccacagaagcagtctgcctggaaggtaatctttaaaaagaaagtatctcttttgaatattgctacacggattatgggcggcggcaaaagcggaacagtgagcagccagaagcaacctgctagcaaggctacaagcgacaaaaccgacagcgcccttaacatcgccacagagattaaggatggactgcaatgtggcaccgtgtcttcacagaaacaacccgcccttaaagccacgacggacgaggaggacagcgtgagtaatattgccaccgagattaaagatggagagaagtctggcactgtgagctcccaaaaacaacccgctcttaaggccaccactgacgaggaggattccgtgtccaatattgctacagagatcaaagacggcgaaaaatcggggacagtgtcatctcagaagcaacccgctttgaaagcaaccacagacgagaaggacagtgtttccaatatcgcaacagaaataaaagatggcgagaaaagtgggactgtcagcagccaaaagccacccgcactgactgcaactagcgacgaggaaggctcagtccttagcatagcaagggaaaataaggatggggagaagtccagaaccgtatcctcacgaaagaaaccagcgcttaaggccacaagcgatgagaaagattcattctctaatataacaagggggaagaaggacggcgaaatttcccggaaggtgtcaagccagaagcctcctacactgaaaggaactagcgatgaggaggattctgtcctgggtatcgcaagagaaaataaagacggcgagaaatctcggaccgtttcctcagaaaagccaccgggtttaaaggcgtctagcgcggagaaagacagcgttctcaacatagctcgtggtaaaaaggacggagagaagaccaaacgcgtttctagtagaaaaaagccatctttggaggccacaagcgacgagaaggacagtttctctaacatcacgcgcgagaagaaggatggggaaatcagtcgcaaggtgtccagccagaaaccaccagccctgaaggggacatccgatgaggaagattccgtattgggaatcgcaagggaaaacaaggacggggaaaaatcaaggactgtttcctctgaaaagcccccagggttgaaagccacctccgacgagaaagactccgtcctcaacatcgcgcgcggtaagaaggacggtgagaaaacacggactgtcagctcgcaaaagccacccaccctgaaagctacgagtgacgaggaggactccgtactgagtattgccagagaaaacaaagacggcgagaagagtcgaacagtcagttccgagaagcccagtggcctgaaagcgacctctgcagaaaaggattccgtcttgaacattgcacggggaaaaaaatacggcgaaaaaactaagcgagtttcatcaagaaagaagcccgccctgaaggccacttcagacgaaaaggatagcgtgctctacattgcccgagagaagaaggacggtgaaaagtccaggactgtgtccagtcccaaacagcctgcgcttaaagcgatctgtgataaagaggactccgtcccaaacatggccaccgaaaagaaggacgagcaaatctctggcaccgtgtcctgccagaaacagccagcgttgaaggcaacaagcgacaagaaggattccgtcagtaacattcccacagagataaaggacgggcagcagtcagggactgtatccagccaaaagcagccagcttggaaggcgacctccgttaaaaaagatagcgtgtcaaacatagccactgaaatcaaggatggccaaatccgtggcacagggatattagagtacacattcaatgttatgttcgatcaaatcgaggagaagttcacttcgcttaataaatccgccggggttagtcctcagaaacagtccgcccagaaagtgatttttaaaaagaaggtgagcctccttaacatcgcaactcgaattaccggaggatggaagagtggcacagagtacccagagaatctgcccacgctcaaggccacaatcgagaacaagaacagcgtgctcaacactgccaccaagatgaaggacgtacaaactagtacccccgctgagcaagacctcgaaatggcctcagagggagaacagaaaaggttggaggaatatgagaacaaccaaccgcaggtgaagaaccagatccactccagggatgatcttgatgacatcattcagtcttctcagactgtgtctgaggacggtgacagcctctgctgtaattgtaagaacgtcatcctgctgatagaccaacatgaaatgaaatgtaaagactgtgtgcacctactgaagattaaaaatacattctgcctgtggaagcgtctgatcaaactaaaggataaccattgcgaacagctgagagttaagattcgcaaactaaagaacaaggccagcgtactccagaagcgcattagtgagaaggaagagatcaagtcgcagctgaagcacgaaatcctggagctcgagaaagaactctgctctctgaggttcgctatccagcaagaaaagaagaaacgtaggaatgtggaggaggtgcaccagaaagttagggaaaagctgcgtattaccgaggagcagtacaggatagaagccgacgttaccaaaccgatcaagcctgcacttaagagtgcagaagtggaattgaaaaccggaggtaataattctaatcaagtgtccgaaactgacgagaaagaggacctgctacatgaaaatcgactgatgcaagatgagatcgctcgtctgagacttgagaaggatactatcaagaatcagaacctggagaaaaagtatcttaaagactttgagatcgtgaaacgaaagcacgaggatctgcagaaagcactgaagaggaatggggagacactggcgaaaaccatagcgtgctacagcggacagctggccgctctgacagacgaaaacaccactctgaggagtaagctcgagaaacagcgggaatcccgccagagactggagacagagatgcagtcctaccactgtaggttgaatgccgcacggtgtgatcacgatcagagccactcctctaagcgggaccaggagctggcgtttcaaggtactgtggataagtgtcgtcaccttcaggaaaacctaaacagccatgtactgatcctgtccctgcagctgagcaaagccgaaagtaagagccgggtattgaaaaccgaactgcactatacaggggaggcactgaaggaaaaggcactggtgtttgaacatgtgcagtcagagttgaaacagaagcaatctcagatgaaggacattgagaaaatgtacaaaagtgggtacaatactatggagaaatgcatcgagaagcaggaacgcttttgccagctaaagaaacagaacatgctgttgcagcagcaattagatgatgcgcgtaacaaggctgataatcaagagaaagcgatactgaacatccaagctcggtgtgatgcacgggtccagaatctgcaggccgaatgtagaaaacatagactgctgctggaggaggacaacaaaatgcttgttaacgagttgaatcactccaaagagaaagagtgccaatatgagaaggaaaaagccgaacgcgaagtcgctgttcggcagctgcaacagaagcgagacgacgtcctcaacaaaggctctgctaccaaggcactgcttgatgcgagcagtcgccactgcacatacctggagaacggcatgcaggattccagaaagaagctggatcagatgcggagtcagtttcaagagatacaggaccagctgacagcaacaataaggtgtaccaaggaaatggaaggcgacactcagaaattggaagtcgagcacgtgatgatgcgaaaaatcataaagaagcaggatgatcaaattgaacgcctggaaaaaattcttcagcactcctctctaatgctgcaggttttcgaatcttag

SEQ ID NO: 26725 - DNA, 3627 bp, Artificial Sequence
  Description of Artificial Sequence: Synthetic coding sequence
atgggcgggggaaagagtggcaccgtatcctcacagaaacagcccgcctctaaggcaacaagcgacaaaacagactctgcgttgaacattgcgaccgagatcaaagatgggctccagtgcgggaccgtttcttcacaaaagcagcctgccctgaaggctactacagacgaagaggacagtgtgtcgaatatagctaccgagattaaagacggggagaaaagcggaaccgtgagttctcaaaaacaacccgccctcaaagcaacaactgatgaagaggacagcgtgtctaacatcgcaacagagataaaggatggtgagaagagcggcaccgtttcatctcagaaacagcccgctctcaaagcgaccacggacgagaaggactctgtgtcgaatattgctactgagataaaggatggcgagaagagcgggaccgtgtctagccagaagccccctgcactcaccgctacaagcgacgaggaaggttccgtactgagcatcgcacgcgagaataaagacggcgaaaaatctaggactgtttcttcacgaaagaaaccagctctgaaggccacttccgacgaaaaggattcatttagtaacataacaaggggcaagaaagacggcgagatcagcagaaaagtgagtagccaaaagcccccaactcttaaggggacgtccgacgaggaggacagcgtcttaggaatcgcacgggagaacaaggacggtgagaaatcccgtacagtctctagcgaaaaaccgccaggcctaaaagcttcaagtgctgagaaggactctgtgctcaacatcgcaagaggaaaaaaggacggcgagaagacaaagcgagtcagctcccggaagaaaccatctctggaagccacgtccgatgagaaggattccttcagtaacattacacgggaaaagaaagacggagaaatatcccgcaaggtgtcctcacaaaaaccaccggctcttaagggaacgtccgacgaagaggattctgttctcggaattgcgagggagaacaaagatggggagaagtctcgtaccgtctcttccgaaaaaccccctggcctgaaagccacttccgatgagaaggatagtgtgcttaacatagctcgagggaagaaggatggggagaagacacgcacagtcagttcacccaagcagcccgccctcaaggccatttgcgacaaagaagattctgtacctaatatggccactgagaaaaaagatgaacagatttcaggtaccgtctcgtgccaaaagcagcccgctctgaaggccacatctgataagaaggatagcgtttcaaacatccctactgaaatcaaggacggtcagcagagtggcacagtgagctcccaaaaacagcccgcttggaaggccacctcggtgaagaaagacagcgtatcaaacatcgccactgagatcaaggatggccagatccgggggaccgtgtcaccccaggtgcccatcccgcggcacaaggtgggaaacatcaagtcataccctaacacaggtcgccgaatccagttagatgccaacaccttcagcgtgagtcctcagaagcagtccgctcagaaagtgatctttaagaagaaagtgagcttacttaatattgcaactcgcatcaccgggggctggaagtctggtacagaataccctgagaacctacccactttgaaagctacgattgaaaacaaaaacagcgtgctgaacacagccacaaagatgaaagatgttcagaccagcactccagccgaacaggatctggagatggcaagcgaaggagagcagaagagactggaggaatacgagaacaaccaaccacaagtgaagaatcagattcactcacgggacgacctcgatgacatcatacagtcttctcagactgtgagcgaagacggggatagcctgtgttgcaactgtaaaaatgttattcttttaatcgatcagcacgaaatgaagtgcaaggactgcgtgcatctgctaaaaataaagaatactttttgcctgtggaagcggttgatcaagttaaaggacaaccactgcgaacagctgcgggtgaaaatcagaaaactcaaaaacaaagcgagtgtgttgcagaagcggatttctgaaaaagaggaaatcaagtcgcagctgaaacacgagatcctggaactcgagaaggaactgtgcagccttaggtttgctatccagcaggagaagaagaagaggcgcaacgtcgaagaggtgcatcaaaaggtgcgcgagaaactgagaatcacagaggagcagtatagaattgaggcagacgtaacgaagcccatcaagcccgccctcaagtccgcagaagtggaactgaaaaccggcgggaacaattcgaatcaggtgagcgagacagatgaaaaagaagatcttctccacgaaaaccggctgatgcaggacgagattgccaggttgcgtctggaaaaagatacgattaagaatcagaacttggaaaaaaagtacctgaaagactttgaaattgtcaagcggaagcacgaggacctacagaaagctttgaagagaaacggggaaacgctggcaaaaactattgcatgttactccggtcagctggctgcgctaactgacgagaataccactctgcggagcaaacttgagaagcaacgcgaatccagacagagactagaaaccgaaatgcagagctatcattgccgactcaatgcggcaaggtgcgaccacgatcagtcacacagctcaaagagggaccaggagctcgctttccagggcaccgtcgataaatgtcggcatctgcaagagaacttgaatagccacgtgcttatactgagcctccagctgtccaaggccgagagtaagtcgcgcgtcctgaagactgagttacactacacaggggaagctctgaaggaaaaggctctggtattcgagcacgtccagagcgagctgaaacagaaacagtcgcagatgaaagacatcgagaagatgtacaagtccggttacaacactatggagaagtgcattgaaaagcaagaaagattttgtcagcttaaaaaacaaaacatgctgttgcaacagcagctcgatgacgccagaaacaaagccgataaccaggagaaggcaattttgaatatacaagctagatgtgatgcccgtgtccagaatctgcaggcagaatgtcgaaaacatcgattgttactggaagaggacaacaaaatgctggtcaacgagctgaaccatagcaaggagaaggagtgccagtatgagaaagagaaagctgagagagaggtcgcagttcggcagctccaacagaagagagatgatgtcctgaataaggggtccgccacgaaggcacttttggacgcctcctcccgacattgtacatacctggaaaacggaatgcaggattctaggaaaaaacttgaccagatgcgctctcagttccaggagatccaggatcagcttactgctaccatcaggtgcacaaaagagatggaaggcgacacacaaaagctcgaggtagaacatgtcatgatgagaaaaattataaagaagcaagacgatcagatcgagcgcctggaaaagatcctgcaacactccagcctgctcctgctgaatttcgagacctag

SEQ ID NO: 26726 - DNA, 1821 bp, Artificial Sequence
  Description of Artificial Sequence: Synthetic coding sequence
agttctagaaagaaaccggccctgaaagctacaagtgatgagaaggatagcttctccaatattacacgtgagaaaaaggacggagagacatctcgcaccgtaagttcccaaaaacctccagctctgaaggccacaagcgatgaagaagattccgtgctatctattgcacgagaggagaaggacggagagaagtccaggacagtatctagcgaacagcctcccggtctgaaggctactagagatgaaaaagattctctgctaaacattgctagggtcatccaggccggaggccagtccttttcagtgagttctcgtaagaaggctgcccttaaagccactagcgacgaaaaggattccttcagtaacatcaccagggagagaaaggacggcgaaaccagtagaaccgtttcgagccagaagccccccgctcttaaggcaacaagtgatgaagaagattcagtcttgaatattgctcgtgagaagaaagacggagagaagagccggaccgtgtctagcagaaagaaagctgcactgaaagctacgagcgacgagaaggacagcttcagtaatatcactagggaacgcaaggacggcgaaacaagtaggactgtgtcctcacagaaaccccctgctctgaaagcaacttcagacgaggaagactctgtcctcaacatcgcaagagagaagaaggatggtgagaaatccaggaccgtcagctcagagcagccacctgggttgaaggctacaagggatgagaaggactcactgctgaacatcgcccgcggtaaaaaacacggtgagaagactagacgggttagcagccggaaaaaggcggctctgaaagctacgtcagatgaaaaggactcattttcaaatataacccgcgagagaaaagacggggagacctctcggaccgtgagttcacaaaaaccacctgccctcaaggccaccggtgatgaagaggattctgtgctgaacatagcccgagagaaaaaggatggggagaaatctcgcactgtttccagcgaaaagcccagtgggcttaaggccaccagcgacgaaaaggactctgttctgaatatcgcccggggtaaaaaacacggtgaaaagacaagacgtgtttcaagccacaaacaaccagcgctgaaggcaacatcggataaggaaaatagtgtccccaatatggccacagagaccaaggacgaacagatctctggcacagtgtcttcacagaaacaaccagctttgaaggccacctccgataagaaggactctgtgtcaaatattccaactgagattaaagatgggcagcagagtggtacagtcagctcccaaaagcagctagcctggaaggccaccagtgtcaaaaaagatagtgtgtccaatatagctacggagatcaaggacggacagatcagagggaccgtatcctcccagagacagcccgcactcaaggccacgggcgacgaaaaagacagcgtgtcaaacatcgcgcgcgagattaaagatggtgaaaaatcagggaccgtttctcctcagaagcagtcagcacagaaggtcatctttaaaaagaaggtctctttattaaatatcgctacaaggatcacaggcgggtggaagtctgggaccgaatatcctgagaatctccccacactgaaagccacaatcgagaacaaaaactctgtcctaaacactgccacaaaaatgaaggatgttcaaacaagcaccccagagcaagatctcgaaatggcttctgagggagaacagaaacgactagaagagtacgagaataatcagcctcaggtttacttctctttctag

SEQ ID NO: 26727 - DNA, 2400 bp, Artificial Sequence
  Description of Artificial Sequence: Synthetic coding sequence
atggcaaccgagaccaaagacgaacagatcagtggaactgtaagcagccagaagcagcccgcactgaaagccacatcagacaagaaggatagcgtgagcaacattccaactgagataaaggatggtcagcaatccggaaccgtgtcctcgcagaaacagctcgcatggaaggctacgtccgtgaagaaggattccgtctcgaacattgctactgaaatcaaagatgggcagattaggggcacggtttctagtcagcggcagccggccctcaaggccaccggcgatgagaaggattcagttagcaatatagctcgagaaatcaaggatggggagaagtctggtactgtgtctccccaaaaacagagcgcacagaaggttattttcaagaagaaggtctctcttcttaacatcgcaaccagaattacaggcgggtggaagagtgggacggaatatcccgagaacctacctaccctgaaggcaacaattgagaacaagaatagcgtcctgaacaccgcaaccaagatgaaggacgtccagaccagcaccccagagcaggacctggaaatggccagtgaaggggagcaaaagcgcctggaagaatatgagaacaatcagccacaggttaaaaaccagattcactcacgcgacgatcttgatgacataatccagagttctcagacagtgtcagaggatggagatagtctgtgctgcaactgtaagaatgtaatcttgctgattgatcagcacgagatgaaatgtaaggactgcgttcatctgctcaaaatcaaaaagactttttgtctatgcaaaagacttaccgaactgaaagacaatcactgcgaacagttgcgcgtaaagatacgaaaattaaaaaataaagcctccgttttgcaaaagcgactctctgagaaggaggaaatcaagagccagcttaaacacgagacactggagctggagaaggaactgtgtagcctgagatttgctatacagcaggagaagaagaagcgtaggaatgtggaggaactccaccaaaaagtccgggagaaactcagaattaccgaggagcagtataggatcgaggctgacgtgacgaagcccatcaagcccgctctgaaatccgccgaagtggaactgaaaactggggggaataacagcaatcaggtgtccgagactgatgagaaggaggatctccttcatgagaataggctgatgcaggacgagattgctaggctgaggcttgaaaaggacactatcaagaaccagaatctcgaaaaaaagtacttgaaagacttcgagatcgttaaaagaaaacatgaagatttacagaaagccctgaaaaggaatgaggagactttggccgaaactatcgcctgttactcaggccagctggccgctttgaccgacgagaacacgacgctgaggtcaaaacttgaaaaacagagggaatctgggcaaagattggaaaccgagatgcagagttaccgctgccgcctgaatgccgccttatgtgaccacgaccagagccactcctccaagcgcgatcaggagctggcttttcaggggactgttgacaaatgctgccatcttcaggagaatcttaactcccacgtcttgatcctgagcctgcagctgagcaaggccgaatctaaattcagagtcctggagactgagcttcattataccggagaagcactgaaagagaaagcgctcgtctttgaacacgtgcagtctgagcttaagcaaaaacagtctcaaatgaaagacatcgagaaaatgtacaagtcaggttataacaccatggaaaagtgcattgaaaagcaggagaggttctgccagcttaaaaaacagaatatgctgctgcaacagcagctcgacgatgcccgtaacaaggcggataaccaagagaaagctatactcaacattcaggcccgctgtgatgctcgcgtggagaatctgcaggccgaatgccgcaagcatcggctattattggaggaggacaataaaatgctcgtgaatgagctgaatcattccaaggagaaaaaatgccagtacgagaaggagaaggcagagcgggaagtcgccgtgagacagctacagcagaaacaggacgacgtcctcaacaaaaggagcgctacaaaagccctactggatgcgagcagcaggcactgtatctacttggagaatggaatgcaagattcaaggaaaaaactggaccagatgagatcacagtttcaagagatccaggatcagttgactgctaccattcgctgcacaaaggaaatggagggagatgcccagaagttggaggtggagaacgttatgatgagaaaaatcattaagaaacaggacgaacagatcgagaggttcgaaaagatactgcaacacagttccctggtgtag

SEQ ID NO: 26728 - DNA, 3090 bp, Artificial Sequence
  Description of Artificial Sequence: Synthetic coding sequence
tcctcaaggaagaaagctgcattgaaagcgacgagcgatgagaaagacagttttagtaacatcactcgagagcgcaaggatggagaaacgtctcgaacagtgtccagccagaagccaccggcgttgaaagccacatccgatgaggaagacagcgtgctgaatattgcccgggagaagaaggacggtgagaagagccgaactgtttccagcgagcagccacccggactgaaagccacccgggatgaaaaggatagtcttctgaacatcgcaaggggcaagaagcatggagaaaagacaaggcgcgtgtcatccaggaagaaagcagcactgaaggcgacctccgatgaaaaggacagcttttccaacatcactagagagagaaaagacggcgagacctcccggaccgtcagttcacagaagcctccagcactgaaggcaacaggtgacgaagaggattctgtgctgaatatcgctagggaaaaaaaggacggcgagaaatccaggacagtgagttccgaaaagcccagcggccttaaggcgacaagcgatgagaaggactctgtgttgaatattgcacgaggaaagaaacacggggagaaaactagaagagtgtcaagccataagcagccggctcttaaagcaacatcggataaagagaactctgtacctaatatggcaaccgagactaaagatgagcagattagtggaacggtctcttcacagaagcagcccgccctgaaggcgacatctgacaaaaaagattctgtgagcaacattccgacagaaatcaaagatggccagcaatccggcactgtctcgagccaaaagcaactcgcctggaaggcaacttctgtgaaaaaggactctgtaagcaacattgctaccgaaatcaaggatggtcaaataagggggaccgtgagtagtcaaaggcagcccgctctcaaggcaaccggcgacgagaaggactccgtgtccaatatcgctcgcgagatcaaggacggtgaaaagtccggcacagtgtctccccaaaagcagtctgcacaaaaggtaattttcaagaagaaggtgagcctcctgaacatcgccacccggatcaccggcggctggaagtccggaaccgagtacccagaaaatctgcccaccctaaaagcaactattgaaaataagaattccgtgctcaatactgctaccaaaatgaaggatgtgcaaacttccacccctgagcaggacctagaaatggctagcgagggtgaacagaagagactggaggaatatgaaaataatcagccgcaggttaaaaaccagatccatagcagagacgacctggacgacatcatacaaagctcacagacagtatccgaagacggcgactctctgtgctgtaattgcaaaaacgtgattttgttaatcgatcagcatgagatgaagtgcaaggattgtgtccacttgctaaaaattaaaaaaaccttctgtctgtgcaagcgcctgaccgagttaaaagataaccactgcgagcagctgagagtaaagatacgtaagctcaagaacaaagcttccgtgctccagaaacgcctgtccgagaaggaggaaataaagtcccaattgaagcacgagaccctcgaactggaaaaagagctctgctcactccgctttgctatccagcaagagaaaaaaaagcggagaaatgttgaagaattgcatcagaaggtgcgagagaagctgaggattaccgaggaacaatacaggatcgaggctgatgttaccaagccaatcaagcctgccctaaagagcgccgaggtcgagctcaaaacaggcggaaataactcaaaccaggtgtccgagactgatgagaaggaagatctcttgcatgaaaaccgtctaatgcaagatgaaattgcaaggctccgtctggaaaaggataccatcaagaatcaaaacctggagaaaaagtatctaaaagactttgaaattgtgaagagaaagcatgaggacctgcagaaggcccttaagagaaacgaggagacactagccgagaccatcgcctgttattctggtcagttggcggctctgaccgacgagaacactacacttcgcagcaaactggagaagcagcgggaaagcggtcaacgcctggagactgaaatgcagtcttatcgatgtcgcctcaatgcagctctctgcgaccacgaccaatcgcacagcagtaaacgcgatcaggagctggcatttcagggcaccgtggacaagtgttgccatttgcaggaaaacctcaattcccatgtgcttattctgagtcttcagcttagcaaggcggagagtaaattccgagttctcgagaccgagctccattatactggagaggccctgaaggaaaaggcactcgtgtttgagcatgtccagagcgagttgaagcagaagcagtcccagatgaaagacatcgagaagatgtacaaatccggctacaacaccatggagaagtgcatcgagaagcaagagcgtttttgccagctcaagaaacaaaatatgcttctgcagcagcaactcgacgatgcacgtaacaaggccgataaccaagagaaagcaattttaaatatccaggctcgatgtgatgcccgggtggagaatctgcaggccgaatgcagaaagcatcgcttgctgctagaagaagataataagatgctcgtcaacgaattgaatcactctaaggagaagaagtgtcagtacgaaaaagagaaggccgagagagaggtggcggtgaggcagctccagcagaaacaggacgacgtcctgaacaaaagaagcgcaacaaaggcattactggacgcaagctcacggcactgcatctatctggagaatggtatgcaagatagcagaaagaagctggatcagatgcggtcccaattccaggagatccaggatcaactgacagctacgatacggtgtacaaaggaaatggaaggcgatgcgcagaagctggaggtggagaacgtgatgatgagaaagatcattaaaaagcaggacgaacagatcgagcggttcgagaagatcctgcagcactcgagcctggttagtattatctttgagacctag

SEQ ID NO: 26729 - DNA, 5337 bp, Artificial Sequence
  Description of Artificial Sequence: Synthetic coding sequence
atggacgataaagagcccaagcgctggcccactctgcgcgatcgtctttgctcggacggcttcctattcccccaatatccgatcaagccctatcacttgaagggtatccaccgcgcagtattctaccgggacctcgaggagctaaagtttgttctgcttaccagatatgatataaataaacgagacaggaaagagagaactgccctgcacttggcctgcgcaacagggcagccggagatggtgcacctcctggtgtcaagaagatgtgagctgaacctatgtgatagggaagatcggacccccctcattaaggcagtccagctgagacaggaagcctgtgccaccctgttattacagaacggagctgatccaaacattacagatgttttcggtcgaactgccctccattacgccgtgtacaacgaggacacatctatgatcgaaaagttattatcatacggtgccaacatagaagaatgctctgaagatgaatacccccccctgtttcttgccgttagccaaaggaaggttaagatggtggaattcctgcttaaaaaaaaagctaacatcaacgccgtcgattatctgggacggtccgctttaattcatgccgtaaccctcggcgagaaagacattgtgattcttctgttacaacacaacattgatgttttcagccgggacgtgtatggcaaactcgccgaagattatgcttccgaggcaaagaatagggtcattttcgaattgatctatgaatatgagagaaaaaaacacgaggagctctctataaacagcaacccagtgtcctcccagaagcaacctgcactaaaggccacctctgggaaggaggacagtatctcgaatatcgccaccgaaatcaaggacggacagaagtctggaactgtgtcgtcgcagaaacagcctgcattgaaaggaaccagcgataagaatgactcagtgtctaatactgccaccgaaatcaaggatgagcagaagagcggtactgtgtcatctcagaagcagcctgccttaaaggatacttccgataaaaatgacagtgtgtccaacacagctactgaaatcaaagacgaacagaaatctggcacggtgctgcctgccgtggagcagtgcctgaataggtccctctataggcccgatgctgttgcgcaacctgtgaccgaggatgagtttgccctggagtcggagatcatctcaaagctgtacatccccaaaagaaagatcataagccctcgcagcattgaggatgtactgccacccgttgaggaagccgtggaccgctgtctctacctgctggaccgatttgcccaggcagtcacaaaagacaagttcgccctggaaagcgaaaatatttcagaaccctactttactaatcggcggaccattagccagcagagcgccgagaaattagatgcagcatgcggtatcgacaaaaccgaaaatggtacgctgtttgaggatcagaatgtggataaagagggcaaggccctacccgccaccggacagaaagccaatgtttcccccgagcagccaccactctttacacacaccgtcaaagactctgaccatattagcaccagatttctcggctctatggactctctgacgtccagtgaggagagctccgagagaccgcctttgtcgacactgactttaaaagaagctgaccccagttctaaagcagcaatgaggcggaaagacagcccacctccagggaaggttagttctcagaagcaaccagcggaaaaagctacgagcgacgacaaggattcagtctccaatattgctacagaaattaaggaagggccaataagtgggaccgtgagtagtcagaagcaacccgctgagaaggctacctctgatgagaaagatagcgtaagtaacatcgcaaccgaaattaaggaaggacagcagtctgggacagtgtcgcctcagaagcagagcgcttggaaggtgatcttcaaaaaaaaggtgagtctgctgaacattgctaccaggatcaccggaggtggaaagtcagggaccgtctcctcgcagaaacagccgccaagcaaagctacttcagacaagaccgattcagcactgaatatcgcaaccgaaatcaaggatggcttgcagtgtggaaccgtgagcagccagaagcaaccagccttgaaggccaccaccgatgaggaggacagcgtgtcaaacatagccacagagatcaaggatggcgaaaagtctgggacagtttcaagtcagaagcaaccagccctgaaggccacaacagacgaggaagactcagtgtcaatcatcgcaaccgagattaaagacggcgaaaaatccggaacggtctccagcagaaaaaaacccgctctgaaggccacgtccgacgaaaaggactccttctccaacattacacgtgaaaagaaggacggagagatttcccgtaccgtgacctcagagaagcccgccggtctgaaggcaacctccgatgaagaagatagcgtgctaaatatcgcacggggcaaggaagacggagagaagactcgtagggtgagttctaggaagaaacccgccctgaaggcaacctctgatgagaaggactcctttagcaatatcacacgggagaagaaggacggtgaaactagccggacagtgtcgtcacaaaaacctccagccctgaaggctacaagtgacgaagaagactccgtgcttaacatcgctagagagaaaaaggatggggagaagagcaggaccgtatcctcagagaagccttcaggactgaaggcaactagtgacgaaaaagactccgtccttaacatcgcccgcggcaagaagcacggtgagaaaaccagacgtgtgtcctcgcataaacagcctgccctcaaagcgacctcagacaaggaaaatagtgtgccgaatatggccacagaaaccaaggacgaacagatttccggcaccgtctcttcacagaagcagcctgcccttaaggcgacttctgataagaaagattctgtgtcaaatattccaaccgaaatcaaagacgggcaacagtctggcaccgtgagttctcagaagcagttagcttggaaggcaaccagcgtcaagaaggatagtgtttccaatattgcaaccgaaatcaaggacggtcagatcagagggaccgtgtctagccagcggcaacccgccttaaaagccaccggcgacgagaaggacagcgtgagcaacatcgctcgggagatcaaggatggagagaagtctggcaccgtatctccacagaagcagtccgctcagaaggtgatcttcaagaagaaagtgtccttgctcaacattgccacgaggatcactgggggttggaaatcgggcaccgagtacccagagaatctgcctacactcaaagcaacaatcgagaataagaacagcgtcctgaacaccgccacaaaaatgaaagatgttcaaactagcacccctgagcaagacctggaaatggcaagcgaaggggaacaaaaaaggttggaggaatacgaaaataaccaacctcaggtgaaaaatcagattcattctcgcgatgaccttgacgatatcattcaatcgagccaaactgtatccgaggacggagacagcctttgttgcaattgcaaaaacgttattctgttgatagaccaacacgaaatgaagtgcaaagactgtgtgcacctcctgaagatcaagaaaacattttgcctctgcaagcgcctgaccgagctcaaagacaatcattgcgaacaactgcgcgtgaagatcagaaaactgaagaacaaggccagcgttctgcagaagagactgtccgagaaggaggagataaagtcacagctgaagcatgaaaccctggagttggagaaagagctgtgctcactgcgttttgcaatacagcaagagaaaaaaaaaaggcgcaacgtggaagagttgcaccaaaaagtccgagagaagcttcggataaccgaggagcagtatcgcatcgaagccgatgttaccaagcctattaagccagcccttaaaagtgcagaggtagagttaaagaccggcgggaacaacagcaatcaggtgagtgagacagacgagaaagaggacttactacatgagaataggcttatgcaagacgagatcgccaggcttcgcctggagaaggatacgatcaagaatcagaatctggagaagaagtatctgaaggacttcgagattgtgaaaaggaaacatgaagatttgcagaaagccctgaagcgtaacgaggaaacactagcagagaccatagcatgctacagcggacaactggctgcactcactgatgaaaatactactcttcgttctaagctggagaagcagcgcgagtctggtcagaggttggaaacggagatgcagagttaccgctgcaggctcaacgctgcattgtgcgatcacgatcagtcacacagtagcaagcgcgaccaggaactggccttccaaggtaccgtagacaaatgttgccatctgcaagagaacctcaactcacacgtgcttatactgagcctgcaattgagcaaggccgaatctaagttccgcgtgttagagacagaactccactacacaggtgaagctctaaaagagaaggcattagttttcgaacacgtgcaatcggaactgaaacagaaacagagtcaaatgaaggacatcgaaaaaatgtacaaatctggctataatacaatggagaaatgcattgaaaaacaggagagattctgtcagttgaaaaagcagaatatgctgcttcagcagcagctggacgacgctcggaataaagccgacaaccaggagaaggccatactgaacatccaggccaggtgcgacgcacgcgttgaaaacttgcaggccgagtgccgtaagcacagactgttactggaggaagataacaagatgttggttaacgagctgaatcactcaaaagaaaagaaatgccaatatgagaaggagaaagcagaacgcgaggtggcagtgagacagctgcaacagaaacaggatgacgtgttgaataagagaagcgccacgaaggccctgctagatgcatcatctaggcactgtatatatttagagaacggcatgcaggattctaggaaaaagctcgaccagatgcgcagtcagtttcaggaaattcaggaccagctcaccgctactatccggtgcacaaaagaaatggagggtgacgcccagaaactggaggtggaaaatgtaatgatgagaaagatcattaagaaacaggatgaacagatcgagcggttcgagaaaattcttcagcatagctcgctgatgctgcaggtgtttgagagttag

SEQ ID NO: 26730 - DNA, 552 bp, Artificial Sequence
  Description of Artificial Sequence: Synthetic coding sequence
atggcgacgcccagaccttgcgccgatggcccgtgttgttcccacccaagcgcggtcctcggggttcagcagactcttgaggagatggattttgaaagagggatttggtccgccgcgctaaacggcgaccttgggcgggtcaaacaccttattcaaaaagcagaggacccttcccagcccgacagtgccgggtacactgctctgcattacgcttcccgcaatggtcactacgcagtgtgtcagtttcttcttgaatctggggctaaatgcgatgcccagactcacgggggagctactgctctgcaccgtgcgagctactgtggtcacactgagatcgctcggttgcttctatcgcacggttctaaccctcgggtggttgatgacgatgggatgacaagtcttcataaggctgccgagcgaggccacggggacatctgttcattactgcttcagcatagcccagccctgaaggcgatacgcgacaggaaggctagactggcatgcgatctgctcccgtgcaacagcgacttgcgagacctcctatctagttag

SEQ ID NO: 26731 - DNA, 1107 bp, Artificial Sequence
  Description of Artificial Sequence: Synthetic coding sequence
atgaacgcgttgcttgagcagaaagagcagcaggagcgcctgcgcgaagccgccgcgctcggagatatccgggaggtgcagaagctcgtcgagagcggagtggatgtgaacagccagaacgaagtgaacggatggacttgcttacattgggcttgtaagagaaaccacggccaagtagtgagctacctgctgaagagcggtgccgacaaagagattctgacgaccaagggagagatgccggtccagcttacgagccgaagagagatccggaaaataatgggagttgaagaggaagacgatgatgacgatgatgatgataatctaccacagctcaagaaagaaagtgagcttcctttcgtgcccaactacttagccaacccagcattcccattcatttacacaccaacggctgaagatagcgcccaaatgcagaatggcgggccatcaactccccctgcctctccgccagcggatgggtctcctcccttgctgccacccggggaaccaccactcctgggcacattcccaagggaccataccagtctggctctggttcagaacggcgatgtgagtgctccatccgcaatcctgcgcactcctgaaagcactaagccgggacccgtctgccagcctcccgtgagtcaatctcgcagcctgttctcttccgtgccctccaagcccccaatgagccttgagcctcagaacggtacatatgccggacccgccccagcttttcagccatttttctttactggggcctttcccttcaacatgcaggagttagtgctgaaggtccgcattcagaatcccagcctgagagagaatgactttatagagatcgagctggacagacaagagctgacttaccaggagcttttgagagtctgttgttgtgaactcggcgttaatcccgaccaggtggagaagatccggaagcttccgaatactctgctgcgcaaggacaaggatgtggccagactccaggacttccaagagctcgaactcgtgcttatgatcagtgaaaataacttcctctttcgaaatgcagcaagtactctgactgagaggccctgttacaatcgacgggcatccaaattaacatattag

SEQ ID NO: 26732 - DNA, 777 bp, Artificial Sequence
  Description of Artificial Sequence: Synthetic coding sequence
ggcgagacacttgcattcccaggtcacgtggcggcattcaaaggggacctgggcatgctaaaaaagctggtggaggatggcgtgatcaatatcaatgaacgagcagataatggttccacgcccatgcataaggcggcggggcaggggcatatcgagtgcttgcagtggctgatcaagatgggcgccgattcaaacatcacaaataaagccggagaaaggccttcggatgttgcaaagcggttcgctcacttagctgccgtaaagctcttggaggaattacagaaatacgatattgacgatgagaacgagattgatgagaacgacgtgaaatattttataaggcacggggtggaaggaagtaccgatgccaaagatgacctgtgcctttccgacctcgacaaaacggacgcccggatgcgagcctacaaaaaaattgttgagttacggcatctgctggagattgctgagagcaactacaaacatttgggcggcatcaccgaagaggatctgaagcagaagaaggagcagctggagtctgagaagacaataaaagaattgcaaggccagttagaatacgaacgtctgaggcgtgagaagcttgagtgtcaactcgatgaatacagggcggaggtggaccagctgagggagacgctcgaaaagattcaggttcccaattttgtggccatggaagacagcgccagctgtgaatccaataaagaaaaaagacgggtaaagaagaaggtgtccagtggaggggtcttcgtgcgacggtattag

SEQ ID NO: 26733 - DNA, 597 bp, Artificial Sequence
  Description of Artificial Sequence: Synthetic coding sequence
atgcccggcgtggcaaattctggacccagcacaagctctagggaaaccgctaatccatgttctaggaaaaaggtccactttggcagtatacatgatgccgtccgcgcaggggacgttaaacaattgagtgaaatcgtggtgagaggggccagtatcaatgaattggatgttctgcacaagttcactcctctgcactgggcggcccatagcggatcactggagtgtctgcactggctcctttggcatggcgctgacattactcacgtgacaacccgcggctggacggcctcgcacatcgccgctatcagagggcaggacgcgtgcgtgcaggcgcttattatgaacggcgccaatctgaccgctcaagatgatcgtggatgcacccccctacatctggccgcaacacacggacacagctttacattgcaaatcatgctgcgatcaggcgtggatccatcagtaacagataagcgcgaatggcgaccagtccattacgctgcttttcacggtcggttaggatgtctgcagctactggtgaaatggggctgttcaatcgaggacgtggattacaacggtaacctgcctgaacccccttag

SEQ ID NO: 26734 - DNA, 1170 bp, Artificial Sequence
  Description of Artificial Sequence: Synthetic coding sequence
atgcccggagtagcaaattcaggaccgtctacctcttcccgggagactgccaatccctgcagcagaaagaaggttcatttcggatctattcatgatgccgtgagggcgggggacgttaagcagctctcagagatcgtctgtctccattggctcttgtggcacggagccgatattacccacgtgactacgcgtggttggactgcctcccacatcgcagctatccggggccaggacgcatgtgtccaggcccttatcatgaatggtgctaacctgaccgcccaggacgatcgcggatgcacacctctgcacctggctgcgacccacggccactctttcaccttgcagatcatgctgcgatctggcgtggatcctagcgtcacagacaaaagggagtggcggcctgtccactatgccgcctttcacggcagactgggctgccttcagctgctggtgaagtggggttgtagcattgaagacgttgattacaacggcaacctgcccgtgcacctggcggctatggaagggcacctccattgctttaagtttctcgtatccaggatgtcctctgctactcaggtcttgaaagcctttaatgataacggagagaacgttctggacctagcccagagattcttcaagcagaatattctgcagtttatccagggggctgaatatgaaggcaaggatttagaggatcaggagacactggccttccctggccatgtcgcagccttcaagggagatctgggtatgttgaaaaaactcgtcgaggacggggtgataaacataaatgaacgcgcagacaacgggtctactcccatgcacaaggcagccggccaaggccatatcgaatgcctacagtggcttatcaaaatgggcgctgactccaatatcacgaacaaggccggagagcggcccagtgacgtggccaaaagattcgcccacctggcggcagtcaaactgcttgaagagttgcagaagtacgatattgatgatgaaaatgagatagatgagaacgatgttaagtacttcatcaggcacggggttgaaggctctaccgatgcgaaggatgatctctgtctctctgatctcgacaagaccgacgccaggcggcccagcaaaaactgtagggcctcttggtctatgaacgactacgtggagaaaaactag

SEQ ID NO: 26735 - DNA, 1776 bp, Artificial Sequence
  Description of Artificial Sequence: Synthetic coding sequence
tcttttccacggcgaaggccttgttgcctctcgagccaggtggccggtgtggggagactagagagagatagcgagaaagtccccgctgaaggaggacggaggtatggtgacagccagggagtcgccgatgaagacggcggccgcagaacctcccatcatgtgtggcgcattaacggtttgcatggccactccggagcggaaagtagggaaagggtttccgatgatggggaaagaaaatgtgaggagagtgataggcgcagtagagtggccgcagggtcacttagtgcggacgccggcttcagccgctctgacctcaggagggtctcagaaaatctgggccattgccgatccgtgtctagagagcgagtgaggggtgacagcggtcattcacactcatgttcgtgggagagggtgagaggcgacagcaccttctgtagttcagacgtaaatttttccgaagtggggggtcaccagacaactgattccaggggaaccgctagagaagatcggggcttaaggttgagcggcccttgggagggagtatcggatataagagacccaagaacaagtgatttcggagacagggtttccgatgacagaagcaggagattttctggctcatgggagggcggttccgtggaaggtggccactcggtcgggagttcttgggaggaagtgtctggtgaccgaggttacgctgcatctgacagttcaggcgtgtctggtagcgaagacgccagttacaggttctctggcttttgggagagagagtctgaggatgagggtttcagatgtagcttttgggagagggctagagaagacctcggcccacggccctcagacgatggggaagaaggccgctgtagatgtagcggttcgtgggtgcgggctagtgaggaccgcaggagtatcagaggactggattcaacacctccccagagtagacgatgttgcgctatgcctggagtggccaacagtggcccttccacaagctctagggaaaccgcgaacccctgttcccgaaagaaggtgcactttggatccattcacgatgccgtgcgggctggagacgtgaaacaattaagtgaaattgtcgtcaggggcgcatcaatcaacgaactggacgtactccacaagttcaccccactccactgggcagcacacagcggctctcttgagtgcctgcattggttactgtggcacggtgctgacatcacacacgttacaaccaggggctggaccgcatctcacattgcagcgatccggggccaggatgcttgcgtccaagccctgattatgaatggtgccaacttaaccgctcaggatgatcgaggatgcacccccctgcaccttgcagccacccacggccattcatttactctgcagatcatgctaagatccggggtagaccctagtgtaaccgacaagcgcgaatggcgtcccgttcactatgctgcttttcacggccgcctggggtgccttcagctgctggtgaagtggggctgcagcattgaggacgtcgactataacgggaacctcccagttcatctggcagccatggaggggcatttgcattgctttaagttcctggtaagtcgtatgagctctgcaacgcaagtgttgaaggcattcaacgacaacggagaaaacgttttggaccttgctcagcgattctttaagcagaacatacttcagttcattcaaggatctccaaaacccgcgaccgatttacagggagaaacgggggctactgagctggcaccccgcgagtcatag

SEQ ID NO: 26736 - DNA, 1650 bp, Artificial Sequence
  Description of Artificial Sequence: Synthetic coding sequence
atggccctggctgctgcggctgctgctgctgctgccggagtgtcccaggccgccgtcctggggtttctgcaggaacacgggggaaaggtgcggaacagcgaactgctgtcccggtttaagcctctgctcgacgcgggagatccccggggccgggctgctaggcgagacaggttcaaacagtttgtaaacaacgtcgccgtggtcaaagaactggatggtgtgaagttcgttgtattgcgtaaaaaacctagaccccccgagcctgagccagcacctttcggtcctcccggcgccgccgcacagccttccaaacctacttccaccgtcttaccacgatcagcctcagcccctggggcccctcccttggtgagggtgcctcggcctgtggaacctccaggggacctgggactcccaacagagccccaagacactccagggggacccgctagtgaacccgcccagccgccaggcgaacggagcgcggacccacccttacccgccttggagcttgcacaagcaactgagcggccaagcgctgacgccgcccctcctcctcgggccccatctgaggcagcaagcccctgttccgatcccccagacgctgagcccgggcccggggccgctaagggtcctccccaacaaaaaccgtgtatgctgcccgtgaggtgcgtgcctgctccagcaacacttcgtttacgcgctgaagagcctggacttagacgccaactgtccgaagagccctccccccgctcctccccccttttactcagacgtctatcggtggaggaatctggcctggggctgggcttgggccctgggaggagcccccaccttagacggctgtcaagggccggtccgagactgctgtccccggacgccgaggagctgcccgctgcaccaccgccttcagcagttccattggagcccagtgagcatgaatggttggtgcgcaccgccggaggaagatggacacaccagctgcacggcctgttgttgagggacaggggtctcgccgcgaaaagagacttcatgagcggattcaccgctctgcattgggccgccaagtctggcgacggcgagatggcgcttcagctcgtggaggtggcacgcagatcaggagctcctgtggacgtcaatgcacgctctcacggggggtacaccccccttcacctcgctgcactgcacggtcacgaggatgccgccgtcctcctggtggtccggctgggtgctcaggtccatgtccgggaccacagcggtcgaagggcctaccagtatcttagacccgggagcagttacgcccttaggcgattgctgggtgatcccggtctgagaggaactaccgaacctgatgcaacagggggaggaagtgggagtttagctgcccggaggcccgtgcaggtggcggccactatactgagctccacaacgagcgcattcctcggcgtactggccgatgatcttatgctccaggacctggctcgaggccttaaaaaatcatcatccttctctaaattcctgagcgcctctcccatggcaccccgaaagaagactaagatcagaggtggtttacccgccttttctgagatttcccgcaggcccacacctggcccactggctggactcgttccatcttttcctcccaccacgtag

SEQ ID NO: 26737 - DNA, 2958 bp, Artificial Sequence
  Description of Artificial Sequence: Synthetic coding sequence
cagccccccttggtgcaggccatctttagcggagatcccgaagaaattcgtatgctcatacacaaaactgaggatgtgaatacactagacagcgaaaagcggacccccctgcacgtggccgcgttcctgggggatgctgaaattattgaactgttgatcctcagtggagctagagtgaacgcaaaggataacatgtggctcacccctctccacagggccgtagctagcaggtctgaggaagccgttcaggtgctgatcaaacactctgccgacgtcaacgctcgtgacaagaactggcagacccccctccacgttgctgccgctaacaaagctgtcaaatgtgccgaagttattattcctctgctatcgtctgtgaacgtgagcgaccgtggcggacgcaccgccctacaccacgccgccctcaacgggcatgttgaaatggtcaacctgttacttgccaagggggctaacattaacgctttcgataagaaagacaggagagctttgcattgggcagcttatatgggacatcttgacgtggtagcactactgataaatcacggcgctgaagtcacatgtaaagacaagaagggatatacaccccttcatgctgccgcgtccaacgggcaaatcaatgtggtgaaacacttgctaaatctgggggtggaaattgacgaaatcaacgtgtacggaaacacagcactacacattgcttgctataacggacaggacgccgtggtcaatgagcttatcgattacggcgcaaatgtaaaccaacccaataataacggtttcaccccgctccactttgccgccgcctctacgcatggggcgctatgcctggaactgctcgtgaacaacggcgcagatgtcaatattcagtctaaagatgggaagtcacctctgcatatgactgcggtacacgggagatttacacgcagccagacactcatccagaacggaggagaaattgattgtgtggacaaggacggtaataccccactccacgtggcagcccgctacgggcacgaactcctaattaacaccctcattacaagtggtgccgacaccgccaaatgcggcattcattccatgtttcccttacacttggccgctctcaacgcgcatagcgactgttgtcggaagttactcagttccggctttgagattgataccccagacaagtttggcagaacgtgtttgcatgccgccgcagcaggagggaatgtagagtgtattaagttactgcagagcagcggtgcggatttccataagaaggacaaatgtggccgcacacctctccactatgcagcagccaattgccactttcactgtatagagacactggtgaccacaggggcaaacgtcaatgagactgacgattgggggcgcaccgctttgcattatgccgccgcaagtgatatggatcggaataagacaatcctcggcaacgctcatgacaacagtgaggaactggagcgtgcaagggaactgaaggagaaggaggccaccttgtgcctggaatttcttctgcagaatgacgccaatccttcaatccgagacaaagagggatacaacagcatccattatgctgctgcatatggacataggcaatgcctggagctgcttctcgagcgaaccaactctggttttgaggagagcgattcaggcgccactaagtcccccctgcacctagcagcttacaacggacatcaccaggctttagaggtgcttctgcaatctttagtagacctcgatatcagggatgagaaggggcgtacagccctggacctggccgcttttaaggggcacaccgagtgcgttgaggcattgatcaaccagggagcgtcaatattcgtgaaggataacgtgaccaagcgcactcccttgcatgcttccgtgatcaacggccacaccctttgtcttaggctactactggaaatcgcggataatcctgaggccgtggacgtgaaagacgcgaagggccagacaccactgatgctcgcggtggcgtacgggcacatcgatgcggtaagtctgctgctggagaaggaggccaacgtggataccgtggatatcctgggctgtacggctctccataggggtatcatgaccggtcatgaagagtgtgtgcagatgttgctcgagcaggaggtgagtatcttgtgtaaagattcgcgcggccgaaccccgcttcactatgccgccgcccggggtcacgcaacttggctctcagaattgctgcaaatggccctctcagaagaagactgttgctttaaagataatcagggttatacccctctacactgggcctgttacaacggcaacgagaactgcatcgaggtactcctggaacagaagtgctttagaaagttcattggaaacccttttactcctcttcactgtgcgattattaacgaccacggaaactgcgcctcattactgctcggagcgatcgattcttccatcgtctcctgtagggatgataaaggcagaacccccctgcatgcagccgcttttgctgatcacgtggagtgcctccagctactactgaggcactccgcacctgtcaatgccgtggacaattctggcaaaaccgccctgatgatggccgcagagaatggacaggctggcgcagtggatattcttgtcaactccgcacaggccgacctcacagttaaagataaggacctgaacacaccgttgcacttagcatgtagcaaaggacatgagaaatgcgccttgctgattttagataagatccaggacgagtcccttataaacgagaaaaataatgcgttgcagaccccactgcacgtggcggctaggaatggtctcaaggtcgttgtcgaagagctcctagcaaaaggagcgtgtgtgctggctgtcgacgagaatgcaagtcgttcaaatggacccaggtccacacccggcacagccgtgcagaaggaggagtag

SEQ ID NO: 26738 - DNA, 2760 bp, Artificial Sequence
  Description of Artificial Sequence: Synthetic coding sequence
atgctaattcacaagaccgaggacgtgaataccctcgattccgagaagcgcactcctttacacgtagcggccttcctaggcgatgccgagatcatcgagctgctcatcttgtcgggtgcgagagtgaatgcaaaggacaatatgtggctgacgcccctccacagggccgttgccagccgatctgaggaagccgtgcaggtcctcatcaagcattcagctgatgtcaacgcacgcgataagaattggcagacgccactacacgttgctgccgccaacaaggccgttaaatgtgcagaggtcatcatcccccttctttcatcagtgaatgtttctgatcggggaggaagaaccgccctgcatcacgccgcactgaacggtcatgtagagatggtcaacttattactcgccaagggtgcgaatattaacgcattcgataagaaggacaggcgcgcactccactgggcggcctacatgggccaccttgatgtggtggctctcctgatcaaccatggcgccgaggtgacctgtaaggacaagaagggttatacccccctccatgctgccgcgagcaatgggcaaatcaacgtggtcaagcacctgctcaacctcggcgtggagatcgacgagattaacgtatatggcaataccgccctgcatatcgcttgttataacggccaggacgctgtcgtgaatgagctcatagactacggcgccaacgtgaaccagccaaataacaatgggtttaccccactccacttcgccgccgccagtacacatggggccctgtgtctggagttgttggttaacaacggcgctgacgtgaatattcagagtaaagatgggaagagtcccttacatatgacagccgtccacggcagatttacgagatcacagactttgattcagaacggaggcgagatcgactgtgtggataaggatggtaacactccgcttcatgtagccgctcgctatgggcacgagttgttgatcaacactctgattacctctggggcggacacagccaaatgtggaatacacagcatgtttcccctgcatttggcggcactgaacgctcactccgattgttgcaggaaattactgtcttccggattcgaaattgacacacccgacaagtttggaagaacttgcctgcacgcagccgctgcaggtggaaacgtagaatgcataaagctcctgcagtcatcaggagcggactttcacaagaaagataagtgtggccgtacacccctgcactacgccgccgccaattgccattttcattgcattgagacactcgtgactacaggggccaacgtgaacgaaaccgacgactgggggaggacagcactgcattatgcagcagcatctgacatggaccgaaataaaaccatcttggggaacgctcacgacaattccgaggagctcgagagagccagggagctgaaggaaaaagaggccaccttgtgtctagagtttttactccaaaacgacgccaaccctagtattcgcgataaagaaggatacaactcaattcattacgccgccgcctacggccatagacagtgcctggagctgctcctcgagaggactaatagcggtttcgaggagtccgactccggggccaccaagtctcccctgcatctggcagcatataatggtcaccaccaggcactggaggtcttgcttcagagtcttgtcgaccttgacattagggatgaaaaaggtcgaacggctctcgacctcgccgcctttaaaggtcacaccgagtgtgtagaggctctcatcaatcagggcgcttccatcttcgtgaaggataacgtcacaaagcgcacgccgctgcatgcgagcgtcatcaacgggcacactctgtgtctccggctgctactagaaatcgccgacaaccctgaggccgtggacgtgaaagacgcaaaaggtcagaccccactgatgcttgccgttgcctatggacacatcgacgcggtctctctgctgttggaaaaggaggccaatgtggacacagtggacattctagggtgcactgcgttgcaccggggcatcatgaccggacacgaggagtgcgtccagatgcttctggagcaagaagtctcaatcctatgtaaggattcacggggtagaactccccttcactacgcagccgccagaggccacgcaacatggctctccgaacttcttcagatggctctatccgaggaggactgttgttttaaagataatcaaggatacactccactgcactgggcctgctacaacggaaatgaaaactgtatcgaggtgctgctggaacagaagtgtttcaggaagtttattggaaatcctttcactcctctgcattgcgctataatcaacgaccatgggaactgcgcctctctccttttgggggctatagatagctccattgtgagttgtcgcgatgacaaaggaagaactccgcttcacgccgccgcatttgccgaccatgtcgagtgcctccagctgctgctgaggcattcagcacctgtgaatgctgtcgataacagcgggaagacagcactcatgatggctgcagaaaatggacaggctggcgcagttgatatattggtaaacagcgcacaggccgaccttactgtgaaggataaggacttaaatacacccctacacttggcttgctccaaaggtcacgaaaaatgcgcactgctgattctggacaagatccaggacgagtctcttatcaacgaaaaaaacaatgcactgcagacctag

SEQ ID NO: 26739 - DNA, 2760 bp, Artificial Sequence
  Description of Artificial Sequence: Synthetic coding sequence
ctgctcatctacaaaacagagatcatttcgaccctggactctgagaagaggactccactgcacgtcgcagcctttctgggggatgcggagattatcgagttattaatcctcagtggcgcccgggtgaatgcaaaggacaatatgtggctgacaccgttgcacagggctgtggcttcgaggtccgaggaagccgtccaggtcctcataaaacactctgccgatgtaaacgcccgggataagaattggcagacaccattgcatgtcgccgccgctaacaaagctgtgaagtgcgccgaagttatcatcccgctgctgagttcagtaaacgtgagtgaccgaggtggacgtaccgcgctccaccacgcagccctgaatggacatgttgagatggttaatctccttctcgctaagggtgctaatatcaatgctttcgataagaaagataggcgcgcgctccattgggctgcttatatggggcatctggacgtcgtggctctgctaattaaccacggagctgaggttacctgtaaagataagaagggctacacccccctgcacgctgccgcatctaacggacaaatcaacgtggttaaacatctgcttaatcttggagtcgagatcgacgaaataaacgtctacggcaatacggcgctacatattgcctgctataatggacaggacgctgtggtgaatgaattgatagactatggggccaatgttaatcaaccaaacaacaacggctttaccccattgcatttcgccgccgctagcactcacggggccctgtgcctcgagctgctagtcaacaatggagctgacgtcaatatacagagtaaagacggcaagagcccactgcacatgaccgctgtgcatgggcgtttcacccgcagccagacactgatacagaacgggggagagattgactgcgtggacaaagatggtaacactcctctgcacgtggccgccagatatggacacgaactgcttatcaacactctcattacgagcggcgccgataccgctaaatgtggcattcatagtatgttccctcttcatctggccgccctgaatgcgcattcggattgctgcagaaaactcctgtcaagtggttttgaaatcgatacccctgacaagtttggcaggacctgtctgcacgcagctgccgcaggcggtaacgtggaatgtatcaaactgttacagagctccggcgccgatttccacaagaaggacaagtgtgggaggactcctttacactatgccgctgctaactgtcacttccattgtatcgagacacttgtgacaacaggggccaacgttaacgagaccgatgactgggggcgcaccgcgctgcattacgctgctgccagcgatatggacaggaataaaaccattctcggaaacgcccatgataattccgaggaactggaacgggcccgtgagctcaaagagaaagaagcgacgttgtgtctggaatttctcctgcaaaatgatgcgaaccctagcattagggacaaggaagggtacaactcaatccattatgcagccgcatatgggcatcgacagtgtttagagctcctactggagaggaccaattcaggatttgaggaatccgactctggggctacgaaatctcccctccatcttgctgcctataacggtcatcatcaggcattggaagtccttctgcaaagcctggttgatttggacatccgagatgaaaagggtcgaaccgcattggacttggccgctttcaaggggcacaccgaatgtgtagaggccctaattaatcagggagcatctatatttgttaaggataacgtcaccaaacgtacacctctccacgcttccgttatcaacggccatactctttgtttgcgactactgctggagatcgccgacaatccggaggcagttgacgttaaggacgccaaaggacagacaccgttgatgctggcagtggcctacgggcacatagatgcagtttccctgctgctcgagaaggaggcgaacgtagacactgtcgacatcctgggatgtacagctttgcatagggggatcatgacaggacacgaagaatgcgtccagatgctcctggaacaggaggtttcaatcttatgtaaagatagcagagggcgtacaccgctgcactatgctgctgcacgcggccacgctacatggctgtctgagctgctgcagatggccctgagcgaggaggattgctgctttaaggacaatcagggctacacccctctccattgggcttgctacaacggcaacgaaaattgtatcgaggtgttgctggagcaaaagtgcttcaggaaattcattggcaacccattcacacctctgcattgcgctatcatcaacgatcatggcaattgtgctagtctgctgctcggcgccattgattctagtatcgtctcctgtcgggatgataaggggcgaacacctctccatgctgccgctttcgccgaccacgtggagtgcctgcagctccttctcaggcacagcgcaccagttaacgcagtggacaatagtgggaagacggccctaatgatggccgcggagaacggtcaggccggggccgttgacattctggttaactcagcgcaagcggacctcacggtaaaagacaaggatctgaatactccactgcatctggcatgcagtaagggccacgagaagtgcgcgttgttgatattggataagatacaagacgaatccctcatcaacgaaaagaataacgccttgcagacctag

SEQ ID NO: 26740 - DNA, 1740 bp, Artificial Sequence
  Description of Artificial Sequence: Synthetic coding sequence
atggctgtcctcaagctgactgaccaaccaccactcgtgcaggccatcttttcgggagatccagaggaaatacgcatgctcatccataaaacagaagacgtcaacacgttggacagcgagaaacgcacaccacttcacgtggcggcatttctcggcgacgccgaaattattgaactgctcatcctgtccggcgcgcgggtcaatgccaaggataacatgtggctgacgcccctgcacagagcagtggcttctaggtccgaggaggccgtacaagttttgatcaaacacagcgcagatgtgaatgcaagggacaagaattggcagactccccttcatgtcgcagccgcgaataaagctgtgaaatgcgctgaagtcatcatccctctgctgagttccgtaaacgtaagtgaccggggcggacggactgctctacatcatgccgccctgaacggtcatgttgaaatggttaatttgctgctcgcaaagggggctaacatcaatgcattcgacaaaaaagacagaagggccctgcattgggcggcgtatatgggccatctggacgtagtcgcgctgttaatcaaccacggtgccgaagtgacatgcaaggacaaaaaaggatacaccccactccacgctgccgcttctaacggccagatcaacgtcgtgaaacatctcttaaacctcggggtcgagattgatgagattaatgtgtacgggaacactgcgctgcatatagcatgttacaatggacaggatgctgtggtgaatgaactgatcgactatggggctaacgtgaatcagcctaacaataacgggtttacaccattgcacttcgccgccgcttccacacacggcgccttatgcttggagctcctggttaataacggcgctgatgtgaatatccagagcaaggatggaaagtccccccttcacatgactgccgtgcatggacggttcacccgcagccagacactcatacagaatggaggagaaattgattgcgttgataaggacgggaacacccccctgcacgtggccgctcgctacggacatgagttgctgatcaatactctaattactagtggcgcagacacagctaagtgcggtattcacagcatgttccctctccatctggcagccctcaatgcacactcagactgctgtcgtaagctcttatcttctggatttgaaatagatacaccagacaagtttggtagaacctgcctgcacgccgctgctgctggcggcaacgtagaatgcatcaaactgctccaaagttcaggtgccgatttccataagaaggataagtgtggacgcactccactgcattacgcagccgccaattgccatttccattgcatcgagaccctcgtcactacgggtgccaatgtgaacgagacagatgattgggggagaaccgcactgcactacgcagctgcttctgacatggatcggaataagacgatcttgggtaatgcgcacgataattccgaagaactggagcgtgccagagagctaaaggaaaaagaggcgaccctgtgtctcgagttcctcctccagaacgatgctaacccctcaattcgagacaaggagggatataactctattcactatgctgctgcgtatggtcatagacagtgcctggaactcgtctcctgctttgtgctgttttcccttacgcacacccacacacatacccctaaccaccgaggcatcaactgtttttttccggaactgtag

SEQ ID NO: 26741 - DNA, 1104 bp, Artificial Sequence
  Description of Artificial Sequence: Synthetic coding sequence
atggctgtgctgaaacttaccgaccaacccccgctggttcaggccatcttctctggggacccagaggagattcgtatgctgattcataaaaccgaagacgtgaacacactcgattctgagaaaagaactcccctacatgtggctgcgttcctcggggacgctgaaattattgagctcctgatactgtctggggcccgagtgaatgcgaaagataacatgtggttaacgcccctccacagggcagtcgcctcaaggagcgaggaggcagtccaagttttaatcaagcacagtgcggacgtgaacgcacgagacaaaaattggcaaactccactgcacgtcgccgctgcaaataaggcagttaagtgcgccgaagtaataattcctctgctttcgagcgtgaatgtctctgaccgcggtggccgcacagctttgcatcatgccgcgctgaatggccatgttgaaatggttaacttgctacttgcaaagggcgcaaatatcaatgcgtttgataagaaagatagacgggctttgcattgggcagcgtatatgggacacctcgacgtcgtggcactcttgatcaatcacggcgcagaagtcacgtgtaaggataagaaaggttacacacccctccacgccgctgccagcaacggtcagataaacgtggttaagcacttacttaacctgggcgtcgaaatcgacgagatcaatgtctatggaaatactgctctacatatcgcctgttacaatggacaggacgctgtcgttaatgagttaatcgactatggggccaacgtgaatcagcctaacaacaacgggtttacacccttacacttcgccgccgcctccacacacggggctttatgtctagagttgctcgtaaataatggcgccgatgtgaacatccagtcaaaagacggcaagtcgccgcttcatatgacagcggtgcacggtcgcttcacccgcagccagacacttattcagaacggtggggagattgattgcgtggacaaggacggaaataccccattacacgtagcggctagatacggccacgagctgctgattaatacactcatcacttccggcgccgatacagctaagtag

SEQ ID NO: 26742 - DNA, 2760 bp, Artificial Sequence
  Description of Artificial Sequence: Synthetic coding sequence
atgctcatccataagaccgaagacgtgaacaccttggattcagaaaagcgaacccctctccacgtagctgcatttctaggcgatgctgagatcatcgagcttctgatactaagtggggcccgggtcaatgcaaaggataatatgtggttgactccactgcatagggccgtggcctcaaggagcgaagaagccgtgcaggtactaataaagcattctgccgacgtaaatgccagagataagaactggcagacaccgttgcacgtagctgcggccaacaaggctgtgaaatgcgccgaagtcatcatccctctgctgtccagcgtgaacgtgtcagacaggggtggacgcactgccctacaccatgctgctcttaatgggcacgtcgaaatggtgaatctgctactcgccaagggagccaacataaacgcctttgataaaaaagacaggcgtgccttgcattgggcagcttacatgggccacctcgatgtggttgccctgctaatcaaccacggcgccgaggtaacctgcaaggacaagaagggctacacacctctgcacgccgctgcttccaatgggcagattaacgtagttaaacacctacttaacctgggagtggaaatcgacgaaattaacgtttatgggaataccgcactgcacatcgcctgctataacgggcaggacgcagtggtaaacgagttgatcgactacggtgccaatgtcaaccagcccaataataatggcttcactcctctgcatttcgccgcggcctcaacacacggcgccctctgcctggagctgttggttaataatggcgcagacgtgaatatccaatcaaaggatggcaagtctcctctgcacatgactgcagtgcatggccgctttacaagatcccagacactgatccagaacggcggtgaaatcgactgcgtggataaggacgggaacacaccgttacatgtggctgcaagatatgggcatgaattgctcatcaacaccctgatcacttccggtgcggataccgctaaatgcggcatacacagcatgttccccctccacctggcagcgttaaatgcccactctgactgttgtcgcaaactgctgtctagtgggtttgaaattgatactcctgataagttcggccggacgtgcctgcacgctgccgccgcaggaggcaacgttgagtgcatcaaattgctgcaatcatccggagccgatttccataagaaagataaatgcggccgcacccctctccattatgcagcggctaactgtcactttcattgcattgaaacactggtaaccaccggcgctaacgtcaatgagaccgacgactgggggcggactgccctgcattatgcggccgccagtgatatggatcgtaataaaactatcctgggaaacgcccatgataattctgaggaactcgaaagggcccgtgagcttaaagagaaggaggccactctgtgcctggagttcctcctgcaaaatgatgccaacccaagcatcagggataaggagggttacaattccatccactacgccgccgcttacggtcatagacagtgtctagagctgctgctcgaacggaccaactcggggtttgaggagagtgacagtggggccacaaagtccccactccatctcgcagcctacaacggacatcatcaggctctggaggtgctgctccagtctcttgtggatctggatatcagggatgagaagggccgcacagcattggacctggcagccttcaaaggccacactgagtgcgtggaagcattgatcaatcagggtgctagcatatttgtgaaagataacgttacaaaacggaccccactgcatgctagtgtcatcaacggccacaccctgtgtctacggctactgctagagatcgcggataaccctgaggctgtagatgtaaaggatgccaaagggcagacccctttgatgttggcggtggcctatgggcatattgacgctgtttccttgctgcttgaaaaggaggctaacgtggatactgtggatatcctgggttgtaccgctctccatcgcgggattatgacaggacacgaagagtgtgtgcagatgttgctggaacaggaggtgagcatcctttgtaaggactcccggggtagaacccccttacactatgcagccgccagaggtcacgccacctggttgtcagagctgctacaaatggctctcagcgaggaagattgttgtttcaaagataaccagggttacacacctctccactgggcctgctataatgggaatgagaactgcatagaggttttgctagagcagaagtgtttccgaaaatttataggaaacccctttacccctctgcactgcgctatcattaatgaccatggaaactgtgctagcctcttgctgggagctatagactccagcatagtcagttgtagggatgataaggggcggactccactgcacgcagccgccttcgcggatcacgtcgagtgcctgcagctcttgctcagacatagtgcccctgtcaacgccgtcgataattctggcaaaactgctctcatgatggccgctgaaaatggccaggcaggcgctgtagatattctggttaatagcgcccaggccgacctaaccgtcaaggacaaggacctaaacacacccttacacctggcctgcagtaagggacatgagaaatgcgcgctgcttatcttggacaagatccaggacgagagtctgatcaacgagaagaacaacgctcttcagacttag

SEQ ID NO: 26743 - DNA, 1524 bp, Artificial Sequence
  Description of Artificial Sequence: Synthetic coding sequence
atgtggttgacacctctgcatagggccgtggcttccagaagcgaggaagcagttcaggttttgattaagcattccgcggacgtaaacgcaagggacaagaattggcagacgccccttcacgttgcggctgcaaataaagctgtaaagtgcgccgaagtcattatccctttgctctcttctgtgaacgtgtctgatcggggaggtcggacagcgctccatcacgcagcactgaatggccacgtggagatggtgaatctcctactggccaagggagccaatatcaacgcatttgataaaaaggaccggcgggcactgcactgggccgcttatatgggtcacctggatgtcgtcgctttgctgataaatcatggagcagaggtgacctgtaaggataagaaaggatacactccacttcacgcagctgcaagcaatggtcaaatcaacgtagtcaaacacctgctcaacctgggggtagaaattgatgagatcaacgtttatggcaatacagcgcttcatatcgcatgttataatgggcaggacgcagttgtgaatgagctcatagactacggagccaatgtgaaccagccgaataacaatggcttcacccctctacacttcgccgccgcgtccactcatggcgcgctgtgtctggagctcctcgtcaacaatggagcagatgtgaacatccagtctaaagacggtaagtcaccccttcacatgaccgctgtccacggaagattcacaaggtctcagaccctcattcagaacggcggcgagatcgactgcgtcgataaggacggaaatacgcccctgcacgttgcagcacgatacgggcatgaacttcttattaacactctaatcacctccggagcggatacagcgaagtgcggcatccatagcatgtttcctctgcatttggcagccctgaacgctcattcggactgctgccgcaaattactcagctccgggtttgaaatcgatactcctgacaagtttggcaggacctgtttgcatgccgctgccgcaggagggaatgtggaatgtattaagcttttacaatcttcgggcgctgattttcataagaaggacaaatgcggccgaactccactgcactacgctgccgccaactgccatttccactgtattgaaacattggttaccacgggagccaatgtgaatgaaaccgatgattgggggagaacagccctgcactatgcagcggcctccgacatggataggaacaagaccattcttggaaacgcgcatgacaattccgaggagttggagagagcgagagagctgaaagagaaagaggcaacgctgtgtttggaatttttgctgcagaacgacgccaatcctagcattagagataaagagggatacaacagcatccactatgccgctgcttatgggcacagacagtgcctggaactggtgagttgttttgtactgttctctctaacccacacccacactcacacacccaatcatcgcgggatcaattgttttttccctgaactttag

SEQ ID NO: 26744 - DNA, 801 bp, Artificial Sequence
  Description of Artificial Sequence: Synthetic coding sequence
atggaaagcgaggggccccccgaatcagagagctcggaattcttcagtcaacaggaagaagaaaatgaggaggaagaggcccaggaacctgaggaaaccgggcccaaaaatcccctcctgcagcctgctttgacgggggacgtggagggcctgcagaaaatattcgaggacccagaaaaccctcaccacgaacaggctatgcagctgctcctggaagaagacatcgtcgggaggaaccttctctatgcagcttgtatggcgggccaatcagatgtcattcgggccctggctaagtacggcgtgaacctcaacgagaaaaccactaggggatatacactcctgcattgtgcggctgcctggggccgactggagacactaaaagcactggtggaattggacgttgacattgaggcattgaattttagagaagagagagctagggatgtggccgccagatactcacagacagagtgcgttgagtttctggactgggcagatgctcgactgactctgaagaagtacattgccaaggtgtcgctcgccgtcacggacacagaaaaggggagtggaaagctgttaaaggaggacaaaaacaccatcctgagcgcgtgtcgcgccaaaaatgaatggttggagactcacaccgaagcctctattaatgagctgtttgagcagagacagcaactagaagacattgtaacacccatcttcaccaagatgaccaccccgtgtcaggtgaagagtgccaagtcagtcacaagccacgaccagaaacggagtcaggacgacacatccaattag

SEQ ID NO: 26745 - DNA, 2331 bp, Artificial Sequence
  Description of Artificial Sequence: Synthetic coding sequence
atggccctggccgataaacgactcgagaatctacaaatctacaaggtcctgcagtgtgtgagaaacaaggacaagaagcagatagagaagttaacgaagctgggataccccgagttgataaactacaccgagccaatcaatggactgtctgccctgcatcttgcatcagtatccaacgacatagatatggtgtcatttcttctggatttaggagctcacccggacgtccaggaccgcatgggatgcacaccaaccatgcgtgcagcagagctcggccacgaactgtccatggagatcctggccaaggccaaagccgatatgactatagtggataatgaaggaaaaggcgttctattctactgcattctgcccaccaagcggcattaccgctgcgccctgattgccctggagcatggtgctgacgtgaacaactccacatatgagggcaagcccatttttctgcgagcatgcgaagacgcccacgatgtcaaagatgtttgcctgacattcctggaaaagggcgcaaaccctaatgcgattaattcttccaccgggcgtacggccctaatggaagccagccgcgaaggggtggtcgagatcgtacgtggcattctggagcgaggcggcgaagttaacgcctttgataatgaccgacatcacgcggcccactttgccgccaaaggaggctttttcgatatcctgaagttgctctttgcctacaacggagatgtgggcttaatcagcattaacggaaatacacccctgcactatgctgcgatgggcgggttcgctgactgttgcaaatacatcgcgcaacgagggtgcgatcttaaatggaaaaacctggatcataagaccccaagggccgttgcaaaagagggaggctttaaggctgcctcaaaagaaatccgcagagccgagaggatagcaaataagctggctagacccggcgcgaaaaatcctaacccattatgggccctaagactgcacgactggtccgtggaacgggaagcgttcctccgtgaagcctttgctgtcttggaccgcggagatggatctatctctaagaatgatttcgttatggtgctcgaagaaaggcaggattatgccagttctgagcagttggcggccattgcccatctgcatgagaagacacggggtgggggggtgaatatcaacgaattctttaaagggaccaggtatctgaataaatccttcgttctgggttcttacggacccaagaaaaaagagaagggcatggggaagaaaggtaagaagggaaaatttgtgctgcccctgcccatttgcgtgattcccgaatacgctttcccaaggcgccaagacggcggccctccctattatatgatcgaaacctataaaaacgtaaccgacagctctagatttaacagggatcaccctccagaacatcctattcaagacgacagcgtatggtacatcgatgacagcgaaaaggtatttagcaatattaacattatcacaaaagccggagacttagcttctcttaagaaagcatttgaaagcgggattccagttgatatgaaagacaattactacaagactccactgatgacggcatgtgccagcggcaacatcgacgtggtgaaattcctcttggagaaaggcgctaatgtgaatgctaccgacaactttctgtggactcctctgcacttcgcttgccacgctggtcagcaggatatagttgaactgcttgtggagagcggcgcacttatcgacgccgcctctatcaataattcgacaccgctgaatcgtgctattgaatcttgccgtcttgatacggttaagtacctactggatattggggcaaagttccagcttgagaatcgcaaggggcattctgctatggacgtggctaaagcttatgccgactaccggatcatcgacctgattaaagagaagctcgacaatcttcccaagcctgctgaaaaccagaagcttaagggaaagacacccccaatactcaaaaccgagggcccagagattaagaaggaggaagaactgctctccagtatctatggcgtgccaactacaagcgagggcaaaaaagtgcagaagggcaatgtcgtacatctcaactccctcatcacttccgggtatactaagaaagtggacatcacattcatcccacgtaggatttggtcacctgaggcaacgaccgctgaactgatccggaaaagggaactccgtagggagcggtttactcacgaggtggattttgatgacttcatgatgcctttccagaagaatattacagagaaggctcgtgctcttgaagcagctctcaaaacctag

SEQ ID NO: 26746 - DNA, 2331 bp, Artificial Sequence
  Description of Artificial Sequence: Synthetic coding sequence
atggcactcgctgacaagcgtcttgaaaacctccagatttacaaggtgttgcagtgtgttcggaacaaggacaaaaaacagatcgagaaactgaccaagctggggtatccagaactgatcaattacactgagccgataaatggactcagcgccctgcatcttgcttccgtgtcaaacgacatagatatggtgtctttcttgctggatcttggggcacacccagatgtccaggaccgcatgggctgcacccccactatgcgagccgctgagctggggcacgagctctctatggagatccttgctaaagctaaggctgatatgacaatcgtggataatgaaggcaagggggtcctgttctactgtattctaccgactaaaagacactacagatgcgccctgatcgcactcgagcatggcgccgatgtaaacaattctacctacgagggtaaaccaatctttttacgagcctgtgaagatgctcatgatgtgaaggacgtgtgtctaacctttttggagaaaggcgccaatcccaacgcaattaactcatctactggtagaacagccctgatggaggccagtcgggagggcgtcgtagaaattgtgcggggcatcctggagaggggcggggaggtgaatgcgtttgacaacgatagacaccacgctgcccactttgctgccaagggaggcttttttgatatattgaaactgctctttgcctacaatggagatgtgggcttgatcagcatcaacggcaatactccactgcactacgccgccatggggggatttgccgattgttgcaagtatatcgcacaaaggggatgtgacctgaagtggaaaaacttggaccacaaaaccccccgtgccgttgcaaaagaggggggcttcaaagccgcatcaaaagagatccggagggctgagaggattgccaacaagctggccagacccggcgccaagaatccaaaccctctctgggctcttaggctccacgactggtcggtggagagagaagcctttctgcgggaagccttcgcagttctggacaggggcgacggatccatttcaaaaaatgactttgtgatggtgctcgaggaacgacaggattatgcatcgagcgagcagctggccgcgatcgcccacctgcacgaaaagactcgaggtgggggcgtgaatatcaatgaattcttcaaagggacgagatacctaaataagtcctttgttctggggtcgtacggcccaaaaaagaaagaaaagggcatgggcaagaagggcaagaagggaaagttcgtcctgcctctccccatttgtgtgattccagaatatgctttcccgaggaggcaggacgggggcccaccctactacatgatcgaaacttataagaacgtgacagacagtagccgattcaaccgcgaccaccctccagagcatccgattcaagacgatagcgtgtggtatattgatgactccgagaaagtcttctccaatatcaacattatcaccaaggctggtgatctcgctagcctgaagaaggctttcgaaagcgggatccctgtagacatgaaagacaactattacaaaacgcccctcatgacagcgtgcgcctctggcaatattgatgttgtgaagttcttgcttgaaaaaggggcgaatgtgaacgcaacagataacttcctgtggacacctcttcacttcgcttgccacgctggacagcaagacattgttgaactcctcgttgagagcggggcccttattgatgcggcgtcaattaataattcaacgccactgaaccgcgctattgagtcctgtcggcttgacacggtgaagtacctcctcgatattggggcgaagttccaactcgagaataggaaaggccactctgccatggacgttgcgaaggcatatgctgactataggatcatcgatttgataaaagagaagctggataatctccctaaacccgccgaaaatcaaaaattaaaaggcaaaacccctcctattctgaagacagaggggcccgaaattaaaaaagaagaagaactgttaagcagcatctacggggtccccaccaccagtgaagggaagaaggtccagaagggcaatgttgtgcatctgaattcccttatcacctcaggatacaccaagaaagtggatatcacatttattcctcgcaggatctggtctcccgaagctacaaccgcagagctgatccggaagcgggagctgaggagagagagattcacacacgaagtagattttgacgactttatgatgccttttcaaaagaacatcactgagaaggctcgagctctggaggcagcgctgaagacttag

SEQ ID NO: 26747 - DNA, 4290 bp, Artificial Sequence
  Description of Artificial Sequence: Synthetic coding sequence
atgacgaacccatgggaagaaaaggtatgtaaaatggcccagacctctttattgcaaggcaagcaattttactgccgagaatgggtgtttcacaagttgcaacattgcctgcaagagaagtctaattgttgcaactcagcagtgaatgctccttcccttgttatgaattcaggaaacaatgcgtcgggtgtttcagggaagggcgccgcctggggcgtgctgctggtaggcggccccggttcaggaaagactgccctgtgtaccgaactgttatggcccagttctcccgcatcactgcagcgggggctccatcgccaggcactcgcatttcacttttgcaaggcccaggattctgacacactctgcgttggtggcttcattagggggctggtagctcagatttgccggtcaggactgctccagggatacgaggacaaactgcgagatcccgcagtgcagagcctgctgcagcccggcgagtgcgaaagaaacccggctgaagcctttaagcgatgtgtgctgctcccactgctcggcatgaagcctccccagcagtcactgtacctactggtggactcagtagatgaaggatgcaatataactgaaggagagcaaacatcaacttccctttccggaacagttgctgccctcctggccggccaccatgagttctttccaccctggctgcttttactctgctccgcccgcaagcagtcgaaggctgtgacaaagatgtttactggattcagaaaaatttctttggacgacctgcgcaaagcatacatcgtgaaagacgttcagcagtacattctgcaccggctcgaccaggaagaggccctgcgccaacatctaacaaaagagactgcagaaatgttgaaccagctgcacattaagtcatcggggtgctttctgtacctcgaacgggtcttagatggcgtcgttgagaattttatcatgctgagagagatacgggacatccccggtaccctaaatggattgtacttgtggttgtgtcagagattatttgttcggaagcaatttgcaaaagttcagcctattctaaatgtgattctggcagcctgcaggccgctgaccatcaccgaactgtaccatgcggtctggacaaaaaacatgtcacttacgctggaggatttccagcgcaaactggacattctgtcgaagcttctggtcgacggtttggggaacacgaagatactgttccactacagcttcgctgagtggctcctggacgtaaagcactgtactcagaagtacctctgcaacgccgcagagggccataggatgctcgctatgtcttacacgtgtcaggctaagaatctgacgccactggaggcgcaggaattcgctttacacttaatcaactcaaacctccagctcgaaaccgccgagttggcactgtggatgatctggaacggcactcccgtgagggactctctctctaccctgatccccaaggaacaggaggtccttcaactgctcgtaaaagcaggcgcacatgtgaacagcgaggacgacaggacttcctgcatcgtgcggcaggcactcgagagggaggattctattcggacactcttggacaatggggcaagcgtgaatcagtgtgactctaacggccgtacgctgctagccaatgccgcttactcagggagcctcgacgtagtcaatttgctggtctccaggggggcagatttggaaattgaggatgctcatggccatacacccctcacccttgccgcacggcaggggcatactaaggtcgtgaattgtctcattggatgcggggccaatattaatcacaccgaccaggatggatggacggcgttgcggtctgcagcctggggtggtcataccgaggttgtgtccgcacttctgtatgccggtgtcaaggtagactgtgccgacgccgattcgcggacggctcttcgcgccgctgcctggggcggccatgaggatattgttttgaacctgctccagcatggagccgaggtcaacaaggcagacaacgagggacggactgccctgatcgcagccgcatatatggggcaccgtgaaatcgttgagcacctgctggatcatggcgccgaggttaaccacgaggacgtagatggccggacagccttatcagtggccgccttgtgcgttccagcatcaaagggccacgcaagtgtggtgagcttactcatagaccgtggcgctgaggtggatcattgtgataaggacggcatgacccccctgctcgtggccgcctacgagggccatgtggacgtagtggacctgctgctcgagggaggagctgacgtcgaccatactgacaacaacgggaggactcccctgttggccgcagcatccatgggccatgctagcgtagtgaatactctactcttttggggcgccgctgtggacagcatcgacagcgaggggcggaccgttctctctattgcttccgcgcaaggcaacgtggaagtggtgagaactctcctggatagagggctcgacgaaaaccatagggatgacgcggggtggacccccctacacatggctgcattcgagggccacaggctaatctgtgaggccctcatcgagcaaggcgctagaacgaatgagattgacaatgatggccggattccttttatcctggccagtcaggaggggcactacgattgtgtccagattctgctggagaacaagtccaacatcgatcaacgcggctacgatggacggaatgcactgagagtggccgcgctcgaggggcatcgggatatcgtggagctcttgttctcacatggcgcggatgtgaattgcaaagacgccgatggtcggcccacgctctacatcttagctctggagaaccagcttaccatggcggagtacttcctggaaaacggcgctaacgtggaggcaagcgacgcagagggacggaccgcgctgcacgtcagttgttggcagggacatatggaaatggtccaggtgttgattgcctaccacgcggacgtgaacgcggcggataacgaaaagaggagtgcccttcaatcagccgcatggcagggacatgtgaaggtggtccagctacttattgagcacggcgcggttgtggatcacacatgcaatcagggcgctacagctctgtgcatcgccgcacaggagggccatatagacgttgtacaagttcttcttgagcacggtgccgatcctaatcatgcagaccaatttggcagaacagccatgcgtgtggccgccaaaaacgggcattctcagataataaagctccttgagaagtacggggcaagttcacttaatggctgcagtcccagcccagtgcacacgatggagcagaagcctctccagtcactgtcatcgaaggtccaaagtttaacaatcaagtcgaattcatctggctcaacaggcggcggcgatatgcagccctccctgcgggggctgcccaacgggcctactcatgccttttcctcaccgagtgagtctcctgactctaccgtggatagacagaaaagctccctgtccaataatagccttaaatcttccaagaactcgtcactgagaactacatcatccacagctactgcacagaccgtcccaatcgacagcttccacaacctcagcttcaccgaacagatccaacaacattcgctaccacggagccggagcaggcagtccattgtttccccctcttctacgacccagagtttgggacagtcacataattcaccatcctccgagtttgagtggtcacaggtgaaaccttctctgaaatccaccaaggcgtccaaaggcgggaaatccgaaaactccgccaagtctggatctgccgggaaaaaggctaaacagtccaatagcagccaaccaaaagtgctcgagtatgagatgacacagttcgacagacggggcccgatagccaagtctggcacagctgctccccccaagcagatgcccgccgagtcacagtgtaaaatcatgatacccagcgcccaacaggagatcggccgttctcagcagcaattccttatccaccagcagtctggcgagcagaagaagcgtaatggtattatgaccaaccccaactatcacctgcagtctaatcaggtttttttagggagggtgtctgtcccgcgaacaatgcaggaccgagggcaccaggaggtactcgagggatacccatctagtgagaccgagctgagtctcaagcaggccctcaagctgcaaatcgagggcagtgacccttcctttaattacaagaaggagacaccgctgtag

SEQ ID NO: 26748 - DNA, 3753 bp, Artificial Sequence
  Description of Artificial Sequence: Synthetic coding sequence
atgaagccgccacagcagagcctgtacctgctggtcgattcagtagatgaagggtgtaatatcaccgaaggcgagcagacttccacatctctatctggcaccgtagcagcgctgctcgcagggcaccatgagttttttcccccctggctgctgctcctttgctccgcccgtaaacagtcaaaagctgtcaccaagatgttcacaggatttcgtaaaatctctctggatgatctacggaaagcatatattgtgaaggatgtgcaacaatatattctgcacagactggatcaggaagaagccctgcgtcaacatctaactaaggaaactgcagaaatgttgaatcaactgcacatcaaatcttcagggtgtttcctttatctagagcgcgtgttggacggcgtcgtggagaattttatcatgctgcgggaaattcgggacattcctgggactcttaatgggctgtacttatggctctgccaacggctgtttgtgaggaagcagttcgctaaggtccagccaatcctgaatgtgattttagctgcatgccgcccgttgacgattaccgagctgtatcatgctgtctggactaagaacatgtccttaacgctggaggattttcagcggaagctcgatatcttgagtaagctgttggttgacgggcttggcaataccaagatcctgttccattattcctttgctgaatggctattggacgttaagcactgcacacagaagtacctgtgtaacgcagccgaaggacataggatgctagccatgtcctatacctgtcaggcgaagaatctaacacccttggaggcacaggagtttgctctgcacctgattaattccaacctgcaacttgaaacagctgagttggcgttgtggatgatttggaacggcactccggtgagggattctctgtcaacgctcatccctaaagaacaagaagttctgcagctgctcgttaaagccggggctcacgtaaacagcgaggacgatcgcacctcttgcatcgttaggcaggctttggagcgggaggatagcatccgcaccctgctcgacaacggggcaagcgtgaaccagtgtgacagcaacgggcggaccctgctcgcaaacgctgcctactccgggtcactcgacgtcgttaatctcctggtctcccggggggcagacctggagattgaagatgcccatggccacacaccacttacgttggctgctaggcaaggccacactaaagttgttaactgccttatcggctgtggtgcaaacatcaaccatacagatcaggacgggtggactgctttacgcagtgcggcttggggaggacacacggaggttgtgtctgccttgctttacgccggcgtgaaggtagattgtgccgacgctgactcccggacagcgcttagggctgcagcgtgggggggccacgaagacattgtcctgaacttactccaacacggtgcagaagtaaataaagctgataacgagggaagaacggccctgattgccgctgcctacatgggccaccgtgagattgttgaacaccttctggatcacggggcggaggttaatcatgaggacgtggacggccggactgcactgtcagtggcagctctgtgcgtgcccgccagcaaagggcacgcgtccgttgtgtcattgttgatcgacaggggcgctgaagttgaccattgtgataaagatggcatgactccgctgctggtggcagcctacgaaggacacgtcgacgtcgttgatctgctacttgagggcggtgcggacgtcgatcacaccgacaataacgggagaacacccctgctcgctgccgcttccatgggtcatgcatctgtggtgaacacccttctgttttggggagctgctgttgatagcatcgattccgaggggaggactgtacttagcatcgcaagcgcgcaggggaatgtcgaggttgtcaggaccctactcgatcgtggactcgatgagaatcatcgcgatgacgcgggctggactccactgcatatggccgctttcgaggggcaccggctaatatgcgaagctctgatcgaacaaggagctcgtactaatgagatcgataacgacgggagaattcccttcatcttggcgagtcaagagggacactacgattgcgtccagatactgctcgagaacaaaagcaacatcgaccagcgtgggtacgacgggagaaatgccttgcgcgtcgctgctctggaggggcacagggacatcgttgaacttctgttcagccacggagccgacgtgaattgcaaggatgcagatggccggccgaccttgtatattttggctttggaaaatcaacttactatggctgagtacttcctggaaaacggcgcaaatgtggaggcatccgacgccgagggacgcaccgcactccatgtcagctgttggcagggccacatggaaatggtgcaggtgctgattgcatatcacgccgacgtgaacgccgcagataacgaaaagcgatctgctttgcaatccgccgcctggcagggacatgtcaaagtggtccagctcttgatagaacatggcgctgttgtcgaccacacatgcaatcagggagcaacagccctctgcatcgccgcccaagagggacatatcgatgttgtgcaggttcttttagagcacggcgccgacccgaaccacgcagaccagttcggcaggacagccatgcgtgtggcagcaaaaaatggacactcccagatcattaagctcctagaaaagtacggtgctagttcgctaaatggatgctcccctagtcccgtgcacactatggagcagaaaccattacaaagtctgagctccaaagtgcagtctctcacaataaagagtaattccagcggatccacaggtggtggcgacatgcagccttcgttgcgcggcctacctaacggccccacccacgccttttcctcaccctctgaatctcccgatagcaccgtggacagacaaaaatctagtctgagtaacaattctctcaaaagcagtaaaaactccagcttacggacaacctcctcaacagccactgcacagactgtacccatcgactctttccacaacctgagttttacagagcagatccagcagcacagtcttccccgaagccgcagtagacaatccattgtgtccccatcttctaccacacagtccctggggcagagccacaacagcccttcatcagagtttgagtggagccaggtgaaaccgtccctaaaatccacaaaggcgagcaagggaggcaaaagcgagaacagcgcgaaaagcggatcagccgggaaaaaggctaaacagtctaactctagtcaacctaaagtattagagtacgagatgacgcagttcgaccgtaggggtccaatcgccaaatcaggaacggccgcccctccaaagcaaatgccagccgaaagccagtgtaaaatcatgatccccagtgcgcagcaagagattgggaggtctcagcaacaattcttgatacatcagcaatccggggagcagaaaaaaaggaatgggatcatgacaaatcctaattaccacctccagtcaaatcaggtatttctcgggcgagtatccgtgccacgtaccatgcaggacaggggacatcaggaggttctggaaggatatccctcttcagaaaccgagctgagccttaaacaggctctcaagctacaaatagaggggtcagatccctccttcaactataagaaggaaacaccactttag

SEQ ID NO: 26749 - DNA, 3231 bp, Artificial Sequence
  Description of Artificial Sequence: Synthetic coding sequence
atggggatactgtctattaccgatcagccgcccctagtgcaagctatcttttctagagatgtggaggaagtgagaagcctactgagtcagaaggaaaatataaacgtgctcgatcaggaacggcggaccccactacatgctgccgcctatgtgggagatgtcccaatcttgcagctactgcttatgagcggcgccaacgtgaacgcaaaggacacgctgtggctcactcccctgcacagagcggcagcctcgcgaaatgagaaggtgctgggactccttctggcccacagcgccgacgttaatgctagagacaagctgtggcagacccccttacatgtggccgctgcaaatcgcgctacaaaatgcgcggaggctctggcgccgttgctatcttcccttaatgtggcggaccgttccggacgatccgcactgcatcacgctgtccatagcgggcacctggaaacagtaaatcttcttttgaacaagggcgccagcctcaacgtgtgcgacaagaaagaacgacagcctttacactgggcagcctttttgggccacctggaggtgctgaaactgctggtggcgcgaggcgccgacctcggatgcaaagaccgcaaaggctacggtctgttgcacaccgctgcagctagcggacagatcgaggtcgtaaaatacctgctcagaatgggagccgagatcgatgaacccaacgcgtttggaaacacagcactccacattgcttgctacctcggtcaggatgcagtggccatcgaactcgtgaatgcaggagctaatgtcaaccagcccaatgacaaggggttcacaccattacacgtggccgccgtttcaacaaatggtgctttgtgtctggagttgctcgtgaataatggcgcagatgtgaattaccaatctaaggagggcaaatctccgctccacatggcggccatccacggccgtttcacccggtcccagatccttatacagaatgggagtgaaattgactgtgccgacaagttcggcaatacacccctgcatgtcgcggctcgctacggccatgaactgctgatctctactcttatgaccaatggggcagacacagcaaggcgagggatccacgacatgtttccacttcatcttgccgtcctgtttgggttcagcgactgttgccggaagctgttatctagcgggcagctgtactcaatcgtatcatctctgtccaacgagcatgttctcagcgccggatttgatatcaacactcccgataatcttgggaggacttgtttacatgccgcagctagtggtggcaatgtcgagtgtctcaatcttttactctctagcggcgcagacctgaggcggagggataagtttggtaggacccctctccattatgccgccgctaacgggtcttatcagtgcgcagtaactttagtcacagccggagccggtgtaaacgaggccgattgcaagggctgcagccctcttcactatgccgccgcaagcgatacatataggagagctgagccccacaccccctcatcacatgatgccgaagaggatgaaccattgaaagagagccggagaaaggaggccttcttttgtctcgagttcctgctagacaacggggctgaccccagcctccgcgaccgtcaggggtacacagccgtgcactacgccgccgcatacggaaacaggcagaatctggaactgctgcttgaaatgagctttaattgcctggaagatgtggaatcaacaattcccgtaagccccctacatctggcagcatacaacgggcactgtgaggcacttaagaccctcgccgagacattagttaacctggatgtgagggaccataaaggacggaccgccctcttcctggcaactgaacgcggaagtacggagtgtgtggaggtacttaccgcgcacggggccagcgctttgattaaggagcgcaaaaggaaatggactcccctgcacgcagctgccgctagcggccacacagattctctccatttgttgatcgacagtggggagcgcgccgatattaccgatgtgatggacgcctatggccaaactccgctgatgttagcaatcatgaatggccatgtggactgcgtgcaccttcttcttgaaaaaggaagcaccgcagacgctgccgatttgcggggtcgaacagctctacatagaggcgctgtcaccgggtgcgaagactgcttggccgcgctcctggatcatgacgccttcgtgttatgtcgggacttcaaaggccgaaccccaatccacctggcctcggcctgtggacatacagccgtgttaagaactctcttacaagccgccctgagtaccgatcctcttgacgccggggttgattactctgggtacagtccaatgcactgggcaagttacaccggccatgaagactgtttggagcttttgctcgagcactcgccattcagctacctggagggaaacccgtttacacccttgcactgcgccgtgattaataaccaagacagcacgacggagatgctgctgggcgccctcggtgccaaaatcgtgaacagcagagacgctaaggggaggacaccactccatgccgcagcattcgctgataacgtaagcggactgaggatgttgctgcagcaccaggccgaggttaacgccactgaccatacaggcaggacagccctcatgactgcagctgaaaacggccaaaccgccgcagttgaatttttactatacaggggaaaggccgatctgactgtgctggacgagaacaagaacacagccctccacctggcttgctctaaaggacatgagaagtgtgcactaatgattctggccgagacccaggatttaggactgattaatgcgaccaattctgcactgcagatgcctctgcatatcgctgctcgtaatgggctcgctagcgtggttcaggctttactgagtcacggtgcaacggtcctggcagtcgatgaggagggacacactcctgcactcgcttgcgctcctaataaggacgtcgctgattgcctggcactgatcctctctacaatgaagccgtttccccccaaagacgctgtcagtcctttctctttctccctcctgaagaattgttccatcgctgcggccaaaacagtaggcggatgcggggcactgccacatggtgcgtcatgtccatattctcaggagaggcccggggcgattggccttgatggatgctacagcgaatag

SEQ ID NO: 26750 - DNA, 3231 bp, Artificial Sequence
  Description of Artificial Sequence: Synthetic coding sequence
atggggatcctgagcataacagatcagccaccactggtgcaagccattttctcacgtgacgtggaagaggtgcgtagtctcttgtctcaaaaggagaatatcaatgtcctggatcaagaaaggcggactccacttcacgccgcagcttacgttggtgacgttcctatcctgcagctgctcctgatgtctggggctaacgtgaacgccaaggacactctgtggctgacacctctgcaccgggcggcagcctcgcgaaacgagaaggtgttgggtctgctgcttgctcactccgccgacgtcaacgccagggacaaattgtggcagacccccctccacgtagcagctgcgaatcgtgcaacaaagtgtgccgaggcactcgcccccttgctgagcagcctgaatgtcgcggacagatccggccgatccgctctgcaccatgctgttcactccggtcatctggagaccgtgaatctccttctcaacaagggagcttctctcaatgtatgcgataagaaggaacggcaaccactgcattgggctgctttcctggggcacttagaggtccttaagctcctggtggcacgcggcgccgacctcggctgcaaggatcggaagggctatggcctgcttcacaccgcagctgcgtctgggcagatcgaagtggtgaaatacctcctgaggatgggggctgagattgacgagcccaatgctttcggcaatacagcccttcatatcgcctgttacttggggcaggatgccgtggccatcgaactagtaaacgctggcgccaacgttaatcaaccaaatgataaaggattcacacccctgcacgtggctgcagtgtcgaccaacggggcattatgtctggagctgcttgtgaataatggggctgatgtgaattatcagtctaaagagggaaaatctcctctgcacatggctgcaatccacggtaggttcactagaagccagattctgatccagaacgggagcgaaatcgactgcgctgataaatttggcaacaccccgctgcatgtggcagccagatatggacacgaattattaatctccactcttatgactaacggagcagacacagccaggcgcggcatacatgacatgttcccactccacctggctgtcctgttcgggtttagtgactgttgtcggaaactgttgtccagcgggcagttatacagtatagtctctagtctgtctaacgagcacgtgctatccgcgggattcgatatcaacactcccgataacctcggcaggacctgcctgcatgctgccgcgtccggtggaaacgttgaatgcctcaacctcttgctgtcctcaggtgccgacttgcggaggagggacaaatttgggagaactccgctccactatgctgctgcaaatggctcttaccagtgcgccgttaccctagttaccgccggagctggagtcaatgaggccgattgcaagggctgttcaccgttacactatgctgccgcatccgacacttaccgtcgggccgagccccatactcctagctcccacgatgccgaagaagacgaacccctcaaggagagtcgtaggaaagaggcatttttttgtctggagtttttgctggataatggtgcagaccccagcctcagggatcgacagggatatactgccgttcactatgccgccgcctatggaaacaggcaaaatctcgagcttctgctggagatgtcttttaactgcctggaggatgtagagtccaccatccctgtttctcctctgcatctggcagcctacaatggacactgtgaagccctcaagacgctggctgagacccttgtcaacttagatgtgagagaccacaagggtagaacagctttatttttggcgaccgagagaggctctacagagtgtgtggaggtgctcacggcccatggcgcctccgccctgatcaaagagcgaaagcggaagtggactccgctgcacgctgcagcagccagcggacacaccgacagtctacaccttctgatcgacagtggtgagagagctgacattaccgatgtaatggacgcttacggacagactccactgatgctagctattatgaacgggcatgttgattgcgtgcatcttctgcttgagaaaggatcaaccgccgatgctgcagacctccgcgggaggaccgcactacaccggggcgcagtgactgggtgtgaagattgcctggcggctctcctggatcatgatgcctttgtactttgtcgagacttcaagggccgcacacctatccatctcgcaagcgcctgcggacacaccgcagtactgagaactctgctccaagcggccctgtctaccgacccgttggacgcaggggtagattattccggatatagcccaatgcactgggccagctacactggacatgaggactgtctggaactgttactagagcactcccctttctcttacttggaaggtaaccctttcaccccactgcattgcgctgttatcaacaaccaggactccacgaccgaaatgctcctcggcgccctcggggctaagatcgtcaacagtcgagacgctaagggacgcacacccctccacgccgcagcattcgctgataatgtctctggcctgcgtatgttgctacagcatcaggcagaagtgaatgcaacagaccatacgggccgcactgcattgatgactgccgcagaaaacgggcagacagccgcagtggagtttttactttacaggggtaaggccgacctgaccgtcctcgatgagaacaagaacaccgccctccacttagcctgtagtaagggacatgagaagtgtgccttaatgattctagccgagacccaagacctcggcctgataaatgcgaccaatagtgcgttgcagatgcccctgcacatcgccgcccgaaatggattggcatccgtggtgcaggctctgctgtcccacggggctacggttttggcagtagacgaagagggccatacgcccgctctggcctgcgctccaaacaaagacgtcgctgactgtttagcacttatcctgagtaccatgaaacctttcccacccaaggacgccgtttctcccttttccttctctttgttgaaaaattgcagcatcgctgccgctaagacagtgggaggttgtggggccctgccgcatggagcgagctgcccttactctcaagagcggccaggcgctattggactggacggctgctacagcgagtag

SEQ ID NO: 26751 - DNA, 1032 bp, Artificial Sequence
  Description of Artificial Sequence: Synthetic coding sequence
atggcttccgcagggtctaccgcgcgtcgagcaggctccgggagctggcacagcgaacgcggcgagggccgtggcgctcggccgcagcccacgccaagtggaagtatgcagcaagccaataaggtgagtttgaaagctacctggactgatgccgagagtaaacaaccaagccaaccactccccgacctcgctgatcatctgagcgcacaagccactgccttggcgcgccctcgacgccccgcttctctgactccccctagagcggatccctctccaagtaaggagagcgaccaaaccgccattgatcagaccgctatcggctcatactatcagttgttcgcagccgctgttggcaacgtggaatggctgagattttgtttaaatcagtctctgcgggaaattcccactgacgacaaggggttcacagctatccacttcgcggctcagtggggtaagctggcgtgtttacaggtgctcgtcgaggagtacaaattcccagttgatctcctgacaaataattcccagacaccactgcacctggttattcaccgcgataatacaactgtcgccctgccatgcatctactacctgttggagaagggcgccgacctgaatgcgcagacctgcaatgggtccacccccttacacctggccgcccgcgatgggttattggactgcgtgaaggtgctggtacagtccggggcaaacgtgcatgcccaggacgccatgggatataagcctattgatttttgtaaaatctggaaccaccgtgcgtgtgcgcggtttctaaaggacgccatgtggaagaaggacaaaaaggatttcgctcgagagatgaccaaaatgaagatgttcaagtcccagttgactctgatggaacataactacctgatagagtaccaaggccaagggtgcagtgtccactttccatttgcattttcccccattacccccgagaccctactctggcaggacatttccttactgtcagactgtggtttcttgtggagaagacgcgaactgtccttctag

SEQ ID NO: 26752 - DNA, 1593 bp, Artificial Sequence
  Description of Artificial Sequence: Synthetic coding sequence
atggcgagtgcaggctcaacagccaggcgggccgggtcaggatcttggcattccgagcgaggagaagggcgtggcgcccgaccacagcctacaccaagcggctccatgcaacaggccaataaggtgagcctaaaagccacatggactgatgctgagagcaaacaaccatcccagccactacctgatctggccgaccacctcagtgcacaggccacagcgcttgctcggcccagacggcctgcgtccctcaccccccctcgtgcagatccatctccctcgaaggagagtgaccaaaccgctattgaccagaccgccatcgggagctactaccagctgtttgcagccgcagttggcaacgtggagtggctgaggttctgcctaaatcaatcactccgcgagatccccactgatgataagggatttacagctatccattttgccgctcagtggggaaaactagcgtgcttgcaggtgctcgtcgaggagtacaaatttcccgtggacctactcaccaataacagtcagacccccttacatctggtgatccaccgcgataacaccacggtagccttgccgtgcatatattatctcctcgagaagggcgccgacctcaacgctcagacctgcaatgggtctacaccattgcatctagcagccagggatgggcttttagactgcgtcaaggttcttgtccaatctggagcgaacgtacacgcccaggatgctatgggctacaagccgatagatttctgtaagatctggaatcaccgagcatgcgcccggttcctcaaagatgcaatgtggaagaaggacaaaaaggactttgctcgagagatgacaaaaatgaaaatgttcaagtctcagcttaccttgatggagcacaattatctcatcgagtatcagaaagagcataaaattctgcgggaggctgccatccgaaagtggctgcatggtaagctgcaccccggccattctctggtgtcaaacacaaaacaggctcgagccacggctctgtccaaaacccctgagcagcgcgaatctcaacggtccagatccttccacccctcagtcgacgctcgacttcagtgcatcccgcagccaaccgagatgcctaagcccatttatcggaaacctaccgtcaagagacctaccatgtggaatgtgtcgaacaatcctgcacgacccccgacgacacaaattagtcactcacagggtattagattgggcgtgcatccagaccccactccagagcacgatttttcctccttcctcgaggtgaggcctgatggacatggtggggcccgcctgcacaccgtggatggccactgggtcgctcccgtcccgcgattgccatttgaggttcttctgcggatgctgtaccctcgtgtctggccgtatcgtatgaaggtgccacaggggttttaccccatctcaatgcgcgaggtcccaagaaagcgtcatctgggtgacaataccttctggaccgacaccttagccatgaatctgcgagatacatttgatgaggcattcctggctgccgtcagaagccatcaggggctccccactctgccttcccctcagaccaatccatag

SEQ ID NO: 26753 - DNA, 1845 bp, Artificial Sequence
  Description of Artificial Sequence: Synthetic coding sequence
atgatgagacaggcaactatggactttagcaccccttcggtcttcgaccagcagaggggagatagtagcgaggaagtggatctcacgatggtgtatcaggcggccagcaatggggatgtgaatgctcttactgcagtgattcgagaagatcctagcatcctagagtgctgtgactcagagggttgtacccccctcatgcacgcagtttctggtaggcaagccgataccgtcaaactccttttgaaaatgggagcaaacatcaatatgcaggatgcttacgggcgaacttcactgtgtctcgcaacctatctggggtggctggaggggtgtgttagtcttttacggaacggggccaaacataacatcccagacaagaacgggaggttgccacttcatgccgcaactgccgagcctgatatgagactgttgacagtgctgctgcagcaatctaatattagcgaaatcaaccaccaggataacgaaggcatgacacccctgcactgggcagcctttcataaccagcctcagcacacacaaatgctgttgaaaaagggggctgatcctacacttgttgacaaggacttcaaaacggcattgcattgggctgtacagagcggcaaccggatattgtgttctatcatcctatctcaccatcagggacctagtatcattaactatgacgacgagagtgggaaaacgtgcgtacacatcgccgccgcagccggattcagcgatataatacatgaacttgccagagtgcccgaatgtaatctgcaagcactcgacgtcgacgataggacgcctctgcattgggcagcagccgcaggcaaggccgagtgtgtgcagagccttctagagctcggtatggatagcaatcttagggatataaacgaatcaaccccactcgcttatgccttgtactgtggtcatactgcttgcgtaaagctgctttcccaagaaagtagaaccgagcctacacgcccgcccccgagccagtcctctcggccgcagaagaaagagagaagatttaacgttctcaaccagattttctgtaagaataaaaaagaagaacagagagcccatcagaaagatccatcaagggaccgctacagagaggaagacaccagcgaggtcaatgacatcataactactttcgattccatcgtgggcacgaattgccaggagcaaccaggcgaccaggtagctatggtggaatttaaaaagaagacaagcgacaactcgaagtatttgctgccagaaaagaaacccttggcaagaaaagggctcccgcccattcgaactcagtccctgcctccaataacactggggaataattttctgacggcatctcacagggccacctctcatgccggactttcctctgctccccaccacatggcacagcgaagtcagaaatcaaggagcgaacaggacctgctgaacaatcgtaccggctgccagatgctgctggataatccctggaagtctgacagcaaccaggtcttttcttacaaggtttggacagtaagctcctccgacaagctgctggaccgtctgctcagcgtaagaccaggtcatcaggaagtttccgttcccccacaccttagacatctgcacaacccttcatccggccagaatttccaacatctgagtcctaaccggcacaagattcgagatttgccgttcactcgaaataacttagcgccactccccgaccagaagtttctgagtggagagccactaagaactaatcgagtgctccctgctatacctagccagcgacgccacagtactgccgccgaggagtcggagcacagcgccaaccccaccagtgacgagaactag

SEQ ID NO: 26754 - DNA, 981 bp, Artificial Sequence
  Description of Artificial Sequence: Synthetic coding sequence
atggactctaaccttagggacattaatgaaagtacaccattagcttacgccctttattgcggacatacggcttgcgttaaactgctctcccaggagtcgcgcactgaacctacccgcccccctccatcccagtcctctagaccccagaaaaaggagaggcgtttcaacgtactgaatcaaatattttgtaagaataagaaagaagagcagcgcgcccaccagaaagatccgtctcgcgataggtaccgtgaagaagacaccagtgaggtgaatgatattatcacaactttcgacagcatcgtcggaactaactgccaggaacagcccggtgaccaggtggcgatggtggaattcaaaaagaaaacaagcgataattcgaagtaccttttgcccgagaagaaacctttggcaagaaaggggctaccaccaatcagaactcaatcgctgccaccgatcaccctggggaacaattttcttacagctagccaccgggcaacttcccatgcaggccttagttccgcgcctcaccacatggcccagcgtagtcagaagagccgtagtgaacaagaccttctgaacaaccgaacagggtgtcagatgctgcttgataacccctggaaaagcgactcaaaccaggtcttcagctataaggtgtggaccgtgagctcctccgataagctgcttgaccgcctgctttctgttcgtcccggacaccaagaggtctccgtccctccacacctgcggcatctgcacaatccatcgtcagggcagaacttccagcatctgagccccaaccggcacaaaatacgcgatttgccatttacacgtaacaacctcgctccgctaccagatcaaaagttcttgagcggtgagcctctgaggactaatcgcgtactgcccgccatcccctcccagcggaggcactctacagccgccgaggaaagcgaacactctgctaatcccacgagcgacgagaactag

SEQ ID NO: 26755 - DNA, 1845 bp, Artificial Sequence
  Description of Artificial Sequence: Synthetic coding sequence
atgatgaggcaggccacgatggacttcagtacgccatccgtgtttgaccagcagcggggcgacagttccgaagaagtggatctcactatggtataccaggcggctagtaacggggacgttaacgcactgactgcggtcatcagggaagatccctctattctggagtgctgcgacagtgaaggatgtacacccctgatgcatgcggtaagtgggcgtcaggcagatactgtgaaactgctgctgaaaatgggggctaacatcaatatgcaggacgcctacgggagaacctcgctttgtttagccacctacttgggctggctggaagggtgcgtgtctctgctcaggaatggggctaaacacaatatccccgataagaacggccgccttcctttgcatgctgccaccgccgaacccgatatgcgcctgctgacggttctgctgcagcagtccaacatttccgaaattaaccatcaggataacgaaggaatgactcccttgcactgggctgcgttccataaccagccccaacacactcaaatgcttctgaaaaagggcgccgaccccaccctggtggataaggattttaagacagctctgcactgggccgtacagtccggaaacaggattttgtgcagcatcatcctgtcccaccaccagggaccatctattatcaattacgacgacgagtcaggcaagacctgtgttcacatcgctgcagccgctgggttctccgacattatccacgagctggccagagtgcccgagtgcaacctacaggccctagacgtggatgatcgcactccactccattgggctgctgctgccgggaaggccgagtgtgtgcagagtttactggaactgggcatggattcgaatttgagagacattaacgagagtacaccacttgcctacgccctgtattgtggccatacagcctgcgtgaagctccttagtcaggagtcccgaacagaaccaactcgccccccacccagtcaatctagcaggccccagaaaaaagaaagaaggttcaacgtgctgaaccagatattctgcaaaaacaaaaaggaggaacagcgcgctcaccagaaggacccgagccgcgacagatatagagaagaggatacctccgaagtgaacgacattataaccacctttgatagcatagtcggtaccaactgccaggaacagcctggggatcaggtagcaatggtggaatttaagaagaaaaccagcgacaactctaagtacctcctacctgagaaaaagccgttagctagaaaaggcctgccccccatcagaacacagagtttgccgcctatcacgctgggaaataacttccttactgcatcccatcgggcgaccagccacgctggccttagctccgcacctcatcatatggctcagcgatcacagaagtcaagaagtgaacaggatctcctgaacaaccgcacagggtgccagatgctcctggataatccctggaagtctgactcaaaccaggtgttcagttataaagtatggactgtgagcagctcagataaactcctcgaccggctcctctccgtgcggcctggacaccaagaggtgtctgtgcccccacatctgcgccacctgcacaacccttccagtgggcagaatttccagcacctttcacctaatcgccacaaaattcgggacctgccctttacgcgaaacaacttagccccccttcctgaccagaaattcttatctggtgagcctctgcgaaccaatcgagtgctgccggccattccatcacagagacggcactcaaccgctgcggaggaatctgagcattccgctaatccaacctctgatgaaaactag

SEQ ID NO: 26756 - DNA, 2382 bp, Artificial Sequence
  Description of Artificial Sequence: Synthetic coding sequence
atggcccgggagctcagtcaggaggcactgctggacttcctgtgccaggccggcggccgggtgaccaacgccgccctcctgagccacttcaaaagtttcctgcgagacccggacgcaagccctagccagcatcaacataggcgggaactgttcaagggcttcgtgaattcagtcgccgccgtacggcaagatccggacgggacgaaatatgtggtgcttaagaggagatatcgtgatcttctaggagaagagggcctccaaaggcctcgagagccccccgcagccgcaccctctgctggaggagctgcaccgtgttcccctaggggcgccagaagaggagaacccccacagcagcagcctaggcgccgtcgcagagagaaggaaccagaggaagaacctgccggcgccgccgctcgtgcggccgacgccgcatgcaacggtcttcctggcagcgattcacgccgggctccaggcaaggggggaggctccaagggaagcccaggacagcgccctcccgtgccagccgctgctgccgcaggggcccaagccagagccagctgtgccgccgccaagacccagggtcggtgttgttgggaatgccttcagaacaatctggctgtgctgcctggggagctgggcgctcttcctcactcggccactgctgaggaaaagccagctagggccctgcccgctcaggatgatagaggagcgtctcgtgagagagaggagggggccctcgccgagcccgctcctgtccccgcggtagcccatagcccccctgcaacggtcgaggcagcgacatcgcgggcgtctcccccagctctgttgcccggtccagccccaaggggagataggccggaactgctaacacctagttctctgcattactctaccttacaacagcagcagcagcgaacaagagagtgggtcgcgcggcatccacaggtgcctgaagctcgtgatcagggtcccatcagggcttggtcagtgctgcccgataactttttacaattgccacttgagcccgggtctactgagcccaattcagagccaccggatccctgtctttcatcccatagtctgttcccagtcgtgcccgacgaatcctgggagtcatgggccggcaacccttcactcacagtatttaggtctatccggtgccagctctctctgcaggacctcgatgactttgtggaccaggagagtgacggctccgaagagtcttcaagtggcccaaaagattctccgggcgctagtgaggaaggcctccaggtggtgctaggtactcctgaccgggggaagctccgtaaccctgctgggggcctgtcagtgagtcgcaaggagggatccccttccaggagtccacagggattgcggaatagaggggacgggcacatatcccaacaggtcccagccggtgctaacggcctggccggacatcctctgaagccattgccgtggcccgtgcctaagttacgaaggtctctgcgccgcagctcactcgcaggccgtgccaagttgtcttcctccgatgaagaatacctggacgaaggattgctcaagcggtcacgcagaccaccccggagtagaaagccgtccaaagcaggaaccgctccctccccaagggtcgacgctgggctaagtttgaaactggccgaagtcaaggcggtggtagctgagagaggttggcggcattcactctgggtgccatccggtgaggggtccgcagccttagcgccccatagaaccagcgagcacaagtccagcctggtgccactcgatgcccgagaacatgagtggattgtcaagctcgcaagcgggtcgtggatccaggtgtggacactgttttgggaggatcctcagctggctctgcataaagactttcttacaggttacaccgccctccattggatagcaaaacacggggatcttcgtgcccttcaagacctggtgtctggagccaaaaaagctggaatcgtgctggacgttaatgtacggtcttcttgcggatacacaccactgcatttggcagctatccacggccaccagggcgttatcaaactgctagtgcagcggctggcatcacgagtgaacgttcgcgactccagtggaaaaaaaccgtggcagtacctgacatcaaatacgtccggtgagatttggcagctgctgggggctccaaggggaaagcccatcttccctgtgtacccgctagttggatcctcatctcccacacgtaaggcgaaaagcaaagagatctcacgctccgtcacacgcaaaacttccttcgcagctctgttgaagtcccagcacaataaatggaaactggcaaatcagtatgagaaattccattctcctagagaacgggaagagtacagcgattag

SEQ ID NO: 26757 - DNA, 1578 bp, Artificial Sequence
  Description of Artificial Sequence: Synthetic coding sequence
atggagggccctgctgaatggggacccgaagccgccctgggtcccgaggcagttctccgattcctagctgaacgcggtggaagggcccttcatgccgagctggtccaacattttcggggcgctctcggaggtgagcctgagcagcgagctcgcgcccgggcccactttaaagaactcgtaaacgcggtagccaccgtgagggtggatcccgctgacggcgccaagtatgtccacctgaaaaagaggttttgtgaagggccttccgagcctagtggggacccccccaggattcaagtcaccgcagaaccagaagccccagatggaccggcgggacctgaagcacgggaccggctgcccgacgccgcggcaccagagtcattaccgggtcaaggtcgggagttaggagagggtgagccacccgcccccgctcattggccgcccctgtcggccggggcacggagaaaaaacagcagacgggacgtgcagccccttccaagaacaccagctcccggaccgagtgaagatttggagctgcctcctcatggatgtgaggaggccgataggggaagctcactagtcggcgctaccgcccagcgccccgccaggcagaacctgagagacctagtgatgggcagcagccctcagcttaagcggtcagtatgtcccgggggaagcagtcccggcagcagctctggcggtggacgaggtagaggcgggggagacagtgattccgcatcagtggccagttccagcgctgaggaagaaagtagcggaggcgggagtgtaactctcgatcccctggaacacgcttggatgctgtccgcgtctgacgggaaatgggattcactggagggactcctaacctgtgaaccggggcttcttgtgaaacgggactttatcaccgggtttacctgtctacactgggctgccaagcacggtcgtcaggagctgcttgctatgctcgtgaacttcgccaacaaacatcaactgcctgttaatatagatgccagaacaagcggtgggtacactgcacttcacctggctgctatgcacgggcatgtggaggtagtgaaactactggtaggcgcctatgacgcagacgtcgacataagagattattcaggtaagaaggcttcccaatatctttcgcgcagtatcgcagaagaaataaaaaacctggtcggtgcactggacgagggggacggagaatctgctgcaggctcaggtggaggtagatggcggctcagtaaggtgctgccaagccacctgattacctacaaactctcacacgccctggaggatggcggagaccatcatcatcatcaccacagtgctgagggctgggtcggcggcaaagccaaggatcctggaagaaaggcttcggggagctcatctgggcggatcaagccgcgcttgaacaagatcagattcagaacccaaattgtgcatacaacccctagctttcgggaccctgagcagcccttggaaggacgtggtgaggagggagtaggtgaggaacgtccagttaaggggcactccccttttactttgaggcctaagagtaacgtattcggatag

SEQ ID NO: 26758 - DNA, 948 bp, Artificial Sequence
  Description of Artificial Sequence: Synthetic coding sequence
atggcacagctggggggcgcggccaacagagctcctacggcttccctagcgcctacctctcagtccctgcgatgcgccccgcagccacgcccttctcgcgctgacacgggttctttaggaagatactggggaaaagctgcggccgcagcctctcgagagcatccattccctgggacacttatgcattccgctgctggtagtggccggagacggggggcccttcgagagctgttgggcttgcagagggccgctccagccggatggctgtccgaggagagggctgaggagctcgggggaccgtccggaccaggatccagccgcctgtgcttagagcctagagaacatgcttggattctggctgcagccgagggcaggtacgaggtgcttcgggaactcctcgaggccgagcccgaattattactgcggggcgacccaattaccggatactccgtgttacattggttggctaaacatgggcggcatgaagagctcattctggtacacgatttcgctctccggagagggttgagacttgacgtttcggcacctggaagtggagggctgacacccctgcatctggccgccttacagggccacgatatggttataaaagtactggtcggggcgctgggcgcagacgccactcgcagagatcacagtggccatcgtgcgtgccactacttgagaccagacgcaccttggcgcttacgagaactatccggagcggaggaatgggagatggaatctggttctgggtgcactaatctgaacaacaatagtagtggtacaacagcttggagggcggcctccgctgtaggtgccacagccgtagagacctcaagaagagtggccgcctcgcgtacgaaggctaaagacaccgctgggtcccgcgtcgcccagatgcactccctgtttcgccacctgttcccctctttccaagatcggtag

SEQ ID NO: 26759 - DNA, 1026 bp, Artificial Sequence
  Description of Artificial Sequence: Synthetic coding sequence
taggcgtgggggatgaggagggctgctgctggggccggaggcgctagggctgccggacctacaggtggcgcctcacggctgcatcccaacgctgggaggcgcagcggggctagagcgggagctcaagggtgtggtggtccccgagttggcagtgccgacagccgtgcgttgcccgcacaacccttggcctgcgcaaggggaaggagtcagcgcctcgtttgtgacccaaaggctgccagcgccctgcccgatctggcacccgatgtgttcgtgctacgggtccggctggaggagacaggcgagatgttccgcgttgccaattgccgaggagacatgaccgtgagggagttaaaggaggagctcgatttaatggttgggatcccttttaatcttcagcgccttcagtatttggatgagggagtacttatggacgacaccactctcaaattccacgacgtggttcccggtgggataattagcctctgcatctggcaccacgacggatggaccgagctcgtcttagccgcagtcgagggcgatccgtccaaattaagctgcttaggtctgactgaagattcattttatcgcactgcaaacagcgagcactttgaaggcgaaaaatggaagcactggacctcccagagagcttttgttgctttgtatgtggcatcacaccggggtcacttcgatgccgtgcagtatctgctcgagcacggggccagctgccttagcagaagccctctcgggcgtacccccctacacgtcgccgcggcgatgggacgctctgattgtattatcctgctgcttcagcacggggcctctattcatgatagagacgccaagggggaaacccctatttcgatagcacaccgattgaatcacaccctctccgagagacaaatggtattgctgcataggatcgcgaagtcaggaatacgcgaccttaatgacctggtgatgaaaaacgccctgcaaagagtaaaatctggcttcagatcagagaaaatgacaatgaccccccattag

SEQ ID NO: 26760 - DNA, 1038 bp, Artificial Sequence
  Description of Artificial Sequence: Synthetic coding sequence
atgacaagaggccgcgcctggggcatgaggcgcgctgcagcaggagctggaggtgctcgcgcggccggacccaccggtggagcttcccgcttgcatccaaatgcaggtagacggagtggagcacgcgctggtgcccagggctgtggcggtccacgcgttggcagtgccgactcgcgcgccttgccagcccagccacttgcatgcgcacgggggcgatctcaaaggctggtgtgcgaccctaaagctgcctctgccctgcccgatctcgctccagacgttttcgtcctcagggtgaggttagaggaaacaggcgagatgtttcgcgtcgcgaattgccgcggggacatgaccgtgcgggagctgaaagaagagctggacctcatggtgggtatacccttcaatctgcaacggctgcaatacctggacgagggtgttctgatggacgacacaacactgaagttccatgatgtcgtgccaggaggcattatatctctgtgtatttggcaccatgatggttggactgaattagtcttagccgccgttgagggcgacccttcaaaactgtcctgtctggggttgaccgaggactcattctacagaacagccaacagtgagcacttcgagggcgagaaatggaaacattggacttctcagcgcgcatttgtcgccctgtatgtggcgtcccataggggccacttcgatgcagtgcagtacttattagagcacggggcttcctgcctctcccgatcgcctctaggaagaacccccctgcacgtcgcggccgctatgggtagaagtgactgtattatcctgctcttgcagcacggcgctagcatccacgacagggacgcaaaaggagaaacccccatatctatcgctcatcgcctcaaccacactctgtctgaacggcagatggtcctgctgcatcgcattgcaaaatcagggattcgtgacctcaacgacttagtaatgaagaacgcgttgcagagggtgaaatctgggtttaggtctgagaaaatgactatgacaccacactag

SEQ ID NO: 26761 - DNA, 2712 bp, Artificial Sequence
  Description of Artificial Sequence: Synthetic coding sequence
atggctacctggaggaaaaaccgcgacaaagatggcttctcaaatcccggataccgcgtgagacaaaaggatctgggtatgatacataaggcggcaatagccggcgatgtcaataaagtgatggaaagtattttgttgcgtctgaacgacctcaacgatagggacaagaagaaccgaactgccctgcttcttgcctgcgcgcacgggcggccaggggttgtggccgatttagtagccagaaagtgccaactcaaccttacagacagcgaaaatcgcactgcactcatcaaggccgttcagtgccaggaggaagtgtgcgctagcattcttctggaacacggtgctaatccgaacgtgcgggacatgtatggtaatactgccctgcattatgctattgacaacgaaaacatttctatggcccgaaaactgttagcttatggcgccgacatcgaggctagaagccaggacggacatacctcactcttgctggctgttaatcggaagaaggagcagatggtagcttttctcctgaagaagaaacccgatctaactgccatagataacttcggaagaacggcattaatcctggccgctagaaacggaagtacctcagtggtttaccagttgttgcaacacaacattgacgtgttttgtcaggatatcagcggatggactgcagaggactatgccgttgctagtaagttccaggcgattagaggcatgatctccgaatacaaggcgaacaagcgctgtaagtcactgcagaactccaactccgagcaggacctggaaatgaccagcgaaggcgagcaggaaagactcgaagggtgcgaaagctctcagccccaggtcgaggagaaaatgaaaaagtgcaggaataagaagatggaggtgtccaggaatgtacacgcagacgattccgacaattacaatgatgatgtggatgaactgatacataaaataaaaaatcggaagcccgacaaccatcagagcccaggaaaggagaacggcgagtttgataggcttgcccggaagacttccaacgagaagagcaaagtgaagtcccagatttatttcaccgatgatttgaatgatatctcgggatcttcggagaaaaccagtgaagatgacgagctcccgtactccgacgacgaaaattttatgttgttaattgagcagtcaggtatggagtgcaaggacttcgtcagcctctccaaatccaaaaacgctacagcagcatgtggaagaagcatcgaggatcaaaagtgctactgtgagaggttaaaggtgaagttccagaagatgaaaaataacattagcgtgctgcagaaggtgctttctgaaacagacaagaccaagagccagagtgaacaccagaacttacaaggtaagaaaaaattatgtaatttgcggttcatcctgcaacaacaggaggaggagaggattaaggcagaagagttgtacgaaaaggatattgaagaactgaaaatcatggaggagcaatatcgtacacagaccgaggtgaagaaacagtcaaagttgaccctgaagagtcttgaggtggaactcaagactgtaagaagtaactccaatcagaacttccacacccacgaacgggagagggatctgtggcaggaaaatcaccttatgagagacgaaattgcaaggcttcgtcttgagatcgacaccattaagcaccagaatcaggagaccgagaataagtacttcaaggacatcgaaattattaaagaaaacaatgaggacctggagaaaacactcaaacgaaatgaggaggccctgactaaaacgatcacgaggtatagcaaggaattgaacgtgttgatggacgagaataccatgttgaactcagagctacaaaaagagaaacaatccatgtcgaggttggagacggaaatggagtcatataggtgtaggctcgccgccgccctctgcgatcatgaccagcgccagtcatccaaacgcgatctgcagcttgccttccaatctacagtcaatgagtggtgccacctccaggaagacacaaattcccacatccagattctgtcacagcagctctctaaggctgagagtacaagctcggggctggaaacagagttacattacgagcgggaggctcttaaggaaaaaactctccacatcgagcacatgcagggggtgctttctcgtacacaacggcggttggaggatattgagcacatgtaccagaacgaccagccgattctcgagaagtacgtaagaaagcagcaatccgtggaagacggcttgttccagctgcaatcgcagaaccttctttatcagcaacagtgtaacgatgccaggaaaaaggctgataaccaggaaaaaaccatcattaatatccaggtgaagtgcgaggatacagtggaaaagttgcaggctgaatgtaggaagctggaggagaataacaaaggactgatgaaggaatgcaccttgctgaaggagcggcagtgtcagtatgaaaaggaaaaggaagaaagagaagtggtccgccggcagttacagcgcgaagtggacgatgctttgaataagcagctgcttctcgaggccatgctcgaaatatcttcagagcgtcgcataaatttagaggacgaggcacagagcttgaagaagaaactgggccagatgcgctcccaggtgtgcatgaagctgagtatgagcacggtgactctctag

SEQ ID NO: 26762 - DNA, 1920 bp, Artificial Sequence
  Description of Artificial Sequence: Synthetic coding sequence
atgaccagtgagggagagcaggagaggttggagggttgcgaatcttcccaaccacaggtggaggaaaaaatgaaaaagtgcagaaacaagaaaatggaagtgtcacggaatgtccatgccgacgatagtgataattacaacgacgacgtggacgagctgattcataagatcaagaaccgaaagccagataatcaccagtccccgggcaaagaaaatggagaatttgaccgccttgccaggaaaacgtctaatgagaagtcaaaagtgaaatcacagatctactttaccgacgacctgaacgatatcagtgggagcagtgaaaagaccagcgaagacgatgaactgccctattccgatgatgagaatttcatgttactgatcgaacaaagtggaatggagtgcaaggactttgtgtccctcagcaaatcaaagaatgccacagcggcttgtggaaggagcattgaggatcagaagtgctactgcgagagactgaaagtgaaattccaaaagatgaagaataacatctccgttctacagaaggtcctcagcgagacagacaagactaagtcccagtccgaacatcaaaacctgcaaggcaagaaaaagctttgcaatctcagattcatcttacagcagcaggaagaagaacgcataaaagcagaagaactttacgagaaggacatcgaggaattgaagatcatggaggaacagtatcgaacccagaccgaggtgaaaaagcagtctaagttaacattgaagagcctggaggttgagcttaaaacagtcagatccaactctaatcaaaacttccacacccacgagagagagcgggacctgtggcaggagaaccacctaatgcgggacgaaatcgctaggttacgcttggagattgacacaatcaagcaccagaatcaggagaccgagaacaagtactttaaggatatcgaaatcatcaaagaaaacaacgaggacctcgaaaaaacgttaaaacgaaatgaagaagcactgacgaagactatcacgcgatacagcaaagagctgaatgtgcttatggatgaaaatactatgttaaatagtgagctgcagaaggaaaaacagagcatgagcagactggaaacggagatggagagttacagatgtcgtcttgccgctgcattgtgtgatcatgaccagaggcagtcatctaaacgagatttacagctggcattccagagcacagtcaacgagtggtgtcacctgcaggaagataccaactcccacattcagattctgagtcagcagctctcaaaagctgagtcaacttcgagcggactggagacggagctccactacgaaagagaggctcttaaggaaaaaactctgcatattgagcatatgcagggcgtacttagtagaacgcagcggcggttggaggatattgagcatatgtaccagaacgaccagcctattttggagaagtacgtgaggaaacagcagtcggtggaagacggattattccagctgcagtcccaaaaccttctctaccagcagcagtgtaacgatgcgagaaagaaagctgataaccaagagaaaacaattatcaacattcaagtgaaatgcgaggacaccgtggaaaagctccaagcagagtgcaggaagctcgaggaaaacaataagggcctgatgaaggaatgcacgctgctgaaggagcgccaatgccagtacgagaaggaaaaagaggagcgtgaggttgtcagacggcagttgcagcgcgaggtggacgatgctcttaataagcagctcttgctggaggccatgctggagattagcagcgaacgcaggataaacctcgaagacgaggcccaatctctgaagaagaaattgggccagatgagaagtcaggtgtgtatgaaattgagcatgtccacggtcaccttgtag

SEQ ID NO: 26763 - DNA, 1143 bp, Artificial Sequence
  Description of Artificial Sequence: Synthetic coding sequence
atgctgaaacctaaggatctgtgtcctcgggctggcacacggacctttctggaagccatgcaagccgggaaggttcatttggcgaggtttgtcttggatgcacttgataggagcattattgactgccgcgccgaacaagggcgaaccccgctgatggttgcagtcggcctccccgaccctgctctgcgggcacgtttcgtgcggctcctcctggagcagggcgcggccgtgaatttgagggacgagcgtggaaggacagctttgtccctggcctgcgagcgtgggcacttggacgcggtccagctgctggtgcaattttccggggacccagaagcggctgattccgctgggaattccccggtcatgtgggcagctgcatgcggacacggtgccgtcctggagtttctggtgagatcttttagacggttgggactgcggcttgatcgtacaaacagagccggacttactgcactgcagctcgctgctgcccggggccatggtacatgtgttcaagccctgacaggcccatggggtagagcagcagccgctgccgccgcccgcggatccaacagcgactctccgcccggcagacccgcacctgctgcctcgccagaacaccggcgcccttcaccacgcagactgccccgaccccttcttgcccgcttcgcccgagcagcaggaggtcacggaggagaagcgggtagcgctgggaaaaattcaggtcggcaccgggcacaggggagtgaacggcccgaactggggaggtctatgtctcttgccctgggagcagtgaccgaggaagaagccgctagattgcgagccggggcacttatggccctccccaacagcccccaatcttctgggaccgggcggtggcggagtcaggaggtgctcgaaggcgccccacccactctggcccaagcacccatagggttgtcaccccaccccgaaggcggtccgggatctggaagactggggcttagacgtcgaagcaccgccccagacatcccctcccttgtgggggaagcacccggccccgaatccggccctgaactggaggccaacgcattatcagtgagcgtacctggccccaacccatggcaggcaggcacagaagcagtagtgctgagggcacagcgctag

SEQ ID NO: 26764 - DNA, 1200 bp, Artificial Sequence
  Description of Artificial Sequence: Synthetic coding sequence
atggactctcagcggcccgaacctagagaggaagaggaggaggaacaggagctgcgatggatggagctagacagcgaagaggctttgggaaccagaaccgagggcccgtccgttgtgcagggatggggccacctcttgcaagctgtctggaggggaccagccggcctcgtaacgcaacttctgaggcagggcgcctccgttgaagaacgcgatcacgcaggccgtacacctctgcacctggcagtgcttaggggtcatgcacctctggttcggctgctgctgcaacgcggcgcgcccgttggagccgtcgaccgggccggccgtaccgcactgcacgaagcagcctggcacggccacagcagggtggcagaacttttacttcagaggggcgctagtgctgctgcgagaagtggaacaggactgactccactccattgggccgccgctcttgggcacactctcctggccgcccgtctcttagaggcaccgggacccggtcctgctgccgctgaggccgaggacgcaaggggatggaccgctgctcactgggccgcagccggagggcggctggccgtattggagctcctggcagccggtggcgctgggttggacggagctctcctcgttgctgcagcggccggtcggggagccgctcttcgcttcctgcttgctaggggtgccagagttgatgcccgggatggcgcgggtgcaactgcccttggtctcgctgcggcattgggtcgctctcaggacattgaagtgctgctgggtcatggggcagatcccggaattcgtgacaggcatgggcggtccgcactccacagggcggctgcaaggggacacctcctcgccgtgcagcttcttgttacgcaaggggcggaagtggatgcccgggacaccctcggtctgactccactgcaccatgccagtcgggagggccacgtcgaggtggccggctgtctattagataggggagcacaggtggacgcaaccggttggctgcgaaagacacccttgcacctggctgcagaacgcggtcacgggcccactgtgggcttgttgctctcacggggcgccagccccactcttcgaacacaatgggccgaggtagcccagatgcctgaaggcgatttgcctcaggccctgccggagctgggcggtggagagaaagaatgcgaagggatcgagagtactgggtag

SEQ ID NO: 26765 - DNA, 525 bp, Artificial Sequence
  Description of Artificial Sequence: Synthetic coding sequence
atggacagtcagagacccgagcctcgtgaggaggaggaggaggaacaggaactgcgttggatggaactagactccgaggaagctctgggtactagaaccgaaggaccctccgtcgtccagggatggggacatctcctgcaggcagtgtggcgaggcccagctgggctggtgacacagctgctgagacaaggtgcctccgttgaagaacggacactccgctgctgttgggccacaggtcaaacacaggcatctgggactgggatggctgccctacggtgcaccggcctgcctcccgaagatacatgtcttccgagtagttgttggtctccaaggggcccaagatggatgaggggtacgccttgggcaagtcatccatgtatcacacctctgggcaaggccacttggaggctaccagcagcctgctggacaggcgtgccccgatggatgctcccagctggatctgaacgacctccttacacctggctccaatccgagggtatgggactcccctggggattctgttag

SEQ ID NO: 26766 - DNA, 198 bp, Artificial Sequence
  Description of Artificial Sequence: Synthetic coding sequence
atggattcccagaggccagagcctagagaggaggaggaggaggaacaggagttacgatggatggagttagactccgaggaggccctgggcaccagaacagagggtccttctgtggtgcaaggctgggggcacctgcttcaagcagtttggaggggtcccgccggactggtaacacaactgctgcgacaagggcactag

SEQ ID NO: 26767 - DNA, 954 bp, Artificial Sequence
  Description of Artificial Sequence: Synthetic coding sequence
atgccatgggatgcaaggaggccgggcggtggggccgacggggggcctgaggccagtggggccgcccgctctcgcgcacagaagcagtgccggaaaagtagtttcgctttttaccaagcggttagggacctgttgccagtgtggcttctggaagacatgcgagctagcgaggccttccattgggatgaacgaggccgagccgccgcctactctccatctgaggcacttctgtatgcacttgtgcacgatcatcaggcttatgcacattatcttttggccacctttccacgccgagcacttgccccaccttctgccggatttaggtgttgtgcggcccccggaccgcatgtggcacttgccgtgagatacaaccgcgtgggtatactgcgacgcatcttgaggacactgcgagattttccagcagaggagcgggcccgggtcctagatcggcgtggatgctctagggtcgagggtggggggacgagcctccacgtggcctgcgagcttgctcgcccagagtgtttgttcctgctgctgggacatggggcgagtccgggtttacgcgacggtgggggtttgaccccactggagctgttactcaggcagctcggcagggatgctggggcgacccccagcgccgctggtgcacctgcctcagctcccggagagccccggcagcgtcgcctgctcctgctagacctactggcactatatacacccgtgggcgccgctggatctgcgaggcaggagcttctaggcgatcggccaagatggcagaggctgcttggcgaggacaagtttcaatggctcgccggtcttgctccaccttccctcttcgcccgagccatgcaggtgctggtcacagcgatatctccgggacgctttccagaagctctcgacgaattacccctaccaccatttctgcaaccgcttgacttaacaggaaagggctag

SEQ ID NO: 26768 - DNA, 318 bp, Artificial Sequence
  Description of Artificial Sequence: Synthetic coding sequence
atgccatgggacgctaggaggccagggggaggagctgacggcggcccagaagcttccggagctgcaagatctcgagcccaaaaacagtgcagaaagtcgtcattcgccttctaccaggctgtgagggaccttctcccagtgtggctgctggaggacatgagagcctcagaggcttttcactgggacgagagaggtcgggcggctgcatatagcccatccgaagcactattatatgctctggtacacgaccaccaggcatatgcccactatctgttggccactttcccaagacgcgcgttggcccccccatccgcctag

SEQ ID NO: 26769 - DNA, 783 bp, Artificial Sequence
  Description of Artificial Sequence: Synthetic coding sequence
atgccttgggacgcacgacgcccagggggtggagccgatggaggacccgaggcttctggagcggctcgtagtcgggcacagaaacaatgtagaaagagctctttcgctttctaccaagcggtgagagacctactacccgtttggctgctcgaggacatgcgagcctcagaggctttccactgggatgaacgcggtagggccgcagcttactccccttcggaagctctgctgtatgccttggtgcatgaccatcaggcctacgcccactaccttttagctacttttcctcgacgcgccctggcccctccgagcgccgggtttcgttgctgcgctgcccctggaccccatgtcgctctggcagtacggtataaccgcgtcgggatcctacgcaggatcctcaggaccctccgcgactttcccgccgaagagcgggcacgcgtgctagatcgccgcggctgcagcagggtggagggcggggggacctcattgcatgtggcctgcgagctggctcggccggagtgtctttttctcttgcttgggcacggcgctagtccaggtcttagggacggcgggggactgacaccgttagagctgctgttgcggcagcttgggagggacgcaggggccacaccttccgcggccggtgcacctgcctccgcaccgggtgaaccacgacagaggaggctgctattgctcgatctgctggctctctatactccagtgggagctgccggcagtgccaggcaggaattgctgggcgataggcctcggtggcagcgctag

SEQ ID NO: 26770 - DNA, 954 bp, Artificial Sequence
  Description of Artificial Sequence: Synthetic coding sequence
atgccatgggatgcccgaagacccggtggaggtgcagatggggggccagaggcctcaggagccgctagatctcgggctcagaagcagtgtcggaagtcaagcttcgcgttctatcaggctgtgcgagatttgctcccggtgtggcttctggaggatatgcgagcttcagaagccttccactgggatgagagggggagagcggccgcttatagtcccagcgaagccctcctatacgcactggtacatgatcatcaggcatacgcacattatttgttggcgacctttcctcgacgcgctctggcccccccctccgccggcttccgatgctgcgccgctcctggcccccacgtggcgcttgctgtaaggtacaacagagtaggcatactgcggcgcatcctcagaaccttgcgagatttccctgcagaggaaagggccagggtactggatagaagaggctgtagcagggtcgaggggggcggtaccagtctacacgtcgcctgtgagctggcccgaccagagtgtctgttcttactgttaggacacggggccagcccaggcctacgcgacggaggcggcctcacccccctcgaactacttctgcgacagcttggacgggatgcaggcgccacaccctcagccgctggcgcccctgcatccgcccccggcgagcctcggcagcggcgtttactgctattggatcttttggccttgtacacccctgtaggggccgcaggctcggccagacaggaactgctcggggaccgccctagatggcagaggctgctcggagaagacaaatttcagtggctggcaggtttagccccaccaagtttgtttgcccgcgctatgcaggtgttggtaacagccataagcccaggacgctttcccgaggccctcgacgagttacccctgcctccatttctccagcccctagatctcactggtaaaggctag

SEQ ID NO: 26771 - DNA, 954 bp, Artificial Sequence
  Description of Artificial Sequence: Synthetic coding sequence
atgccctgggacgcacggaggcccggaggtggtgctgacggcggacctgaagctagcggcgcagcgagatctcgcgcccaaaagcagtgtaggaaatcctcttttgcattctatcaggccgtgagggaccttttgccagtctggcttctcgaggacatgcgcgccagcgaagccttccattgggatgaacgaggacgggccgctgcatacagcccctccgaagccctcttatacgctcttgttcacgaccatcaggcttatgcccattaccttctggcaacgttcccgaggagagccctggctccgccgtccgcagggtttagatgctgcgcggcaccaggcccacacgtagccctggcagtgcgctacaatcgcgtcggtattctcagacgaattctcaggaccttaagggactttccggccgaagagcgggccagagtattggatcggagaggttgtagtcgggtggagggcggaggaacttccctgcatgtggcttgcgagttggcacggcctgagtgtctcttcctgcttttgggacatggcgcatcccccgggctgcgtgatgggggcgggctgacgcccctggaacttctgctgcggcaacttggaagagacgccggggcgaccccatcagctgccggtgcgccagccagcgcacccggggagccgcggcagcgcagacttctgctcctcgacctgctggccctctacacgcccgtaggagccgccggctcagctcggcaggaattgctgggagaccggccaaggtggcagcgtctcctaggcgaagacaaattccaatggcttgcaggtctcgcaccccccagtctgttcgcgcgggcgatgcaggttcttgtcaccgcaatcagtccagggaggttcccagaagccctggacgagcttcctctcccaccattcctgcagccactggatctgactggcaaagggtag

SEQ ID NO: 26772 - DNA, 2292 bp, Artificial Sequence
  Description of Artificial Sequence: Synthetic coding sequence
atggaggccagtctgacgcggcgactgcttttcaaggatcggcacttcacatgctctaagatcatcggaaggcgttttgcctgtttcgcacaacgcttgtcccatcgccggaagcaaagtcagtgcgaccttctgaatgagtccacaggccaactccctacgacatgttcatctgcggcctctaattcaattaattggaactgccgtgttaagatgacacaacagatgcagaatctgcatttgtgccagagtaaaaagcattccgcaccgagcagcccgaacgctgccaaacggctttatagaaatctgtccgagaagctgaagggttcccactcaagtttcgacgaggcctactttcgaacgagaactgaccggctgagcctgcgcaagacctcagtcaacttccaggggaacgaggccatgtttgaggccgtggagcagcaggacatggacgcagtgcagattctgctctaccagtatacacccgaggagctggacctgaatacgcctaattccgagggtttaacacccctagacatcgcaattatgaccaataacgtgccaatcgcccgcatacttctccgaaccggggcgagagagagtccgcactttgtgtctttggaaagccgggctatgcacctgaataccctagtgcaggaggcccaggagcgggtgagcgaactatccgcgcaggtggagaatgaggggtttaccctggacaacaccgaaaaagaaaaacagctgaaggcgtgggaatggcgttatcgtctctaccggagaatgaagactggctttgagcacgcaagggccccagaaatgcccaccaatgtgtgtctgatggtgacctctagcaccagcctgacagttagttttcaggaaccgctcagcgtgaatgcggctgtggtaaccaggtataaggtagagtggtccatgtcggaggatttctctcccctggccggggagataatcatggataatctccagacactccgctgcactatcactggcttgaccatgggccagcagtacttcgtccaagtgtccgcgtataatatgaaggggtgggggcccgctcagacgactacaccagcttgcgcctctccgtcaaattggaaagactacgacgatagagaacctcggcataaagggcaaagcgaggtgcttgaagggttgttacagcaggtaagggcacttcaccagcactatagttgtagggaatcaacgaaattgcaaaccaccggacgaaagcaaagcgtgtcacgctccctgaaacacttatttcatagtagtaacaagttcgttaaaactctcaagagagggctgtatatagccgttattttctactataaagataatatcttagtcacgaacgaggaccaggtgcccatcgtggagattgatgattcacatacatcctctattacgcaggatttcctgtggttcacaaagctcagttgcatgtgggaggatatcagatggttgaggcagtcgataccgatcagcagcagctcgagcaccgtcctccaaacgcggcaaaagatgctcgccgccaccgcgcagctccagaatttattaggcacccacaacctggggcgggtctactacgaacccatcaaagaccgacatgggaacatcctgatcgtgacaatacgggaggtggagatgctgtactccttctttaacggtaagtggatgcagattagtaagctgcaaagtcaacgtaaaagtctgagcacacctgaggagcctacagcgctcgatatcctcctgatcaccatacaggatatcctgagttatcacaaacgctcccaccagaggctgtttcctgggctgtacctcggctacctcaagttatgtagctccgtcgatcagattaaggtcctagtgacacaaaaactgcccaatattctctgtcacgtgaagatccgagagaataacaacatttcccgggaggagtgggaatggattcagaaactcagcggcagcgaaagcatggagagcgttgatcacactagcgattgtcctatgcaactgttcttttatgaactgcagatggccgtcaaggccctgttacagcagataaatatacccctccaccaggccaggaatttccgactctatacacaggaagtccttgagatgggtcacaacgtatcttttcttcttctgctgccagcatctgacgatgtgtgcaccgcacccggtcaaaataacccgtacaccccccattctggttttctgaatttgccccttcagatgttcgaactgggtattgtggcttgctttacctag

SEQ ID NO: 26773 - DNA, 831 bp, Artificial Sequence
  Description of Artificial Sequence: Synthetic coding sequence
atggcctggtggaaatcttggatcgagcaggaaggggtgaccgttaaaagttctagccacttcaaccccgatcctgacgcagaaacattgtaccaggcaatgaaggggattggagtggggtcccagctgctctcacatcaagccgccgcattcgcgttcccctcctccgccctcacttcggtctccccttggggacagcagggtcacttgtgctgcaaccctgctggaacgaacgaacaggccattatcgatgtcctgactaaacgctccaatacccagcggcagcagatagccaagtcttttaaggcccagttcggtaaagacctaacggagacgctgaaatccgagttgagtggaaagttcgagcggctcatagtcgcattgatgtaccccccttatagatacgaggcgaaagagctccacgacgcaatgaaaggttctagagatgacgtgagcagcttcgtggacccagggctcgcactgcaagacgcacaggacctgtacgccgctggtgagaaaattagagggaccgacgaaatgaagttcatcacaattttgtgtacccggtcagctacacatctgcttcgcgtgaaatgtacccagaatctccattcctactttgcggaaaggttgtactatgccatgaagggcgccggaacccgagacggcactctcattcgtaatatcgtaagccgctccgagatcgatctgaacctgataaagtgtcactttaagaagatgtacggcaagacgttgagctcaatgatcatggaagatacatctggagattacaaaaacgcgctgctctctctcgtgggatcggatccgtag

SEQ ID NO: 26774 - DNA, 984 bp, Artificial Sequence
  Description of Artificial Sequence: Synthetic coding sequence
atggcctggtggaagtcttggatcgaacaagagggcgtgacggtcaaaagctctagccattttaatccggatccagatgctgagacactgtatcaagccatgaaggggatcgggacaaacgagcaagcaattatagatgtgttgactaagcgttccaatactcagcggcaacaaattgcgaaatcctttaaggcacagttcggcaaagatctcacagagacacttaagagtgagctcagtgggaaattcgaaagactcattgtggccttaatgtaccccccctatcggtatgaagctaaggagctccacgacgcgatgaaaggactcggaacaaaagagggggtcataattgaaattcttgctagtcggactaaaaaccagttgcgtgagatcatgaaagcatacgaagaggattatggctcaagccttgaagaagatatacaggctgatacgtccggttacctggagcgcattcttgtgtgtctccttcagggaagccgagatgacgtttctagctttgtggatcccggtcttgcgctgcaagacgctcaggatctttatgccgctggagagaagattcgcggcactgatgaaatgaagtttataacaatactgtgcacccgttctgccacccacttgttgcgggtgtttgaggaatacgagaaaatagccaataagtctatcgaagattccattaaatctgaaacacatggcagtctggaggaggcaatgttgaccgtggtgaaatgcacgcagaacctgcactcctatttcgcagagcggctgtattatgcgatgaaaggggcaggtacccgggacggcactctgatccggaatatagtgtctcgttcagagatagacttgaatctaatcaagtgccatttcaagaaaatgtatggcaaaaccctgtcatcaatgattatggaagacacctcgggtgattataagaacgcacttctgtcgctggtcggttctgacccttag

SEQ ID NO: 26775 - DNA, 798 bp, Artificial Sequence
  Description of Artificial Sequence: Synthetic coding sequence
atggcatggtggaagtcttgggatcttaccgagactcttaaatctgaactcagcggtaaattcgagcgattaatagtggccttaatgtatccgccatatcgttacgaggctaaagagctgcacgacgctatgaaggggctcgggaccaaggaaggggtaattatcgaaattctggcttcacggacaaaaaaccaactgcgagaaattatgaaggcatatgaagaggactatggcagtagtctggaggaggacatccaggcagacacaagcggctacctggaacgaattcttgtctgcctgttgcagggaagccgcgatgacgtatcctcctttgtagatccagggttagctctgcaggatgcacaggatctgtatgccgctggcgaaaaaatacgagggactgacgagatgaagtttattaccatcttgtgcacaagaagcgccacgcatttactcagggtgtttgaagaatatgagaagattgccaataagagcatcgaagattctattaaaagtgaaacccatggtagcctggaagaagctatgctgacggtggtgaaatgcactcaaaatttacactcttacttcgctgagcgactgtactacgccatgaagggtgcgggaacaagggacgggaccctgatccgcaatattgtctcccgctcggaaatagatcttaacctgattaagtgtcatttcaaaaagatgtacggcaagaccctttcaagcatgattatggaagatacctcaggggattataagaacgcgctgctgtccctcgtggggtcagatccatag

SEQ ID NO: 26776 - DNA, 426 bp, Artificial Sequence
  Description of Artificial Sequence: Synthetic coding sequence
atggcatggtggaagtcatggatagaacaggaaggcgttacggtgaaaagcagttcccattttaatcctgatcctgatgctgaaacgctctatcaggctatgaaaggaatcggcacaaacgagcaggcaatcatcgatgtcctaaccaagaggtctaacacccagagacaacagattgccaaaagttttaaggctcagttcggaaaggatctcactgaaacactgaagtccgaacttagcggaaagttcgagcggctaatcgtggctcttatgtacccaccgtaccgatatgaggccaaagagcttcacgatgctatgaaggggctgggtacaaaagagggagtaatcatagaaatcctggccagcagaactaagaaccagctacgtgagatcatgaaagcatacgaagaaggtcagcagggctag

SEQ ID NO: 26777 - DNA, 831 bp, Artificial Sequence
  Description of Artificial Sequence: Synthetic coding sequence
atggcctggtggaaggcttggattgagcaggaaggcgtgacagtcaagtccagcagccacttcaaccctgatcccgatgccgaaacactttacaaggccatgaagggcatcggggtagggtcccagctgctgagccaccaggctgcagcctttgcctttccctcctcagccctaacatctgtgtcaccctgggggcagcagggacatctgtgctgtaaccctgccggcaccaatgaacaggctattatcgatgttctcaccaagcggtcgaatacgcagcgccagcagatcgcaaaatcattcaaagctcaattcggtaaggacttgacggagactctgaagagcgagctgtccgggaaattcgagcggctgatcgtggcattgatgtatcctccttacagatatgaggctaaagagcttcatgatgccatgaagggctcacgggatgacgtaagctctttcgtggacccagcactagccttgcaggacgcccaggatttgtacgcagcaggtgagaatatacgcggcaccgatgagatgaaattcataacgatcctgtgtacccgtagcgcaacacatctcctgcgcgttaaatgcacccaaaacttgcattcttattttgctgaacgtctgtattacgctatgaagggcgcggggacacgcgacgggactttgatccggaacattgttagcaggtcagagatcgatctgaacctcatcaagtgtcacttcaaaaaaatgtacggcaagactctctcaagtatgataatggaggacaccagcggtgactataagaacgccctcctgagcttggtgggatccgatccatag

SEQ ID NO: 26778 - DNA, 984 bp, Artificial Sequence
  Description of Artificial Sequence: Synthetic coding sequence
atggcttggtggaaggcctggatcgagcaggagggggtgactgttaaatcttcctctcatttcaatccagacccagatgccgaaaccctatacaaagccatgaagggcataggcaccaatgagcaggcaatcattgatgttctgactaagcgctccaacacacaacgacagcaaattgctaaaagcttcaaagcccaattcggcaaagatctgactgaaaccctgaaatctgagttatcaggtaagttcgaaaggctcatcgtggccctgatgtatccaccctatagatatgaagccaaggaactgcatgatgctatgaagggcttggggaccaaggagggcgttattatcgagatcctcgcatcgcggactaagaaccagctgcgggagatcatgaaggcctatgaggaggattatggtagttcgttggaggaggatattcaggcagacactagcggctacctggagcgaatcctggtctgtctactccagggatcccgggacgacgtgtcgtctttcgttgacccagcactcgccctgcaggacgctcaggatctctacgctgcgggggaaaacattcggggtactgatgaaatgaagtttatcacaattctgtgtaccagatctgctacccatctactgcgcgtgtttgaggagtacgaaaagattgcgaataaatccattgaggattctatcaagtcagaaacacatggcagcctggaagaagccatgttgaccgtcgttaagtgtacacagaatctccattcctattttgcggagcgcctgtattacgccatgaaaggcgccggaacgagagatggcaccctgatacgaaatattgtgagccgttccgaaatcgatctgaacctgatcaaatgccattttaagaaaatgtatggcaagacgctttccagtatgatcatggaagatacaagcggagattataaaaacgccctgctgtctctcgtaggatcagatccatag

SEQ ID NO: 26779 - DNA, 426 bp, Artificial Sequence
  Description of Artificial Sequence: Synthetic coding sequence
atggcctggtggaaggcctggattgagcaagaaggagtaaccgtcaagtcttcgtctcactttaaccctgaccccgatgcagagaccctatataaggccatgaaggggatcggcacaaacgagcaggcaataatcgacgtgcttaccaaacggagcaatacgcagagacagcagattgccaagagcttcaaggctcagtttggaaaagacttgactgaaacgttgaagagcgaactgtccggaaaatttgagcggctgattgttgcccttatgtatcccccttatcgatatgaagcaaaagaactgcacgatgcaatgaaaggcctcgggacaaaggagggtgttattatcgagatcttagcctccagaacgaagaatcagttgcgtgagatcatgaaagcttacgaagaaggccagcaggggtag

SEQ ID NO: 26780 - DNA, 798 bp, Artificial Sequence
  Description of Artificial Sequence: Synthetic coding sequence
atggcctggtggaaggcttgggacttgaccgaaacactcaagagtgaactgtccggcaagttcgaacggctgattgtggcattaatgtatccaccctaccggtacgaggcaaaagagctgcatgacgcaatgaaggggcttggcaccaaggagggggtgatcattgagattctggcttcacgcaccaagaatcaattgcgagaaatcatgaaggcttatgaagaggactatggtagctccctggaggaagatatccaggcggacacctccgggtacttggaacgcatcctcgtgtgcctcttacagggttcacgggacgatgtgtcgtccttcgtcgatccagccctggctttgcaggatgcgcaagacctgtacgccgcaggagaaaacattaggggcactgacgaaatgaagttcattactatcctgtgcacccgatctgccactcatctcctgagagtctttgaggagtatgaaaagatcgccaacaagagcattgaagattctatcaaaagcgaaactcatggctccttggaagaagcaatgctgacggttgttaaatgtacacagaatcttcatagctattttgcggagcggctctattatgccatgaagggcgccggcaccagagacggcaccctgatccgcaatattgtttccagatccgagatcgacctaaacctaattaaatgtcactttaagaaaatgtacgggaagacactctcatccatgattatggaggacacttccggcgactacaagaacgccctattgtccttggttggctctgacccgtag

SEQ ID NO: 26781 - DNA, 306 bp, Artificial Sequence
  Description of Artificial Sequence: Synthetic coding sequence
taacacgttcatctgggctttattatagcctttgaaaacgtggttttttttttcctgtgtccaaatgaccgattagttcctgacgtccctgcactggccacgaagataaccgcccgggctctgcctgggcaggcggggggcgggaggcagcccggcgatgcagttagtgtatccaagctccggatatgggccgtgagccaggggaggagcggcagctggatgcgcgggttagagtttcccggagatttacagacatgtacagctactctgccttgtagttgcctgctggctagcgtgcaatgctag

SEQ ID NO: 26782 - DNA, 777 bp, Artificial Sequence
  Description of Artificial Sequence: Synthetic coding sequence
atgcccaggccccggagagtgagtcagctcctggatctgtgcctttggtgcttcatgaaaaatatctcaaggtaccttacggatatcaaacccctgcctccaaacattaaggaccgcttaatcaaaatcatgagcatgcagggtcagattaccgatagcaacataagcgagatcttacatcccgaagtccagacccttgacctgcgatcttgtgatatttcagatgctgctctgctgcacctatctaattgtcggaagcttaaaaaactgaatctaaacgcatccaaaggcaacagagtgagcgtgacgagcgaaggcattaaggccgtagcgtcttcctgctcttatctgcatgaggcctcactgaagcgctgctgtaatttaaccgatgagggagtggtggcgttggccctgaactgtcagctgttgaaaatcatcgatctgggggggtgtttaagcatcaccgacgttagcctgcacgcattgggaaagaactgcccctttctgcagtgtgttgatttcagcgctacccaggtatcagatagtggagtcatcgccttggtatcggggccctgtgccaaaaaacttgaagaaatacatatggggcactgcgtaaatttgactgatggggcagtagaggcagtactgacatattgtccacaaatcagaatcctgctattccacggatgtccactgattaccgaccactcccgagaggtgctggagcagctggtcggtccgaataagcttaagcaggtgacatggacagtgtactag

SEQ ID NO: 26783 - DNA, 588 bp, Artificial Sequence
  Description of Artificial Sequence: Synthetic coding sequence
atgggcgcggcagtcttctttggctgtactttcgttgcctttggacctgcctttgcactgttccttattactgtcgccggagacccactaagagtcatcatactggtggcaggtagatgttctgctttgccaacgaccagctgcttaataagcgggctctcattcggaatcattagcggggtgttctccgtcatcaacatcctggcagacgcactaggcccgggtgtggtcgggattcacggcgattctccttactactttctcacctctgcctttctcacagcagctatcattctgctgcacactttttggggcgtggtgttctttgatgcatgcgaaagaaggagatactgggccctagggctggtagtggggtcacatctactcacctctggattgaccttcctgaacccttggtacgaggcctctctcctgcccatctacgcagtgaccgtttccatgggcctctgggcttttataaccgcaggtgggtcactgaggtcaattcagaggtctctactgtgtcgacggcaagaggatagtcgggtgatggtttattccgccctgcggattccccctgaggattag

SEQ ID NO: 26784 - DNA, 495 bp, Artificial Sequence
  Description of Artificial Sequence: Synthetic coding sequence
atggaggaggaggccgagaccgaagaacaacagagattctcctaccaacagcgcctgaaagcggccgtgcattacactgtcggctgtctgtgcgaagaagttgccttggacaaagaaatgcagttctccaagcaaaccatcgccgcgatttctgagctcacctttcggcaatgtgagaacttcgctaaggacctggagatgtttgccagacacgctaaaagaaccaccattaatacagaagacgtgaaacttttggcgcgcagatccaactccttgcacatgcaggaagccgctggcattagaaagagctctttgttgaccttcttagcctggtggttcgagtggacctcacaggcatccgccggacccctgatcggcgaggaagccagagaagtggccagacgacaggagggcgctccaccacaacagtccgcccgacgagatcgcatgccatgccgaaacttcttttggaagaccttttcttcttgtaaatag

SEQ ID NO: 26785 - DNA, 234 bp, Artificial Sequence
  Description of Artificial Sequence: Synthetic coding sequence
atggaagaagaggccgaaactgaagaacaacagcggtttagctaccaacaacgactaaaggccgctgtgcactatacagtcggctgtctgtgcgaagaggtagccctcgacaaggagatgcagttcagtaagcagaccattgctgccatctcggagctgacgttccggcagtgcgaaaattttgcaaaggatctggagatgtttgcctctatctgtcggaagcgacaggaatag

SEQ ID NO: 26786 - DNA, 600 bp, Artificial Sequence
  Description of Artificial Sequence: Synthetic coding sequence
atggaggccagcccagcaagtggcccacggcatttaatggatccacatatctttacatccaattttaacaacgggattggccggcacaagacgtatctgtgctacgaagtggagaggctagataacgggacttcagtgaaaatggaccagcatcgagggttccttcacaaccaggcaaaaaatcttctgtgtggattctacggtaggcatgcagaactgaggttcctggacttagtcccgtccctccaattggatcctgcacaaatttatagagtgacgtggtttatcagttggtccccatgtttcagctggggatgcgccggtgaggtccgggcctttctccaagagaatacccacgtgagattgaggatatttgcggcgcgaatctacgactacgaccccctgtataaggaggccctgcaaatgttgcgggacgcgggtgcacaagtgagtattatgacttatgacgaattcaaacattgctgggatacatttgtagatcatcagggctgtccatttcagccttgggacggcttagacgaacattcccaggccctttcagggcgcctgcgggcaatactccagaaccaggggaattag

SEQ ID NO: 26787 - DNA, 1161 bp, Artificial Sequence
  Description of Artificial Sequence: Synthetic coding sequence
atgcacgcacggggtccccatggtcaactgtcaccagccttgcccctcgctagttcagtgctaatgttgttgatgagtaccctgtggctggtaggcgccgggcctggattagtgctcgccccagaactcctgttggacccttggcaagtccataggctgctgacccacgcacttgggcacacagctctcccggggttgctgctgagcctcttgctgctgccaactgttggctggcagcaagaatgtcaccttggcaccctccgattcctgcatgcctctgctctgctcgccttggcctcaggactgctcgctgttctgctggccgggctggggctctcttctgctgccggctcatgcggatatatgccggttcatcttgcaatgctggccggcgaaggtcatcggccaaggcgccctcgaggagcacttcccccatggctgtcaccatggctgctgctggccttaacacctttattgtcctcggagccaccttttctgcagctcctgtgcggccttctggctggcctggcgtacgccgccggggcctttcggtggttggagccatcagaacgcaggcttcaggttttacaggagggtgtcctttgtaggacactggctggctgttggccgctgcgtctgctcgctacaccaggctcactggccgaacttccggtcactcaccctgcgggagtgcggcctcccatccctggacctccatatgtagccagcccagacctctggtcccattgggaagattctgccctcccaccccctagtcttaggcccgttcagccaacttgggaaggtagctcagaagccggcttggactgggcaggagcctcattctctcccggaactccgatgtgggccgccctcgatgagcagatgcttcaggagggcatccaggcctcactgttagacgggcccgcacaggagcctcagagcgccccatggttgagtaagtcatccgtgtccagcctccgcctccaacaactggagcgtatggggtttcccaccgaacaagcggttgtggcacttgcagctactggacgggtagaaggcgctgtctctctgctcgtgggaggacaggtcggcactgaaactctggtcacgcacggcaagggggggcctgctcattccgaaggacccggcccaccgtag

SEQ ID NO: 26788 - DNA, 1161 bp, Artificial Sequence
  Description of Artificial Sequence: Synthetic coding sequence
atgaaccctcagatcagaaacccaatggagcgaatgtaccgggatacgttctatgataattttgaaaacgaaccaatcctgtacgggaggagttacacctggttgtgctatgaggtgaagataaaacgcgggagatccaacctcctctgggacaccggcgttttccggggacctgttctgcccaagcggcagagcaaccacaggcaggaagtttatttcagattcgagaatcacgctgagatgtgttttttgtcttggttttgcggcaacagactgcccgcaaatcgccggtttcagattacttggttcgtgagctggaatccctgtcttccctgcgtcgtcaaagtaacaaagtttcttgcagagcaccctaatgtcaccctgaccatatcggccgcgcgattgtactattaccgggatcgagactggcggtgggtcttgttacgcctccataaggctggcgcccgggtgaaaattatggattacgaggactttgcatattgttgggagaacttcgtgtgcaacgaggggcaaccattcatgccctggtacaagttcgatgacaattatgcttctctgcaccgaacattgaaggagatactccgcaaccccatggaggcaatgtacccccacattttctactttcactttaaaaatctacttaaagcctgcgggagaaacgaatcctggttatgcttcaccatggaagtgacgaaacaccactcggctgtttttcgaaaacgcggggtgtttagaaaccaggttgaccctgaaactcattgtcacgccgagagatgcttcctttcttggttttgcgacgacatccttagtcccaacacgaattacgaggtgacatggtacaccagttggtcaccatgcccagaatgtgctggcgaggtcgctgagttcctggcaagacactctaacgtcaaccttactatctttactgctaggttgtgttacttctgggatacagactaccaggagggcctgtgctccctgtcccaagaaggggcctcggtcaagatcatgggatacaaggatttcgtaagttgttggaaaaatttcgtgtacagcgacgatgagcccttcaaaccttggaaaggcctgcagacgaactttaggttactgaaaaggcgcctcagggagatcctgcagtag

SEQ ID NO: 26789 - DNA, 609 bp, Artificial Sequence
  Description of Artificial Sequence: Synthetic coding sequence
atgaaccctcaaatccgaaaccctatggagcgaatgtaccgggatacattttacgataatttcgaaaacgaacctatattatacgggaggagctacacatggctctgctacgaggtcaaaattaaaagaggccgctctaacttgctctgggataccggcgtcttccggggtcctgttctgcctaaaaggcaatccaaccataggcaggaagtggacccggagactcattgccacgcggagagatgtttcttaagctggttctgcgacgatattttgtcgcccaacacaaactatgaggtgacctggtatactagctggtccccctgccctgaatgtgctggtgaagtggctgagtttctcgcccgccatagcaacgtcaacctcactatctttacggcacggctgtgttacttctgggacacagattaccaggagggattatgtagtctgtctcaggagggtgcttcagtgaagatcatgggctataaagattttgttagttgctggaaaaacttcgtgtactcagacgacgaaccttttaagccatggaaaggtttgcaaacaaatttccggctcctgaagcgccggttgagagaaattctgcagtag

SEQ ID NO: 26790 - DNA, 3210 bp, Artificial Sequence
  Description of Artificial Sequence: Synthetic coding sequence
atggatttcctgaggctgtacctgcccggtctccatcaggccctcaggggggcactggactctctggggacatttgtgagctacctcctcggtgatgccgtgcctacagtagagagggaggctcaggcagctgaagaattgggcgtggtagctgtgggcaagacaggaaaaatcgtggaagaggaagcacaggaggacctcgaggggctccgggggtcccaaaatgagggggcaggccgcctccgcggccctggcgatgaccggcgacatgaagtgggctcatccgcggttgaacagacctggggttggggcgatgggtccagccacggaagtcaggctgaaaggcaagactcaggcgccggtgagactgcgaaggccgcccgttgccaggagccttctgctcatttggaagcaagaaagaagtccaaggccggctccggcgcctgccaggacagatccggacaggcccaggagcgccaagagagccacgaacaggaggtcaatcgggaggagcggttgagatcatgggagcaggaagaggaggaagaggaagtgagggcccgagagcctggaatggccagaggggcagaaagcgaatggacctggcatggcgagacagagggcaaagccggtgctgtaggtccaaaggccgcaggcgataatagagaaatggagcagggagtccgggaggctgacgctggagagacggaggaaccaggagctgaaggcgccggtaagggggaagaggttgtggtggtagaaaaggcctgtgagagtacccgggcctggggaacgtggggcccaggagccgaaccggaggattggggcatcctgggaagagaagaggctagaaccactccgggcagggaggaggccagagcaatcctggacggagaggaagccagaacgatttctggcggagaagaggctgaaaccgcatccggcggcgaagaagctgagacagcctctggtggagaagaagccggaacagcttccggcggcgaggaggccggcatcgccagcggaggagaggccggaacagcttccgggggagaggaagctggaactgcctccggcggagacgaagcttggacaacctcaggtaaggaagaggctgacttgctgggagtccggcaaacagaatacggagccgttcccggtgagcgcctgctcgaggctaccggaaaggtgtgggtcctggaagaagaaggagacgaggagcgagaggcggaagttagccccttccccaaacagccccaggtgttaggaaccgagagaactgaagaggcagccgagagccaaaccgccgggcgcgaagctgtaggcggccaggaagccggcgagtcatttgaaggtcaagtggacctgagaggcaaggaggccgagatgcggcaggacttgggcatcagggctgacagggccagaatggaagagctggtgcaggccgaggaggctcaggaggaacggggctcctcccgcgacccggtagccgagttgccaagcgacggcgaggctgaaggtacagctgacttggaggcgaccccagaagcacgccctgaagaggagctcaccggggaagagtcggaagccgcccagacatcctgtggcctgctcggagtggaatggggtggactcacacactccgttacgaagggccagggccccgaactgatgggcggggcccagacgcccactaaacagcctgaagagcgtgaggccggggaggttgagttaatgggtgtactggctttgtcaaaggaagagcaggagaggagcctggaggcaggaccgaggcacgctggaagcgtgaagccggaggcctccgaggcttttcccggtgcgtgggagaaccgaaccaggaaagacatggaaagggggaatacgcaagaagacgcagccgacggcgagcagagggaggaggaggagactgcgggtgggcagactttggccgcagaagccgagggagatcgcgaatcagagctgagcgaggtgcccgaagccggtggagagggtctgacgactcaggacgctgggtgtggcaccgaagagggagaagcatcggtgagcgagaaccaggagttggatggcagtacgggagctgatgcaggaccatgtccctcactcggtgaggcttatgctagggagaccgaagatgaggaagcagaagctgatcgcaccagccgaagaggatggcgcctgcaggcagtcgccgttggtctccccgatcgtgaagacgcccagactggatctgtggccgctggtattatgggcggagatgtcgtaccccatatctctgcagccggcgctggtgaggccctagagggcgtgctgggccaggggtgggatagtaaagagaaggaagaggctgccgcaggcgaacatgctggagggcaggagtttggcctcgaaggcagtgcagaagaggaggtaaccggccgtggctctcaggttgaggcattcgagtcccgggagggaggtccatggggggggcgagtggaggccgaggaaagcgccggcgccgaggattcgtgtggtctagatcccgcaggatcccagacagcacgtgcagagggcatgggggctatggtagaggcaggcgggctcttagaaaaatggacgctgctcgaggaagaagccgtgggatggcaggaacgcgaacagagggaggattccgaagggagatgtggggactatcaccccgaaggcgaagcgccccggctcctcgacgctgagggtctcatggttaccggagggcgcagagcagaggcaaaggagacagagccagagtctcttgagcacgtccggggacaggaggaacagccaactcatcaggcccccgcagaggctgcccctgaatcagtgggcgaagccgagaccgcagaagcaatgggctccgcccgtggcggagctgccaacagctggtctgaagcacccctgcccgggagtcttttggatgtcagcgtccctaggtcccgggtgcacctttccaggtcctcaagccagaggagatcccgccctagctttcgtagaacgccggcctgggagcagcaggaagaaccgccggcccccaaccctcctgaagaagagctgagcgcacccgagcaacggcctctgcagctggaggaaccattggaacctcgatgggaggatcggctgcggcccggcgtgagagatcaaccaggtcaacattctaagattcccatcttttag

SEQ ID NO: 26791 - DNA, 3267 bp, Artificial Sequence
  Description of Artificial Sequence: Synthetic coding sequence
atggactttctccgcctgtacctgcctggacttcatcaggccctgaggggcgcccttgattctcttggaaccttcgtgagttacctcctcggagacgctgttcctacagtggagcgggaagcccaggcagcggaggagctaggcgttgtggccgtcggtaagaccggcaagatagtggaagaggaggcacaagaggatctggaaggcctaaggggttcgcagaacgagggagccgggaggttgcgaggtccaggcgacgacaggagacatgaagtcggcagcagtgccgtagagcagacatggggctggggtgatggcagcagccacggctcccaggccgaacggcaggattccggagcaggggagaccgctaaggccgcccgttgccaggagccctccgcccatctcgaggcacgaaaaaagtccaaggccggatccggtgcctgtcaagaccgctccgggcaagcccaggaaaggcaggagtcgcatgaacaggaagtgaatcgggaggagcggctacgtagctgggagcaagaagaggaagaagaagaggtgcgcgcccgtgaacccgggatggccaggggggccgagagcgaatggacatggcacggcgaaacagagggaaaggcaggcgccgtcggcccgaaggctgcaggtgacaatagagagatggaacagggtgtgcgagaggcggatgcgggcgagaccgaggagccaggcgctgaaggtgccggaaagggagaggaggtggtggtggtagaaaaggcctgtgaaagcactcgcgcttggggtacctggggtcccggtgctgagccagaggactggggtatcctgggaagggaagaggctcgtacgacgcccgggcgcgaggaagcacgggccattctcgatggagaagaggcacgaacgatttccggcggggaagaagcagaaaccgcatccgggggagaggaggcagaaaccgcgtcaggaggagaggaggctggaacagccagcgggggggaggaggccggcatcgccagtggtggcgaagcaggcacagcctctggtggcgaggaggctggaaccgcttccggaggcgacgaggcatggactacatcagggaaagaggaggcagacttactgggcgtgcgccagacggaatacggggctgtaccgggcgagcggctccttgaggccacgggaaaggtttgggtgctggaggaagaaggtgacgaggaacgtgaggcagaggtatcccctttccccaagcagccccaagtacttggaaccgaacgcacagaggaggccgcggagagtcagacggcggggcgggaggcggtgggcgggcaagaagcgggggaaagcttcgagggccaggtggacctgagaggaaaggaagcagagatgaggcaggacctgggaatcagggctgacagagcacgcatggaggaactggtgcaggcagaggaagcacaagaagaaaggggttcttcacgggaccctgtggccgaactcccctctgacggagaggccgagggtaccgcagatttggaggcaacaccagaagcccgacctgaggaggagctgactggcgaagagtccgaagcagcacaaacatcttgtggcctgttgggcgtagaatgggggggattaactcacagcgtcacgaagggacagggccctgagctgatgggcggtgcccagacccccaccaaacagcctgaagagagagaagcaggagaggtggaactgatgggggtattagcccttagtaaagaagagcaggagaggtctttggaagccggcccacgacacgcaggtagcgtgaagcctgaagccagtgaggccttcccaggggcttgggaaaaccggactcggaaggatatggaacgtggcaacacccaagaggacgccgccgatggtgagcagcgtgaagaggaagagaccgcaggcggacagaccttagccgccgaagccgagggcgatcgcgagagcgagctgagtgaggtgccagaggccgggggagaggggttgacaactcaggacgcaggttgcgggaccgaagagggcgaagcctcagtcagcgaaaaccaagaactggacggtagtaccggggccgatgccggcccctgtccctcacttggtgaggcgtatgcgcgtgagactgaggacgaggaggcagaggcggatcgcacatccagacgaggatggagactccaggcagttgccgtgggactccctgaccgggaggacgcacaaactggcagcgtcgctgcaggcatcatgggtggtgatgtggtgccacatatctccgctgccggggcgggagaggccttggagggtgttttgggccagggctgggatagcaaagaaaaagaagaggccgcggcaggggaacatgctggaggacaggagttcgggttggagggttccgccgaggaggaagtgaccggtagaggtagccaggtggaggcttttgagtctagagaaggcggcccatggggtgggcgtgtggaggcagaggagagtgccggtgcagaagactcatgcggacttgatcccgccggctcgcagacggcccgtgctgagggcatgggcgccatggtggaggctgggggcctgttagagaaatggacgctgctcgaagaggaggcagtcgggtggcaagaacgagagcagcgcgaggatagcgaaggccgctgcggggactaccatcctgaaggggaggcccctagactgctcgatgccgagggactcatggttacgggtgggcgcagggccgaggcaaaggaaacagagccagagtcccttgagcacgtgcgcggccaggaggagcagcccacccaccaggcccccgctgaagccgcaccagaaagtgtcggcgaagccgaaacggctgaggctatggggtctgcgagggggggcgccgctaatagctggagcgaggcccccctccccggcagcctgctcgacgtgtctgtaccacggtcccgtgtgcacctgagtcggtccagctctcaacgccgaagccggccctcttttagacggactcctgcttgggagcagcaagaggaacctcccgccccaaaccctcccgaggaagagctgagtgctccggaacagaggccactgcaactagaggaaccactggagccttctccgctccgccatgacggtacacctgttcctgcccgccggcggcccttaggccacggttttggtctggcccaccccgggatgatgcaggagctgcaggcacgcctcggccggccaaagccccagtag

SEQ ID NO: 26792 - DNA, 3294 bp, Artificial Sequence
  Description of Artificial Sequence: Synthetic coding sequence
atggactttctgcgcctttacttacccggcctgcaccaggcacttcggggagccctggattcgctgggtacgttcgtgtcctaccttttgggggacgccgttccaaccgtggaacgagaggcccaggccgctgaggagttaggagtggtggctgtgggtaagactgggaagatagtggaggaagaagcacaggaggacctggagggcctgagaggctctcagaatgagggcgctggaagattgcgcggtcctggggatgataggcggcatgaagtagggagttcagcagttgaacagacttgggggtggggggacggctccagccatggatctcaggccgagagacaggactctggtgccggcgagacagctaaggctgcacgatgccaggaaccttcagcccacctcgaagccaggaagaagtccaaggcaggatccggggcctgccaggacagaagcggccaagcacaagaacgacaggaaagccatgagcaggaggtaaacagggaggaacgactgcggagttgggagcaagaagaagaagaggaggaggtacgtgctagggagcctgggatggccaggggagctgagagtgaatggacctggcatggcgaaactgagggaaaggccggggccgtgggacccaaagcagctggtgacaacagggagatggagcagggggtgagggaagccgacgcgggggaaacagaagagcccggggccgaaggggccgggaagggagaagaggtggtcgtcgtggaaaaagcctgcgaatcaaccagagcctggggaacatggggtccaggcgcggaacctgaagactggggaatcctgggtcgagaggaagcacgaaccacccccggaagggaggaagccagggccatcttggatggggaagaagcacgtaccatttctggtggagaggaggccgagactgcatctggcggagaagaggccgaaactgctagcggcggtgaagaggctggcacggcatcaggaggtgaggaggcagggattgcaagtggaggagaggccggcacagcttcaggcggtgaagaagccggtacagctagcggcggggaggaggcaggaacagccagcgggggggatgaagcctggacgacttctggtaaagaggaagctgacctgctgggggtgcgccagaccgagtacggtgccgtgccaggggaacgactgcttgaagccacagggaaggtctgggtgctggaggaggagggggatgaagagcgcgaggcagaggtctccccttttcctaagcagcctcaagtcctcgggactgaaagaacagaagaggcggccgagtcccagactgcaggccgagaggctgtgggcggtcaggaggctggcgaatcctttgaggggcaggttgatttgcgcgggaaagaggccgagatgcgccaagatttagggataagagctgaccgcgcccggatggaggaactggtgcaggccgaggaggcccaggaggagcggggaagctccagagatccggttgcagaactgccatcagacggcgaagctgaagggacggcggatctagaagctacacccgaggctcgaccagaagaggagctgactggcgaggaatctgaagctgcgcagacgtcatgtggcctcctgggggttgagtggggcggcttgactcatagcgtgacaaaagggcagggccctgagttgatgggcggagctcagactccgactaagcaacccgaagagcgtgaggcaggcgaagtcgagctcatgggcgtccttgccctgtctaaagaggagcaggagaggtctctggaagcaggacctaggcatgctggctccgtaaagccagaggcttccgaggctttcccaggcgcctgggaaaatcggactcggaaggatatggaacggggcaatacacaagaagacgccgccgacggagagcaacgtgaggaagaggaaaccgctgggggacagaccctggctgcagaagcagagggcgatcgggaaagtgagctgagcgaggttccagaggcaggaggagagggtctgaccacacaggacgctggctgcggaaccgaagagggcgaagcctctgtcagcgaaaatcaggagctggacgggagtactggggccgacgctggtccgtgtcctagccttggtgaagcctacgctcgtgaaaccgaagacgaagaggccgaagcagatcggacaagcaggcgcgggtggcgactccaggcagttgctgttggcctgcccgatagggaagacgcccagaccggctcagtggccgcaggcatcatggggggggatgtagtcccgcatataagcgcggcaggcgctggagaggccctggagggtgtgctgggccagggctgggactccaaagaaaaggaagaggcagcggcaggagaacacgctggtggacaggagtttggtctcgagggtagcgccgaagaggaggtcaccgggaggggatcccaagtggaggcctttgagagtagggagggtggaccttgggggggacgggtcgaggccgaggagagcgcaggcgccgaagattcctgtggactggaccccgccgggagtcagaccgctagagccgagggcatgggtgccatggtcgaagcgggaggactgctggaaaagtggacattgttggaagaggaagcagttggatggcaagagagggagcagcgcgaggattccgaggggagatgtggggactatcaccccgaaggggaagcaccgcgtctgttagatgcggagggactgatggtgactgggggccgtcgggccgaagcaaaggaaaccgaacccgaatctttagagcatgtccggggccaggaagagcagcccactcaccaggctcccgccgaggcagcccccgagagcgtgggcgaagccgaaacagccgaggcaatggggtcggcccggggtggagccgccaacagttggtccgaggccccgttgcccggcagcttgctcgatgtgagtgtcccaaggagccgcgtgcatttatcccgctcgagctctcagagaagaagtcgacctagttttaggcgaaccccagcctgggagcagcaggaagagccccccgcaccaaatcctcctgaggaggagctgtctgcgccagagcagcgcccactccagctggaggagcctctcgagccctcccctctgcggcacgatgggaccccagtgcctgcccgaaggcggcccctaggacatggtttcgggctggcacatccaggcatgatgcaggaactccaagcacgtttgggccgtcccaagccgcagtag

SEQ ID NO: 26793 - DNA, 384 bp, Artificial Sequence
  Description of Artificial Sequence: Synthetic coding sequence
atgtctctcctcaggaacaggcttcaggcgctgccagccctctgcctttgtgtgctggtactcgcatgcatcggcgcgtgccagcctgaggcccaggaagggactctgtctcccccccccaaactgaaaatgtccagatggagcttagttcgcggacgaatgaaagagctcctcgaaacagtggtgaatcggacaagggatgggtggcagtggttttggagccccagcaccttcaggggattcatgcagacgtactatgacgatcatctcagggatctagggcctctgaccaaggcttggtttttggagagcaaggactccctgctgaagaagacacactccctctgtccacggctggtttgtggggacaaagatcagggatag

SEQ ID NO: 26794 - DNA, 924 bp, Artificial Sequence
  Description of Artificial Sequence: Synthetic coding sequence
atggccggtctgaacgtctcactgagctttttcttcgcaacctttacgttatgcgaagctgcgcgacgcgcttccaaggctctgctgcccgtcggtgcctatgaggtatttgctagggaagccgtcggggctgtacagctgggcgcatgttttctggaaatgcgcactctagtcgagcttggcccgtgggctggggacttcggccccgatcttctcctcacccttctatttctgctctttctggctcatggcgtcacgctggacggggcatctgcgaatccgacagtgagcctgcaggaattcctcatggccgaggagtccctccctggtacactgctcaaactggctgcccaaggactgggaatgcaggccgcgtgcaccttaacccgcctgtgttgggcctgggagttgtcagacctgcaccttctgcagtccctgatggctcaaagctgcagctcagcgctgcgaacaagcgtgccacacggcgccctggtcgaagctgcatgcgccttttgctttcacctgacactgttgcacctgagacacagccccccagcttactcaggcccagcagtggctttactggtgacagtcacagcctacacagccggccctttcacttcggcgtttttcaatccggccctagcggcgagcgtgactttcgcttgcagtggtcatacactgctggagtacgtgcaggtctactggcttggtccactcacaggcatggttctggcagtcctgcttcaccagggtagactcccacacctgttccagcggaatctgttttacggtcagaagaacaaatatagggcgccgagagggaagcccgctcccgcctccggcgatacccagactcctgctaagggcagttctgtgagggagcctggccgtagcggcgtggaaggtccccactctagctag

SEQ ID NO: 26795 - DNA, 1497 bp, Artificial Sequence
  Description of Artificial Sequence: Synthetic coding sequence
atgctacaatgtcgacctgcacaggaattctcctttggtcccagggccttaaaagacgccctcgtgtctaccgacgcagcgctgcaacagttgtacgtctcagccttttcccctgcagagcgactgttcctggctgaagcctacaatcctcaaaggacgctcttctgcacgctcttaatacggactggatttgactggctgctgtctcgccccgaggccccggaggactttcagaccttccatgcttctctgcagcaccgcaagccacgtctggcacgaaagcacatttatctgcagcccatagatctgagtgaggagcccgtgggcagctcactcctgcatcagctgtgcagttgtactgaggccttcttcctgggcctccgcgtcaagtgcctacctagcgtggccgccgcctccattcgctgttcctctcgaccgtcacgcgactctgatcgcctgcagctgcatactgatggaatccttagttttttgaaaaataacaaacccggggacgcactgtgtgtgctgggtttgaccctgagcgacctttacccccacgaggcttggtccttcaccttctccaagtttctccccggccacgaggtgggggtatgctcctttgccaggttctctggggagttccctaagtctggcccgagcgcccccgacttagctctggtggaggctgccgcggatgggccagaggcgcccctgcaggatagagggtgggccctctgcttctcagctcttggaatggtgcaatgttgcaaggttacctgtcatgaactttgtcatctgctcggattaggtaattgtcgatggctgaggtgcctgatgcagggagcactaagcttggatgaggcccttcggagacccctggacctgtgcccgatctgtttacgcaaactgcagcatgtcttaggcttccgcctcattgaacggtaccagaggctgtatacctggactcaggccgtcgttggtacgtggccatcacaagaagcaggcgaaccctccgtgtgggaagacacgcctccagcaagcgccgatagcggaatgtgctgcgagtcagactccgaaccaggtacctccgtttccgagccgttaacacccgacgcgggcagccatactttcgcttccggtcctgaagaggggctctcctacttagcggcttcagaggcacccctcccgccagggggaccggcagaggcaataaaggagcacgagagatggctcgccatgtgcattcaggcattgcagcgagaagtggccgaagaggatctggtccaggtagatagggccgttgatgccctggatcggtgggaaatgtttacaggtcagctgcccgcaacacggcaggaccccccttccagtagggactctgtcggcttacggaaagtgcttggggacaagttttctagcctgaggcggaagctgtccgcgcggaagctggctcgggctgagagcgcgccgcgaccgtgggacggagaagagagttag

SEQ ID NO: 26796 - DNA, 909 bp, Artificial Sequence
  Description of Artificial Sequence: Synthetic coding sequence
atgcagattattcgccacagtgagcagactctgaagacagctttgatctctaagaatcccgttctcgtttcccaatatgaaaagcttaacgcaggcgaacagaggttaatgaacgaagcctttcaaccggctagcgaccttttcggccctatcactctgcactctccttctgactggattacatcgcatccagaagcaccacaggacttcgagcaatttttttcagatccttatcggaagaccccaagcccaaataaacgctctatctacatccagtctataggggacatcctgaaattcctgaagaagaaaaagcctgaggacgccttctgcgtggtaggcattactatgatcgatctgtatccacgtgactcctggaactttgtctttggccaggcttcactgacagacggcgtgggcatatttagcttcgcccgctatggcagcgacttctacagcatgcactataaaggaaaagttaagaagctcaagaagacttctagttccgactactcaatttttgataactattacataccagagatcacttcagtcctgctcctcagatcatgcaagactctgacacacgagatcgggcatattttcggtctccgccattgtcagtggctggcctgcctgatgcaaggcagcaatcacctcgaggaagccgacaggcgcccgttaaatctatgccctatatgcttgcacaagctccagtgtgcagtcggcttttcaatcgtggagagatacaaggctttagtgcgctggatcgacgatgaaagttcggacactccgggggccacgcctgaacattcccacgaggacaacgggaacttgcccaagccggttgaagcgtttaaagaatggaaggaatggatcatcaagtgcctggctgtccttcagaagtag

SEQ ID NO: 26797 - DNA, 1083 bp, Artificial Sequence
  Description of Artificial Sequence: Synthetic coding sequence
atgcagatcatccgccattccgagcaaactctgaaaaccgcactaattagcaaaaaccccgttctcgttagccagtatgagaagctgaatgctggggagcagaggctgatgaatgaggcgtttcaacccgcctccgatctcttcgggccaatcacgctccactcccctagcgattggatcaccagccatcctgaggccccccaagactttgaacagttcttcagcgacccataccgtaagactccgtccccgaataagcgaagcatctatatccaaagcatcgggtccctagggaacactcgcatcatctcagaggaatacatcaaatggctgacggggtattgtaaggcgtacttttatgggctccgggtgaagctgctcgagccagttcccgtctccgtcacgaggtgtagcttcagagtgaacgagaacacccataatctccaaatccatgcaggcgacatactgaaattcttgaagaagaaaaagccagaagatgccttctgcgtggtggggattacaatgatcgatctttatccaagggattcctggaattttgtatttggacaagcctccctcacagatggagtgggcattttcagctttgccagatatgggagcgatttctatagcatgcactacaaaggcaaggtcaagaaactaaagaagactagctcctctgactacagtatcttcgataactattacatccccgaaatcaccagtgtgctccttctgaggagttgcaaaacgctgactcatgagatcgggcatatctttggcctgcgacattgccagtggttggcatgcctcatgcaaggtagtaatcatctcgaggaggctgatagacgcccattaaacctttgtcctatctgcctccacaagctgcagtgtgctgtgggcttctcaattgtggaacgatataaggccttagtgagatggattgatgacgagtcttctgacacccccggggcaacccctgagcacagccacgaagacaatggcaatctgccaaaacctgtcgaagccttcaaggagtggaaggaatggatcatcaaatgcctggctgtactgcagaagtag

SEQ ID NO: 26798 - DNA, 1083 bp, Artificial Sequence
  Description of Artificial Sequence: Synthetic coding sequence
atgcaaatcattaggcattctgagcagacgttaaagactgctctgatttccaaaaacccagttttagtgtcccagtatgaaaagctgaacgcaggtgaacagcgattgatgaatgaggctttccagcccgcctccgatctgttcggccctatcaccttacactctcctagcgactggataacatctcacccagaggccccacaggatttcgaacaattcttttccgacccttaccggaagacaccttccccaaataagagaagcatttatatacagagcattggaagtcttggcaacacccggataataagtgaagaatacatcaaatggctgaccggctactgtaaagcctatttttatgggctcagggtgaagctgctggaacctgtccccgtctccgtcacaagatgttccttcagagtcaacgaaaacactcacaatctccaaatacacgcaggcgacattctgaaattcctgaagaaaaaaaagcctgaggatgctttttgcgtggtgggcatcactatgatcgacctgtacccaagggactcgtggaactttgtattcggccaggcttcactgacggacggagttggcatcttttccttcgcgaggtatggaagcgatttctacagcatgcattacaaggggaaagtgaagaagctcaagaaaaccagtagctccgattattcaattttcgacaactactatattcccgaaattacgagcgtgcttcttctgagatcctgtaaaacccttacgcatgagattggtcacatatttggcctgcgtcattgccaatggctggcatgtctaatgcaggggtcgaatcacctagaggaagcagataggcgcccactgaatctctgtccaatctgcttgcacaaactgcaatgcgccgtcggcttctccatagttgagcgctataaggctctggttcgatggattgatgacgagtcttctgatactccaggcgccacaccagaacattctcacgaggacaacgggaaccttcctaagccggtggaggcgttcaaagaatggaaggaatggattatcaagtgtctcgctgtcttgcagaagtag

SEQ ID NO: 26799 - DNA, 1083 bp, Artificial Sequence
  Description of Artificial Sequence: Synthetic coding sequence
atgcagatcatccggcacagcgagcagacccttaagactgccctaatatctaaaaaccccgtgcttgtgagccaatatgagaaactgaatgctggtgagcagcgtctgatgaatgaggcgtttcagcccgcgagcgatctgttcggcccaattaccctgcacagcccttccgattggattacgagtcaccctgaggcccctcaggattttgagcagtttttctctgacccctatagaaagactccctctcccaataagagatccatctacattcaaagtatcggatctctgggaaatacaaggatcatttcagaggagtacatcaaatggttgaccggctattgtaaggcgtacttttacggattgagagtgaaactacttgagccggtccccgtttcagtgactcgctgctctttcagagtcaacgagaacactcacaacttgcaaatccacgcaggagacattctaaagttcttgaagaaaaagaaacctgaggacgcattttgcgtggttggcatcacgatgatagacctctacccaagggactcgtggaactttgtgttcggacaggcgtccctgacagatggggtgggcattttcagcttcgcccggtacggaagcgatttttattctatgcactataaaggcaaggtgaagaaactaaaaaaaacaagctcttctgattacagcatcttcgataactattacattcctgagattacttccgtcctattgctgcgtagctgcaagacgttgacacatgaaattggccatatcttcggcctccggcattgtcaatggctcgcctgcctgatgcaaggctcaaaccatctcgaggaagctgaccgtcggcctctgaacctgtgtcccatctgtctccacaagcttcagtgtgccgtcggattttcaatcgttgagcgctataaagccctggtccgttggattgacgatgagagtagcgatacccctggagccacaccagagcacagccacgaggacaacggcaatctgccaaaacccgtggaagcttttaaagaatggaaagagtggataatcaagtgcctggcagtcttacagaagtag

SEQ ID NO: 26800 - DNA, 1083 bp, Artificial Sequence
  Description of Artificial Sequence: Synthetic coding sequence
atgcagataatcaggcacagtgaacagacacttaaaaccgctctgatttcaaaaaatcccgtgcttgtcagccagtacgagaaactgaatgcaggcgaacagagactcatgaacgaagcttttcagccagcatcagacctctttggacccataaccctccacagcccttcagattggattaccagccatccagaagcacctcaggatttcgagcaattcttcagcgacccctataggaaaacaccgtctcccaacaagagaagcatatatatccaatctattgggagcctgggcaacactaggataatctccgaggaatatattaagtggttaaccggttactgcaaggcctatttttacgggctgcgagtaaaacttctggagcctgtgccggtgtctgttactaggtgcagtttccgggttaatgagaacacgcataacctccagattcacgcaggcgatatcttgaaatttttgaaaaaaaaaaagcccgaggatgctttttgtgtcgtggggattaccatgatcgacctgtatcctcgagacagctggaatttcgtgtttggtcaggctagtctcaccgatggcgtagggatcttctcatttgcaaggtatggcagcgatttttacagcatgcactataaagggaaagtgaaaaaactgaaaaagacgagctcctctgattatagtatttttgataactactacattcccgaaatcactagcgttctgctccttcgttcctgtaagactcttacacacgaaatcgggcatatcttcggcctcagacactgtcagtggcttgcatgtttaatgcaagggagcaaccacctggaagaggccgaccggcgcccactgaatctttgtcctatctgccttcataaacttcagtgtgcagtcggcttctctattgtggagagatacaaggcactcgtgcgttggatcgatgatgaaagctctgacaccccaggcgcgaccccagaacactcccatgaggacaatggcaatttacctaagccggtggaagccttcaaagaatggaaggagtggattatcaagtgccttgctgtgctgcagaaatag

SEQ ID NO: 26801 - DNA, 1083 bp, Artificial Sequence
  Description of Artificial Sequence: Synthetic coding sequence
atgcaaatcatccggcattcagagcaaacgcttaagacagcgttaatcagcaagaacccagtgctggtctctcagtacgaaaagctcaatgctggggaacaacgcctcatgaacgaggcctttcagcccgctagcgatttatttggacctattacgctccatagcccttcagattggatcacatcacaccctgaggctccacaggactttgaacagtttttctccgatccctatcgaaagacaccttcccccaacaagcgatctatttatatacagtccattgggtctctggggaatacaagaatcattagcgaggaatacatcaagtggctaaccgggtactgtaaagcctacttctacggcctccgcgtgaaacttttggagccagttcccgtgtccgtaacacggtgtagcttcagggtcaatgagaacacccacaatctgcagatacatgccggagacattctcaagttcctgaagaagaagaagcccgaagatgcgttctgtgtcgtgggaataacgatgatcgatctctacccccgagattcttggaattttgtctttggtcaagcaagccttacggacggggtgggcatcttcagcttcgccaggtatggttcggatttttattctatgcattacaagggtaaagtgaagaagcttaagaagaccagcagctcagattactccatattcgacaattactatattcccgagataaccagcgttctgctcttgaggtcctgcaaaaccctcacgcatgagatcggtcatattttcggtctcagacattgccagtggctggcctgcctgatgcagggttccaatcacctggaagaggccgaccgacggccactgaatctgtgccctatatgtctccataagctgcagtgtgctgttggatttagcattgtggaacgctataaagcattggtgagatggatcgacgacgagtcctctgataccccaggagccacaccggaacactcacacgaagacaatgggaatctgccgaagccagttgaagctttcaaggagtggaaagagtggatcataaagtgccttgccgtgcttcaaaagtag

SEQ ID NO: 26802 - DNA, 2505 bp, Artificial Sequence
  Description of Artificial Sequence: Synthetic coding sequence
atgaccgtggagttcgaggaatgtgttaaagactctccacgctttcgcgctacgatcgatgaggttgagacagacgtggtggaaattgaggccaagctcgacaaactggtgaaactgtgctctggaatggtggaagccggcaaagcctacgtgagtaccagtagactattcgtttcaggcgttagagatctgtcccaacagtgtcagggtgacacggttatcagcgagtgccttcagcgatttgctgactctttgcaggaagtggtgaactaccacatgattctgtttgatcaggctcagcgttcggtcagacagcagctgcaatctttcgtgaaagaggacgtccggaagtttaaggagaccaagaaacagttcgacaaagtccgagaagacttggagctttctctggtccggaacgcccaagcacccagacatcggcctcatgaggttgaagaagcgacaggcgctctgactcttacccggaaatgtttccggcatctggcgttggactacgtcctgcagataaatgtcctgcaggcaaaaaagaagttcgaaattcttgatagtatgctctcctttatgcacgctcaatctagttttttccagcagggatactccctgcttcatcagcttgacccatatatgaagaagctcgccgcagaactagaccagttggttattgactctgcggtggaaaagcgcgagatggagcggaagcacgccgccattcagcagagaacactgctgcaggatttttcatatgacgagtcaaaggtggagtttgatgtggacgctccctccggggtggtgatggaggggtatctgttcaagcgggcaagcaacgctttcaaaacctggaatagacgctggtttagcatccagaattcacaactggtgtaccaaaagaagctgaaagacgctctgacagtggtggtcgatgacctgagactgtgttcagttaaaccgtgcgaagatatcgagcggcgtttttgcttcgaggttcttagccctacgaaaagttgcatgttgcaggcagactctgagaaactgaggcaggcgtgggttcaggccgtccaggcctcaattgcttctgcataccgggagtcgcctgactcgtgttacagcgaaagactcgaccgcaccgccagtcccagtacatcttctatcgactcagccacagatacgcgagaacgcggcgtgaaaggcgaatcagtcttacagagagtgcaatcagtggccggtaattcccagtgcggggactgtggacaacccgacccacgttgggcctctatcaacctaggagtgctgttgtgcatcgagtgtagcggcatccatagatcactgggtgtgcattgttcaaaggtgcggagcctgacactggatagttgggaacctgagctactgaagctgatgtgcgaactgggcaacagcgcagtaaaccagatctacgaggcccagtgcgagggagcgggttccaggaagccgacagcatcctctagccgtcaggacaaagaagcgtggataaaggataaatacgtcgagaaaaagttcctccggaaggcccccatggctcccgcgctggaagcacctcgaaggtggcgtgttcagaagtgtctgcgcccacattcttctcccagggctccaactgctcggcgcaaggttaggctcgagcctgtcctcccttgtgtcgctgccctctcttctgtcggtaccctggatcgcaagtttagacgcgactcactcttttgccccgatgaactcgactccctgttcagttacttcgacgctggagccgccggggctggaccaaggtcgctgtcgtctgactctggtcttggaggatcatctgatggaagcagtgatgttttggctttcgggtccggttccgtggtggatagtgttactgaagaggaaggagccgagtccgaggaatcatctggcgaagccgacggggataccgaggccgaagcatggggactcgccgacgtgagagagcttcatcctggtctcctcgctcaccgggctgctagagcacgcgatctcccagctctcgcggccgctctcgctcacggtgctgaggtgaactgggctgatgcagaagacgaggggaaaactcccctggttcaggctgtcctgggcggttccctaattgtttgtgagtttctcttgcagaacggagctgacgtgaatcagagagacagccgcggaagagctccactgcaccatgccactctgctgggacgcactgggcaggtgtgcctcttcctaaaaaggggcgccgaccagcacgcattggaccaagaacagagggaccccctagccatcgccgtgcaggcagctaacgcggacatcgtcacattgctgagactcgccagaatggccgaagagatgagagaagcggaagccgcccccggcccgcccggagctttggccggaagtcccaccgaacttcagtttcgcagatgcattcaagagtttatttcccttcatctggaggaatcctag

SEQ ID NO: 26803 - DNA, 2280 bp, Artificial Sequence
  Description of Artificial Sequence: Synthetic coding sequence
atggtggaagccggtaaagcatatgtgagcactagcagactgttcgtgtccggcgtgcgcgacctgagtcaacagtgccaaggggacactgtcatcagtgagtgcttacagcgctttgcagattctcttcaagaggtcgttaactaccatatgatactgttcgatcaggcccaaaggagcgtgcggcagcagctccagagcttcgtaaaagaggacgtgaggaaattcaaagaaacgaaaaaacagttcgataaagttcgggaggatctggagttgtcactggtcaggaacgctcaggcaccgagacacaggccgcacgaggtggaggaagcgaccggagccctcacgctgacccgtaaatgcttccggcatctcgcactagattatgttttacaaattaacgtgttgcaggccaagaagaaattcgagatccttgatagcatgctctcctttatgcacgcccagtcctctttcttccaacaggggtactcactgttgcatcagctggacccttatatgaagaaactggctgccgaactagaccagctggtgatagactcggctgttgagaaaagggaaatggaacggaagcacgccgctattcagcaacggacactgcttcaggacttctcatatgacgagagcaaggtcgagtttgatgtggacgcaccaagcggtgtagtgatggaagggtatttatttaaaagagccagtaatgcttttaaaacatggaatcgacgatggttcagtatccagaactctcagctggtgtaccagaaaaagctgaaggatgcactgaccgtcgtcgttgacgatctgcgcttatgttctgtaaagccttgcgaagatatcgagcggcggttttgttttgaggtgttgtccccgacgaaaagctgcatgctccaggccgatagtgagaagctcagacaggcatgggtgcaggccgtccaggcaagcatcgcaagcgcatatcgcgaatcccccgattcatgctactctgagcgtctcgaccggactgctagccccagcacctcttctattgatagtgctacagacactcgggaaagaggcgtgaagggcgaatcagttctccagagagtgcaaagtgtggctggaaattctcagtgtggcgattgcggacaaccagacccgagatgggcaagtataaacttaggggtactgctgtgcatagagtgcagcggtatccaccgatccttaggggtccactgctcgaaggtgcggtcattgaccctggactcctgggagccggaattgctcaagctgatgtgcgagcttggcaactccgccgttaatcagatctatgaagcacagtgcgagggcgccgggtctcgaaaaccaactgctagctcttcccggcaggataaagaagcatggattaaggataaatacgtcgaaaaaaagttcctgcggaaagccccgatggcacccgctttagaggccccccggagatggagagttcagaaatgcttgcggccccactcttcccctcgtgcccctactgcgaggaggaaggttcgcctggagcccgttctcccatgcgtcgcagccctcagcagtgtggggacgctggacaggaaattccggagggacagcctgttctgcccagacgagttagactctctctttagctacttcgatgccggcgccgcgggggctggcccccgcaaaggggcggaatcagaggagagcagtggagaggccgacggggacacggaggctgaggcttggggcctggcagatgtgcgggagctccatcctggcctgcttgctcatagggccgcaagagctagagatttgcccgctctggcggccgctctggcacatggtgctgaagtgaattgggcagacgcagaggacgaaggtaaaacacccctggttcaggccgtgctgggcggatcattgatcgtgtgcgaattccttctgcaaaacggtgccgacgtcaaccagcgagacagtcggggccgcgcccccctgcatcatgccactctcttaggtagaaccggccaagtgtgcctgtttctgaaaaggggagctgatcagcatgcattggaccaggaacaacgggatccactggcaatcgctgtacaggcagcgaatgccgatattgtcactctgctcaggctggcccggatggctgaggaaatgcgagaggcagaagccgctccagggccacctggcgctctggccgggagcccgactgaactgcaattccggagatgcatccaggagttcatatcactgcacctggaggagagttag

SEQ ID NO: 26804 - DNA, 468 bp, Artificial Sequence
  Description of Artificial Sequence: Synthetic coding sequence
atggtaatggccgcgaaaaagggaccgggtcctggcggtggcgtgtccggtggtaaggctgaggctgaagcagcttccgaagtgtggtgccgcagagtccgtgaactcggggggtgtagtcaagcggggaataggcactgcttcgagtgcgctcagaggggagtaacttatgtggacattactgtgggctccttcgtgtgtacgacatgctccggcctcctgcgcgggctaaaccccccccacagagtgaagagtatctccatgaccacattcaccgagccagaggtggtgttcctgcaatccagaggtaacgaggtgtgccggaagatctggctggggctgttcgacgcccgtacctccttggtgcctgactcacgggacccacagaaagtgaaagagttcctccaggaaaaatacgaaaaaaagcgttggcccgacaccttccccagacggctgtgtcagctgtag

SEQ ID NO: 26805 - DNA, 1446 bp, Artificial Sequence
  Description of Artificial Sequence: Synthetic coding sequence
atggtgatggccgcaaagaaaggacccggcccgggcggaggagtaagcggagggaaggctgaagctgaggccgcctcggaagtatggtgtagacgggtgcgtgaactaggcggttgtagccaggcaggcaaccggcactgcttcgagtgcgcccagcgcggagtgacatacgtggatatcactgtgggcagcttcgtatgcaccacatgcagcggattactacggggcctgaatcctccacaccgcgttaagagtatctcaatgacaacgttcaccgagccagaggtcgtatttttgcagtcaagagggaacgaggtctgtcgtaagatttggctgggcctctttgatgcaagaacaagcctagtgccagattctagggacccccagaaggtaaaggaatttctgcaggaaaaatacgagaagaagcgctggtacgtgcctcccgatcaggtgaaggggccaacctacaccaagggttctgctagtacccctgtgcaagggtcaatccccgagggcaagccactcaggacacttttgggagatccggctcctagcctgagtgttgcggccagcacttccagccagcccgtgtcacaaagccatgcccggacctctcaggctcgaagcacccagccaccacctcactcttcagtgaaaaaagcatcgaccgatctcctggccgacatcggaggagatccttttgccgcaccgcagatggctccagccttcgccgcttttccagccttcggcggccagacaccttcgcaaggcggcttcgcaaatttcgatgctttctcctcagggccttcgagtagcgtgttcggctctctgcctccagcaggacaggcaagttttcaggcccagccaactcccgcaggtagcagccaggggactccctttggtgcaacccccctcgcacccgcctcccagccaaattcccttgcagacgttgggtcgtttctcgggccaggcgtccccgccgctggagtgcctagctccctcttcggtatggccggtcaggttccgcctctccagagcgtgaccatggggggcggaggcggttcaagcacggggctcgcatttggcgcctttactaatccgtttaccgctccagccgcacagtctcctctgccatcaactaacccgttccagccaaatggcctggctcccggtcctgggtttggtatgagtagtgcgggccccggcttccctcaagctgttccacccaccggggctttcgcatcttcgttcccagcaccccttttcccccctcagaccccactggtgcaacagcagaacggttccagctttggggacctcggctctgccaaattgggccagaggcctttaagccagccagccggtatcagtaccaacccattcatgactgggccttcttcctcccctttcgcttcgaagcctccaacaactaatccctttctgtag

SEQ ID NO: 26806 - DNA, 1992 bp, Artificial Sequence
  Description of Artificial Sequence: Synthetic coding sequence
gagttactgagaataagtccagatctgctcgccgcagcagttatctctgcacaggaggagcccctcaccaatatccagagggcaagcggacctaccggcttactctggtcggtgtcactggaattcgaccagcagcagggctcagtctgcccatccgaaagcgaaatatatgaagctggagccgaagaccggatggcaggagcccctatggccgcagccgtgcaacccgccgaagtgaccgttgaagttggcgaggatctccacatgcatcaggtacgagaccgggaaatgcctgaggccctggagtttaacctttctgcaaaccctgaggcctccactattttccagagaaactctcagaccgacgccctagagttcaactcctccgctaacccggaggccagtaccatcttccaaagaaattctcagaccgacgtggtggaaatccggcggtcaaattgtacaaatcatgtgtcgaccgagagattttcccagcagtattccagttgcagcacaatattcctggacgattcaaccgccatccagcactacctcactatgacaatcatcagtgtgacgctggagattcctcaccatatcactcagagggacgcagatagaagcctgagcattcctgacgagcaactgcacagctttgcagtctcaacagtgcacatcatgaaaaagagaaacggcgggggctctttgaataattatagctcatctatcccacctactccctctaccagccaggaggacccacagttcagtgtgcctcccaccgccaatacccccacccctgtatgtaagctctctatgagatggtctaacctctttacgagcgaaaaaggttccgatcctgacaaggaacgaaaagcccccgagaatcatgccgataccattggctctggtcgtgctatccctattaaacagggcatgctgctgaaaagatctgggaaatggctgaaaacctggaaaaaaaagtatgtaaccctctgcagcaatggggtgctgacgtactattctagcctgggagattacatgaaaaacattcataaaaaggaaattgacttgagaacatccaccataaaggtccctggcaagtggcccagtctggccacgagtgcgtgtgcgcctatatcctccagtaagtccaacggtctgagtaaagacatggacacgggattgggcgactctatatgttttagtcctgggatctcatctaccactagcccgaagctgaaccccccaccttcacctcacgctaataaaaaaaagcatctgaaaaaaaaatccacaaacaatttcatgatagtttctgccacagggcagacctggcatttcgaagctacaacatacgaggagagagatgcctgggtgcaggccatccagagccaaagtgaggcgatggccctacagtctatacagaatatgcgcggcaatgctcactgtgtagactgcgagacccagaatccgaagtgggcatccctgaatctcggcgtgctgatgtgcatcgaatgttctggtattcacagatcgttcgggactaggttaagccgcgtgcggtcacttgagttggacgactggccagtggaactgagaaaggtcatgagcagtattgggaacgagctagccaattcaatctgggaaggaagctcacagggacagacgaaaccctcaataaagtccacaagggaggagaaggaatggtggatccggagcaagtacgaagaaaagctttttcttgcacccttaccatgtactgagctgtcacttggacagcagcttttgcgggccaccacagacgaagatctccaaacggccatactcctccttgctcatgggagtcgagaagaggtgaatgaaacatgtggagaaggggacggttgcactgccctgcatctcgcctgccgcaagggcaatgtcgtgctggagcagctcttgacggggtggactagttggccggagatgccaactggtacccagcggtag

SEQ ID NO: 26807 - DNA, 2112 bp, Artificial Sequence
  Description of Artificial Sequence: Synthetic coding sequence
atgtttgaggacgtcttcagtgatagtgggaataccggcaacttcgaccgagggaagaaaaggcggctcaccattatcgagtgcggatgtgacataaacatgatgattgacctagccaaagtggccgatctcgtcctgatgctcattgacgccagtttcgggttcgagatggagatgttcgagttcctcaatatatgccaagctcacgggtttcctaagattctgggcgtactgacccatctagatagcttcaaacacaataaacagctgaaaaaaactaagaagcggttaaaacacaggttttggactgaggtgtaccaggacaaggtgggattaacacatgagctcgttcagagcctgatctctacctacagcacaattgatgctaagatggcaagcagccgtgtgactctgctctctaacagcaagccactgggctccgaagccatcgataatcaaggcgtaagtcttgaatttgatcagcagcaaggctctgtttgccccagcgaaagcgagatctatgaagccggcgcagaagacaggatggctggcgccccgatggcggccgccgttcagccagctgaagtgaccgttgaagtgggagaggaccttcacatgcatcaggtgcgcgacagggaaatgccagaagtggtggagattagacgctccaattgcaccaatcactgtgatttgggagatacatcttcttatcacacgaaggtgtctacagtacatattatgaagaagcggaacggcggaggatctcttaacaactacagttcttccatcccaccgactcctagtacgtcacaggaggaccctcagtttagcgtgccccccactgctaacacccctacccccgtgtgcaagctgagcatgaggtggtccaatctgtttacaagcgaaaaaggtagcgatcccgacaaagaaaggaaggcacctgagaaccatgccgataccattggctctgggcgggctataccaatcaagcaagggatgctgcttaaacgctctggcaaatggcttaagacctggaagaagaaatacgtgacactgtgcagtaatggggtgctgacctactattcatcgctcggagattatatgaagaacatccacaaaaaggagatcgacctccggacttctacgatcaaagtgcccggaaaatggccctctctggcaactagcgcatgtgccccgatatcatccagcaagagcaatggtctgagtaaagatatggacacaggcttaggtgatagcatatgctttagtccaggaatttcctctaccacaagccccaagttgaacccgcccccatctccccacgcaaacaagaagaagcacctgaaaaagaaatccactaataatttcatgatcgtgtcagcaacagggcaaacatggcatttcgaagcaacaacttacgaagaacgggatgcctgggtacaagcaattcaaagtcagatcttggcatccctgcaaagctgtaagagctcaaagtctaagtcccaacttacgtcacaatccgaagccatggcattacagagtatccagaacatgcgcggcaacgcacactgtgtagattgtgagactcagaaccccaaatgggccagtctgaacctgggagtactgatgtgtatcgaatgctcgggtatccatcggtcttttggcacacgtctgagtcgcgtgcgctccttggagctcgacgactggccagtggagctccgcaaggtgatgagtagcataggtaacgaactggctaacagtatctgggaggggtcttctcaagggcagaccaagccaagcatcaagtccacaagggaggagaaagagtggtggataagaagtaagtacgaggagaaactgttcctggccccactgccctgcacagaattaagcctgggccagcagctcctgcgtgcaacaacagacgaggatctccagactgccatactcctactggcccacggctcccgggaggaagtaaatgagacctgtggcgagggtgacggctgtacagcgctccacctcgcctgtcgcaaaggaaatgttgtgttagaacagctgctgaccggctggacttcttggcctgaaatgcctacgggcacacagcggtag

SEQ ID NO: 26808 - DNA, 1977 bp, Artificial Sequence
  Description of Artificial Sequence: Synthetic coding sequence
atggggaacatcttaacatgtagggttcatccctccgtcagccttgagtttgaccagcagcagggtagcgtgtgtccttccgagtcggagatatatgaggcgggagccgaagacagaatggcaggggccccaatggccgctgctgtgcagccggcggaagttacagtggaagtgggtgaggatcttcacatgcatcaggtgcgtgacagggagatgcccgaagccctcgagtttaatttaagtgctaatcctgaggctagcaccatctttcagaggaacagtcagaccgacgccttagagtttaacagctcggctaatcccgaggcttctaccatcttccagcgtaacagccagactgatgtagttgaaatccgtcgctcaaactgcactaaccatgtgagcacagaaagattctctcaacagtattcatcttgctctaccatatttctcgacgatagcacagcaatccagcattacctgactatgaccattatctccgttacgctggagattcctcatcacatcacccagcgtgatgctgatcggtcactgtccatccctgacgagcagctgcattctttcgcggtgtctacagtccatatcatgaagaagagaaacggtggtggaagtctcaataattattcatcttctattccccctaccccgtctacatcacaggaggacccccaattttccgtcccccccactgccaacacacctactcccgtctgtaaactctccatgagatggagtaatctgtttacttccgaaaaggggagcgatcccgacaaggaaaggaaagcgcctgagaaccatgcggacaccataggatcaggccgggctatccccattaaacagggtatgttgttgaaacggtccggaaagtggttaaagacttggaagaagaaatacgtaaccctgtgctcgaacggggtgttgacatactattcttctctcggcgactacatgaagaatattcataaaaaagagattgatcttcggacatctacaatcaaggtaccaggcaaatggccctccctagccacatctgcatgcgcccccatctcaagtagcaaaagtaatgggctgagcaaagacatggacacaggcttgggtgactcgatctgtttctctcctggcatttcttccactacctcgcctaaactcaatccccccccatccccccacgccaacaaaaaaaagcatctgaaaaaaaaatctacaaacaatttcatgatagtttctgcgacaggacagacctggcacttcgaagctactacttatgaagaacgagacgcgtgggtgcaggccattcagagccaaattcttgcctctctacaaagctgtaagtctagtaagtctaagtctcaactgacctctcagagcgaggccatggccctccaatctatccagaatatgagaggaaatgctcattgcgtggattgcgaaacacagaacccaaaatgggcatcactgaacctgggtgttctgatgtgcattgaatgttcgggcatccaccggagttttggcacccgcctttctagggtaagaagcctcgagttggacgactggcctgtcgagttgagaaaagttatgtcctcaataggtaatgagttggccaattctatttgggagggttcctcccaaggacagaccaaaccgtccatcaaatcaacacgcgaggagaaagagtggtggattcgctccaagtatgaagagaagttatttctcgcccccctaccctgcactgaactttctcttgggcaacagctgctacgggcaactactgatgaagatcttcaaaccgcgatcctcttgctggctcatggcagtagagaggaagtgaatgagacatgtggggagggggacggctgtactgccctacacctcgcctgccggaaaggtaacgtggtgctggagcagttattgacaggatggacgtcctggcctgagatgcctacgggaacccagagatag

SEQ ID NO: 26809 - DNA, 1320 bp, Artificial Sequence
  Description of Artificial Sequence: Synthetic coding sequence
atgcgatggagtaatctgtttaccagtgagaagggatcagatcctgacaaggaaagaaaggctccagagaaccatgcggatacaattgggagtggtcgggccattccaatcaagcaaggtatgctgctgaagaggtctggtaagtggctgaagacttggaagaaaaaatacgtcaccctatgttctaacggggtgttgacctactatagctcgttgggagactacatgaagaacatccataagaaggagatcgacctacagacctcaacaattaaagttcctggaaaatggccgtccctggccacgtccgcctgtacccctataagtactagcaagtctaatggactctcaaaggacatggacaccggcctcggcgatagtatttgtttctccccctcaatttcctccactacttcgcccaagttaaaccccccaccgtccccccacgctaacaagaagaagcatctgaaaaaaaaaagcactaacaattttatgatcgtcagcgcaacaggtcagacctggcatttcgaggctactacctatgaggaaagggacgcatgggtgcaggccattcagtcgcagatactcgcctccctgcaatcctgtgagtctagcaaatcaaaatcgcagctgacatcccagagcaaagccatggctctccaaagcatccagaacatgagaggcaatgcccactgtgtcgactgtgaaacccagaacccaaagtgggcatccctgaatctgggtgtgcttatgtgtatagaatgctctgggatccaccggtctctgggcacgcgcttgtccagagtgagatctctcgagctcgatgattggccagttgagctgcgcaaggttatgtctagtatcggaaatgaccttgccaattccatctgggaaggcagcagccaggggcagactaaacctagcgaaaagagtacccgcgaggaaaaagagagatggatccgaagcaaatacgaggagaagttgtttctcgctccactgccctgcacagaactctcgctgggacagcaattgctgcgcgcgaccgcagacgaagatctgcagacggccattctcctgctggcgcacggatccagggaagaagttaatgagacctgcggtgagggggatgggtgcacagccttacatctggcatgcagaaagggtaatgtcgtcttggcgcagctgctaatctggtatggagtcgatgtgatggcccgcgatgcacacggcaacacagccctcacttatgccaggcaggcaagttctcaggaatgcatcaatgtcttgcttcagtatggatgtccggataagtgcgtgtag

SEQ ID NO: 26810 - DNA, 1992 bp, Artificial Sequence
  Description of Artificial Sequence: Synthetic coding sequence
atgggcaatatactgacttgcagagtccacccaagcgttagcctggagttcgaccagcaacaggggagcgtttgtccatccgagagtgaaatctacgaggccggagccggggaccggatggcaggggcacctatggccgctgccgtgcagccagccgaggttaccgtggaggtgggtgaggatctccatatgcatcacgtacgcgatagagagatgcccgaggctctggaatttaaccctagcgccaaccctgaagccagtacaatttttcagcggaatagccaaaccgacgtcgtggaaatccggagatctaactgtactaatcacgtgagcacagtgcgattctctcagcagtactcattatgttcgaccattttcctggatgacagcacagccattcagcactatcttacgatgacaattattagcgtcacactggagatccctcatcacatcacgcaacgggacgccgacaggtccctcagcatcccggatgagcagcttcacagctttgcagttagtacagtgcacatcatgaaaaaacgcaatggcggagggtcgctgaacaactattcttcctccattccgtcgactcccagcacttctcaagaagatccacaattctccgtcccgcccacggccaataccccgactccagtttgtaagcgatctatgcgatggtctaatctgtttacttctgagaaaggcagcgacccagataaggaacgcaaggcacccgaaaatcacgctgacacgattggtagcggtagagctatccctatcaagcaggggatgctgttgaaaaggtccgggaagtggctgaagacatggaagaaaaagtacgtaactctttgctcaaacggagtgctgacatactatagctccctgggggattacatgaagaatattcataagaaagagatcgacctgcagacttcaacaatcaaggtgcccggaaaatggccatcattggccacaagtgcttgtactcccatatcaacatccaagtccaacggattgtctaaagatatggatactggcctgggggattccatttgttttagcccttccatctcatctacaacatcacccaagctaaacccgccacctagcccacacgcaaacaagaaaaagcaccttaaaaagaaaagcaccaataacttcatgatcgtatctgcaacgggtcaaacttggcacttcgaggccactacgtacgaggagagggacgcatgggtgcaagccatccaatcacagattctcgctagtctgcagtcatgtgagtcctccaagagcaagtcccagctgacttctcagtctaaagccatggcccttcagagtattcagaatatgcggggaaacgcgcattgtgtcgattgcgaaacccagaatccaaagtgggcaagtttgaacctcggcgtgctgatgtgtatcgagtgttctggcattcaccggagtctcggcaccagactgtctcgggtgagatctctcgagctcgacgactggccagtcgagctgagaaaagttatgtcctcgattggtaacgacctggcgaatagcatttgggaggggtcaagtcagggtcagactaagccgtcagagaagtccacccgcgaagagaaagagcggtggattcgtagtaagtatgaagaaaaactcttcctggctccactgccttgcacagagctgtcactgggtcagcagttgctgagagcaaccgccgatgaagaccttcagacagccatactgcttttggctcacgggagtcgcgaggaagtgaatgagacctgtggcgaaggagatggatgcactgccctacatctcgcctgtagaaaaggtaacgtggttttggcacagctccttatttggtatggagttgacgtgatggcccgagacgctcatggaaataccgcgctcacatacgccagacaggcttcttcacaagagtgtattaatgttctcctgcaatatggctgcccagataaatgtgtttag

SEQ ID NO: 26811 - DNA, 2061 bp, Artificial Sequence
  Description of Artificial Sequence: Synthetic coding sequence
atgggcaacattttaacatgctgcgtgcatccatccgttagtttggagttcgatcaacagcagggctcagtgtgcccttccgaatccgaaatctacgaggccggcgccggcgatagaatggctggcgcaccaatggcagctgcggtgcagcctgctgaagtgactgtcgaggtcggagaagatttgcacatgcaccacatccgagatcaggagatgcccgaagcacttgagttttcactgtctgcaaatcctgaagcttccactatcttccagaggaattcacagacagacgctctggagttcaatccctctgcaaatcctgaagcctccacaatctttcagcggaactcccagactgatgttgtagagatcagacgttcgaactgcaccaatcatgtgagtaccgaaaggttctcccagcagtattctagctgctccacaatcttcttagacgattctaccgccagtcaacactacctcacaatgaccatcatctccgtgactctcgagatcccacatcatataactcagcgagacgccgaccgctccctgtccatccccgatgagcagcttcactcatttgcggtctcaaccgtccatatcactaagaaccggaatggcggcggttctctgaacaactactcatcatctataccgtccacccccagcacctcacaggaggatcctcaattttcagtgccaccaaccgctaacacaccaacgccagtatgtaagcgctctatgcgttggtccaacctgttcacaagcgagaagggctcacatccagacaaggagcggaaggcaccagagaaccatgccgataccatcggatctggacgggcaatccctattaagcaggggatgctgctgaagagaagcggaaagtggctgaagacctggaaaaagaaatacgtgacgctctgtagcaacggcgtgctcacgtattactccagcctgggggactacatgaaaaacatccataagaaggagattgatttaagaaccagtacaatcaaagtgcccggcaagtggccaagtctggccacctcggcctgtgcccccatttcctcctcgaagtccaacggtttgtctaaagacatggataccggtttgggtgactctatctgctttagcccctctatcagctctacaacttctcccaagctcaatcctcccccgtccccccacgctaacaagaagaagcatctgaaaaagaaatccacaaacaattttatgattgtctccgctacaggccagacatggcacttcgaagcaacaacatatgaggaaagggacgcttgggtgcaggccatacagtcacagatcctcgcgtcccttcagagttgtgagtcctccaagtctaaaagccagctgacaagtcaaagcgaagcgatggccctgcagagcattcagaacatgcgcgggaatgcacattgtgttgactatgaaacgcagaaccccaaatgggcttcacttaatctcggagtgctgatgtgtatcgagtgctccggcatccacaggtccctgggtaccagactcagcagggtgagatcgttagagctggatgactggcccgtagagctcaggaaagttatgtcctcaattggcaatgatctcgctaactctatttgggaggggagctcacaggggcaaaccaagccttcggtgaagtctactcgcgaggaaaaggagcgatggatccggtcaaaatatgaagagaaacttttcctagcaccactgccatgtactgagctcagtctcgggcagcacttactacgcgcgactgccgacgaagatctccagacagctatccttcttctcgctcacggctcccgggaggaagttaacgaaacgtgtggtgagggcgacggctgtactgccttgcacctggcttgtcgaaagggcaacgtggtgttggcgcagctgctaatctggtacggagtggacgtaatggccagggacgcccacggtaatacagcacttacatacgccagacaagccagctctcaagagtgcatcaacgtgctgttgcagtacggatgtccagatgagtgcgtttag

SEQ ID NO: 26812 - DNA, 1992 bp, Artificial Sequence
  Description of Artificial Sequence: Synthetic coding sequence
atgggaaacatactaacttgctgcgttcaccccagcgtgagcctggagttcgaccagcaacaaggatctgtttgtcccagtgaaagtgaaatctacgaagctggggccggcgatcgaatggctggcgctcccatggcggctgcagtacagccagccgaggtgaccgtagaagtaggagaggacctccatatgcaccacatccgggatcaggaaatgcctgaagccttggagtttaatccgtcggctaaccctgaagcctctactatctttcagcgtaactcgcagaccgacgtggtggaaatacgccgctccaactgcactaaccacgtgagtaccgaaaggttcagccagcaatacagttcatgttctaccatctttttggacgactctaccgcctctcaacactatctcacgatgaccataataagtgtgacacttgagatcccacatcacattacacaaagggacgctgatcgcagcctgtcaataccagacgagcagctgcactccttcgcagtgtctacagtgcatattacaaagaatagaaacggagggggttctctcaacaattactcctccagcatccctagtacaccttcgacttcacaggaagatccgcagttctccgttccgccgactgccaatacacccacgccagtgtgcaagcgcagcatgcggtggtctaacctgttcacttccgagaaaggaagtcacccagataaggagaggaaggctccagagaaccacgccgatacaataggatcaggcagggcaatccccattaagcagggaatgctgctgaagcgttccggaaagtggctcaagacttggaagaagaagtacgttacactctgtagcaacggtgtgttgacatattacagcagtctaggcgactacatgaagaatatccacaagaaagagatcgatctgagaacttcaactataaaagtccctggaaagtggccatctttggctacctcagcgtgtgctcccatctcctcaagcaaatccaatgggttaagcaaggacatggatacagggctgggcgatagtatctgttttagcccgtcaatctcctccacgacttctcccaagctgaatcctcctccgagtccacatgcaaataagaagaaacacctgaagaagaagtccaccaataactttatgatagtgtcagccactggccaaacatggcattttgaagctaccacatacgaggagcgcgacgcctgggtccaggctatccaatcccagattctggcctctttgcaatcatgtgaatctagcaaatctaagagtcagctgactagtcagtctgaagcaatggcactgcagagcatccagaatatgagaggcaacgctcattgcgttgattatgagacccagaatcccaaatgggcatctctaaacctcggtgtcttgatgtgtatcgaatgctccggcattcacaggtccctgggtacccgtctgtcgcgggtgaggtcactggagttggatgactggcccgttgaattaaggaaagtgatgagtagtatcggaaatgacctggctaattctatctgggagggcagcagtcagggacagactaaaccatccgtgaaatccaccagggaagagaaggagcggtggatacgctctaaatatgaggagaaactattccttgcaccgctgccctgcacagaattgtccctggggcaacacctgttaagagctacagccgatgaggacctccagaccgctattctgcttcttgcgcatggctctagagaagaagtgaatgagacatgcggcgagggtgacggctgcacagccctgcatctcgcgtgtcgaaagggcaacgtcgttctcgctcagttgttgatctggtacggcgtggatgtgatggcaagagatgctcatggtaatacggccttgacttatgcacgccaggctagctcacaggagtgtatcaacgtgttactccagtacgggtgtcccgatgagtgcgtgtag

SEQ ID NO: 26813 - DNA, 2061 bp, Artificial Sequence
  Description of Artificial Sequence: Synthetic coding sequence
atgggcaacatactcacatgtagagttcatcctagtgttagcctggagttcgatcagcaacaaggcagtgtctgtccgagtgagtcagagacttacgaagctggtgccagggaccgcatggctggagcaccaatggctgctgccgtacagcctgcagaagtcacagtggaggtaggagaggatctgcacatgcaccatgtccgagacagagagatgcctgaagcactggaattcaacctgtcagctaacccagaaagttccaccatcttccagaggaactctcagactgaagctctggagtttaacccaagcgcgaaccctgaggcctccaccatctttcagcgtaattcccagactgatgtcgtagaaatccgccgcagcaactgtacaaatcatgtgtcagctgtcagattctctcaacagtactcactttgcagtacaatctttttggacgattccaccgctattcagcattatctgactatgaccattatctcagtgacgttagaaataccacaccatattactcagcgcgacgctgacaggacactcagtatccctgacgagcagttgcattctttcgcagtgagcacagtccacattatgaaaaaacgaaatggaggggggagcctgaataattattccagctcaattccaagcacgccttccacctcccaggaagacccccagttcagcgttccaccaaccgctaacaccccgacgccggtgtgtaaacggagcatgcggtggagcaatctgttcactagtgaaaaggggtcggatcctgacaaagagcggaaggcccccgaaaatcacgccgataccatcggctcaggacgggccattccaatcaaacagggcatgctcctcaaaaggtcaggaaagtggctgaagacttggaagaagaagtatgtgaccctttgttcaaacggaatgctaacttattatagctccctgggggattacatgaagaatattcacaaaaaagaaattgacttacagacatctactatcaaggtgccgggaaagtggccttcacttgccacgtccgcctgcacaccgattagttcttcgaaaagcaatggtctatccaaagatatggacaccggcttgggagattccatttgtttctccccctctatctcctctaccactagccctaagctcaacccccctcctagtccccacgctaataagaagaaacacctgaagaagaagtccacaaacaatttcatgatcgtctccgccactggccagacatggcatttcgaggctacaacttacgaagaacgagacgcttgggtgcaagccattcagagccagattctggcatctctacaatcctgtgaaagttcgaagtccaaaagccagctcacatcgcagtccgaggccatggcactccaatcaattcagaacatgcgcggcaatgcacactgtgtggactgtgaaactcagaaccctaaatgggcgagtctaaatctgggtgtcctcatgtgcatagaatgctcaggtattcatcgaagcctcggtcctcacttgagccgtgttaggagtctcgaactggacgactggcccgtcgagcttcggaaggtgatgtccagtatcgtaaatgacctggcaaactctatttgggagggctctagtcaagggcagactaagccgtctgagaagagtacccgcgaagagaaagaacggtggatcagatctaaatatgaggagaagctattcttggcacctctcccatgtacagagttgtccctgggacagcaacttttaagagccacggcagatgaggatctgcagaccgcgatccttctgctggcgcacggctcctgtgaggaggtgaatgaaacttgcggcgaaggtgacggatgtacagccctgcatctggcatgcagaaaggggaatgtggtactagcacagttgctcatctggtacggcgtcgatgtcatggctcgggacgctcacgggaataccgccctaacctacgcccgccaggcctcaagtcaggagtgcatcaacgtcctgttacagtacgggtgcccggatgaatgcgtttag

SEQ ID NO: 26814 - DNA, 1992 bp, Artificial Sequence
  Description of Artificial Sequence: Synthetic coding sequence
atgggaaacattctgacctgtagagtgcacccatccgtcagcctggagttcgatcagcagcaaggcagcgtgtgcccaagtgaaagcgaaacgtacgaagccggggcaagagaccggatggcaggagcccctatggcggctgctgtgcagcccgccgaggtcactgtggaggttggggaagacctgcatatgcaccacgttagagatagggaaatgccagaagctctggagtttaacccttcagcaaacccagaagccagcacaattttccaaaggaacagccagactgacgtggtggagatcaggaggtccaattgcacaaatcatgtttccgccgtgcgtttttcgcagcagtactctctttgttctacaattttccttgatgatagcacagctattcagcattatctgactatgactataatttcagtgacgctggagatcccccatcacatcactcaacgggacgctgatcgtaccctcagtattccagacgaacaacttcactctttcgccgtgtccactgtgcacattatgaaaaagaggaatggcggcggaagcctcaacaattattcttcaagtattccctcgacacccagcacctcccaggaagacccgcaattcagtgtgccccctacagcgaatacccccacccccgtgtgcaagcggagtatgcgctggagcaatctgttcacgtctgaaaaaggatcagaccccgacaaagagcggaaggccccagaaaatcacgccgacacaatagggtcgggacgagctataccaattaaacagggtatgctgctcaagcgcagcggcaaatggctgaagacctggaagaaaaagtacgtaaccctgtgttcgaatggcatgcttacttactactcatccttgggggattacatgaaaaacatccataagaaggaaatcgacttacagacgtctacaatcaaagttcctgggaaatggccttccctagctacatctgcctgtactccaatatccagctcaaagagtaatggattgagtaaggacatggatacggggctgggtgacagtatatgtttctctccttcaattagctcaactacctctcctaaactgaaccccccacctagtccccatgcaaacaagaaaaagcacctgaaaaagaagtccaccaataactttatgattgtaagtgccaccggacagacatggcacttcgaagcgaccacctatgaggagcgtgacgcctgggtccaggcgatacagagccagatcctggcttccttgcagagctgtgaatcatcgaagtcaaaatcccagctgacctctcagagcgaggccatggcacttcagtctattcagaatatgcgagggaatgcacattgtgtggactgtgaaacccagaaccctaagtgggcctctctcaaccttggtgtgctgatgtgtatagagtgttctgggatccaccggtcgcttggcccccacttatcacgggttcgctccctggaattagatgactggcctgtcgagctacgcaaggttatgtccagtatcgtcaacgatttggccaatagcatctgggagggttctagtcagggtcaaacaaaaccttcagaaaaaagtactagggaggaaaaggagcgttggatcaggagcaagtacgaggaaaagttatttttggcacctttgccctgtaccgaactctctttagggcagcaactccttcgtgctactgctgacgaggacctgcagaccgcaatcctgcttttggcccatggcagctgcgaagaagtgaacgaaacatgtggagagggcgacggttgcacggctcttcacctggcatgtcgtaagggcaacgtcgtcctcgcgcaactgctcatctggtacggcgtcgacgtcatggcgcgtgacgcacacgggaatactgctctcacttatgcacggcaggcctcaagccaggagtgcatcaatgtactccttcagtatggatgtccagatgaatgtgtgtag

SEQ ID NO: 26815 - DNA, 1992 bp, Artificial Sequence
  Description of Artificial Sequence: Synthetic coding sequence
atgggaaacattctgacctgcagggtgcatccatcggtaagtctcgagtttgatcagcaacagggctccgtgtgcccttccgagtcagaaatttacgaggccggagccgaagatcggatggcaggcgccccaatggccgcggccgtgcaacccgccgaggttaccgtggaagttggtgaggacctgcatatgcaccacgtgcgggacagagagatgcccgaggccctggagttcaacccctctgcaaaccctgaggcttccacaatttttcagcggaacagtcagaccgatgtggtggagattcgccgctccaattgcacaaaccatgtgtccactgtgcacttcagtcagcagtactctctctgtagcacaatatttctggacgactccacggccattcagcactatcttacaatgaccatcatttctgtcaccctggagatcccccaccacataacccagcgagacgccgaccggagcttaagcatacctgatgagcaacttcacagtttcgccgtgtctacagtgcatattactaagaatcgcaacggtgggggctccctgaataactacagctcctctatcccaagcacccctagtacctcacaagaggacccccagttctctgttcctccgactgctaatacacccactccggtatgtaaacgatccatgcggtggagcaacctgtttacttcggaaaaggggtctgatcccgataaagagcgcaaggcccctgagaaccacgccgatactatcggctctgggcgggccatcccgatcaagcagggcatgctgcttaagaggagcggcaagtggctgaagacctggaaaaagaaatatgtgaccttgtgcagcaacggcgtcctcacttattattcaagcctcggggactatatgaagtacatacacaagaaagagattgacctacaaacatcaacaattaaggtgccaggcaagtggccaagcctggcgactctagcatgcacacccatctcaagtagcaagtcagacgggcttagcaaggatatggatacgggtctgggcgatagtatttgtttctcgcccagcatttcgagcaccactatccccaaactaaatccacctccctcaccacatgcaaataaaaagaaacatctgaagaaaaagtctacaaacaatttcatgattgtgagcgctaccggccagacgtggcacttcgaggcgacgacctatgaggaacgcgacgcttgggtacaagctattcaatcccagatccttgcttccctccagtcttgcgagtcctcgaaatctaagagccaacttacatcacagtctgaggctatggcccttcagtccatccagaatatgagaggaaatgcccactgcgtagattgtgagactcagaacccgaagtgggcgtcgttaaaccttggcgtgctcatgtgtattgagtgtagcgggatccaccgctcactcgggactcgcctgagcagagtgcggagcctcgaacttgatgattggcctgtggaactcaggaaggtgatgtcaagcataggaaatgatctggctaattctatctgggaaggctcctctcagggaagaaccaagccaacagagaagtctacacgtgaggagaaggaacgttggataagatctaaatacgaggaaaaattgtttctggcaccattgccatgcactgaactgagtcttggacagcaattactgcgagcaactgcggacgaagacctgcagacagccattcttctgctcgctcacggatccagggaggaagtgaacgaaacatgtggcgagggggacggctgtacagccctccacttggcctgtaggaagggcaatgtggttctcgcacagcttttgatctggtatggcgtggatgtgatggcgcgcgatgcacatgggaataccgccctcacctacgcccggcaggcctcttctcaggaatgcatcaacgttctcttacaatacgggtgccctgacgaatgcgtttag

SEQ ID NO: 26816 - DNA, 1320 bp, Artificial Sequence
  Description of Artificial Sequence: Synthetic coding sequence
atgcgttggagtaacctgtttacaagcgagaaggggtccgacccagataaggaacgaaaggcccctgaaaaccacgccgacacaattggaagcggacgggccatcccgatcaagcaaggtatgctgttgaagagatctgggaagtggctgaagacttggaaaaagaagtacgtcacgttatgtagcaacggcgtattgacctattatagctcactgggcgactatatgaagaacatccacaaaaaggaaatcgacctgcaaacatcaacaattaaggttcctgggaagtggccctcccttgcgacttcggcatgcactcctattagctcatcgaagtcaaacggactgtctaaggacatggacacgggtcttggtgactccatttgcttctctcctagcatcagcagcacgacgagccccaaattaaatccccccccttcgccccacgcgaacaagaaaaagcatctgaagaaaaagagcactaacaactttatgatcgtaagcgcgaccggacaaacgtggcacttcgaagcaactacctacgaggagagagacgcctgggtccaggccatccagagccagatcctggccagcttgcagtcttgcgagagcagtaaaagcaaatctcagctaacttcccagagcgaggcgatggctctgcaatcgatacaaaacatgcggggcaatgctcattgtgtggattgtgagacgcagaatcccaagtgggcctccttgaatctcggcgtgttgatgtgcatcgagtgctccggcattcatcactctttgggcacacgtctctccagggtgcggtcgctggagctggacgactggccagttgagctgagaaaggtaatgtcctccatcggaaacgacttagccaactctatctgggagggatcctctcaggggcaaaccaaaccaagcgaaaagagcacacgagaagagaaggaaagatggatccggtctaaatatgaagagaagctgtttcttgcgcccctcccatgcacagaactgagtctggggcagcagctgctgtgggctaccgcagatgaggacctgcagactgcgattctgcttctggcccacggttcaagagaagaagtcaatgagacctgcggcgaaggcgacgggtgtacagcgcttcatctggcctgccgcaagggaaacgtggtgctagcacaactgcttatatggtacggggtcgacgtgatggcccgcgatgcacacggcaataccgccctcacatacgccaggcaggccagttcacaggaatgcataaacgtcttattgcaatatgggtgtccagacgagtgtgtgtag

SEQ ID NO: 26817 - DNA, 1992 bp, Artificial Sequence
  Description of Artificial Sequence: Synthetic coding sequence
atgggcaacattctcacatgtcgcgtccatccttccgtgtccctggaattcgaccagcagcaaggatctgtttgccctagcgaatctgagatttacgaagcaggggctggagaccggatggcgggtgccccaatggcagcagccgttcagccggcggaagtgactgttgaagtgggcgaggatttgcatatgcaccatgtcagggacagagagatgccagaagccttggagtttaatccttccgcaaacccagaggcgtcaaccattttccagagaaatagtcagacagatgtggttgagattagaaggtccaattgcaccaaccacgtctcgactgtaaggttctcccagcaatactctctttgctctacgatcttcctcgatgactccacggctattcagcactatctgacaatgaccattatttcggtcacattggagattccccaccatattacacagagagatgccgatcggagcctgagtattcccgacgaacagctccattcctttgctgtatccacagtccatattatgaagaaacggaacggagggggctctcttaataactactcgagcagtataccaagcacgcctagcacttcccaagaagacccacaattctccgtaccaccaacagctaatacaccaactcctgtttgtaagaggagcatgagatggagtaatctgttcacctccgaaaaagggtctgatcccgataaagagcgcaaagcgcctgagaaccacgccgatacaattggctcgggcagggccattccgatcaagcagggcatgttactcaagcgatcaggcaaatggctgaagacctggaaaaagaagtacgttacgctgtgtagcaatggtgtgctaacatattattctagccttggggattacatgaagaatattcataaaaaagagatcgacctccagacatcgacaattaaggtgcccggtaagtggccatcgttggcgacgtctgcctgtacacccatcagctcaagtaaaagcaacggtctctcaaaagatatggacaccgggctgggcgattcgatctgttttagtccctccattagctccacgacgtctcctaagctgaatcccccgccaagccctcacgctaataagaaaaaacatctgaagaaaaagtctacaaataacttcatgatagtctctgcaaccgggcagacatggcatttcgaggccaccacgtacgaagaacgcgatgcctgggtacaggccatacagtcccagattctggcctcattgcagtcttgcgagtctagcaagtccaaatcacagcttacttctcagagcgaagctatggctctgcagagtattcagaatatgaggggcaacgcacattgtgtggactgtgaaacccagaaccccaagtgggcaagtctaaacttgggagtgctaatgtgcattgaatgcagcgggatccaccattccttggggaccagactctcccgggtgcgcagcttagagctggatgattggccagtcgaactgcgaaaagtaatgtcatctattggcaatgacctcgccaactccatctgggaggggtcaagtcagggccaaacgaagccctccgagaaatccacgcgtgaagagaaagagaggtggattcgatcgaaatatgaggagaaattatttttggcccccctgccgtgtactgagctgtcgttagggcagcagctactgtgggctaccgccgatgaagatctgcaaactgccattttgctgctcgcacacgggagtagggaagaggtgaacgagacatgtggggaaggtgatggttgcactgctctgcacctcgcctgtcgtaaggggaacgtggtccttgcacagcttctgatttggtatggtgtggatgtgatggcccgggatgcccacggaaacaccgcattaacgtacgcacgccaagccagttctcaggaatgcatcaatgttctcctgcaatatggatgccccgatgaatgcgtttag

SEQ ID NO: 26818 - DNA, 1992 bp, Artificial Sequence
  Description of Artificial Sequence: Synthetic coding sequence
gagctgttgcggatctcgcccgacttactggcggccgccgtgatatccgcacaagaggagccccttaccaacatccaaagagccagtggccctacagggttgttgtggtcagtgtcattggagttcgaccagcagcagggctccgtgtgccccagcgagagcgaaatatatgaggcaggggcagaggacaggatggccggtgctccaatggctgcggcagttcagccagcagaagtgaccgtggaggtcggcgaagacctgcatatgcaccaggtaagagatcgagagatgccagaagctctggagtttaacctgtcggccaaccccgaggcatctactatctttcagagaaactcacagaccgacgcactggaattcaattcttcggccaatccagaggcctccacaatatttcagcgaaattcacaaacagatgtagtggaaattaggcggtccaactgcacgaatcatgtctctacagagaggttcagtcagcaatactcctcctgtagcacgatctttctggacgattctactgccatccagcattatttaacaatgaccatcatctctgtgaccttagaaatcccccaccacatcacacagagggacgcagatcgttccctcagtatcccggacgagcaactgcactcctttgcagtgtctaccgtccatatcatgaaaaagcggaacggtggaggatcacttaataactactctagcagcattccccccacgccctcaacaagtcaggaggacccccaattctctgtacctcccaccgcaaataccccgaccccagtgtgtaagcggagtatgcggtggagtaatctgtttactagtgaaaaagggagcgaccctgacaaggaacgtaaggcaccagaaaaccacgccgacactataggaagtggcagggctatcccaatcaagcaagggatgctgctgaagagatcaggaaaatggctgaagacttggaaaaagaagtacgtcacattgtgcagtaacggcgtgctgacgtactactcttctctcggtgattatatgaagaacatccacaagaaagagatcgatctacggacatccactattaaagtcccaggcaaatggccctctctggccacttccgcatgcgctcccatctcctcaagcaagagcaatgggctgagtaaggacatggatactggattgggagattctatctgcttctcgccgggtatctcctccacgacaagccccaagctcaatccccccccatctccccacgctaataagaagaagcacctgaagaaaaaaagcactaacaatttcatgatcgtcagtgcaaccggtcagacatggcatttcgaagctacgacctacgaggagcgcgatgcctgggtgcaagccatccagagccagagtgaagcaatggccttacagtctattcagaacatgcgcggcaatgcgcactgcgtggactgtgagacccagaaccctaaatgggcctccctcaacttaggggttctgatgtgcatcgagtgcagtggaatccaccgctcttttggaacaaggctgagtcgcgtgcgaagtctcgaactcgacgattggcccgtcgagctgcggaaggtgatgtcctccattgggaacgagctggccaactccatttgggaaggatcctctcaggggcagacaaagccctccattaagtctacccgcgaagaaaaggagtggtggatacgcagtaagtacgaggagaaactgtttctggccccccttccatgcactgaactaagccttggacagcagctgctgcgggcaaccaccgatgaagacctgcagaccgcaatcttgctgctggctcacggctcaagggaggaggtgaacgaaacttgcggggagggtgacggatgtacagctttacacttagcttgtcggaaaggaaacgtcgtgctggagcagctcctaactggctggaccagttggcccgagatgcccactggaacacagaggtag

SEQ ID NO: 26819 - DNA, 1047 bp, Artificial Sequence
  Description of Artificial Sequence: Synthetic coding sequence
taggctgaggaccgcatggctggagcccccatggctgccgccgtccagcctgccgaagtgactgtggaggtgggggaggacctacacatgcaccaagtgagagatcgggaaatgccggaggcactagaattcaacctctctgctaatcccgaagcatctaccatattccaacggaattcccagaccgacgcattagaatttaattctagcgctaaccccgaagcctctactatttttcagcgcaacagccagactgacgtggtggaaattaggcgctccaattgcaccaaccacgtcagcaccgagagattttcccagcaatactctagttgttctactatctttctggacgactccaccgcaatccagcattacctgaccatgaccattatctccgtaacactggaaattcctcaccatattacccagcgagatgcagaccgcagcctgtctatcccagatgagcagctacactccttcgctgtctctaccgtgcatattatgaagaagaggaacggtggtggatctctaaataactactcttctagcataccacctactccctcaacaagccaagaagatcctcagttttcagtgcctcccactgcgaatactccaacccctgtctgtaaaagatcaatgagatggtccaacctcttcacatcagaaaaaggcagcgatcctgataaggagcggaaagcaccagagaatcatgccgataccattggcagcggacgggccatacccatcaagcagggaatgctgctgaaacggtccggcaagtggcttaagacttggaaaaagaaatacgtgaccttgtgttccaatggtgtgttaacctactattcgtcccttggcgattacatgaaaaatatccataagaaagaaatcgacttgaggaccagcaccattaaggtgcctggcaaatggccatccctggcaacaagcgcttgcgcaccaatctcctcctctaaatccaatggactgagcaaggatatggacaccggcctgggtgattcaatctgcttctctcctggaatctcttag

SEQ ID NO: 26820 - DNA, 2112 bp, Artificial Sequence
  Description of Artificial Sequence: Synthetic coding sequence
atgttcgaggatgtgttcagcgactctggcaacactggcaactttgatagaggaaagaagcggcgcctgactatcatcgaatgcggctgtgatattaatatgatgattgacttggcaaaagtcgcagacctggtgcttatgcttatcgacgctagcttcgggttcgaaatggagatgtttgagtttctgaatatctgtcaggctcatgggtttcccaaaatcttgggagtcctgacgcatctcgactccttcaagcataacaaacagctgaaaaagactaagaaacgcttgaagcacaggttctggactgaggtgtatcaggataaggttgggttgactcacgaactagttcagtcacttatttcaacatacagcactatcgacgcaaagatggcatctagccgcgtgactcttctgtcaaatagtaagccattgggctctgaagctattgacaaccagggcgttagccttgaattcgaccagcagcagggatcagtctgcccatccgaatccgaaatctatgaggccggcgccgaagataggatggccggggctccaatggctgcggctgtgcagccagcggaagttaccgttgaagttggcgaggatttacacatgcaccaagtccgtgatagagagatgcccgaagtcgtggagatccggcggagcaactgcacgaatcactgtgatttaggggacacaagttcttaccataccaaagtaagtacagtgcatatcatgaagaagcgcaatggcggcgggtccctcaacaactacagcagctctatcccgcctactccaagcacttctcaggaggatccgcagttttctgtcccaccaacagcaaacacccctacccccgtctgcaaacgcagtatgcgctggagcaatttgttcacatcagagaaaggctccgatcctgataaagagagaaaagctcccgaaaatcatgctgatactatcggctccggccgcgcaattcctatcaagcagggcatgcttctgaagagaagcggcaagtggcttaaaacatggaaaaaaaagtatgtgacactatgttccaacggcgttctgacatactactcttccttaggagattacatgaaaaacattcacaaaaaagagatcgatctacgcacctccacaattaaggtacccggtaagtggccaagtttggcgaccagcgcttgcgcaccaatttcgtctagtaagtcgaacggattgagcaaggacatggacacgggactgggtgatagtatttgcttctccccgggaatttcatctacgacctctccaaaactgaatccacccccgagcccccatgccaacaaaaagaaacacctcaagaagaagtctacgaacaattttatgattgtgtctgccacagggcagacctggcattttgaggctacaacctacgaagagagagacgcttgggtccaggcgatccagtcccagatactggcctcgctgcaaagttgcaaaagctccaaaagcaagtcacagctgacgtcccagtcggaggctatggcactgcagtctatccagaacatgcgtggcaacgctcattgcgttgattgcgaaacccagaaccccaagtgggcctcactcaaccttggagtgctgatgtgcatcgagtgtagtggtatacacagaagcttcggaacccggttgtctagagtgcgaagtctggaactggacgattggcccgtcgagctgagaaaggtcatgtcgtccattggcaacgagctagcaaacagcatctgggaagggtccagccaaggacagaccaaaccaagcataaagagcacccgggaggagaaggaatggtggattcgctctaagtatgaggaaaagctgttcctggctcctctaccgtgtacagagctctcattgggacaacagcttcttcgcgccacaaccgatgaagatctacagaccgcaatcctgcttctggcccatggctcacgcgaggaggtgaatgaaacatgcggagaaggagatggctgtacagctctgcatctcgcctgcagaaagggaaatgtagtgcttgaacaactgttgacaggatggacctcttggcccgagatgccgacagggacccagcgatag

SEQ ID NO: 26821 - DNA, 1977 bp, Artificial Sequence
  Description of Artificial Sequence: Synthetic coding sequence
atgggaaacatcttgacctgccgggtgcatccttcagtcagcctagaattcgaccaacagcagggatccgtttgtcctagcgaatcggaaatttatgaggcaggcgccgaagatagaatggctggcgctccgatggctgctgcggtacagccagctgaagttaccgtcgaagtaggcgaggacctccacatgcatcaggttcgcgacagggaaatgcctgaggcattagagttcaacttaagcgccaaccccgaggccagcaccatcttccagaggaactctcagactgatgctctggagtttaacagcagcgccaatcctgaggcttccacgatatttcagaggaatagccagactgatgtggtagagattcgtaggtccaactgtacaaatcacgtgagtaccgaacggttcagccagcagtattcctcttgctccacaatcttcctcgatgattctacggctatccaacattatctgactatgacgatcatttcagtgacgttagaaattccccaccacatcactcagagggacgcggaccggagcctgtccattcccgacgaacagctacactctttcgctgtgagcactgtccacattatgaaaaaacggaacggtggtggctccctcaataattattcaagctccatcccgcccacgcccagtacttcccaagaagacccccagttctctgtcccacccacggccaatactccaacccccgtgtgtaagagaagcatgaggtggagcaatctcttcacctctgagaaagggagtgaccctgacaaggaacgaaaggcacctgagaaccacgccgataccatcggaagtgggagggcaattcccattaagcaaggaatgctcctgaaaagaagtgggaagtggctgaagacctggaaaaaaaaatacgtaacactctgctccaatggcgtcctgacgtactatagtagtcttggcgactacatgaagaatatccacaaaaaagaaattgatcttcgcacaagtaccattaaagtgccagggaagtggccttcactggcgaccagcgcttgtgctcctattagctcgagcaaatccaacgggctgtcgaaagatatggatacgggcctgggagattcaatttgttttagtcccggaatcagctcaacaaccagtcccaaactgaatcctcccccatcaccacacgctaacaagaagaagcacctgaagaaaaagagcacaaacaacttcatgatagtgtctgcaaccggccaaacctggcactttgaggccaccacgtacgaggagcgggatgcctgggttcaggctatacagagtcagattttggcctctcttcaatcatgtaaatcatccaaatcaaaatcccaactcacatcgcaaagcgaagcaatggcccttcagtcaatccagaatatgagaggtaatgcgcattgcgtcgattgcgagacacaaaaccctaaatgggccagcttgaacctgggagtgttgatgtgcattgaatgttctggcattcatagaagttttgggacccggctttctcgggttcggagcctggagttagatgactggcccgtagagctgcgaaaggtcatgtcaagcatcggcaacgaactggcaaattcgatctgggagggctcaagtcagggacagaccaagccttcaataaagtcaaccagggaggagaaagagtggtggatccgatcaaagtatgaagaaaagctcttcctagctcccctgccatgcacagagctgtcactcggtcaacagctcctgcgggcaaccaccgacgaagatctccaaacagccatcctgctgttagcacacgggtccagggaggaagtgaatgagacctgcggcgaaggggacggatgcaccgcccttcacctggcatgtcgaaagggaaatgtagtcctggaacaactgctgaccggctggaccagctggcccgaaatgcccactgggacacagcgctag

SEQ ID NO: 26822 - DNA, 4635 bp, Artificial Sequence
  Description of Artificial Sequence: Synthetic coding sequence
atggctgcccctcaagatctggacatcgccgtctggttagcaaccgtccatctggaacagtatgccgataccttcagaagacacggtctcgcaacggccggagcagcacggggtcttggccacgaagagcttaaacagcttgggatatcagcaaccggtcaccgcaaacggattcttcgcctcctgcaaactggaaccgaagagggaagcctggacccaaagtcagactcagctatggagccaagcccttcgcccgcaccgcaggctcaaccccctaagccagtccctaaaccacggaccgtgtttggtggacttagcggacctgccaccacacagcggccgggactctctcctgctctgggtgggccaggcgtgtcccgatccccggaaccatcgccgcgccctcctccactgcccacctctagctctgagcagagctccgcattgaatactgtagagatgatgccaaattctatctactttggattagactcccggggcagggcccaggcagcccaagataaggcgcctgattcgtctcagatctcagccccgactcccgcactgcggccaacaacgggcacagtgcatatcatggatcccggctgcctgtactacggggtacagcccgtcggcacaccaggcgcccctgatcgtcgggagtccaggggggtttgtcaagggcgagctgagcataggctcagccgccaggatctggaagctagggaggatgcgggctatgctagtctggaactgccaggagacagcaccttactcagccctacgctcgagacagaagaaacctcagatgatctgatttccccatacgcaagtttctcttttacagctgatcgcctgacacccctgcttagtggttggttggacaagttatccccccaagggaattacgtttttcagagacgctttgtccagtttaatggacgaagcttaatgtacttcggttcagacaaggatcctttccctaagggggtcatccctctgacagcaatcgagatgacccgcagcagcaaagataataagtttcaggtaattaccgggcagagggtgttcgtcttccggaccgagagcgaagcacagcgcgatatgtggtgttcgacacttcaatcttgcctaaaggagcagaggttgcttggacaccccaggcccccacagccgcctagaccactcaggaccggaatgttggagctgcggggccacaaagcaaaggttttcgccgcactctcccctggagagctcgccctgtacaagtctgaacaggcattcagtctgggtatagggatctgcttcattgagctccaaggatgttccgtgagggagacgaagtccaggagctttgatctgctcaccccgcaccgctgctttagcttcaccgctgaatctggcggtgcccgccagagctgggcggcagctctgcaggaagccgtcactgaaacactgtccgattacgaagttgcggagaagatttggagcaaccgggccaacaggcagtgcgccgactgcggatctagtcgaccagattgggctgcggtgaacctgggagtggtgatctgcaagcagtgcgccggccagcatcgggctctgggatccggcatttctaaagttcaatcccttaagctggacacttccgtgtggtcaaacgaaatcgtccagttgtttatcgttctagggaatgaccgggctaaccggttttgggcaggcaccctgccacctggcgaagggcttcaccccgacgcaacaccggggccccgcggggagttcattagtagaaagtacaggctaggtttgttccgcaaacctcacccgcaatatccggatcattctcagctcctgcaggccctctgcgcagccgttgccaggcctaacctgctgaaaaacatgactcagttactgtgtgtagaagccttcgaaggcgaggagccttggtttcctccagctccggatgggagctgtccagggttgctcccatccgatccttcgcccggggtgtacaatgaagtggtggtgagagccacctactcggggttcctgtattgttcccccgtctctaacaaggcaggaccatctcctccccgccgaggtcgggatgccccgcctcgcttgtggtgtgtgctgggcgccgctctcgagatgtttgcctccgaaaacagcccagagcccctgagtctaattcagccccaagacattgtctgccttggcgtgtctcctcctcctactgaccccggagatagattcccattttcttttgagttgattctggctggcgggcggattcagcactttggtaccgatggggccgacagcctagaggcctggacgtctgccgttggaaagtggttttcacctctcagctgccatcagttgttgggccccggacttttgaggctcggtcggctgtggctgcggtctccctctcataccgcgcccgcgcctgggctgtggctgtccggctttggccttctgcgtggggatcatctattcttgtgctcagctcccggtccagggccacctgcaccagaagacatggttcacttgaggaggctgcaggaaatttccgtggtgtcagctgctgacacgccggacaaaaaagaacacctagttttggtggagacggggcggactctgtaccttcagggggagggtagactagatttcaccgcgtggaatgctgcaatcgggggggcggccggaggtggcggcactggtcttcaagagcagcagatgagcaggggggatatccctatcatcgtggacgcctgtatatccttcgtcacgcagcacggcctgaggttggaaggcgtctatcgcaaggggggcgcccgcgcgaggagcctgcgactgttggctgagtttagacgggacgcccgctcagtgaagctgaggccgggggaacattttgtcgaggatgtcaccgacacactgaagagatttttccgagaactggacgatcctgtcacgtccgctaggctcctgcctaggtggagagaggccgccgagcttccacaaaagaaccagaggttggagaagtacaaagacgtgatcggatgcctacccagggtcaatcgaaggacactggccacgctgataggccacctatatcgggttcagaagtgtgctgcactcaaccaaatgtgtactcgcaatctggccctcctgtttgccccaagcgtcttccaaacggacggaagaggagaacatgaagtgagagtgttacaggagctgatcgatgggtatatcagcgtttttgatattgatagcgaccaagtggcacagatcgacctggaggtgagccttatcacaacatggaaagacgtacaactaagccaggccggcgacctgattatggaagtgtacattgagcagcagcttcctgataattgtgtcaccttgaaagtgtcccctacgctgacggccgaggaactcactaaccaggtgcttgagatgcgggggaccgccgctggcatggatctgtgggtgacatttgagataagggagcacggcgagctggagcgacctctacatcctaaggaaaaggtcctggaacaggcactccagtggtgccagctgcctgagccatgtagtgcaagcctcttgttaaagaaggtgcctctggcacaggcaggctgtctgttcaccggcatccgaagggaatctcccagggtcggactgctcagatgccgagaggagcctcctcggctactggggagcagattccaagaaagattcttcctcctccgcgggcgatgcctgctgctgcttaaggagaagaaaagtagtaagccagagcgagaatggccgctggagggagccaaggtgtacttggggattcgcaaaaagctgaaacctccgactccatgggggttcacgctaatcctagagaagatgcacctgtacctcagctgtaccgatgaggacgaaatgtgggattggacgacaagcattctgaaagcccagcatgacgaccagcagcccgtagtgcttcgccggcattccagtagcgacctggctagacagaaattcggtacaatgcccctgctgcccatcaggggcgatgatagcggagccacattactgtcagcaaaccaaaccttgaggagactgcacaatcgaaggacattaagcatgttcttccccatgaaaagctcccaagggtccgtcgaggagcaggaagagctggaggagcctgtttacgaagagccagtgtacgaggaggtgggtgcattccccgagctgatccaggatacttccacctccttcagcacaacacgagaatggacagtgaagcctgagaatcctctcacctcccagaaaagcttggatcagccttttctgagtaaatcgtccactctgggccaagaagagagaccccctgagcctcctcctgggccacccagcaagtccagcccgcaggcacgcgggtctctcgaggagcagctgctacaagagcttagcagtcttattcttagaaagggtgaaaccacagccgggctcggttccccatcgcagccaagctctcctcagagtccgtcgccaaccggattgccaacacagacaccaggatttcccacacagcctccctgtacctcgtcccccccatcgtcccagcccctgacatag

SEQ ID NO: 26823 - DNA, 1422 bp, Artificial Sequence
  Description of Artificial Sequence: Synthetic coding sequence
atggcagctccacaggatttagacatagccgtctggctggcaacagttcacttggagcaatacgccgatacgtttagaaggcatggcttagcaactgcgggcgcggcccggggattggggcacgaagaactcaaacagctggggatatccgcgacaggacatagaaaaagaatcctcagactcctgcagactggaacagaagagggatctctagacccaaaaagcgattcagctatggagccatctcccagcccggcacctcaagcacagcctcctaagcctgtgcctaaacctaggactgtttttggaggactaagtgggccagccacaactcagcgcccagggttgagcccggctctcgggggaccaggcgtcagccggtcccctgagcctagccctaggccccccccccttcctacgtcaagtagcgagcagagcagcgccctgaacacggtggaaatgatgccaaactcaatttattttggtttggactctagagggcgcgcgcaggcggcccaagacaaggctccagactcttctcagatatctgcccccactcccgcactgaggcctacaacaggcactgtccacattatggatcccggctgcctatattatggagtccagcccgtgggaacacccggtgctccagatcgccgggagtccaggggggtgtgccaggggagagcagagcatcggctcagccgtcaagacttagaagcacgagaagacgccggctatgccagcctcgagctgccaggagattcaaccctattatcacccactctcgaaactgaggagaccagcgatgatctaatttccccttatgcctctttttcatttaccgccgataggcttactccgctcctctcaggctggctggacaagctatctccgcagggtaactacgtcttccagaggaggtttgtccagttcaatgggcgaagtctcatgtatttcgggtctgacaaggacccctttccaaaaggagtcattcctttgacagccatcgaaatgacccgatcctcaaaggacaacaagttccaagtcattactgggcagcgtgttttcgtgttcaggaccgaatcagaagcccagagggatatgtggtgtagtacattgcagagctgcctgaaggagcaaaggctgcttggtcaccctcgcccaccccaacctcccaggcctcttcgcacggggatgctcgagcttcgcggacacaaggctaaggtgtttgcagcactcagtcctggggagctggcactttacaagtccgaacaggccttttccctggggattggtatctgcttcattgagttgcaagggtgctccgtgagagagactaagtcccgctcttttgatctattaacccctcataggtgtttttcgtttactgctgagagcggtggtgcacgacagagctag

SEQ ID NO: 26824 - DNA, 4128 bp, Artificial Sequence
  Description of Artificial Sequence: Synthetic coding sequence
atggagccaagcccttcgcctgccccccaagcacagccccctaagccggtgcccaagcctagaactgtgttcgggggactgagtgggcccgccactacacagaggcctggtttaagccctgccctgggggggcctggcgtgtcgcggtcccccgagccgagtcctagacccccacctctacccacatcctctagcgagcagagtagcgcccttaacactgtggaaatgatgcctaatagcatttactttggattggatagcaggggtcgcgctcaggccgcacaagataaagcgcctgacagctcccagatttcagcacctacccctgccctgcgccccaccactggcacagtccatattatggaccccgggtgcctgtattatggggtccagcccgtgggcacaccaggcgcccctgatagaagggaaagcagaggagtgtgtcagggaagagcggaacatcgattgtcaagacaagatttggaggcccgggaggacgccggctacgcgtcactggagctgccaggagacagcacactcctgtcgcccaccttggagactgaggagacctcagacgacttgatttccccatacgcctcattctccttcacagccgatagactgactccactacttagcgggtggctcgacaaactctctccacagggcaactacgtgttccaacggcgttttgtccagtttaatggtcggagcctaatgtattttggttccgacaaagatcctttcccaaagggagtgattcccctaaccgcaattgaaatgacaagatcgagcaaggataataagtttcaggttattactggccaaagggttttcgtgttcaggacggagagcgaggcgcagcgcgatatgtggtgttccacactccaatcatgtttgaaggagcaaaggctgctcggccatccacgaccacctcagcctcccaggcctttgaggacaggcatgttagaactccgtggccacaaggcaaaagtgtttgctgcgttaagcccgggcgaattggctctttataagtcagagcaggcattctccttgggaatcggaatctgtttcatagaactacagggatgcagtgtaagggagactaaatctcgttccttcgacctgcttacaccacacaggtgtttcagtttcacagcagaatcagggggagctcgccaatcttgggccgcagcactgcaggaggccgtaaccgagactctgtccgactatgaggtggccgaaaagatttggagtaatagagccaataggcagtgcgctgattgtggctcttcccgcccagattgggccgctgtgaacctgggggttgttatctgtaagcagtgtgcaggacaacaccgtgccctcggcagcggcatttccaaagtgcagtcactgaaattggatacctccgtgtggtccaacgagatagtccagttattcatcgttctaggtaacgatcgtgctaacaggttttgggccggcaccctccctcccggcgaggggttgcaccccgacgctaccccgggacctaggggcgagttcatttcaaggaagtacaggctggggctgtttcggaagccacaccctcaatatcctgatcattcacagctcctgcaggcgctatgcgctgcggtggccaggcctaatttattaaagaacatgacccagctgctctgtgtcgaggctttcgaggacccctcccccggcgtgtataatgaggtggttgtccgcgccacgtactcaggtttcttatattgctccccagtatcaaacaaagccggcccctcaccaccgcggaggggaagggatgcaccaccccgtctgtggtgtgtgttgggtgccgccttggagatgtttgccagcgaaaacagtcccgagcctctcagcctcatacagcctcaggatatagtgtgtctgggagtgtctcctcctcccacggaccccggggaccgcttccccttttccttcgagttgatcctcgctggcggacgcatccaacattttggcaccgatggggcggattcgcttgaagcctggacatctgcagtgggaaagtggttcagccccctgagctgccaccaactgctgggacctggattattgaggcttggacgtctctggttgaggagcccttcacacacggcccctgcacccgggctgtggctgtcggggttcgggctgttgcgtggagaccacctcttcctctgctcagctcctggacccggaccacccgcaccggaggacatggtgcatctgaggcggctgcaggagatcagtgttgtttctgccgctgatactcctgacaagaaggagcatctggttctggtagagaccgggagaactctgtacctacagggcgagggacgccttgacttcacagcatggaatgcagcgatcggcggggccgctggcggtggcggaaccgggctgcaggaacagcagatgagccgcggggatatccctattatcgtcgacgcgtgcatcagcttcgttactcaacatgagctcccccaaaagaaccagaggctcgagaaatacaaggacgtcataggttgtctgccccgggtcaacagaaggactctggccaccctaattggtcacctctaccgagtgcagaaatgtgctgctcttaatcagatgtgtacccggaatttggccctgctgttcgccccctccgttttccagacggacggcaggggggaacacgaggtgcgcgtgctgcaggaactcattgacggatatatatcagtttttgatatagatagtgatcaggtagcccagattgacctcgaggtctctttaattaccacctggaaggatgtgcagctgtctcaggccggggacctcatcatggaagtctatatagagcagcagctgccagataattgtgtgactctaaaggtatctccgacgctcacagctgaagagttgactaaccaggtcctggaaatgagggggaccgccgcgggcatggacctgtgggtcacattcgaaattagggaacacggagaactggaaaggccgctgcaccccaaagagaaggtacttgaacaggcactgcagtggtgtcagctgcctgagccctgttctgcctccttgctactgaagaaagtgccgttggcgcaagctggatgcctgtttactggcatccgaagagaatcaccgcgggtaggactgctacggtgtcgcgaggagccgcccagactgctgggctcgagattccaggaacgcttcttccttctgcgcgggagatgtctactgctgctgaaagaaaaaaagtcatcaaagccggaaagggaatggcccctagaaggggccaaggtctacctggggatcaggaagaagctaaaaccgcctaccccgtggggttttacattgattttggaaaagatgcatctgtacctgagctgtaccgatgaagatgagatgtgggactggaccacttcaatactgaaggcccagcacgatgaccagcaacccgtagttctgcgtcggcatagctcttccgacttagctagacagaagtttggtactatgcctctgctccctatccgcggcgatgattccggcgcaacgttgttatcggcaaatcagacattgcgcagactgcacaacagaaggaccctatccatgttctttcccatgaaatcctcacagggctccgtggaggagcaggaggagctggaggaaccagtttacgaagagccagtctatgaagaggtgggagcttttcccgaactcatccaggatacgagtacgagtttttcaacaaccagggagtggactgtgaagccagagaaccccttgactagccagaagtccctcgatcagccatttctaagcaaatccagtacactgggacaggaggaaagacccccagaacctcctccgggaccgccatcaaagtctagtccacaggcacgtggcagcctggaggaacagctgcttcaggagttgagctcattgatcctgcggaaaggggagaccacagctggactggggagccccagccagccatcctcccctcaatctcccagcccgacaggccttcctactcagactccgggcttccccactcaacctccttgtactagctcccctccatccagccagcctctcacttag

SEQ ID NO: 26825 - DNA, 3582 bp, Artificial Sequence
  Description of Artificial Sequence: Synthetic coding sequence
atgactagatctagcaaagacaataaatttcaggttatcactgggcaaagagtgtttgtattcagaacagaatcagaagcccaaagagatatgtggtgttccaccttgcagagctgtctgaaggagcaacggctgcttgggcatccccgcccccctcagcccccccggcctttacgtactggtatgctagaactgcgtggccacaaggcgaaggtctttgcagcccttagccccggagagctggctctttataaatctgagcaagcttttagtcttggcatcgggatttgcttcatagaactccaggggtgctcggtgcgcgaaactaagagcaggtcttttgatcttctgacaccccacaggtgttttagtttcacggccgaatccggaggtgcaagacagtcttgggcagcagccctgcaggaggccgtgaccgaaacacttagcgattacgaagtggctgagaagatctggtctaatcgcgcaaataggcaatgtgccgactgtggttcgtcccgccctgactgggctgccgttaacctcggcgtggtcatatgtaaacaatgcgctgggcagcaccgagcccttggcagcggcatctcaaaggtccagtcccttaaactggatacatccgtgtggagcaacgaaatagtccagctcttcatcgtgttggggaacgacagggccaacaggttttgggctggtactctgcccccgggcgaaggtctccatcccgatgcaacacctggtccacgtggcgaattcattagccggaaatacaggctcggcctcttccgtaaaccgcacccacagtaccccgatcattcccagctgctccaagctctttgcgcagccgtggctaggcctaatttactcaaaaacatgactcagctgctgtgcgttgaggccttcgagggcgaagagccgtggttccctccagctccagacggatcgtgcccaggattgctgccttcagatccaagcccgggagtctacaatgaggtcgtcgttagggccacatattccggctttctgtactgtagcccagtgtccaataaggccgggccctcccctcctaggagagggagggacgctccccctcgtctctggtgtgtgctgggagcggccctggagatgttcgcctccgaaaattctcctgaaccgctaagcctcatccaacctcaggatattgtgtgcctcggagtgtccccaccaccaaccgaccctggcgacagattcccctttagttttgaattgattctggcgggcggtcggatacagcacttcgggactgacggcgctgacagcctcgaggcatggacctcagcagtcggcaagtggttttccccactgagttgccatcagctgttgggaccaggcctactccgtcttggacgcctctggctaagatcccccagtcacacggcccctgccccaggactctggctgtcaggattcggcctgctgagaggggaccacttatttctctgctcagcccccgggccaggaccacctgcacccgaagacatggttcacctcagaagacttcaggaaatttccgtggtaagtgcggcggatacccccgataagaaagagcacttggtgctggtcgagaccgggaggaccctctacctgcaaggagaggggagactcgattttaccgcatggaatgccgctattggaggagctgctggtgggggaggcacaggcctgcaggagcaacaaatgtcacgcggcgacatccccattatcgttgacgcgtgtatcagttttgtcactcagcacggactgcggttggaaggcgtgtaccggaaggggggcgcccgggcgcgctctttacgcctcctcgccgagtttagacgagatgccagatcggttaagctacggccaggtgagcactttgtggaggatgtgaccgacactctgaagaggttctttcgtgaactcgacgacccagtaacgagcgcccgcctgctcccgagatggcgcgaggccgccgagctcccccaaaagaatcagcggcttgagaaatacaaagatgtgatcgggtgcttacctagagtgaatcgacggaccttggccacgctgatcggccatctgtatagagtgcagaaatgtgcggcactgaaccagatgtgtacgcggaacctagcacttttattcgcccccagcgtgtttcagaccgatgggcgcggggaacatgaggttcgtgtgctgcaggaactcatcgacggctatatttccgtctttgacattgattcagaccaggtggctcagattgacttggaggttagtctcataactacttggaaagacgttcaattgtcccaggccggtgacttgataatggaagtatatatcgagcaacagttgccagataattgtgtgactttgaaggtgtccccaaccctcactgcagaggagctcactaaccaggtcctggagatgagaggtaccgcagccgggatggacttgtgggtgactttcgaaattagagaacacggagaactcgagaggccacttcatcccaaagagaaggtgctagaacaggcccttcagtggtgccagctcccggaaccatgtagcgccagcctcctcctgaaaaaagtacctttggctcaagcaggctgtcttttcaccggtatcaggcgagagagcccccgggtaggactcctgcggtgcagagaagaaccccccagactcctgggtagtcgcttccaagagaggttttttctcctgagagggcggtgtctgttgctactgaaggagaagaaatccagcaaaccggagcgggagtggcccctggaaggtgctaaggtgtacctcgggatccggaaaaaattaaagcctccaaccccctggggatttaccctgatcttggagaagatgcatctgtacttgtcctgcacagacgaagatgagatgtgggattggaccactagcattctgaaagcccagcatgatgaccagcagcctgtagtattgaggcgtcattcctcctccgaccttgcccggcagaaatttggaaccatgccactcctgcctatccgaggagacgatagtggcgcaacactcttgtctgcaaaccagacgctcccaatgaaatcatctcagggttctgttgaggaacaagaagaactcgaagaaccagtgtatgaggagcctgtttacgaggaggtaggagcctttcccgaactgatccaggacacatctacatctttttccactacacgggaatggacagtaaaacctgaaaatcctcttaccagccagaagtccctggatcagcctttcttatccaagtcaagtacactgggacaggaagagcggcccccagagccaccaccaggacccccgagtaagagcagtccccaagcacgaggctcgctggaggaacaactgctacaggaactctcaagtctgatcttgcgcaagggggaaacaactgctggactgggatccccatcacagccttcctccccacagagccctagcccgactggcctgcctacgcagactcctggatttcccacacagccgccctgtacatcctcaccaccttcttctcagcccctgacttag

SEQ ID NO: 26826 - DNA, 1116 bp, Artificial Sequence
  Description of Artificial Sequence: Synthetic coding sequence
atgttaatggcttctacgacttccgcggtgcccggacatccttcccttcctagtttaccaagcaacagtagccaagagcggcctctggacacacgggatccactgttagccagagccgaactcgccctcctctccatcgtgtttgtcgccgtcgctctgagcaacgggctggtgctcgcagccctcgctaggcgtggccgcagggggcactgggcgccaattcatgtttttattggccacctctgccttgccgacctggctgttgcgctgttccaggttttaccccaattggcttggaaggccaccgatcggtttaggggacctgatgctctctgtcgtgcagtaaagtacctgcaaatggtcggcatgtacgcatcctcttacatgatcctcgctatgacactggatcgtcatcgcgcaatatgtaggccaatgctcgcatatcgccatggcagcggcgctcactggaatcgacccgtcctggtcgcatgggccttttcattattgctctccctaccacaactcttcattttcgcgcaacgaaacgtcgaaggggggtctggcgtgactgattgttgggcttgttttgcagaaccgtggggacggcgcacctacgtgacatggattgccctgatggtctttgtggccccgactcttggcatcgcggcatgtcaggtgctcatctttcgagagatccatgcaagtttagtccccggcccttctgaaaggccgggagggcgtaggagaggcaggaggaccggcagccccggagagggggcacacgtgagcgccgccgtggctaaaacagttagaatgacactcgtgattgttgtcgtgtacgttttatgttgggcgccgttcttcttggtacaactttgggccgcctgggaccccgaggccccgctggagggcgctccctttgtcctactcatgctgctggcttcactcaactcctgtaccaatccgtggatctatgcttcattcagtagctccgtgagcagtgaactccgatcattactttgctgtgccagggggcgcactcccccatccctgggcccccaagatgagtcctgtaccaccgctagcagttctctggctaaagatactagttcctag

SEQ ID NO: 26827 - DNA, 444 bp, Artificial Sequence
  Description of Artificial Sequence: Synthetic coding sequence
atgggaacccctgcctctgtcgtctccgaacctccaccttggcaggcacctattgaagcccgagggaggaagcaggctagcgctaacatctttcaggacgcggagctgctgcagatacaggcgttatttcaacgctcgggagatcagttggccgaggaaagggctcagattatctgggagtgtgccggcgatcatcgcgtcgccgaagcactcaagcggctgcggagaaaaaggccccccagacagaaaccacttggtcactccctccaccattgttccaggctccgaatcctggaacctcactctgccctggccaatcctcaaagcgcaaccgagactgcatcttccgaacagtatctgcattctcggaagaagagcgcgaggattagacgaaattggcgaaagtccggacctacttcttacctgcatcagattaggcactag

SEQ ID NO: 26828 - DNA, 1305 bp, Artificial Sequence
  Description of Artificial Sequence: Synthetic coding sequence
atggccgcctccgacaccgagcgggatggcttggctcccgaaaagacaagccccgaccgcgataagaaaaaagagcaaagcgaggtgtctgtgtcaccaagggcatccaaacaccattactccagaagtcgaagcagaagcagagaacggaagcgaaaatctgacaacgaggggagaaagcatcgtagccggtcacggtccaaggagggacgtagacacgaaagtaaggacaagtcaagcaagaaacacaaaagcgaagagcacaacgataaggagcactccagtgataagggaagggagagactgaatagtagcgagaatggcgaagatcgtcataagaggaaggaaagaaaatcatcacgagggcgatcccactcccgctcacgatctcgagagcgccgtcaccgttcgcgtagcagggagagaaaaaagtcgagatcacggagccgcgaaagaaagaaaagcagaagccggagccgagaaagaaagaagtctcggtctcgatctcgggaacgcaagcggcggattcgcagtcgatccaggtctaggagccgccatcgccatcggacaagaagtcgcagtaggacacgttccagaagtcgtgacaggaagaaaaggatcgaaaagccaaggcgattctccagaagcctgtcaaggacaccatctcccccacctttcaggggtaggaacacggccatggacgcacaggaggcactggctcgaagattagagagggcgaagaaactgcaggagcagagggagaaagaaatggtggagaaacagaaacagcaggagattgccgccgccgccgcaaccgggggcagcgtcctaaatgtggcagcactgctcgcgtcagggacacaggtgacacctcagattgctatggccgcacaaatggctgcccttcaagcaaaggcattggctgagactgggatcgccgtgccatcctattacaacccggcagccgtaaatcctatgaaattcgctgaacaggaaaagaagcgcaagatgctgtggcaggggaagaaagagggcgacaagagtcagagtgccgagatttgggagaagctgaacttcggcaacaaggatcagaacgtgaagtttcgcaaactgatggggatcaaaagcgaggacgaagctggatgtagtagcgtggatgaggagagttataagaccctgaaacaacaggaagaagtcttccggaatctggacgctcagtacgagatggcaagaagtcaaactcacacacagcgggggatgggactcgggttcacttctagcatgcgcgggatggacgctgtgtag

SEQ ID NO: 26829 - DNA, 1161 bp, Artificial Sequence
  Description of Artificial Sequence: Synthetic coding sequence
atgaaggaggagaacacaggcgctggggctgaagccaaaaggaccaacttctttctgaagcagggcagacgacatgagagtaaagataaatcctcaaagaagcataagagcgaagaacacaacgacaaggagcattcctcggataaaggcagggagagactgaacagctctgaaaacggggaggatcgacacaaacgtaaggagcgaaagagttccagagggcgatcacatagccggagtcgctcgagggagaggcgacatcgatctcgaagccgcgagcgcaagaagtcgcggagtagatccagggagcgcaaaaaatcaagatcacgttcacgcgaacgaaaaaagtcgcggagcagaagtcgggaacgaaaacgcaggatcagatcccgttctcgttcacggtctaggcacagacacaggacccgatctagaagtcgtactaggtctagatcccgggatcgcaaaaagcgcatcgaaaagccacgcagattctccagatctctaagcagaacaccaagtccaccacccttcagagggcgcaacactgccatggatgcacaagaggccttggctcggaggctggagcgcgctaaaaaactccaagaacagagggagaaggagatggttgaaaaacagaagcaacaagaaatcgctgccgctgctgctacgggggggagcgtacttaatgtcgccgccctgctggcctccggcactcaagtgactccacagattgcaatggcagcccagatggcagcacttcaagctaaagctctcgcagaaactggaattgccgtcccaagctactacaatcctgcagcagtgaatcccatgaaattcgccgaacaggaaaagaagagaaagatgctctggcagggcaagaaggaaggggataaatcccagagcgcagaaatctgggagaaacttaatttcggcaacaaggaccaaaatgttaaatttcggaagctgatggggatcaaatccgaagacgaagcaggctgcagttcggtagatgaagagagctacaagaccctgaaacagcaggaggaggtgttcagaaaccttgacgcccagtatgaaatggcccgctcacaaacccatacacagaggggcatgggcctgggcttcacatcatccatgaggggcatggacgctgtttag

SEQ ID NO: 26830 - DNA, 1110 bp, Artificial Sequence
  Description of Artificial Sequence: Synthetic coding sequence
atggcagcttcagacaccgagcgagatggactggccccggagaagactagccctgaccgagataaaaaaaaggaacagtccgaggtttccgtcagtccgagagccagcaagcaccactacagtcgatctaggagcagaagccgagagcgaaaaagaaagtccgataacgaaggtaggaagcatcgtagccgatcaagatctaaggaaggacggcgacacgagtctaaagataagtcatccaagaaacataaaagtgaagagcacaacgacaaagagcactcctccgataagggccgcgagcgccttaattcctccgagaatggggaagacaggcacaagagaaaggagcgtaaatcatcccgaggcagaagccatagcagatcacggtctagggagcggagacaccgcagccggagtagagagcggaagaaatcccggagccgctccagagaacgcaagaagtcccggtcgcgatcaagagagcgcaagaaatcaagatcccggtcacgtgaacgcaaaaggagaatacggagcaggagccggtccaggtccaggcacagacaccggacaaggtcccggtcccggacaagaagcagatctagagatcgtaaaaagagaattgagaaaccccgccggttctcaagatctctgagccgcacacccagccctccaccattcagaggaaggaataccgccatggacgcccaggaagccttggcaagaagacttgagagagcaaaaaaactgcaggaacaacgtgagaaagaaatggtggaaaaacaaaaacagcaggaaattgctgccgccgctgccgctacaggcgggagtgttttgaatgtggctgccctgttggcatcgggaactcaggtaacaccacagattgcaatggccgcacaaatggcggctctgcaagccaaagctctcgctgaaaccggcatcgctgtgccaagctattacaaccccgcggcagtaaatccgatgaagttcgccgagcaggaaaaaaagcgtaagatgctgtggcaagggaagaaggagggcttcataccaaactacctcgaaatcatggggaagatcgaattttggaagcagggacagaacgtcaagttctag

SEQ ID NO: 26831 - DNA, 333 bp, Artificial Sequence
  Description of Artificial Sequence: Synthetic coding sequence
ggcgctaggagtcctggttccactcaccaggggtcgctagcctctggtgtcctgcccattaaatgcagccacgttgaattcggaatgtggaaagggggacgatctcacccgttcttgccgcattcgtctcgatgtgcagggtccggagggcagttggattctattctgccacaccagtccccagcgtggggaccttgggggtgcaaggacctgagcagtgggtttcctagcttccttacatcatccattctctggaagagcgctgtcgtccgcgagccacatatctcccctcaccaggcgcccccgtataaaacatccgattgtatcacctag

SEQ ID NO: 26832 - DNA, 1104 bp, Artificial Sequence
  Description of Artificial Sequence: Synthetic coding sequence
atgggtaagagcatccctcagtacctgggacagttggacatcagaaagtcagtggtttccctcgcaaccggcgcaggcgcaatctatctgctgtataaggcaatcaaggctggcataaagtgcaagcctccactctgttctaattcacccatctgcatcgcaagagagtgtcctggacccggcgaacgcgcgctgccacaggaagccccagcgccagaggccagtgcagttggaggtccaaagggactggcagtggaaagggaacggcatgggcgggactcaggtgaactgaggcgcctgctcaactcattggagtgcaagcaagatgagtacgccaagtcaatgatcctgcacagtattacaagatgcgtgtatctactggaggcggaagcgtcagcctgtacaaccgatgacatcgtgctgctggggtatatgctggatgacaaggataacagcgtcaagacgcaggccctgaacacactgaaagccttctctggcatacgcaagttcaggttaaagatccaggagcactccatcaaagtcttggagctcatctcaacaatatgggatactgagctgcatatcgcaggcctccggttgctcaataatctccctttgcctgattacgttcatcctcagctgcggcgggtaatgccggccttaatggaaatactgcagtccgattacatcctcgcccaggtccaggctgtgagactgctgagttacctagctcagaagaatgaccttctctacgacattttgaattgtcaagtgcacagtaacttcttaaatcttttccagcccacccagagtggaagtctgctctacgaagtgctggtgtttgccgagaggctcagtgaaggacgaaacgcccctcactatcacgtggtgaagtggcattataatgaacaatcccttcacgagtcattatttggagaggaaagccgtttagccgatcggctgcttgccctggtgatccatcctgaggaagatgtgcagattcaggcctgtaaggtcatagtttcgcttcagtatccccaagacctgcgcgcgagaccatctagctgccaaccgtccagaagttattttaagaataccgaatag

SEQ ID NO: 26833 - DNA, 1023 bp, Artificial Sequence
  Description of Artificial Sequence: Synthetic coding sequence
atgggaaagagtatcccccaatatcttggacagctcgatatccgcaaatcagttgtcagcctcgcgactggtgccggggccatctatctgctatacaaggccattaaggccggcattaagtgcaaacccccgctgtgcagtaacagcccaatctgcatagcacgcctcgccgtcgaaagggaacggcacgggagagattctggtgagctgaggcggctccttaattctcttgaatgcaagcaagatgagtatgccaaaagcatgatcttgcactccatcactcgatgcgtgtacctgctggaagccgaggcttctgcttgtacaaccgacgacatcgtcctgttagggtatatgctagatgacaaggataatagcgtgaagacgcaggctttgaatactttgaaagcgttcagcggcattaggaagttcagacttaagatccaagaacacagcataaaggtgctggaactgatcagcaccatttgggataccgagttgcatattgccggccttcgcttgttgaacaacttacccctgccagactatgtgcatcctcagctgcggcgcgtgatgcccgctcttatggagatactgcagagcgactacattctcgcccaagtccaggccgtaagactgctaagctatctggctcagaagaacgacctcctttacgacatcctcaactgccaggtccactccaattttcttaacctgtttcaaccgacacagtccggttccctgctgtacgaagttttggtcttcgctgaacgtctgtcagaagggcggaacgctccgcactatcacgtggtcaagtggcattataacgaacaaagtctgcacgaatccctgtttggggaggagtcccgactggccgatcgactgttggctctggtcatacacccggaagaggacgttcagatacaggcctgtaaggtgatagttagcttgcagtaccctcaggatctgcgggcgcgaccctccagctgtcagccatctagaagctatttcaaaaatacagaatag

SEQ ID NO: 26834 - DNA, 993 bp, Artificial Sequence
  Description of Artificial Sequence: Synthetic coding sequence
atgggtaaatctatcccacaatatctgggacaactggatatcagaaagagtgtggtgtctctggccaccggagctggcgcgatctatctcttatataaggccattaaagcagggataaagtgcaagccccctctgtgcagcaattcaccgatctgtatcgctaggctggcagttgagagagaacgccatggtcgcgattcaggagagctccggagattgctgaactctttggagtgcaaacaggacgaatatgcaaagagcatgatcctgcacagtatcacccgctgcgtgtatctgctcgaagctgaggcctctgcctgcaccaccgatgatattgttctgttggggtatatgcttgacgacaaggacaattccgtgaaaacccaggcgcttaacacactcaaggccttcagtgggataagaaaatttcgcctcaaaatccaagagcactcaatcaaggtgcttgagctgatatctaccatctgggacacagagcttcatatagccgggctgagactgctaaacaatctgccccttcctgactacgtgcacccgcagctgaggcgggtcatgccagcacttatggaaatcctccagtctgactacatcctcgcacaggtgcaggccgtgcggctgttatcctacctagctcaaaagaacgacttactgtacgatatcttaaattgtcagccaacccaatctgggtctctcctctacgaggtattggtgtttgcagaacgactgagcgagggacgcaatgcaccccactaccacgtagtcaagtggcactacaacgagcagtccctgcatgaaagcttatttggcgaggagagtagattagccgacagattactcgcacttgtgatccatcccgaagaagacgtgcagatccaagcctgcaaggtgatagtgtcacttcagtatccgcaggatctgcgtgcccggcctagcagttgccagccctctaggagctacttcaaaaatactgaatag

SEQ ID NO: 26835 - DNA, 672 bp, Artificial Sequence
  Description of Artificial Sequence: Synthetic coding sequence
atgctctctcctaacgataagatgctgggaaagctcgacccattttaccagccgagcgtgagtaagcagaaaacatcagcagagatcatttcagaagcccgcaatgcactgcgcactgtcagaacacagcgccctttcacgcctcaggaggctcaacggaaactctttggtccagcatctagtcgcacatccgaaaacagaccaccctcgtcattctctctgcacgcgagctcttttgaatcaagcgatagccgccctatttccggcacaagactaagccctctggaacttaaaccaaaggttcctgcgtcacccacacgagaggaagactcctgcttctccttccccaagccccctgttgaccccgccaaaatccgtagggtgtcgaacgcacgcgcgcgcctatttagggcagcatcccagagggccctcttaccggatcgctctttgccgccttctgatagcaaaaagaccgtggaatcaaaggagaccgtgatgatgggtgattccatggtgaagatcaacggaatctacctgacaaagagtaacgcgatttgccatctcaagagtcatcccctgcaattaaccgatgatggcggcttctctgagatcaaggagcaggagatgtttaaggggacgacgtccctaccttcacatttgaaaaatgggtag

SEQ ID NO: 26836 - DNA, 2109 bp, Artificial Sequence
  Description of Artificial Sequence: Synthetic coding sequence
atgatgggcgattccatggtaaagatcaacgggatctatctcaccaagtccaacgcaatatgtcatctgaaaagccatcctctgcagcttaccgacgacggcggcttttctgagataaaggaacaagaaatgtttaagggaactacttctctgccctcacacttgaaaaatggcggggaccagggcaagagacacgcgcgcgcatctagctgcccatcgtccagcgacttgtcaaggctgcagacgaaggctgtccctaaggcagacctgcaagaggaggacgccgaaattgaagtcgacgaagtattttggaacactcgaatcgtgccaatcctcagagaactggaaaaggaagaaaacattgaaaccgtgtgcgcggcctgcacccagcttcaccacgctttggaagagggtaatatgttgggcaataaattcaagggtagatctatactcttgaaaacgctttgcaaactggtagacgtgggcagtgatagtctgagcttgaaactggctaagatcatcctggcattaaaggtgtccagaaaaaacttactgaacgtgtgcaaactgattttcaagattagtcgaaacgagaagaacgacagtcttatccagaacgactccatcctggagtctttgctcgaggtactccgcagtgaagaccttcagacaaacatggaagctttcctctattgcatgggctctatcaagtttatcagcggaaatctcgggttcctcaacgaaatgattagtaaaggagctgtggagattcttatcaacctcatcaagcagatcaacgagaatatcaagaaatgcggcacttttctgccgaatagcggacatctgcttgtacaggtgacggctacgctgagaaacctggtagatagcagtttagttcgaagtaaatttctgaatatcagtgcactgccccagctttgtaccgcaatggaacagtataagggggacaaagacgtctgcaccaacattgcccggattttctcaaaactgaccagttatcgggactgctgcacagcgctcgcatcgtatagcagatgctatgccctgtttcttaacctaatcaataagtaccagaagaaacaggatcttgtcgttagagttgtctttatcctgggcaacctaacagcaaaaaataatcaggcccgcgaacagtttagtaaggagaagggttcaatccagactctcctgtctcttttccagacgttccatcaattggatcttcacagtcagaaacccgttggacagaggggggaacagcaccgcgcacagcggccaccttcggaggcagaggatgtgctgatcaaacttaccagggtactggccaacatcgcaattcacccaggcgtcggacccgtcctggcggcgaatccaggaatcgtcggactactgctgacaaccctcgaatacaaatccctggacgattgtgaggagctggtgataaacgctactgctactatcaataatttatcttactaccaggttaaaaactctatcatacaggataagaagctttatatcgctgagctcctgcttaagctgctggtgagcaataacatggacggaatcctggaagcggttcgggttttcgggaatctgtctcaggatcacgatgtatgcgacttcatagttcagaataatgtgcatcggttcatgatggctctcctggatgcccaacaccaggatatctgcttctctgcttgcggcgtcctcctgaatttaaccgtcgacaaagataaacgagtgatcttgaaagagggcggcggaatcaagaagctggtcgactgtcttcgggaccttggcccaaccgactggcagttggcctgtttggtctgcaaaaccctctggaatttcagtgagaacatcaccaatgccagttcgtgttttggaaacgaagatactaatacgcttctcctgcttctgagttcattcctggacgaagagctggccttggatggatcttttgaccctgacttaaagaactaccataagctgcattgggagacagaattcaaacccgtggcacaacagttgctgaacaggatccaacgccaccacacattcctggaacctctacccatcccttccttttag

SEQ ID NO: 26837 - DNA, 2604 bp, Artificial Sequence
  Description of Artificial Sequence: Synthetic coding sequence
atgctgtccccaaacgataaaatgctcggcaagctcgatcccttctaccaaccaagcgtcagtaagcagaagaccagcgccgaaattatttccgaggctcgcaacgccctgaggactgtcaggacccagcggccttttacaccccaggaggcacagcgtaaactattcggcccagcatctagcagaacttctgagaaccgacctccctcctctttcagtcttcatgcctcttcattcgagtcaagcgactccagaccgataagtggaactagactcagccccctcgagctcaagcccaaggtacctgcgagtccaacaagggaggaagattcctgcttcagcttccccaaaccccccgtggacccagccaagattcgccgagtgtcaaacgcgcgggcccgtcttttccgagccgcctcacagagggcacttttgcctgacaggtcactgcctccctccgactccaaaaagacagtggagtctaaggagacagtaatgatgggcgatagtatggtaaaaataaatggtatctacctgacaaaatcaaatgccatttgtcaccttaaatctcatcctttgcaactgacagatgacggtggcttctctgaaataaaggagcaggaaatgtttaagggaacaacctcacttccctctcacttaaagaacgggggagaccagggaaaaaggcatgcccgggccagctcatgcccttctagtagcgatctgtccagactacagactaaggctgtgccgaaagctgacctgcaggaagaagacgccgagatcgaagttgacgaagttttctggaacacacgtatcgtccccatactgcgggagctggaaaaggaagagaatatagaaacagtttgtgcagcttgcacccagctgcatcatgcgctcgaagaaggtaatatgctgggtaataaattcaaggggcgcagcatcctgctgaaaactctgtgcaaactagtggacgtggggtcggattcgttgtccttgaagctggccaagatcatcctggcattgaaggtgtctcgaaaaaaccttctgaatgtctgtaagctgatatttaaaatatcacgtaacgagaagaatgattcgctaatccagaatgacagcattctcgagtcgctcctggaagtcctgcggagcgaggatttacaaacaaatatggaggcatttttatactgcatgggatctataaagtttattagcggcaacttaggatttctcaatgagatgatctctaagggggccgtggagattctcattaacctgatcaagcaaatcaatgaaaatatcaaaaagtgcggcacgtttctgcctaactctgggcatctgctggtacaggtgactgctactctgcggaatctggtagattcttccctggtgcggtcaaaattcctgaatattagcgccctgccacagctgtgcacagctatggagcaatacaaaggggataaagatgtatgtacgaatatcgcacggatattcagtaaactcacatcttatagggattgctgcacggccctagcctcttactccagatgctacgcattattcctaaatcttatcaacaagtaccagaagaaacaggaccttgtggtccgcgtggtgtttattctgggaaaccttacagctaagaataatcaggcccgggagcaattctcgaaggagaagggctccatccagacgcttctctcactcttccaaactttccaccagctggatttgcacagccagaaacctgtgggccagaggggagagcagcacagagcacagcgcccgccatctgaagccgaggacgtgctgatcaagctaacacgcgtcttggctaacatagctattcatcccggcgtcggacccgttctagccgcaaacccaggaattgtaggacttctattaaccaccctcgaatacaagagcctcgatgattgcgaggaattggtgataaacgccactgctaccatcaacaatctgagctactatcaggtcaagaactcgattatccaagacaaaaaactgtatatcgccgaactcctgctgaagctgctagtgtccaataacatggatggtatcctggaggctgtgagagtttttggcaatttgtcccaggaccacgacgtctgtgatttcattgtgcaaaataatgttcatagattcatgatggcgctgttggatgcacaacatcaggatatctgcttttcagcctgtggtgttctcctgaatctgactgtggataaggacaaacgcgtcatattaaaagaaggcggcggaataaagaaactggtggactgcttaagggatcttgggcctacggattggcagctggcgtgcctggtttgtaagaccctgtggaatttcagtgaaaatattacgaacgcaagttcttgctttgggaatgaagacacaaacactctcttactgctgctctcctcctttctggacgaagaactggccctggacgggagctttgatccggatctcaaaaactatcataagcttcactgggaaaccgagtttaagccggttgcccagcaacttctgaacagaattcagaggcaccatacttttttggagcccctccccataccgtctttttag

SEQ ID NO: 26838 - DNA, 2619 bp, Artificial Sequence
  Description of Artificial Sequence: Synthetic coding sequence
atgggcaaaaaaattaagaaagaagtggaaccaccgccaaaggacgtgtttgaccccctcatgatagagagtaaaaaggcagctaccgtagttctcatgctgaatagccctgaagaagagatccttgctaaagcatgcgaggcaatttataaattcgctctcaaaggagaggagaacaagacaaccctcctcgaactaggggccgtagagcctcttacgaaactcctgacacatgaggacaaaatcgtccgacgcaacgcaacaatgatcttcggaatcttggcttctaataacgacgtgaaaaagctgctccgcgaattggatgttatgaacagtgttatcgctcagctggctcctgaggaagaagttgtgatacatgagtttgcctcactctgcctagcgaacatgagtgcggaatacacgtcaaaggttcagatctttgaacacggcggcctggagcccctgatccgcctgctctcctccccagacccagacgtcaaaaagaactcaatggaatgtatctataaccttgtgcaagattttcaatgccgggcaaaactgcaagagctcaatgctatccctcccattctagaccttctgaagtcggagtacccggtaatacagctcttagcgctcaaaaccctcggtgtgatcgccaacgacaaagaatctcgaaccatgctgagagataatcaggggctggaccatctcatcaaaatcctggaaacgaaggagctcaacgatctgcatattgaagcactcgctgtgatcgctaattgcttggaagacatggatactatggtgcagatccagcaaacagggggtctgaagaagttgctgtcattcgccgagaattccacaattcctgatattcaaaaaaacgcagctaaggctattaccaaggctgcttatgacccagagaaccgtaaactctttcatgagcaagaagtggagaaatgtctcgtggctctactgggatctgaaaacgacggaacgaagattgctgcctctcaggccatatccgccatgtgtgagaattcaggctccaaagacttcttcaataaccaaggtatcccacagctcatccaactgctcaagtccgacaacgaggaggtcagggaggctgcggcccttgccttagccaatctgaccacttgcaatccagctaacgctaacgccgcagctgaggcagatggaatcgaccccctgataaatttactcagcagcaagagggacggggcgattgccaatgcggcaaccgtattgacaaatatggcaatgcaggaaccgctgagactgaacattcagaatcacgacataatgcacgcaatcatcagcccactgcggtcagccaatacagtggtgcaaagcaaggccgccctcgcagtgacagcgaccgcgtgtgacgtggaggctagaacggagttgcggaactcaggcggcctcgaacccctcgttgaattgctgcgctccaagaatgatgaagtccgcaagcatgcctcatgggcggtaatggtgtgtgcaggagatgagctcacggccaacgaactctgcaggctaggcgctctggacattcttgaggaagtgaatgtttctggcaccagaaagaacaagttctcagaggctgcttacaacaaattgctcaacaacaacttgagcttaaagtactcacagaccggctacctgagtagctcgaacattattaacgacggcttctatgactacgggaggattaatcctgggacaaagctgctgccactcaaagagctgtgcctccaggagcctagtgatctgcgggccgtgctcctcattaacagcaaatcatatgtgagccctccctccagcatggaggacaagagcgatgtgggatacggccggtccattagttcttccagttctcttaggcgatcttcaaaagagaagaacaaaaaaaattcttatcacttctctgcaggctttggttcccccatcgaagacaagtccgagccagcctcaggtcgaaataccgtgttaagcaagtccgcgactaaagagaagggatggcggaagtccaaaggcaaaaaggaggaagagaaagtgaaggaagaagaggaggtgatggtggttcccaagttcgtcggagagggtagcagtgacaaggagtggtgccctccttctgatccggacttcagtatgtacgtttacgaagtgaccaagagcatccttcctatcacaaatatcaaggaacagatcgaagacttggccaagtacgtcgccgagaagatgggcggaaagatcccaaaggaaaaactgcctgacttctcctgggaacttcacatttcagagctcaaatttcaattaaagagcaatgttatccccattgggcatgttaagaaagggatcttttaccaccgcgcgctgctatttaaggcccttgctgatagaatcggaataggctgctcacttgtcaggggggagtatgggagggcctggaacgaggtgatgttgcagaacgactctaggaaaggcgtcattggcgggctcccagctcctgaaatgtacgtgatcgatctgatgtttcaccctggtggcctgatgaagttgcgtagccgggaagccgacctgtatcggttcatctag

SEQ ID NO: 26839 - DNA, 1830 bp, Artificial Sequence
  Description of Artificial Sequence: Synthetic coding sequence
atggataccatggtgcaaatccaacagactggcggtctgaagaagttattgtcgttcgcagagaactctaccattcccgatattcagaagaacgctgcaaaggcgataaccaaagccgcctatgacccagagaatcggaagttgtttcacgaacaggaagtggagaaatgcctggtggctttactcggcagcgagaatgacggaactaaaatagcagcctctcaggccatcagtgccatgtgcgaaaattcaggcagcaaggacttctttaataaccagggaatcccccagcttatccagctgctaaaaagtgacaacgaagaagtgagggaggccgccgcactggcgcttgctaatctcacaacctgtaaccctgccaacgccaacgccgcggccgaggcagacggaatagacccactgataaatcttctgtcatcgaagcgtgacggagctattgccaacgctgccaccgtcctcactaatatggctatgcaagaacctttgaggctcaatatccagaatcacgatattatgcacgctataatcagccctcttcgctcagctaatacagtggtccagtctaaggcagcactagcagtgactgccacagcttgcgatgtcgaggcacggaccgaactgcgaaattctggaggcttggaacccttggttgaactcttgcggtccaaaaacgatgaggtgagaaagcatgcttcatgggctgtaatggtctgcgcgggcgacgagttgactgccaacgaactctgtagactgggggctctcgatatactggaggaagtgaacgtgtcaggcacacggaaaaataaatttagcgaggccgcctacaataagcttctgaataacaacttgtcactgaaatactctcagacaggatacctctcaagcagtaacatcataaatgacggtttctacgattatggacggataaatccaggcaccaagttactgccactcaaggagctctgtcttcaggaaccgtcggatctccgagctgtgttgctaataaattcaaagtcctatgtttccccaccatctagtatggaagataaaagcgacgtaggctacggtagatctataagctcgagcagcagcctgagaagatcatctaaggagaaaaataaaaaaaatagctaccacttttctgctggttttggcagtcccatcgaagataaatcagagccagcctccggccggaacaccgtcctgtccaagtctgccacaaaggaaaaaggctggcgtaaaagcaagggaaagaaagaagaggaaaaggtgaaggaagaagaggaggtgatggttgtgccaaaattcgtgggagagggttctagcgacaaggagtggtgtccccctagcgacccggacttctctatgtacgtgtatgaagtaacgaaaagcatattaccgatcactaatatcaaggaacagatcgaagatctcgccaagtacgtggccgaaaaaatgggagggaaaattccaaaggagaaattacctgacttctcttgggaactgcatatcagtgagctaaaattccagctgaaaagcaacgtcattcctataggacacgtaaagaaggggatcttctaccatcgagctctcctttttaaagctctggccgaccgcataggtatagggtgctcccttgtgcggggggagtatggtagagcatggaacgaggtcatgctgcagaacgattcaagaaaaggggtgatcggcggcctgcctgccccagaaatgtacgtcatcgacctgatgttccaccccggtgggctcatgaaactccggtcacgcgaagccgacttgtacagatttatctag

SEQ ID NO: 26840 - DNA, 2067 bp, Artificial Sequence
  Description of Artificial Sequence: Synthetic coding sequence
atgggtaagaagatcaaaaaggaggtggaacctccgccgaaagacgtttttgaccccctcatgattgagtccaagaaggctgctactgtggtgttgatgctcaacagtcctgaggaggagatattggccaaggcttgcgaggctatctataaatttgccctgaaaggagaggaaaataaaacaacacttctggagctgggagctgtggaaccccttactaagctactgacccacgaggataagatcgtgcggcggaacgccactatgatcttcggcatcctagcttcaaataatgacgtgaaaaaactcctgcgggagctcgacgttatgaactcggtgattgctcagctcgcccctgaggaggaagttgttattcacgaatttgcctctctttgtctggccaacatgtctgctgagtacacctctaaagtgcagatctttgaacacggaggcctggaacccttaatacggctcttatctagtccagaccccgacgtgaaaaagaactccatggagtgtatctacaaccttgtgcaagacttccaatgccgggctaaattacaggagctgaacgctatcccacccatccttgacctgctgaagtctgagtatccagtgatccagctgctggccctgaaaactctgggcgtgatcgccaatgataaggaatctcggaccatgttgcgagataaccagggcctcgatcatttaattaagatcctcgagacaaaggaacttaatgatctgcacattgaggcacttgcggtcatcgcaaactgcctcgaggatatggacactatggtgcagatccagcagacagggggcttgaaaaagctcttaagtttcgcagagaacagcacaatccccgatatacagaagaatgctgccaaggcaatcactaaggcagcctacgaccccgaaaataggaagctgttccatgagcaggaagtcgagaagtgtctggtggcactcctcggtagtgagaatgatgggacaaagattgcagcctctcaagctatctcggccatgtgtgaaaacagcggcagcaaagactttttcaataatcaaggaatcccacagctgatccagctgctcaagtccgataatgaggaagtccgcgaagcggcggccctggcactggccaatctgaccacatgtaatcccgccaacgccaacgccgccgctgaagccgatggcattgatcctctaattaatctgctctcttctaagagggatggagcgatcgcaaacgcagcaactgtgttaacaaatatggcgatgcaggagcctcttagactgaacatacaaaaccatgacatcatgcacgccattatttcccctctcaggtctgctaatacagtggtccaaagtaaggccgccctggccgtgacagccacagcttgtgatgtagaggcccggacagaactgaggaatagtgggggacttgagccccttgtcgaactgctgcggtccaagaatgacgaggtccgaaaacacgctagttgggccgtgatggtgtgtgcgggcgacgagttgaccgctaatgaactgtgcagattgggagccctcgacattctggaggaagtcaacgtctccggcaccaggaaaaacaagttcagtgaggcagcctataacaagttgctgaataataacctgagcttaaagtactctcagacggggtatctcagcagcagcaacatcatcaacgatggattttacgactacggtagaataaacccaggcactaagctgctcccactgaaggagctgtgcctgcaggagccttcggaccttagggcggttttgctgatcaactccaagtcttatgtgtctcctcctagttccatggaggacaagagcgacgtcggctacggaagatccatcagttccagcagcagcctgcgaaggagctctaaagagaaaaacaagaaaaactcttatcacttctccgccgggttcgggagccccattgaggacaagtcagaacccgcctcggggaggaatactgttctgtccaagtccgccactaaggaaaaagggtggtcgtcactgccgacctcacgatag

SEQ ID NO: 26841 - DNA, 2598 bp, Artificial Sequence
  Description of Artificial Sequence: Synthetic coding sequence
atgggaaaaaaaattaaaaaagaggttgagccacctccgaaggacgtatttgatccattaatgatagaatccaagaaggctgcaactgtcgtgttgatgctgaattctcccgaggaagagatactcgctaaggcatgtgaggctatatacaaattcgctctaaaaggagaggaaaataaaaccaccctcctcgagctgggcgccgtcgagccattgacaaagctactgacacacgaggacaagattgtccggcgcaacgctactatgattttcgggattctggcttctaacaatgatgtgaagaaactgttacgagaactggatgtgatgaattcggtaatcgcacagcttgcccctgaggaggaggtagtgatccatgaattcgcgtccctatgcttggcaaacatgtcagctgagtatacctctaaggtgcagatcttcgagcatggtggcctggagccgctcatccgtttactgagctccccagaccccgatgtgaaaaagaactccatggaatgtatatacaatctggttcaggatttccaatgtcgcgcgaagctccaggagctaaacgccatcccgccaatccttgatctccttaaaagtgaataccccgtcatccagctcctggccctgaaaacacttggcgtcatcgccaacgacaaagaatcccgcacaatgcttcgtgacaatcaaggactggatcacttaattaagatccttgaaaccaaggaactcaatgacctgcatattgaggcattagcagtcatagcaaattgcttggaggacatggacaccatggtccagatccagcagaccggcggtttaaagaagcttttaagctttgccgaaaactcaaccatcccagatatccagaagaacgccgctaaggcaataaccaaggctgcctatgatccagagaacagaaagctgtttcacgaacaagaggtcgagaaatgtcttgtggccctcttgggatctgagaacgatggaacaaaaatcgctgcctcgcaagccatcagcgccatgtgcgagaactcaggtagcaaggactttttcaacaatcaaggcatcccacagctgatacaattgttaaagtccgacaatgaagaggttcgagaagccgctgctctggcgctcgccaacctgactacctgtaatccagcaaacgcaaacgctgcagctgaggcggacggcatcgatccgctgattaaccttctttctagcaaaagggacggggccattgctaatgccgccactgtgctgaccaatatggccatgcaagaacccctccggctgaacatacagaatcatgacatcatgcatgctattattagccccctgcggtcggccaatacggtagtgcaatcgaaggccgcactcgctgtcacagcaaccgcgtgcgatgtggaggcccggaccgagctaaggaattctggtgggctcgaaccgctggttgagttactccgctccaagaacgatgaagtgcgaaaacatgctagctgggctgtcatggtgtgcgccggtgacgagttgaccgctaacgaattgtgcaggctgggggccctagacattctcgaagaagtaaacgtaagtgggacccgaaagaacaaattttctgaagccgcttataataaactgctgaataataacctgtcattgaagtacagccagaccgggtatctctcttcgtccaacataattaacgatggattctatgattacggccgaattaatcctggtactaaactcctgcccctgaaagagctatgtctgcaggaacccagcgacttacgagcagtcctgctcatcaactcgaagtcttatgtgtctcctcctagcagcatggaagataagtcggatgtggggtatggccggagtatatcctccagttcctctctgcgcaggtcctcgaaggaaaaaaataacgctggattcggttctcccatcgaagacaaatctgaacccgcttctggccgcaatacagttttgtcaaaaagtgctacaaaggagaagggctggaggaagagtaagggcaaaaaagaggaagaaaaggtcaaagaggaggaggaggtgatggtggttcctaagtttgtgggggaaggctccagcgataaggagtggtgcccgcccagcgatcctgatttctctatgtatgtgtatgaggtcactaaaagcatactgcctataacaaacattaaagagcagatcgaagatctggccaagtacgttgccgaaaagatgggtggaaagatacccaaggagaagctgccagacttcagttgggagctgcatatttcggagctgaaattccagcttaagagtaatgttattccaatcggccacgtgaaaaaagggatattttatcatcgtgctctgctgtttaaggccctcgctgacaggattggaattggctgttccttagtgcggggtgagtatggacgtgcttggaatgaggtcatgttgcagaacgattcccggaagggcgtgatcggcggcctgccagccccggaaatgtatgtcattgacctcatgtttcatcccggggggctgatgaagttaaggtcaagagaagcggacctctatagattcatctag

SEQ ID NO: 26842 - DNA, 1059 bp, Artificial Sequence
  Description of Artificial Sequence: Synthetic coding sequence
atgaaggagaactccattgctctgaacatacttggtaaaatcactcgggacgacgacccagaatctgaaatcaaaatgaagatcgctatgctgctcaagcagcttgacctgcacctgctcaaccacagtctgaaacatattagcctggagatttctctctcaccaatgacagtgaagaaggacatcgagctcttaaagcgcttttcaggtaagggcaaccagacagtcttagagtcaattgagtacaccagcgattacgaattctccaacggttgtagggctccgccatggcgacagataagaggcgaaatctgctacgtgctggttaagccgcacgacggggaaacactctgcatcacctgcagcgctggcggggttttcttaaacgggggcaagaccgatgatgaaggagacgtgaactacgagcgcaaaggatctatttataaaaatcttgtgacattcctgcgcgagaaaagtcccaagttctccgagaacatgtctaagctcggaatctcatttagcgaagaccagcagaaagaaaaagaccaactaggaaaggccccaaagaaagaagaagcagccgctctgagaaaagacatatctggatcagacaaaagaagtcttgagaaaaaccagatcaacttctggcgaaatcaaatgaccaaacggtgggagccgagtctcaattggaagactaccgtcaattataaaggaaaaggctctgctaaagagattcaggaagacaagcatactggcaaattggagaagccaaggcctagcgtatcacacggccgtgcccagcttctgagaaagtctgccgaaaaaatcgaggaaacggtaagtgacagctcctcagagtcagaagaggacgaagagcctccagaccacaggcaggaagcgtcagccgacctgcccagtgaatattggcaaatccagaagctagtcaagtacttgaagcagaaggaaacatcccaaaacggtagaaacaagaggtggattcgcaagcagaacactcgcgtgatcaggtcaatgattttcgatgtcggaaagacgtcatag

SEQ ID NO: 26843 - DNA, 3135 bp, Artificial Sequence
  Description of Artificial Sequence: Synthetic coding sequence
atgggggtcgccctgcggaaactaacccaatggaccgctgccggccacggcaccggcatattagagattactcctcttaacgaggcaatacttaaagagataattgtgttcgttgagtcttttatttataagcatccgcaggaagccaagttcgtcttcgtggaaccgctggaatggaacaccagcctggccccctctgcttttgagtcaggatacgtggtgagcgaaaccacagtaaagtccgaggaggtagataagaacggccaacctctcctgttcctctccgtcccccagatcaagattcgcagcttcggccagcttagtcgcttgctgctgatcgcaaagacaggcaagctgaaagaagcacaggcatgcgttgaagccaacagggacccgattgtgaagatcttaggatctgactacaataccatgaaggaaaacagcatagccctgaacatcttaggcaaaatcacacgggatgacgacccagagtcagagatcaagatgaaaatagccatgctcctaaagcagctcgatttgcatctgctcaaccacagtcttaagcacatttcccttgagatttcgctctcacctatgactgtgaagaaagatatagagctcttaaagaggttcagtggcaagggaaaccaaaccgtgcttgagagtattgaatatacatccgattatgagttcagcaatggctgtcgggcaccaccctggcgccagatccgcggggagatctgctacgtcctggtcaagccccatgacggggagactttatgtattacgtgttccgccggcggagtgtttctgaatggtggaaaaacagatgacgagggggatgtaaactacgagaggaaggggagcatctacaagaatctggtcaccttcctgcgggaaaaatcacctaaattttctgagaatatgagcaaacttggcatctcattctctgaagaccagcaaaaggaaaaggatcagctaggcaaggcccctaaaaaagaagaggctgcagccctgcggaaggacattagcggttctgataaaagaagcctggaaaaaaaccagatcaatttctggcgtaaccagatgactaagagatgggagccctcactcaattggaaaacaactgtgaactacaagggcaagggctccgctaaggaaatccaggaagacaagcacaccggcaaactcgagaaaccaaggccttccgtcagccatggaagggcgcagctcctccgcaaatcagccgagaagatcgaggaaacagtgtccgactcaagttcggagagcgaagaagatgaagaaccacccgaccacagacaagaggcctctgcagacctgccgtcagagtactggcaaatacaaaaactggtgaagtacttaaagggaggaaaccaaaccgcgactgtaatagccctgtgtagtatgagggacttttccctggcccaggaaacctgccaactggctattcgcgatgtgggtggactggaagtgctgattaacctgctggagaccgatgaagtaaagtgcaagatcggcagtctgaaaatacttaaggagatctcccataatccacagatccgacaaaatattgtagaccttggcggcctacccatcatggttaatatcttagacagccctcataaatctttaaagtgtttggccgccgagaccatcgccaacgtagcgaaattcaagagagcaaggcgggtggtgagacagcacggaggtatcaccaaactagtcgcactcctcgactgcgcacacgatagcacaaaaccagctcagagctccttgtacgaagctcgggacgtggaagtggccagatgcggagcccttgccctgtggtcctgctctaagtcacatacaaataaagaggccatccgtaaagctggaggcattcctttgcttgcacgacttctcaagacctcgcatgaaaatatgctgatccccgttgtcggcactctgcaagaatgtgcctccgaggagaactatagagccgctattaaagctgaaagaataatcgagaatctagtcaagaatctaaacagcgagaacgaacagctgcaggaacactgtgcaatggcgatatatcagtgtgccgaagacaaggagacacgggatctggtgagactgcacggcggtttgaagccgcttgcctctctattgaacaacactgataataaggagaggctcgccgcggttaccggagcgatttggaaatgtagtatatccaaggaaaacgtgactaagttccgagagtataaggccatcgagacgctggtgggtctgctgacagatcagccagaagaagttctggtgaatgtggttggggctctgggggaatgctgccaggagcgcgaaaacagggtgattgtgcgtaagtgtggcggaattcagcccctggtaaaccttttagttggaataaatcaggccttgttagttaacgttacaaaggcggttggcgcctgcgctgtcgagccggagagcatgatgatcatagaccgcctcgatggcgtgagactgctgtggtcccttctgaagaaccctcatcccgacgtcaaagcgagcgcggcctgggctttgtgtccatgcattaagaatgccaaggacgcaggggaaatggttagaagtttcgttggcggcctggaattaatcgtgaacttgctcaaatcggacaataaggaggtgctggcctccgtttgcgccgcaatcacaaatatcgccaaagaccaagaaaacctggctgtaatcaccgatcatggtgtcgtccccctcctgagtaaactcgcaaatacaaacaataacaagctcagacaccacctggccgaagctatcagccggtgttgcatgtggggccgtaaccgcgttgcgttcggcgagcacaaagctgtggctcccttggttcgttatctaaagtccaatgacaccaatgtgcatcgtgctacagctcaggcgctctaccagctgagcgaggacgccgataactgtatcaccatgcacgaaaatggagctgttaaactgctgcttgatatggtcggatcccctgaccaggatctccaggaggccgctgcaggatgtatatctaatataaggcgactcgccttagcaaccgagaaggcccggtacacctag

SEQ ID NO: 26844 - DNA, 1170 bp, Artificial Sequence
  Description of Artificial Sequence: Synthetic coding sequence
cttagcagactactgctcatcgccaaaacaggcaaattgaaagaagcccaggcttgtgtggaggccaatagagaccccattgttaagatacttggatccgactacaatactatgaaagaaaatagcatagcactgaacattttaggaaaaataactcgtgatgacgaccccgagtctgagattaagatgaagatagcaatgctgcttaaacagctcgatctacatctgcttaaccattctcttaagcacatctccctggagatttctctatcccccatgactgttaagaaggacatagaacttttgaaacgcttctcagggaaggggaaccaaaccgtgctggagagtatcgagtatacctccgattatgagttttctaatggttgtcgcgcgcctccctggagacagatccgcggtgaaatatgttatgtgctggttaaacctcatgacggggaaacactgtgcatcacctgctcagctggtggcgtattccttaatggcggcaagacagacgatgagggcgacgtaaattacgagagaaaaggaagcatttacaaaaatctggtgacattcctgagagaaaagtccccaaaattctctgagaatatgagcaagctgggcatttcatttagtgaggatcaacagaaagaaaaagatcaactgggcaaggcaccgaagaaagaggaagccgccgccctgcggaaggacatctccgggagcgataagcgctcacttgagaagaaccaaatcaacttttggagaaaccagatgacaaagcgatgggagccaagtctgaattggaaaactaccgtcaattacaaaggaaagggtagcgcaaaggaaatccaggaggacaaacacacgggaaagttagagaaacctaggccctctgtctctcacgggcgtgcacaactgctacgcaagagtgcggaaaaaatagaagagacagtgagcgattcttcgtcggaatccgaagaagacgaggagcctccggaccatagacaggaagcctcggctgacttaccatctgagtactggcaaatccagaagctggtgaaatacctgaaacagaaagagactagccagaatgggagaaacaaacggtggataagaaagcagaatactagggtgattaggagtatgattttcgacgtgggaaagacctcatag

SEQ ID NO: 26845 - DNA, 621 bp, Artificial Sequence
  Description of Artificial Sequence: Synthetic coding sequence
atgtctaagctcgggatatcatttagtgaagaccagcagaaagagaaggatcaactggggaaagcccctaaaaaggaagaagctgccgcactgagaaaagatatttccggcagtgataaaaggagcctggagaagaatcagatcaacttttggcggaaccagatgactaaaagatgggaaccttcgttaaactggaagaccacagtgaactataaggggaaggggagcgctaaagaaattcaggaggacaagcacactggcaaactcgagaagccaagaccatccgtgtcccacggaagggcacagctcctccgtaagagtgctgagaagattgaggagactgtgagcgactcctcctccgagtccgaggaagatgaggagccccctgatcataggcaggaagcttcagcggatctgccctctgagtactggcagatccagaagctcgtgaaatacctgaagggtggaaaccagacagctacagtgattgccttatgcagtatgagagatttcagcctggcacaagagacttgccaactggctatcagagacgtgggaggcctggaagtgctcattatttgtcttaaacctatgaagtctaacgtccggctagtgcactag

SEQ ID NO: 26846 - DNA, 2118 bp, Artificial Sequence
  Description of Artificial Sequence: Synthetic coding sequence
atgtcaaaactcggcattagttttagcgaggatcagcagaaggaaaaggatcagttaggaaaagccccgaaaaaggaggaagccgccgccctgaggaaagatattagtggaagcgataaacggagcctggagaagaatcagatcaacttctggcgtaaccagatgaccaaaagatgggaaccaagcttaaactggaagacaacagtgaactataagggcaagggatctgccaaagagattcaagaagataagcataccggcaagttggaaaagcctagaccctccgtaagtcatggcagggcacaactgctgcggaagagcgcagaaaaaatcgaggagactgtttccgattcaagcagcgaatctgaagaggacgaagagcctccggatcaccgccaggaggctagcgctgatctccctagtgaatactggcaaattcaaaagctggtgaagtatctgaaaggggggaatcagactgcaaccgtcatagctttatgttcgatgcgagatttctctttggctcaagaaacatgtcagctcgccattcgtgacgtgggtggtttggaggtgctcataaatctgctggaaactgatgaagtcaagtgcaagatcggatctctgaagatccttaaggagatcagtcacaacccccagatccgtcagaacatcgttgacctaggcggcttgcccatcatggtcaacatcctggatagcccccataagtccctcaagtgtctagccgccgagacaatcgccaacgtagcgaagtttaagcgagcaaggagggtggttagacagcatgggggcattactaagttagtggcccttctggactgcgcccacgattccaccaagccagctcagagctcactgtatgaggctagggacgtcgaggtggctcggtgtggggccctggctctgtggtcatgcagtaaatcccacaccaacaaggaggccattcgcaaagcaggcgggatcccactgcttgctcggctccttaaaactagtcatgaaaacatgcttatccctgtggtgggaaccttacaggagtgcgctagcgaggaaaactaccgcgccgcgatcaaagccgagcgaatcattgagaatctggtcaagaacctgaactctgaaaacgaacagctgcaagagcactgtgctatggccatttatcagtgtgctgaagacaaggagaccagggacctcgtcaggctgcacgggggacttaagcctcttgccagcctactgaataacactgataataaggaaaggctggcggccgtcacaggcgccatctggaagtgttccatcagtaaggagaatgtcactaagtttagggaatacaaggctattgagacattagtcggcctgttgacggatcagccagaggaagttctggtcaacgtcgtaggggctctcggggagtgctgtcaagaacgagagaatagggtcattgtgcgtaaatgtggtggcatccagcccttggtcaacctcctggtggggattaaccaagctctgctggtaaacgttacaaaggccgtgggtgcttgcgctgtggaacctgagagtatgatgatcattgatcggctggacggcgtgagactgttatggtccctactcaaaaaccctcatcctgatgtgaaggctagcgccgcctgggccttgtgtccatgtatcaaaaacgctaaagatgccggggaaatggtccggagtttcgttggcggactggagctcatcgtcaacttacttaaaagtgacaataaggaggtcctcgcatccgtgtgtgccgccatcactaatatcgctaaggatcaggaaaacctggctgttatcacagaccatggtgtggtacctctcctgagcaagcttgcaaacacaaataacaataagctaagacatcatctcgccgaggcaatttccaggtgttgtatgtggggccgaaatagggtggccttcggcgagcataaggcagtggccccattagtccgctacttgaaatctaacgataccaacgttcacagagcaacagctcaggctctgtaccaactgtcagaagatgccgacaactgcatcacaatgcatgagaacggcgcggtgaagaaaaatattttcatcagttag

SEQ ID NO: 26847 - DNA, 1839 bp, Artificial Sequence
  Description of Artificial Sequence: Synthetic coding sequence
atgcgggatttcagtctggcccaggagacctgtcagcttgccattcgggacgtcggtggcctagaagtgctaattaatcttctcgaaaccgacgaagttaaatgcaagataggctccctcaagattttaaaggagatttctcacaatccccagatcagacaaaacatcgtagatttgggcgggttgccgatcatggtgaacattctggacagtccgcataaatccttgaagtgcctagcggccgaaacgatcgccaacgttgccaagtttaagagggctcggcgagtggttcggcaacatggaggaatcaccaagctcgtagctcttctagactgtgctcacgatagcactaaacctgctcagtcatccttgtacgaggccagagatgtggaggtggctcggtgcggtgcgctcgccctctggtcgtgttctaagagccacactaataaggaggccatccggaaggctgggggaatacctctcttggcaaggctcttgaaaacatcgcacgaaaacatgctgatccctgtcgtgggcaccctgcaggaatgcgctagtgaggagaattaccgagccgcaatcaaggccgagagaatcatcgagaatctcgtgaagaacttgaacagtgaaaatgagcagttgcaggagcactgtgcgatggccatctatcaatgtgcagaggataaggagacgcgcgatttagtcagacttcacgggggcctgaagcctctggcaagcctcttgaataatacagacaacaaggaaaggctggctgccgtgaccggtgccatttggaagtgtagtatatcgaaagagaatgttactaagtttagggagtataaggccattgagactttggtcggactgttaactgaccaacccgaggaggtattagtgaacgtggtgggtgccttgggagaatgctgccaggagcgcgaaaatagagtgattgtcagaaagtgcgggggtattcagcctctggtgaatctgcttgtgggaatcaaccaggcgctcttggtgaacgtcacgaaggccgtgggcgcctgtgccgtggagcccgagtctatgatgattattgaccgactggacggcgttcgattactgtggtccttacttaaaaatccccacccggacgtaaaggcctcagctgcctgggcattgtgcccttgcatcaaaaacgctaaggatgccggggaaatggtccggtcattcgtgggcggtttagaattgattgtcaaccttcttaaatcagacaataaagaagttctggcctcagtgtgcgccgcaatcacaaacatcgcaaaggatcaggaaaacctcgccgttataactgaccacggagtggttcccctgctcagcaagctggcaaatactaacaataacaagcttaggcatcatcttgcagaggcaatcagtcggtgctgcatgtggggtaggaaccgtgtggcattcggggaacataaagccgtcgcccctttagtccgatacctcaagagtaatgatacaaatgtccacagggccactgcccaggcattgtaccagctgtcagaggacgcggacaattgcattacgatgcatgagaatggcgctgttaaaacagagtccaggcacgtggctagactagagtgctcggataatgatctcggttctcttcaacccccccccccaggctttaaacggttcagctgcctgagtttattgtcatcttgggactattcattctactggatttggttgggccctttgacccgaatctctagaaaactgcagctggtggtatacccgatatctgcgggttggttgctgctgcaacggagacaagacacactggagatatag

SEQ ID NO: 26848 - DNA, 2808 bp, Artificial Sequence
  Description of Artificial Sequence: Synthetic coding sequence
atggctgcagcaaagcccaccctgacggacagtctgtcgttctgcctcgcccagcttgctgctgccgccggagaggccctcgggggagaaaaggatcctgctactaacgagacccctctcagtcgagccttgctggctctgagaacacgccatatcaaggctgccgggggcatcgaacgttttcgggcccgtggaggactgcgccctctcctggctctgctgagacgggccgcagcagccggctccgccccctcacaggccggaccaggatcagcgccctcttccgcagccagtggggcgagctcccccgcccccgcatccggacctgcaccttctgctgtgtcatcatccagccccacccctccggtgcggctcagaaaaacactggacctggcactttcgattttggccgattgctgtaccgaaggtgcctgtaggactgaggtgcggcggctgggcgggatcctccccttggtcacaattttgcaatgcatgaagacagattctattcagaacagaacagcgagagcactgggaaatcttgctatggagcccgagagctgtggtgatatccattgtgccggagccgtgccgctgctggtggaaagtctgacggcatgtcaagactcacagtgtctgcaatcggtggtgcgggctctgagaaatcttgcagatagtccacagcacaggctggccctggcacagcagggcgctgtaagacccttggcggaactccttgccacagcccccgatgccgccctgacccttgccttggtacgggcccttctggagctaagtaggggctgttctcgagcatgcgccgagcagctatctttggggggcggcctggggcctcttgtgagcctggcatcccatccgaaacgcgccgttcgagaagggacaatactgattctcgcaaatctgtgcgcacagggactcatccggccggcccttggcaacgccggtggggtggaggtgctagtggacgagctccggcagcgccgcgaccccaacggagcttcaccaactagtcagcagcccctcgtgcgcgccgtgtgccttctctgtcgagaagcgattaaccgagcacgcctgagagacgctggcgggctggacttgctcatgggtctcctcagggacccaagagcctctgcctggcaccctaggattgtagccgcccttgtcggctttctctacgacacaggagctctggggcggcttcaagctctcggcttggtcccgctgctcgctggccagctgtgtggagaggctggtgaggaggaggaggagggacgcgaggccgctagctgggacttccctgaagaaaggacaccagagcgcgcccaggggggatcttttaggagcctcagaagttggctgatatccgaaggatacgcgacagggcctgatgacatttcgcccgactggagtcctgagcaatgccctcccgagcctatggaacctgcctcccccgcccctaccccaacttcccttagggcgccccgcactcagcgaaccccaggtaggagccctgctgcagccatcgaagagccctgggggcgggaagggcctgctctcctgctgctcagtcgattttcccaagcacctgatcctagtggcgccttggtcacaggtcccgcactgtatggacttctcacatatgtgacaggtgctccgggaccgccttcaccacgcgcgctgagaatcctgtccaggctcacctgcaaccccgcttgtctggaagcttttgttcggtcatatggagcggccttacttagggcttggctcgtcctgggcgtggcccctgacgactggccggcgcccagggctagacccacactgcacagtaggcatagagaactaggtgagcggctgttacaaaaccttaccgtacaggccgagtcaccgtttggcgtgggcgctctgactcacttgctgttgagtggatcaccagaagaccgtgtcgcatgcgcccttactttacctttcatatgccgcaagccgtcattgtggcggcgcctgctactcgaacagggaggactgcgcctcttattagctgcccttactaggcctgcaccccaccccctgttcctcttttttgccgctgattcactgagctgcctgcaagacctggtgtcaccgaccgtctcccccgcagtacctcaggcggtccctatggatttggatagtccaagtccatgtctgtacgaaccactgctgggcccagctccagtgccggctccagatctgcactttctcctcgattccggattgcagcttcctgcccagcgcgcggcctccgcgaccgcatctccattctttagggccttgttgtctggctcctttgctgaagctcagatggatttagtgcctctccgggggctaagccctggagccgcatggcccgtgctccaccacctgcatggttgccggggctgcggtgctgccttaggccctgtgcctccacctggacaacctctgctcggaagcgaggccgaggaggccctcgaggccgccggaaggttcttattgcccggtctggaggaagagcttgaggaggctgtgggcagaatccaccttgggcctcagggagggcctgagagtgtcggagaagtgttccgtctaggaagaccaagactggccgcacactgcgcgcggtggacgctgggatctgaacaatgcccccggaagagagggctggccctggtgggactcgtggaagcagcgggagaggaagccgggcctctgaccgaagccttgctggctgtcgttatgggcatcgagcttggggctagggttccggcttag

SEQ ID NO: 26849 - DNA, 3093 bp, Artificial Sequence
  Description of Artificial Sequence: Synthetic coding sequence
atggttaccttaggggccggagtacgcttatttactggcgtgtatcccgtggtgctgaaccagataagagcgactagcgaggcttctgctatcacccggacaacgatgcccgccccggagttgacctccacctcaagagccgaagacacccgagatactggtgtgcagctaaggaaaaggaagataccgcaggctcgacatagccggaagcgccaacgcactttcagcttccgatccctaggcagtgcagctcgcagcggcgccgagtccgaggcacgcgctaaaatggctgcagcaaaacctactctcactgacagccttagcttttgcttagcgcagttagctgctgctgccggtgaagccctgggcggagagaaagatccggcaacgaatgaaacccctctgagtcgcgcacttctcgcgctcaggacgcgacatattaaggctgccggggggattgagcggttccgcgcgcggggcgggctgcgccctctactggccctgctgaggagggcggccgctgccgggtctgccccatcccaggcagggccggggagcgcaccctcgagtgccgcaagcggggcctcatctcccgcacctgcttctggccctgctccatctgctgttagctcttcctcaccaacccctcccgtcagactgagaaagaccctggatctggcgctgtccattttagcagattgttgtactgaaggagcttgccggacagaggtgcgaaggctcggcggcattttgcctttggtgactatcctgcaatgcatgaaaactgattctatccagaaccggactgctcgggctctgggcaatctcgcaatggaacctgaatcatgtggcgacatccactgtgcaggtgcagtccctctgctggtggagtctttgaccgcatgtcaggattcccaatgcctccaaagtgtggttagggccctgagaaatctggccgattcaccacagcataggctcgccctggcacagcagggtgcagtccgtccgcttgcggagctgctggccaccgcacctgacgcagcccttaccctggctcttgttcgggccctgctggagttgtctcgtggctgtagtagagcctgcgcagaacagctgtccttaggaggaggattgggaccactcgtgtctttggcctcacatccaaagcgcgccgtcagggaggggactattctcatattggccaacctgtgtgcgcaagggctaatcaggcccgcccttggcaacgcaggcggtgttgaagtcttggtcgatgagttacgccaaagaagggacccaaatggcgcctcccccactagccagcagcccctagtccgggcagtttgcctcctatgcagagaggccattaatagggcacggctgcgcgacgcagggggcctggaccttttgatggggttgttgcgggatccccgggccagcgcttggcatccgcggatagtcgccgctctagtgggatttttatacgacaccggagccctggggagactgcaggctctggggctggtgcctctgctggcggggcagctatgcggggaggcaggagaggaggaggaggagggtagggaggctgcgtcctgggattttcccgaagagaggactccagagcgagcgcagggggggtccttcaggtccctcaggagctggttaatttctgagggttacgctacaggaccagacgacattagtcccgattggagtcccgagcagtgtccccccgaaccaatggagcccgcctccccggcgcctacccccacgtccctccgcgcacctcgcactcaacggacccctggccgctccccagcggctgcaatcgaggagccttggggtcgggaaggccccgcgttacttctgcttagtaggtttagccaggctcccgacccaagcggggcactggtaactgggcccgcgctttatggactgttgacatacgtcacgggggcccccggacctccgtcgccaagggcgctccgaattctgagcagactcacttgcaatcccgcttgccttgaagccttcgtcagatcatatggggcggccctgctccgcgcttggttggtcctgggggtggctcctgacgactggcctgccccacgagcacgccccactctgcactccagacaccgggagctgggagagcgcttactacagaatttaacagtgcaggcagaaagccccttcggggttggtgctttgacgcatcttctgctttcaggcagcccggaagatagagttgcttgcgcgctgactctgcctttcatttgtagaaaaccctctctgtggcgcaggttactgctcgagcaaggcggactgagattactgttagccgctcttacacgccctgcccctcatccgctctttctgtttttcgccgccgattctctctcctgccttcaagatctagtgagcccaacagttagtccagccgttccacaggctgtcccaatggaccttgactctccatcaccttgcctgtatgagccactcctcggtccagcaccagtcccagcccctgacctgcactttctcctggattcaggattgcagctgccagctcagagggcagctagcgctaccgccagcccattttttcgcgcactcctcagcgggtcatttgctgaggcccaaatggacctggtgcctctcaggggactgtcacccggtgctgcttggcctgtacttcatcatctgcatggctgtcgaggctgcggcgccgctctgggcccagtgcctccaccaggccagccactgctcggctcagaagctgaagaggccctcgaggctgctggccggtttttgctcccggggcttgaagaggagctggaagaggccgtcgggcgcattcacttgggtccacagggtggacctgaatctgtcggcgaggtgttccgtctgggtaggccccgcctcgcagcccattgcgcgaggtggacactcggttcagagcaatgtccccgaaaacgcggactggctctcgtgggcctcgtagaagccgcaggtgaggaagccggccccctgacagaggccttgctggccgtggtgatgggtattgaactgggcgcaagggtgccagcctag

SEQ ID NO: 26850 - DNA, 1740 bp, Artificial Sequence
  Description of Artificial Sequence: Synthetic coding sequence
atgaagactgatagtatccagaataggacagcgagggctctcggcaatctcgccatggaacccgagagttgcggcgatatccattgcgctggagccgtgcctctcctcgtcgaatccctcaccgcctgtcaggactcccagtgcctccagtccgtggctctggggctggttcctctcttggccggtcagttgtgcggcgaagccggggaagaagaggaggagggtcgggaagccgcctcatgggatttcccagaagagcgtactcccgagagagcccaaggcgggtcgttccgtagtcttagatcctggctgatttccgaggggtatgcaaccggcccagacgatatttctcccgattggtcgcccgaacagtgtcctcccgagccaatggaacctgcgtcacccgcccctacccctacctccctcagagccccccgcacacagagaaccccgggcagatccccggcagctgcaattgaggaaccatggggacgcgagggacctgccctgctgctactatcaaggttctcccaggcgcccgacccttctggagccctggtgaccggacctgccctctatgggctgctgacatacgtcactggggccccgggcccgcctagtccccgggctctgagaattttatctcggctgacctgtaatcccgcttgtcttgaagcatttgtgcgcagctacggcgcggctctactgcgcgcctggctggtcttgggcgtggcccctgatgactggcccgcaccaagagccaggcctaccctacactctaggcacagggagctgggggaaaggctgcttcaaaatctaacagtgcaggccgagtctccttttggcgtgggggcgttgacccacctgctgctgtcgggctctccagaagatcgagtggcctgcgccctaactctcccctttatttgtaggaagccctccctgtggagacgtttgctgctagaacaggggggcctgaggctgcttctagccgctctgacccgccccgcaccccaccccctttttctgttcttcgcggccgatagtctctcatgcttgcaggatctagtctcgcccactgttagccccgctgttcctcaggccgtcccgatggacctggattctcctagcccctgcctgtatgagcctctgctggggccagcccccgttcccgcgcctgacctacacttcctgctagactctgggcttcagttacccgcccagcgagcagcatcagcaaccgcgagcccattttttcgcgctctcctctccgggtcatttgctgaggcccagatggatctggtaccactgagaggattgtctccgggcgctgcctggccagtccttcaccatctgcatgggtgccgcggatgtggggccgctctcggtcctgtgccgccacccggtcagcctctgctcggctcagaggcagaggaagccttagaggcagcaggtcgtttcctgttacccgggctggaggaagaacttgaggaagcagtcggccgcatccacttgggtccacagggggggcccgagtctgtgggcgaggtctttagactgggaagacctaggttagccgctcattgcgcaagatggaccctgggatccgaacagtgccctagaaaacgcggtctggcccttgttggactcgtagaagccgcgggggaggaggccgggccattgaccgaggctctccttgctgtggtgatgggaattgaacttggcgcacgcgttcctgcctag

SEQ ID NO: 26851 - DNA, 2178 bp, Artificial Sequence
  Description of Artificial Sequence: Synthetic coding sequence
atggcggcagcaaagccaacactgacagacagccttagcttctgcctcgctcagctggctgcagccgctggcgaggccctgggcggcgaaaaggaccctgctaccaacgagacacctttgtcccgcgctctcttggcactgaggactcgacatatcaaagcagctgggggaatcgagagattccgtgcacgcggtggtctccgccccctcttggccctgctgcggcgcgcagccgccgccggctccgcaccctctcaggcaggccccggctcggcgccgagcagtgctgcgagcggagcttcttctccagcccctgcctcagggcccgccccctccgctgtgagctcctccagtcccaccccccctgttagactgaggaaaactctggacctcgccctgagcattctcgctgactgttgcaccgagggagcctgcaggactgaggtccgccggttaggagggatattgccattggtgaccatcctgcagtgcatgaagacggacagcatccaaaatcgcaccgcgagggcacttggtaacctggctatggagcctgagtcctgtggcgatattcactgtgctggcgcagtcccattactggtagagtcgctgacagcctgtcaagatagccagtgcctacaaagtgttgtgcgagctctgaggaacctcgccgatagcccacaacaccgcctcgcattggcccagcaaggtgccgttcggcccctggccgaactgctggccactgctcctgacgcggctctgaccctggccctggtccgcgccctcctggagttatctcgcgggtgttcacgcgcgtgtgcagaacaactctcattaggcggaggcctggggcctctcgtcagtctcgccagccacccaaagcgagccgtccgcgaggggactatcctcatacttgccaacctttgtgcccagggcttgatccgccccgctttgggcaacgctgggggcgtggaggtcttagtcgatgagctcagacagaggcgcgaccccaacggcgcatctcctacctcgcaacagccattagtccgggcagtatgcctgctgtgtcgagaggcgatcaatagagcacgcttgagagatgccggaggcctcgatttattaatgggcttgctgcgggatccacgtgccagcgcttggcatcccagaatagtggccgctttggttgggtttctgtacgataccggcgctctgggcagactgcaagctctcggactggttccactgttagcaggccagctgtgcggggaagccggcgaagaagaggaagagggtagagaggccgcatcctgggactttcccgaggagagaactcccgagagagcccagggcggctcatttaggagccttcgcagctggttaatttccgagggatatgcgactggcccagacgacatttcgccagactggtcacctgaacaatgtccccccgagcctatggaacctgcaagtcccgcccctacacctacttcactacgagcgcctcggacccaacgtacccccggacgctcacctgcggccgctatcgaagagccgtggggcagggaaggccctgccctgttattgctctcccgattttcccaggcgcctgacccgtccggcgccctggtgaccgggcccgccctctatggcctcctgacatatgttacaggggcccctggccccccaagccctcgtgcactgcgtattctcagtcggctcacctgtaaccccgcctgtcttgaagccttcgtacgcagctatggagcagcactgctgcgggcgtggctggtactaggggtcgccccagatgactggccagcaccaagggcccgtccgaccctgcattctaggcatcgcgagctgggagaatttccgtatccgcccgttagtctgccaccttgtgagtctcctagcagcccgatggctagcatggggcccgagcctcacttaccaacgcatctcagttcacccgcacggcccccagacaacctgtccccagaatgggggggagagcagggtgtacccgtgcctccctgggcacatcggcagagtagcgctgtgagctctgccctggctttagggccaagatatcctaatagccgctgctctcctgccccccggatctgggccggtttgtgcttctttccaggctcagccatcgggtccgccctctcctag

SEQ ID NO: 26852 - DNA, 2904 bp, Artificial Sequence
  Description of Artificial Sequence: Synthetic coding sequence
atgcacaggccacacgtccctggctgcgccgcaattaaatttagatccctagggagcgccgctagaagtggcgccgagtctgaggctcgtgcgaaaatggcggccgctaagcctaccctcaccgattccctgagcttctgcctggcccagctggccgcagccgctggcgaagctttaggcggggagaaagatcccgcgactaacgagacacctcttagtagagccttgcttgccttacggactaggcacatcaaagctgccggtggcatcgaacgctttagggctcgcggagggttgcgccccttgctcgcactgcttcgccgagctgctgccgccggatccgccccttcccaggccgggccgggcagtgccccatctagtgctgctagcggggcatcctcaccagcacccgcatccgggccagccccaagcgcagttagcagttcaagccccaccccgccggtccgcttgaggaagaccctggaccttgccctgagtatcctggccgattgttgtacagaaggagcgtgtaggacggaagtgcgcaggctcggcgggatactgccgctggtgactattctgcaatgcatgaagacagactccatacaaaatcgaaccgcaagggccctgggcaacctggctatggagcctgagtcctgcggcgatattcattgtgccggagccgttccgctgctggttgaatcactcaccgcttgccaagacagtcagtgtcttcagtccgtagtcagagccctaaggaacctcgcagacagtcctcagcatcggcttgccctggcacaacagggagcggtccggcccttggccgaactgctggccacagctccggatgccgcactcaccctggcgctcgtgcgcgctcttttggagctcagccgtggttgctcccgcgcttgcgccgagcaactctcacttgggggggggttgggccccctcgtgtccctggccagtcaccctaaaagggccgttagggaaggaaccattctgatcttggccaatttgtgtgcacagggcctgatcaggcctgctttggggaatgctggaggcgtggaggtgctggtggatgaactgaggcagagaagggaccccaatggggccagccccacctcccagcagccgttagtgcgagcagtttgccttttgtgccgggaagcgattaatcgcgcccgactgagagatgcaggaggcctggatcttctgatgggtctgctccgagatccgcgggcctcagcgtggcaccctcgaatcgttgcagcattggtcggtttcctctacgatactggcgccctcggacgcttacaggcacttggcctcgtccctctgttggcaggccaactctgcggcgaggccggagaggaggaagaagaaggacgcgaagcggcctcctgggacttcccggaggagcggacccccgagcgtgcacagggaggttccttccggtctctccggtcttggctcattagtgagggctatgctactgggccagacgacataagtcctgattggtcaccagagcagtgccccccagaaccaatggaaccagcctcgcccgcacctaccccaacatctcttcgcgcaccacggacacagcggacacccggccggagcccagcagctgctattgaggaaccgtggggccgggaaggcccagccctgctgcttctttccaggttctcgcaggcacccgatccttccggtgctctggtgaccggacccgccctgtacggccttctgacttatgtgaccggagcaccaggacccccctctccccgggcattgcgcatcctttcccgcctgacctgtaacccagcctgccttgaggccttcgtgcgttcatacggggccgcacttctgcgtgcctggttagttctgggagttgctcctgatgattggcctgcaccccgggccaggcccaccctgcacagccgacacagggagctcggggagcgcttgctacagaacctgaccgtccaggcagaaagcccattcggtgtgggggcattaacgcatctcctgctgtctggttcccctgaagatagagtggcctgtgcgttgaccctgcccttcatttgccgaaagccttcgctctggcggcgtctcttgttggagcagggcggactccgcctgctgctggccgccctgacgcgacccgccccccatccactgttcctcttcttcgccgccgacagcctgagttgtcttcaggatttggtatcacccaccgtgtcaccggcagtcccacaggccgtgcccatggatctggactccccaagcccatgcctgtacgagcccttgctgggaccggcccccgtccctgcccccgatctgcactttctgctggacagcggcttacagctaccggcccagcgagcagcctcagctaccgcctctccgttctttcgtgccctgttaagcggaagtttcgcagaagcccagatggatttagtaccgctgcgcggcctaagcccaggcgcagcctggcctgtcctgcaccacttgcacggatgcaggggctgtggggccgccctgggaccagtcccaccacctggtcagcctctcctgggatcagaggctgaagaggctctagaggcggcagggcgcttcctgctccctggactagaggaagaacttgaggaagctgttgggcgtatccatttaggccctcaaggcggtccggagagcgtcggcgaggtgtttagactcggccgcccccgattggccgctcattgtgcaaggtggaccctcggttccgagcaatgccccagaaagcggggcttagccctggtgggtctggtggaagccgcgggtgaggaggcaggtcccttgaccgaagctctgctggctgtggtgatgggaatcgaactcggcgctcgcgttcccgcctag

SEQ ID NO: 26853 - DNA, 1431 bp, Artificial Sequence
  Description of Artificial Sequence: Synthetic coding sequence
atggtatccaaacgcattgcccaagagacctttgatgccgcagtccgcgaaaatattgaagagttcgccatgggccccgaggaggcggtcaaggaagcagtagaacaattcgagtcccagggcgtggacctaagcaacattgtcaaaaccgcgcctaaggtatctgccgacggaagtcaggagccgacccatgacattctgcagatgctaagcgatctccaagagagcgtggcctcatcacgaccccaggaagtcagcgcttacctgactaggttttgtgaccagtgcaaacaggataaggcatgtcgcttcctggcagctcagaagggcgcatatccaatcatctttactgcttggaaactggcgactgctggggaccagggcctcttgctgcaatcgctgaatgctctgtccgtgctcactgacggacaaccagacttgcttgacgcgcagggtctccagctgctggtcgccaccctgacgcagaacgcagacgaagcagacctcacgtgctcaggaatccgctgtgtgcgacacgcttgtctgaagcatgagcagaaccggcaggaccttgtaaaggccggcgtgctgcctctgctgacgggtgccatcactcaccatgggcatcacacagatgtcgtgcgcgaagcttgctgggcgctcagagtgatgacctttgatgacgacatccgggtacctttcggtcatgcccacaaccacgccaaaatgatcgtgcaggaaaataagggactgaaggttctcatagaagcaactaaagcatttctagataatccaggtattcttagtgaactatgtggtaccctttctagattggccatacgcaacgaattctgtcaagaagtggtggacctggggggactgagcatccttgtgagcctattggccgactgcaatgaccaccaaatgcgcgatcaatccggggtccaggagttggtgaaacaggtgctgtctactttgcgcgcaattgccgggaatgacgacgtcaaggacgcaatcgtgagagccgggggaaccgaaagcattgtcgccgccatgacgcagcatttaacctccccacaggtctgcgagcagtcatgtgccgccctgtgttttcttgccctcaggaaaccagataatagcaggattatcgtggaaggcggcggtgccgtcgccgcgttgcaggcgatgaaggctcatcctcagaaggcgggggtccaaaagcaggcttgcatgctgatccgaaacctagtcgcccatggccaagcattctcaaaaccaatcctggatctcggtgcagaagcactgatcatgcaggcgaggagcgcacaccgggattgtgaggacgtcgccaaggctgccctaagagacctcggatgccacgtggagttgcgggagctttggactggacagcggggaaatctggcaccctag

SEQ ID NO: 26854 - DNA, 1395 bp, Artificial Sequence
  Description of Artificial Sequence: Synthetic coding sequence
atgaccagctgccgatgctcagtgacttctcggtccctatggccagcactggctcctcgtcgctgtcagcacacttcacctgcttccgctcagtgtaaacaggataaggcttgtcggtttttggccgctcaaaagggcgcttaccctattatcttcacagcctggaaacttgccaccgctggagatcaggggcttctgctgcaaagtctgaatgctctgagcgttctgactgacgggcagccagatctgctggatgcacaagggctccagctcctcgtcgcgaccctgacacaaaacgcagatgaagccgacctcacctgctcaggaattagatgtgtcaggcatgcctgcctcaagcacgagcagaaccgccaggatctggtaaaagctggggtgctaccgctgctgaccggtgcgattacacatcatggacatcacacagatgtggttcgcgaagcctgctgggcattgagggtcatgacctttgacgacgacatccgtgttcccttcggacacgcacacaatcacgcaaagatgatcgtccaggaaaacaagggactaaaggtgctgatcgaagcaacaaaagcattcctcgataatcctggaattttaagtgagctatgcgggactttgagcagactagctattcggaatgagttctgccaggaggtggtggacctgggtggtctttcaatcctggtcagcttgctcgctgactgcaatgatcatcagatgcgtgatcagagcggcgtacaggagctggtcaagcaggtcctgtctacgctccgagccattgctggcaatgatgatgtgaaggacgctatagtgcgtgccgggggtacagagtccattgtggccgccatgactcagcacctcacttctccgcaggtatgcgagcaatcctgcgccgccctctgttttcttgctctgagaaagccggacaatagtagaatcatagtcgagggaggaggcgcagtggctgcactccaggctatgaaggctcacccacagaaagcaggggtgcaaaagcaggcgtgcatgctgatccgcaacctggtcgcccacagaccctctcgcagtccctcctggacatgggggcttcggcatagttcttgcaggccagatttaccaacagtaacggtccgaacatggcctagacccccatgtggcacatgggtggtgatgtccagctctgagtcctgtggccaggcccgcggagctacttggcggcatgacccaaggccctccctggtgaccttgggagagtcttgcgactctggaatgggagtcgacccctgtccaccactctcacccattagctcggttcccttcactatgcgctccgtattctggcaagccctgggtaaagggagcggtgaaggcggagctctgtag

SEQ ID NO: 26855 - DNA, 1431 bp, Artificial Sequence
  Description of Artificial Sequence: Synthetic coding sequence
atggtgagcaagagaatcgcccaggagaccttcgatgccgcggtgcgggaaaacatagaagagtttgcaatggggcccgaggaagccgtcaaggaggccgttgagcagttcgagtctcagggtgtggatttgtcaaatattgtcaagactgccccaaaagtgagcgccgacggcagtcaggaacctacccacgacatcttacagatgctgtcggatctgcaggagtctgtggccagctcacggccacaggaggtgagcgcttacctaacgaggttttgtgatcagtgtaagcaggacaaagcgtgtcggttcctggccgcacagaaaggagcctaccccattatttttacggcctggaagcttgcaacagctggagatcagggcctgctgcttcaatccctcaacgccttatccgtcttgacagatggccagcctgatctgttggatgcgcaggggctgcaactcttggtggctaccctgacccaaaacgctgatgaagccgatcttacctgtagcggaatccgctgcgtcaggcacgcttgcttgaaacatgaacagaatcggcaggatctggtcaaggcgggcgttctccccctgctgacaggtgccattacacaccacgggcaccacactgatgtggtgagggaagcgtgttgggctctgcgggtcatgacctttgacgacgatatcagggtcccctttggacatgcccacaatcatgctaagatgattgttcaggagaacaaggggctgaaagtgcttatagaggccaccaaagcctttctagacaaccctggtattttatcagaactatgcgggaccctctcgaggcttgccatcaggaacgagttctgccaggaggtagtcgacttgggcggcttgagtattttggtcagcctgctggccgattgtaatgatcatcagatgagggatcaaagcggcgtgcaggagttggtgaagcaagtgctgtcgacactgagagccattgcggggaacgacgatgttaaagacgccattgtcagagctggcgggaccgaatccatcgtggccgcgatgactcagcacctgacttccccccaggtgtgcgagcaatcttgcgcagccctctgtttcttggccttaaggaaacctgataatagtaggataattgtggaaggagggggcgctgtggctgcccttcaggctatgaaagctcaccctcagaaggcaggtgtgcagaagcaagcgtgtatgctaattagaaatttggtggcccatgggcaagcattttctaagcccatcttagatctgggagccgaagccctgattatgcaggctcggtcagctcaccgggactgtgaggatgtggccaaggcggctctcagggatctgggctgccatgtggaacttcgcgagctatggactggtcagcgggggaacttagctccatag

SEQ ID NO: 26856 - DNA, 1506 bp, Artificial Sequence
  Description of Artificial Sequence: Synthetic coding sequence
atgagcgagagatgctgctcccgctattcctccggggctagcatcggatgtacccccacgtccacccaggccaaaatggtttcaaaacgcattgcccaggagacctttgacgccgccgtacgcgaaaacattgaggaattcgccatggggcctgaagaggcagtcaaagaagccgtcgagcagttcgagtcacagggggtggacctaagtaacattgttaagactgcacccaaggtgtcggccgatggctcccaggaacctacccatgacatactgcagatgctatccgatctacaggaaagtgtagccagtagtagaccacaagaggtcagtgcatatttaacgagattttgtgatcaatgcaagcaggataaagcttgtagattccttgccgctcagaagggcgcttatccaattatattcaccgcatggaagttagccaccgccggcgatcaggggctgctgctacagagtcttaatgcactcagcgtcctgactgacggtcagcctgatctattggacgcccagggtctacaactgctagtagctaccttgacacaaaacgcagacgaggccgatctcacctgttcagggatccgctgtgtcagacacgcctgtctaaaacacgaacaaaatagacaggaccttgtgaaggcgggagtgctccccctgctgacaggagctatcacccaccatggtcatcataccgacgttgtgagagaggcctgttgggccctacgcgttatgactttcgatgatgacatccgagtgcctttcggccatgctcacaatcatgcaaaaatgatagttcaggaaaataaagggctcaaggttctcatcgaggcaacaaaagccttcctggataacccagggatcctgtcggagctatgtggcaccttaagcagactagcaatccgaaatgagttctgccaagaggtggtcgacctcggggggttgagtatcctagtatctctcttggccgattgtaacgatcaccagatgcgggatcagtccggagtccaggagttggtaaagcaggtgctgtcaaccctgcgggccattgcaggtaacgatgatgtgaaagatgccatcgtccgcgctgggggtacagagagtattgttgcagcaatgacgcagcatctaacatctccccaggtctgcgagcaaagttgcgctgcgctctgttttctcgctctaagaaaacctgacaacagcaggattatcgtcgaagggggcggcgctgtggctgctttacaggccatgaaagcacacccccagaaagcaggagtgcagaagcaggcgtgtatgctgattcgcaatctcgttgcccatggacaggccttttctaaaccaatccttgatctgggcgcagaggctctaatcatgcaagccagaagtgctcatagggattgtgaagacgtcgccaaagcagcactccgagacctcgggtgccatgtggagttacgggagctctggacaggacagagaggcaatctggccccctag

SEQ ID NO: 26857 - DNA, 1506 bp, Artificial Sequence
  Description of Artificial Sequence: Synthetic coding sequence
atgagcgaacgatgctgtagccgatactccagcggggcttcaatcggctgcactccaactagcacgcaagctaaaatggtgtctaaacgcatcgctcaggagaccttcgatgcggccgttcgcgagaacatagaagagttcgcaatggggccagaggaggccgtgaaggaggctgttgaacagttcgaatcccagggggtggatctcagtaacatcgttaagacagcaccaaaggttagcgccgatgggagccaggagcccacccacgacatactgcagatgctgagcgatcttcaggagtcagtcgcttcttctaggccacaggaagtgtctgcctaccttacccggttttgcgaccagtgcaaacaggacaaagcctgccgattcctggcagcccagaaaggggcataccccattattttcactgcatggaaactcgcgacggcaggggaccagggcctgctgctgcagagcctgaatgccctgtctgtgttgactgatggacagcctgatctcctggacgcccaggggctccaacttcttgtcgcaactcttactcaaaatgccgacgaggctgatttgacgtgctcgggaattcgctgtgtgcgacacgcctgcctcaaacacgagcaaaaccgacaggatctcgtgaaggctggggtgttacccttgttgactggcgctattacccaccatggccatcacacagacgttgtccgggaggcctgctgggccttaagggtgatgacctttgacgatgacatcagggtgccttttgggcatgctcataatcacgctaaaatgattgtgcaggaaaacaagggcctcaaagtgctaatcgaagcgacaaaggcattcctggacaatccgggcattctgagcgaactatgcgggacactgagccggctggccatccgaaacgaattctgccaggaggtggttgatctgggtggcctgtcaatcctggtgagcctcttggccgattgcaacgatcaccaaatgagggatcagagcggtgttcaggagctcgtaaagcaggtgctcagcaccctgcgagctatcgcagggaatgacgatgtgaaggacgctatcgtaagagcaggtggcactgagtccatcgtggcagccatgacacaacacttgacaagcccccaggtctgtgagcagagctgcgctgcgctgtgcttcctggccttgagaaagccggacaactccaggataatcgtagaaggtggcggagctgttgcggctttacaggctatgaaggcccacccccagaaggcaggcgtccagaagcaagcgtgcatgctcataagaaaccttgtcgcccacgggcaggctttttccaagcccatcctggaccttggcgccgaagctctgattatgcaggctcgctcagcgcaccgcgactgcgaagacgtggccaaggccgccctacgggacttgggctgtcatgtggagttgagagaactctggacgggccagcgggggaacctagcaccctag

SEQ ID NO: 26858 - DNA, 213 bp, Artificial Sequence
  Description of Artificial Sequence: Synthetic coding sequence
atggtcagtaagaggatcgctcaggaaacctttgatgccgcagtgcgagagaacatcgaggagttcgcaatgggtccggaggaggcagtgaaagaggccgtggagcagttcgagtctcagggcgttgatttgtctaatatagtgaagacagccccaaaggtgtctgccgatggctcccaggaacccacgcacgacattctccagatgctctag

SEQ ID NO: 26859 - DNA, 774 bp, Artificial Sequence
  Description of Artificial Sequence: Synthetic coding sequence
atggtctccaagcgcatcgcccaggaaacctttgacgccgctgtgagagaaaacatcgaggagtttgccatgggtcccgaggaggccgtcaaggaagccgtggaacaattcgagagccagggagtagacctgtcaaacattgttaaaactgctcccaaggtgagcgcggacggcagtcaagagcccacccatgacatcctgcagatgttaagcgatctccaagagtcagtagcctcatctaggccacaggaggtcagcgcctaccttacaagattctgcgaccagtgcaagcaggataaggcttgccgctttttggcagcacagaagggcgcctatcctatcatttttaccgcgtggaagctcgcaaccgcgggagatcaagggttgctgttacaatcactgaatgccttgagcgtgttgactgacggccagccagacctattggacgctcagggattgcagcttctcgtcgccacacttacccagaatgcagatgaagcggatctcacatgttcaggcattcggtgtgtcagacacgcatgtctgaagcacgaacagaaccgccaagacttggttaaagccggagtcctgccattgctgaccggagcaattacccaccacgggcaccacacggacgttgttagggaggcgtgttgggccttaagggtcatgacattcgacgatgacatccgggtaccatttggtcacgcccacaaccatgctaaaatgattgtccaggaaaataagggacttaaagtgctgattgaagcttag

SEQ ID NO: 26860 - DNA, 312 bp, Artificial Sequence
  Description of Artificial Sequence: Synthetic coding sequence
atggtttcaaagcggatcgcacaggaaacttttgacgcagcagtaagggagaacatagaggagttcgcgatgggcccggaggaggctgtgaaagaagctgtggagcagttcgaatctcagggggtcgatcttagcaacatcgtcaagacggccccgaaagtgtccgccgacgggtcccaggagcctactcacgacatcctccagatgctttccgacctccaggagtctgtagctagctctaggccacaagaagtttctgcctatttgacaaggttttgcgaccagtgcaagcaggataaggcctgccggtag

SEQ ID NO: 26861 - DNA, 246 bp, Artificial Sequence
  Description of Artificial Sequence: Synthetic coding sequence
taaaaggcccacccacagaaagctggcgttcagaagcaggcgtgcatgctgatccgtaatctggttgcccacggacaggcatttagcaaaccgattttagatctgggcgcagaggccttaattatgcaggcccgctcagcccatcgggactgtgaggacgtggctaaggcagcgttgcgagacctcggctgccacgtggagctccgcgagctctggacgggccagcggggcaatcttgccccatag

SEQ ID NO: 26862 - DNA, 93 bp, Artificial Sequence
  Description of Artificial Sequence: Synthetic coding sequence
atggtgtctaagcgcatcgcccaggagacttttgatgctgctgtgagagagaacattgaggaattcgctatgggtcctgaggaagcagtctag

SEQ ID NO: 26863 - DNA, 486 bp, Artificial Sequence
  Description of Artificial Sequence: Synthetic coding sequence
atggtcagcaagcgaattgcgcaggaaacctttgacgccgctgtgagggaaaatatcgaggagtttgcgatgggacctgaggaagccgtgaaagaggccgtcgaacagtttgaatctcagggagtcgacctgtcaaatattgtaaagactgcaccgaaggtgtcagccgacgggtctcaggaacccacacacgacatcttgcagatgctaagcgacctgcaagagtctgtggccagttctcgcccccaggaagtgtccgcctatctaacacggttctgtgaccagtgcaaacaggataaggcctgtaggtttctggctgcacagaagggtgcctatccaattatctttaccgcttggaagttggctactgccggggatcaaggactcttgctgcagagtctcaatgccctctcggtgcttaccgatggacagcccgacctgctcgatgcacaaggccttcaattgctggtcgctaccttaacttag

SEQ ID NO: 26864 - DNA, 492 bp, Artificial Sequence
  Description of Artificial Sequence: Synthetic coding sequence
atgtcagaaagatgttgcagtcggtattcatcgggagcttccatcgggtgtacccccacgtctacgcaagccaagatggtgagcaaacggatcgcccaggagaccttcgatgcagctgtgagagagaacatcgaggagttcgcgatggggcccgaagaggccgtgaaagaagccgtggagcaatttgagagtcagggcgtcgatttgagcaatatcgtcaagacagcaccaaaggtgagcgccgacgggtcacaggagcctacacatgatatcctgcaaatgttatctgatctgcaggagtccgtggcgtctagtagaccgcaagaagttagcgcttaccttaccaggttttgtgaccaatgcaaacaggataaggcttgccgatttcttgccgctcaaaaaggtgcttaccccatcatctttacagcgtggaaactggccactgcgggggatcagggcctcctgttacagagcttgaatgccctcagttag

SEQ ID NO: 26865 - DNA, 780 bp, Artificial Sequence
  Description of Artificial Sequence: Synthetic coding sequence
atggtgagcaaaagaattgctcaagagactttcgatgcagcagtaagggagaacatagaggaatttgccatgggccccgaagaagctgtgaaggaggcggtggagcagttcgaatcgcagggggttgacttgagcaacatcgtcaaaacagccccaaaagtaagcgccgatggctctcaggagcccactcatgacatactacagatgctctccgatctgcaagagtccgtggcgtccagccggccccaggaagtgagtgcctacttaactcggttctgtgatcagtgcaaacaggataaagcttgccgatttctggcagcacagaaaggagcttacccaatcattttcacagcatggaagctggccaccgccggggaccagggattattgctgcagtctctcaatgccctctccgttctgacagacgggcaaccggacctgcttgatgcccagggccttcagctgctggtcgcaacgctgacacaaaatgccgacgaggccgatctgacctgctctggaatccggtgtgtacgtcatgcctgcttgaagcacgagcaaaacagacaagatctagtcaaggcgggagttctcccactccttactggggcaattacacatcacgggcaccacacagacgtggttagagaggcatgctgggccttacgggtgatgacattcgatgacgacattagggtgccatttggacatgcacacaaccacgctaagatgatcgtgcaggaaaataagggtttgaaggtgctgattgaggcgactaaatag

SEQ ID NO: 26866 - DNA, 597 bp, Artificial Sequence
  Description of Artificial Sequence: Synthetic coding sequence
atggctcagaaaccaaaggtcgaccctcatgtgggccgattgggctatttgcaagccctggttaccgagtttcaggaaacgcagtctcaggacgctaaggagcaggtgctggcaaatcttgctaactttgcttacgacccctccaactacgaatacttgcgccagcttcaggtgctggatctgttcttggacagcttaagtgaagaaaatgaaacacttgtggaattcgctataggaggcttgtgtaacttgtgtcccgacagggccaataaagaacatattcttcacgcggggggcgtacctctgattattaactgtctctctagtccaaacgaggagacagtgctgtcagccatcaccaccctcatgcatttgtcccctcccggaaggagtttcctgccggagctaacagcgacccccgtcgtgcagtgcatgttacgcttctccttgagtgccagcgcaagactccgcaacctcgctcagatcttccttgaggacttttgctccccccggcaggtggctgaggccagaagccgccaggctcactcggccttgggaattcccctgccgcgttccgtggctccccggcagagatag

SEQ ID NO: 26867 - DNA, 1158 bp, Artificial Sequence
  Description of Artificial Sequence: Synthetic coding sequence
atggaagtgactgccagtagccggcactacgtcgatcggctgttcgatccggatccgcagaaagtgctccagggagtgatagacatgaaaaatgctgtcatcggcaacaacaagcagaaagccaacctgatcgttttgggcgccgtgccccggctactctacctgttgcagcaggagacttcaagtacggaactgaagacggagtgcgcagttgttctcggaagtcttgctatgggtacagagaacaacgtgaagagtctcttagactgccacattattcccgcactgctacagggtttgctctctccagatctaaagttcattgaggcttgccttcgctgtcttaggacgatctttactagtccggtgacccccgaagagcttctgtataccgacgctaccgtgatcccgcacctcatggcactactttcaaggtctcgctacactcaggagtatatctgtcagattttttcccattgctgcaagggtcccgaccaccagacgattctgttcaaccatggcgcggtccagaacattgcacacctgctgacgagcctgtcctataaggtgagaatgcaggcgctaaaatgtttctctgtgctggcgttcgaaaacccccaggtgagtatgacgctcgttaacgtcctggtggatggtgagttactgccgcagatctttgtgaagatgctacaaagagataagccaattgaaatgcagctgacatcagccaagtgcttgacatacatgtgccgggcgggggctattagaacagacgacaactgcattgtccttaagactctcccttgtcttgtgcgcatgtgttctaaagagcgcctgctggaggagcgtgtggaaggcgctgagacgcttgcctacttgatagagcccgatgtagaactccaacggatagcaagcatcaccgaccaccttattgcaatgttagccgactattttaagtacccaagttcagtttccgctatcaccgacataaaacgcttggatcatgacttgaaacacgctcacgaactgcggcaggctgccttcaagctttatgcgagcttgggagccaatgacgaagatatcagaaaaaaagttagcctgggcgagggtcgaccacctgtgcttacagcttcccgccaaggggtgacatccacctag

SEQ ID NO: 26868 - DNA, 1992 bp, Artificial Sequence
  Description of Artificial Sequence: Synthetic coding sequence
atgagtgtcctgtccgaagtgacagcgtcatctaggcattacgttgaccgcctgttcgaccccgatccccagaaggtgctgcaaggagtgattgacatgaaaaatgcggttatcggaaataataaacaaaaggccaacttaattgtcctgggggccgtccctaggctcctgtacctcctgcagcaagaaactagctctacagagctcaagactgaatgcgctgtcgttcttgggtctctggccatggggactgagaataatgtgaaatccctgcttgactgccacattatccccgctctcctgcaaggtctcttgtcccccgacctcaagttcatcgaggcctgcctgaggtgcctgagaacaatcttcactagtccagtgactcctgaagagctcttgtacaccgacgctactgttatcccacacctcatggccctcttgtcccgatcccgatacacacaggagtacatatgccagatcttctcacactgctgcaagggccccgatcaccagaccatcctgtttaaccacggtgctgttcaaaatatcgcacacctcttgacgtctttgagttacaaggtgcggatgcaagctcttaaatgtttttcagttctggctttcgaaaatccccaggtatcgatgacactggtgaatgtcctggttgatggggaacttctacctcaaatctttgtgaaaatgctgcagcgggacaaacccatcgaaatgcagctgacctctgcaaaatgtctgacttatatgtgccgagccggggcaatcaggaccgatgataactgtatcgtcctaaagacactgccatgcctagttcgtatgtgtagcaaggaaaggctcctggaggaacgggtggaaggcgctgaaaccctcgcctacctcattgaacccgatgtggaactccagcggatcgcatccataacagaccatttaatcgccatgctcgctgactacttcaagtatccttcaagtgttagcgcgattaccgacataaagcgactcgaccatgatctgaaacacgcccatgaactgcggcaggcagctttcaaactatacgcaagcctgggtgcaaatgacgaggacattcgtaagaagatcatagaaacagagaatatgatggacagaattgtcacagggttaagtgagtcgtctgtgaaagtgcgcctggccgcagtgcgctgcttgcactcgttgtctcgcagcgtccagcagctgcggacgagctttcaggatcatgccgtgtggaaacccctcatgaaagtgttgcagaacgctcccgatgagattctcgtggtggcgtcatccatgctctgcaacctactgttggaattttcaccaagcaaagagcccattctggaatctggtgcagtcgaattgctgtgcggccttacacagtccgagaacccagcactaagagtgaatggtatctgggcacttatgaatatggccttccaggctgagcagaagattaaggccgatattctcagatccctgtccactgaacagcttttccgattgcttagcgattccgatctgaatgtgctgatgaaaaccttagggctgctaaggaatttactgtctactcgtcctcacattgacaaaattatgtcaacccatggtaagcaaattatgcaggccgtgacacttatcctggagggtgagcacaacatcgaggtaaaagagcagaccctatgtatcctcgccaatatcgctgacggcacaacggccaaggatttgattatgaccaacgatgatattctgcagaaaattaaatattacatgggccacagccacgtgaaattgcagcttgcagccatgttctgtatctccaacctgatttggaatgaggaagaagggagccaagagcgtcaggacaaactccgagatatgggtatcgtggatattctccacaagctgtcccagtcacccgatagcaatttgtgtgacaaggccaaaatggctctccagcagtatctggcctag

SEQ ID NO: 26869 - DNA, 597 bp, Artificial Sequence
  Description of Artificial Sequence: Synthetic coding sequence
atggcttgtctcctggaaacacccatacgcatgtccgtcctctctgaagtcactgccagctctcgccattatgttgaccggctcttcgacccagatccacagaaagttctgcagggagtgatcgatatgaagaacgccgtgataggcaacaacaagcagaaggccaacttgatcgtgctcggtgccgttccgcgcctgttgtatcttcttcagcaggaaacttccagcacggaacttaaaacagaatgtgccgtggttcttggaagtttagcaatggggaccgagaacaatgtgaaatccctgctcgattgccacatcattcctgccctgctccaaggtctgctgtctccggacctaaagttcatcgaggcatgtctgcggtgcctcagaacgatcttcactagtccagtgactcctgaggagcttctctacacagacgcgactgtgatcccccatcttatggcccttctgtcacggtccaggtacacccaggaatacatctgtcagatatttagtcactgctgcaagggtcccgaccatcaaacgatcctgtttaaccacggcgccgttcagaatatcgcccacctgctaacgtag

SEQ ID NO: 26870 - DNA, 393 bp, Artificial Sequence
  Description of Artificial Sequence: Synthetic coding sequence
atgaaaaacgccgtcatagggaataataaacagaaggcgaatctgatcgtgctaggtgccgtacctcgtctgctgtacttgcttcagcaagagacaagctctactgaacttaagaccgaatgtgcagtggttttggggtctctcgccatgggcacagagaataatgtcaagagcttgttggattgccacatcatcccagcactgttgcagggcctgctgagtccggacttgaagtttattgaagcttgcctccggtgtctgcggactattttcacgtcgcccgtgacccctgaagagctgctttacactgatgccaccgtcattccacatttgatggccctcctatctcggtctcgatacacccaggagtacatctgtcagattttttcttag

SEQ ID NO: 26871 - DNA, 81 bp, Artificial Sequence
  Description of Artificial Sequence: Synthetic coding sequence
atggaggtgacagccagcagccggcactacgtagaccgcctctttgacccggaccctcaaaaggtgctccagggagtttag

SEQ ID NO: 26872 - DNA, 2022 bp, Artificial Sequence
  Description of Artificial Sequence: Synthetic coding sequence
atggcctgcctgctcgagacgcccatcaggatgtcggtgttgtcagaggttacggcctcttctcgtcattatgtcgacaggctgtttgacccagatccgcagaaagtattgcagggcgtcattgacatgaaaaacgccgttatcggtaataacaaacagaaggccaacctgattgtgctgggggctgtgcctaggctgctatatctgctccagcaggagacaagttccaccgagctcaaaactgagtgtgccgtcgtcttaggctctctcgcgatgggaaccgaaaataacgtgaagagcttgttagactgccatattattccagccttgctgcaaggcctactctcccctgacttgaaatttatcgaggcttgcttgcgatgcctaaggaccattttcactagccccgtcacccctgaggagctgctgtacacagatgccacagtgataccccatctgatggcattgctctctcgtagccgttacacccaagaatacatctgtcagatctttagccactgctgcaagggtcccgaccaccagacaatcctgttcaatcatggggcagtccagaatatcgcgcacctgctaacatccctttcatataaggtacgaatgcaggcgctgaaatgttttagcgtcttggctttcgagaatcctcaagtttccatgactctagtcaatgttttggtagatggggagctgcttccccagattttcgtcaagatgctgcagcgtgataagcctattgaaatgcagctgacctcagccaaatgcctgacatatatgtgtcgagccggggcaataagaactgatgacaactgtatcgtgttgaagaccctgccctgcctcgtgaggatgtgctctaaagagagactgctggaggagcgggtggaaggcgctgaaacactcgcctacctcattgaacccgacgtggagctgcagaggattgcaagcatcacggaccacctgatagccatgctcgctgattactttaaataccccagcagcgtatcagccatcacagacattaagagacttgatcatgatctcaagcacgctcatgaactgcgccaagctgcattcaagctgtatgcctccctgggcgccaatgatgaagatatcaggaagaaaatcattgaaactgagaacatgatggacagaattgtcactggtctctcagagagttcagtcaaagtgcggttagcggccgtcagatgtttacactccctgtcaagaagcgtccagcagttgcgcacctcattccaggaccatgccgtctggaagccattaatgaaggttttacaaaacgctcctgatgagatcttggtagtggcttccagcatgctgtgcaatttgctcctcgaattctccccttcgaaagaacctatccttgagtctggggccgtggagctcctgtgtggcctcacacagagtgaaaaccccgctctgcgcgtgaacgggatctgggccctgatgaatatggcgtttcaggccgagcaaaaaattaaagctgacatcctaagatccttgtccacagaacagctcttcagactgttgtctgacagcgaccttaatgtactcatgaaaaccctggggctgctgaggaacctgcttagcacacggccccacattgacaaaataatgtcgacccacggcaaacaaattatgcaggctgttactctgatcttggaaggggagcacaatatagaggtgaaagagcagacactctgtattcttgctaacattgctgacggtacaacggctaaagacctcataatgacaaatgatgatatacttcagaaaataaaatactatatgggacactcccacgttaaactccagctagcagcaatgttttgtatttctaatctcatttggaacgaggaggagggtagccaagagcgtcaggataagctccgtgacatgggcattgtggacatccttcataaactctctcagagcccggattccaacctatgtgacaaggccaagatggccctgcagcagtatctcgcctag

SEQ ID NO: 26873 - DNA, 1158 bp, Artificial Sequence
  Description of Artificial Sequence: Synthetic coding sequence
atggaggtgactgcttcctcccgccactacgttgataggttatttgatcccgaccctcaaaaagtactgcagggggtaatcgatatgaagaatgccgtgatcggtaataacaaacagaaagcgaatctgatagtcctcggcgcagtgcctcgtctgctgtatcttcttcaacaggagacctcttccaccgagctcaaaacagagtgtgccgttgtgttggggagcctggccatgggcacagaaaacaatgttaagtcactcctggattgccacataatccctgctctcttgcagggcctactcagccctgacctaaagttcattgaagcttgtctgcgctgtctgcggaccatcttcacgagcccggtcacccctgaggagttactgtacacagatgcaacagtcataccacatctgatggcgctcttgagtaggagcaggtacacccaggaatatatctgccagatattctcacactgttgcaaagggcccgaccaccagacgattctgtttaatcacggggcagtgcagaacattgcccaccttctgaccagtctttcttataaagtaaggatgcaggctctgaaatgcttttccgtgctggcattcgagaatccacaagtgtccatgaccttagtgaacgtgctggttgatggcgaactgttgccacagatttttgtgaaaatgctgcaacgcgataagccgatcgagatgcagcttacctctgcgaaatgtttaacctatatgtgccgcgccggagcaataaggaccgatgataactgtatcgtcctcaaaaccctgccatgcctcgtcagaatgtgctcgaaggagcgccttctggaggaaagggttgagggcgccgagaccctggcttatctgattgagcctgacgtggagctgcaaagaatcgccagcatcacggatcatttaatagcaatgttggcggattactttaaataccccagcagcgtgtcagccataactgacattaagaggcttgatcatgatctgaagcacgcacacgagctcaggcaggccgcattcaaactgtacgccagcctgggagccaacgacgaagacatccgcaagaaggtgtcactaggcgaggggcggccccccgttcttactgcttcaagacaaggggtcacctccacttag

SEQ ID NO: 26874 - DNA, 1980 bp, Artificial Sequence
  Description of Artificial Sequence: Synthetic coding sequence
atggaagtgaccgcttcttcgaggcattacgtggaccggctattcgacccggaccctcagaaggtcctgcagggagtcatcgacatgaaaaacgctgtcatcggtaacaataaacagaaggccaatttgattgtgcttggcgctgtccctcgactgttatacttacttcaacaggaaacatcttctactgaactgaagacagagtgtgccgtggtgttaggaagcctggcaatggggaccgagaataacgttaaaagtctactggattgtcacattatccctgccctgctgcagggtctcctgtctcctgatctcaagttcattgaagcttgcctccgatgcctgagaactatattcacatccccggttacgcccgaagagctgctctatactgacgctactgttattccacacctgatggcactgcttagccgctctaggtacacacaggagtacatttgccagatcttcagccactgctgcaagggtccagatcaccagaccatcctgttcaatcacggggccgtccagaatatcgcacacctgctgacctccctatcctacaaggtcagaatgcaggccctcaaatgtttttctgtgctcgcctttgaaaaccctcaggtttcgatgacccttgttaacgtgttagtggacggtgaactcctgccacagatctttgtgaagatgctacagagggacaaaccgatcgagatgcagctcacttccgccaaatgtctcacctacatgtgtcgggctggagccatcagaactgatgataactgtatcgtgttgaaaaccttaccttgcctggtacgcatgtgctctaaagagcgactgctggaggaaagggttgaaggcgccgagacgctcgcatacctgattgagcccgatgttgaactacaacgaattgcttctataacagaccatctgattgccatgctcgccgattattttaagtacccttcctcggtgtccgccataaccgacatcaaacgtctggaccacgatctcaagcacgcccatgagctcaggcaggctgcattcaaactctatgcttccctaggggccaatgacgaagatataagaaagaagattattgagaccgaaaacatgatggacagaattgtcacgggactctcagagagctccgtgaaggtgcgcctggctgccgtaagatgtcttcactctctgtccagatctgtgcagcaactgcggacttcctttcaggatcatgcggtctggaagccccttatgaaagtattgcagaacgcgcccgatgaaattctggtggtggcttcaagtatgctgtgcaacctgctgcttgagttcagccctagcaaagagccgatcctggagagtggggcagtggaactgctgtgtggtctcactcagtccgaaaatcctgccctgagagtgaacggcatttgggctttaatgaacatggcatttcaggcggagcaaaaaatcaaggctgacatcctgcggagtttgagtaccgagcaattgttccggctcctttccgacagcgaccttaacgtcctcatgaagactctgggtctcctgaggaatctcctatccacccggccacacattgacaaaattatgagcacacatggcaaacagatcatgcaggcggtgacattgatactggaaggggagcacaatatcgaggttaaggagcagactctgtgcatactggcaaacattgccgacggtaccactgccaaagatttaatcatgacaaatgatgatatcctgcaaaagataaagtattacatggggcactctcatgtaaaactgcagctcgcagctatgttctgcatctcgaatctgatatggaacgaggaagagggttcacaagagcgtcaagataaactccgggatatgggcatcgttgatattctgcataagctctcacagtctcccgatagcaacctatgcgataaggccaaaatggcactgcagcagtatctcgcgtag

SEQ ID NO: 26875 - DNA, 1896 bp, Artificial Sequence
  Description of Artificial Sequence: Synthetic coding sequence
atgaaaaatgctgtcataggtaataacaaacagaaggcaaatctaattgttctgggggccgtgcccagactgctctatctgctgcagcaggagacttccagtaccgagctcaaaacagaatgcgcggtcgtgctcggatccctcgccatgggcactgagaataatgtgaagtcattactcgattgtcatataattcctgccttactgcaagggctgctgtcgccagatttgaagttcatagaggcctgcctaagatgcctgcgcaccatttttacgagccccgtgacgcccgaggaactgctgtacactgacgccaccgtgataccacatctgatggccttgctgagcagatcacgttatacccaggagtacatttgccaaatcttctcacattgctgcaaaggcccagaccaccagaccatactcttcaaccacggggctgtgcagaacatagcccacctgctcacctccttatcgtacaaagttcggatgcaggcactgaagtgtttctcagtgttagccttcgaaaaccctcaggtctctatgacattggttaatgttctggtggacggagagctgctaccacagatcttcgtgaagatgctgcagagggataagcccattgagatgcagctcacgtccgctaaatgtttgacgtatatgtgtcgtgccggtgcgattcggaccgatgataattgcatcgtgttgaagacgctgccctgcctggtgcggatgtgctctaaagagcgccttctcgaggaacgagtagagggagcagagacactcgcatacttgatcgaaccagacgttgaattacagcgcattgccagtattacagatcatcttattgctatgcttgcagattactttaagtacccctcttctgtgtcagccataacagatattaagcggctggatcatgacctgaaacacgcacatgaactgaggcaggcggctttcaaactctacgcttcgctgggggcaaatgatgaagacatcaggaagaaaatcatcgaaacagagaatatgatggatcgaatcgtgaccggcctttccgaatcctctgtgaaagttagactggcagccgtgcggtgcctccattctctctctcggtctgttcagcagctaagaacgagcttccaagatcatgccgtctggaaaccactgatgaaagtgctgcagaacgcccctgatgagattctcgttgtggcatcttccatgctgtgcaatctgctgctggagttcagcccttcaaaggagcctattctcgaaagtggagcggtggagcttctctgcgggctgactcagtccgaaaaccctgccctcagggttaatggcatctgggcgcttatgaacatggcgttccaggctgagcaaaaaataaaagcggatatactaaggtctctgagcaccgaacagctcttcagactgttgagcgatagcgaccttaacgtactgatgaagaccctggggctactgaggaatttgttatccacgcgtccgcatattgacaagatcatgtctacccatggtaagcaaataatgcaggccgtaacacttatcttagaaggagaacataatatcgaggtcaaagagcagaccttgtgtatactcgcgaatatcgcagatggaacaactgccaaggacctcatcatgacgaacgacgatattttgcagaaaatcaaatactatatggggcatagtcatgtaaagctccagttggccgccatgttttgtatttccaatcttatctggaacgaggaggaaggatcacaggagcgccaggacaagctccgcgacatgggcatcgttgatatcctgcacaagctgtctcagagcccagattctaacctgtgcgacaaggcaaagatggctctccaacagtacttagcctag

SEQ ID NO: 26876 - DNA, 1929 bp, Artificial Sequence
  Description of Artificial Sequence: Synthetic coding sequence
atggcctgccttctcgagacccctattcgcatgtcagtactctccgaagtaaccgcttcatcccgccactacgtggatcgattgtttgatcctgaccctcaaaaagtccttcagggggttatcgacatgaagaacgccgttatcgggaataacaagcagaaggcaaacctgatagtcttaggggccgtgccacggctcttatacctattacagcaggaaacaagcagcaccgaactcaagaccgaatgtgccgttgttctggggagtctcgccatgggaacagaaaataatgtgaaaagtcttctagactgccatattatccccgccctcctgcaggggctgcttagtcctgatctgaagtttatcgaggcatgcctccgctgtctccgcactatctttacgtccccagtgacgccagaggagctactctatactggtcctgaccaccagaccatcctgttcaaccatggagcagttcagaacatagcacacctgctcacatcactgagctacaaggtgagaatgcaggctctgaagtgtttttccgtccttgcgtttgaaaatccccaggtatccatgaccctcgtcaacgtgcttgtcgatggcgagctgttgccacaaatatttgtgaaaatgctgcagcgagataagcccatcgaaatgcagctaacttcggccaagtgcctgacatacatgtgccgggctggggcaatccgaactgatgataattgcatcgtcctgaaaacattgccctgtttagtgcggatgtgcagcaaggaacggctgttggaagagcgtgtagagggagccgagacgctggcctatctaatcgagcccgatgtcgagcttcagagaatcgcttctataaccgaccatctgatcgcaatgcttgcagactacttcaaataccccagctcggtgagcgccataacagatatcaaaaggctggatcatgacctgaaacatgcacatgagctgagacaggccgcatttaaactttacgcctcactgggcgcaaacgatgaggatatcaggaagaagattatcgaaaccgagaatatgatggatcgcatcgtgactggcttaagcgaaagttccgtgaaggtgcgtctggctgctgtgagatgtctgcactcattgtccaggtccgtccagcagctaagaacctcttttcaagatcacgccgtgtggaaacctctcatgaaggttttgcaaaatgcccccgatgaaatcttggtggtggccagttctatgctgtgcaacctgctgttggaattctcaccttcgaaagaaccaatcctcgagagtggagcagtggagctgctgtgtggcctgacacagtctgaaaaccctgcattgagggtgaacggcatctgggctctaatgaacatggctttccaggccgagcagaagatcaaagccgacattctccggtccttgagcacagagcagttgttccggctcctctcagactccgacctaaacgtcctgatgaaaactctgggcctcttgcgaaacttgctgagcactcgcccacatatcgacaagataatgtccacccacggtaagcaaataatgcaggccgttactttgatattagagggggaacataacatcgaagtgaaggaacagaccttgtgtattctcgcaaatattgccgacgggacaaccgcaaaggatcttatcatgaccaatgacgacattctccagaaaattaagtattacatgggtcactcccatgtcaagctgcagttagcggcgatgttctgcatatccaatctaatatggaacgaagaagaaggctcccaggaaagacaggacaaattgcgcgacatgggaatcgttgatatcctccataagttaagccagagtccggattctaacctgtgtgacaaagcgaagatggcgctccagcagtacctggcctag

SEQ ID NO: 26877 - DNA, 1593 bp, Artificial Sequence
  Description of Artificial Sequence: Synthetic coding sequence
tatcaggatgctacagttattcctcatctcatggctctattgtcgagaagcaggtatacacaggaatacatctgtcagatattttcccactgctgcaaagggcccgaccaccagaccattctcttcaaccacggcgcagtgcaaaatatagctcatctgcttacatccttgagttataaggtgagaatgcaggcgctcaaatgtttctcagtcctggcttttgaaaatcctcaggtgtctatgaccctggtcaatgtgctggtcgatggcgagttgttaccacagattttcgttaagatgcttcagcgggataagcccatcgagatgcaactgacttccgcgaaatgcttgacctatatgtgccgggcgggtgccattaggaccgacgataattgcatcgttctgaaaactctgccatgtctcgtgagaatgtgttccaaggaaaggctgctggaggagcgtgtggaaggagccgagaccttagcctacctcatagaaccggatgtggagctacagcgcatcgcttccattaccgaccacctcattgccatgctggccgactatttcaaatacccttcttcggtgtccgcgattaccgacattaagcggctcgaccatgatctgaaacacgctcacgagcttcggcaggccgccttcaaattgtatgcctccctgggcgcaaatgatgaggatatccgtaagaaaatcattgaaacggagaacatgatggatcgcattgtgactgggctgagtgagtccagcgtgaaggtgcgcctggctgccgtcaggtgcctgcacagcctgagcagaagcgtgcagcagctgagaaccagctttcaggaccacgccgtttggaaaccacttatgaaggtcctccagaatgcaccagatgaaatcctagtcgtggccagctcaatgctttgcaacttgctgttggaattctctccatcaaaagagcccattcttgagagtggagcggtggaactgctgtgcgggttgactcagtctgagaatcctgccttaagagtgaatgggatttgggctttgatgaatatggcctttcaggcggagcagaaaataaaagccgacatcctcagatccctctctacggaacagctgtttcggttgttgagcgattctgaccttaatgtgttgatgaagacacttggattgttacggaatctcctaagcaccaggcctcatatcgacaagattatgagcacccacggcaaacagatcatgcaggccgtcacattgattctggagggcgagcacaatatcgaagtaaaagagcagaccctgtgcattctagcaaacattgctgacgggactaccgccaaggatttgatcatgaccaatgatgacattttacagaaaatcaagtattatatgggccatagccatgtgaaattacagctagccgcaatgttttgtatttccaacctcatctggaatgaagaagagggctctcaggagaggcaggataaacttagggacatgggcattgttgacatactgcataagctgtcacagtcacccgattctaatttatgtgataaggcaaagatggctctgcagcagtacttagcctag

SEQ ID NO: 26878 - DNA, 1998 bp, Artificial Sequence
  Description of Artificial Sequence: Synthetic coding sequence
atgggagacatacttgctcacgaaagcgagcttctcggattagtcaaggaatatctagacttcgccgagtttgaagacacgttgaagactttttcaaaagaatgcaagatcaaggggaagcccctgtgtaagaccgtcggcggctccttcagagatagcaagtccctcaccatccagaaagaccttgttgcagccttcgacaatggagaccagaaggtattctttgacctatgggaggaacacatttcaagcagtattcgggatggcgattcttttgcacagaaactcgagttctacctgcacattcattttgctatctaccttcttaagtacagcgttggtcgacccgataaagaagagctagatgagaagatttcctattttaagacatacctggagactaaaggggctgccctgtctcagaccactgaatttctacccttttacgcccttcctttcgtccctaaccctatggtccacccctcttttaaggagctgtttcaagactcttggactccagagttgaaactcaagctgattaagttcttggccctgatctcaaaagccagcaatactcctaaactgctgacgatctacaaggagaatggtcagagtaataaagaaatattgcagcaattgcatcagcagctggtggaagccgaacgccgatccgtaacgtatcttaagaggtacaacaagatccaggccgattaccataatttgattggagtcacggccgaacttgtcgactcactagaggctaccgtcagtggtaagatgatcacccctgaatacctccagtcggtttgtgttcgcctgttctcaaaccagatgcggcagagcttggcgcatagcgtggactttacgaggcctgggactgcatcaacaatgctccgcgcaagtttagcaccagtcaagttaaaggatgtccctctgctgccgtcgctagattatgagaagcttaagaaggatctcatcctcgggagtgacagactcaaagcctttctccttcaggctctccgttggcgactgacaacgtctcaccccggcgagcagcgcgagaccgtccttcaagcgtatatttcaaacgatctgctcgactgttattcacataaccagagatccgtgctgcagcttctccatagcacttccgatgtggtccgccaatacatggcaagactgatcaatgcctttgctagcttggccgaaggtagactttatctcgcacagaatacaaaagtgctccagatgctcgaaggtagacttaaggaagaggacaaggacataattacgagagaaaacgtgctgggagccctccagaaattctctctcaggagacctctccagaccgctatgattcaggacggactcatcttttggttggttgatgtcctgaaggacccagactgtttgtctgattataccctcgaatacagcgttgctctgttaatgaacctctgtttgaggtccacaggaaagaacatgtgtgctaaagtggcaggattagttcttaaggtcctgagcgatttgctggggcatgaaaaccacgaaattcagccgtatgtgaacggagcactgtactcaatcttgtctgtgccatcaatacgcgaagaggcgagggcgatgggaatggaggatatcttgcggtgcttcataaaagaaggcaatgcggagatgatccgccagattgagttcattatcaagcagcttaattctgaagagctgcctgatggggtcttggagtccgacgatgacgaagacgaggatgatgaagaggatcatgatatcatggaggccgacttggacaaggatgagctgattcaaccacagctgggagagctgtctggcgagaagttattgaccaccgagtatctgggaattatgaccaacacaggaaaaactaggcgaaaaggtctggcaaacgtccagtggtctggcgatgaaccgcttcagaggccagtgacaccaggaggacacaggaacggctatcccgtttag

SEQ ID NO: 26879 - DNA, 2451 bp, Artificial Sequence
  Description of Artificial Sequence: Synthetic coding sequence
atgggtgatatactcgcccatgaatcagaactcctcgggctagtcaaggagtatctggatttcgccgaatttgaagataccctgaagacgttcagcaaagagtgcaagattaagggaaaacctctgtgcaagacggtgggtgggagcttccgcgactcgaaatccttgacaatccaaaaagacctggtcgccgctttcgacaacggcgatcagaaggttttcttcgatctctgggaagagcatatttcatcttcaattagggacggagatagctttgctcagaaattggagttctaccttcacatccatttcgctatctacctgttgaagtacagcgtgggcagacctgacaaagaagagcttgacgagaagatatcttattttaaaacctacctcgaaacaaaaggggctgctcttagtcaaaccaccgaatttcttccattctacgctctgcccttcgttcccaaccctatggttcatcctagtttcaaagagctctttcaggattcttggaccccagaattgaagttgaaattgatcaagttccttgccttaatttccaaagcgtccaatacccctaagttgttgacgatctataaagagaacggccagagcaacaaggagattttacagcaactgcatcagcagctcgtggaagcagaacgccggagtgtcacgtatctgaagcgctacaataaaattcaggccgattatcacaatctgattggtgttacagccgagctagttgactctttggaagccacggtcagcggcaaaatgatcacgcccgaatacctccaatcagtgtgcgtgcggctgttctcaaatcagatgcgtcaatccctcgcccactctgtggattttactcggcccggcaccgctagcacgatgcttcgcgcgtcgctggcaccagtgaaactgaaggacgttcctctgctaccttcgctcgactatgaaaagctgaaaaaggacctgattctgggaagcgatagactcaaagccttcctcctccaggctctccgctggaggctcaccaccagtcacccaggagaacagagagaaaccgtgctgcaggcttacatctccaatgatcttctggattgctacagccataaccaaaggagcgtgctccagttacttcattctacctcagatgtggttcgtcaatacatggcccgcctgattaatgcgttcgcttctcttgctgagggtagactgtacttagcacagaatacaaaagtactgcagatgttggagggccggctcaaagaggaagacaaggacatcatcacccgggaaaacgtgctgggagcactccagaagttcagcttgcgtcgccccctgcagacagcaatgattcaggatgggctaatcttttggttggtcgacgtgctcaaagaccccgattgcctgagtgactatactctcgaatattccgttgcgctacttatgaacttatgtttgagatcgacaggcaagaatatgtgtgccaaggttgccggcctggtcctgaaggtgctcagtgatttgctcgggcacgaaaatcacgaaattcagccctacgtgaacggagcactgtacagtattcttagtgtgccttccattcgtgaagaagcccgggcgatgggtatggaagatatcctgcggtgttttatcaaagaaggtaacgcagagatgattcgccaaattgaattcatcatcaaacaactgaattcagaggaactacccgacggcgtgctcgaaagtgatgacgacgaggacgaggacgatgaagaggaccatgacataatggaagcagacttggataaggatgagctcatacaacctcagcttggcgagctgtctggtgagaagttacttactactgagtacctcggaattatgaccaatacaggcaagacaaggcgaaagggcctcgcaaatgtgcagtggagcggagatgagcctctgcagaggccggtgacaccaggaggccatcgcaatggataccccgtggtggaggaccagcacacaccacctcaaaccgcccaacacgcgagaaatgggcacccacaagccttgccagcagctcacgaagccgtgtatcgagagggcaaaccttctacccctgagtcctgcgtctcttcttccagcgcgattattgctaaacccggcgagtggcttccacgcggccgccaggaggaaccacgccctgcacccactcctagacagcctagagaagccccccaagaccctggcaacggggtgaccactagagagtgtgcatccgcctttacttgtaagcctcgcgccccctgcactcctgaaatgttggattggaatcctcctaaggcgaaggcctccgtgttggcaccactgttctccagctgcggaccccagcaggctagccgcccagggtccactgcttcttctacccgaggactcccttccaaggagacgcaccctaagtag

SEQ ID NO: 26880 - DNA, 501 bp, Artificial Sequence
  Description of Artificial Sequence: Synthetic coding sequence
atgggtgacatcctggcccatgaatccgagctcctggggttggttaaggaatatctggattttgcggaattcgaagacactcttaagacattttctaaggaatgcaagataaaagggaagcctctctgtaaaacagtaggagggtctttccgggactctaaaagcctgaccattcagaaggacttggtcgctgcattcgacaacggtgaccagaaagtgtttttcgacctttgggaggagcacatttccagttccatcagggatggcgattccttcgctcagaagctggagttctaccttcatattcactttgctatttacttactcaagtacagcgttgggaggcccgataaggaggagcttgacgagaaaatcagctatttcaaaacctatctcgagacaaagggagccgcgctgagtcaaacgacggagttcttgccattctacgccctgccatttgtgccaaatcccatggtacatccaagttttaaggagctgtag

SEQ ID NO: 26881 - DNA, 1140 bp, Artificial Sequence
  Description of Artificial Sequence: Synthetic coding sequence
atgggatacgccaggaaggtcggatgggtgaccgcaggtctcgttatcggtgccggtgcttgctactgtatataccggctgacccggggaaggaaacagaataaggaaaagatggcagaaggcggctccggagacgtggatgatgctggcgattgtagcggtgccagatacaacgattggtcggacgatgacgacgattctaatgagtccaagtcgattgtctggtaccccccatgggctaggattgggacagaggccggtacccgagcacgggctagagcgagagctcgagcaactagagcacggcgcgccgtgcagaagcgtgccagccccaattctgatgacaccgtgctgtcccctcaggagcttcaaaaggtcctctgtcttgttgagatgtctgaaaaaccttacattctggaggcggcactaattgccctgggcaacaatgccgcatatgctttcaatagggacattattcgggaccttgggggactcccaatcgtggccaagattctcaacacacgcgatccaattgtcaaagagaaagccctgatagttctcaacaatctgtcggtgaacgccgagaaccagcgtaggctcaaggtctatatgaaccaggtttgtgacgacactatcacctctcgcttgaattcctccgttcagcttgcaggccttcgactgctcaccaacatgactgttactaacgagtaccagcatatgctggctaattctatttccgacttctttagactctttagtgccggcaacgaagagaccaagcttcaggtgctgaagcttctgctcaacctcgctgagaatccagcgatgacccgcgaattacttagggcccaagttcctagcagcctaggttctttattcaataagaaagagaacaaagaagtgatcctcaagctgcttgttatcttcgaaaacatcaacgataacttcaagtgggaagagaacgaaccgacccagaatcagtttggcgaaggaagcctgttcttttttctcaaggaattccaggtgtgcgcagataaagtgctggggattgagagccaccacgacttccttgtaaaagtcaaggtgggtaagttcatggctaagctcgctgagcatatgtttccaaaatctcaagagtag

SEQ ID NO: 26882 - DNA, 1140 bp, Artificial Sequence
  Description of Artificial Sequence: Synthetic coding sequence
atgggctacgcacgtaaagtaggatgggtgaccgcagggctggtaatcggcgcaggagcttgttactgtatttatcgtctaacaaggggcaggaagcaaaataaggagaagatggcggagggcgggtccggagacgtggatgatgcaggcgactgtagcggggccagatataatgactggtctgacgacgacgacgactcaaatgaatcaaaaagcattgtgtggtatcccccgtgggcccggatagggactgaagccggcactagggcgcgggcacgggcccgggcacgagcaacacgtgccagaagagccgtgcagaaacgagcatctccgaattccgacgataccgtgttatcccctcaggagttacagaaagtcctttgtctagttgaaatgagcgaaaaaccgtacatactcgaagcagctcttatcgccctcggcaacaacgcagcgtacgcctttaatcgcgacattatcagggacttaggagggctcccgatcgtagccaagatcctcaacacgagagaccccatcgttaaagagaaggcattaatagtactgaataacctgagcgtgaatgcggagaaccaaaggagacttaaagtgtacatgaaccaagtctgcgatgacacaataacatcccggctcaacagctccgtgcaactggccggcctgcggctgttaaccaacatgacggtgactaacgaatatcagcacatgttggccaattccatcagcgattttttccgtctgtttagtgccggcaatgaagagaccaaactgcaagtactgaagttgttgttaaatttggctgaaaacccagctatgacccgggagctgcttagagcacaggttccctctagcctcggctcactgttcaacaaaaaggaaaataaagaggtgatactgaaactgctggtgatctttgaaaacatcaacgataattttaaatgggaggaaaatgaacccacacagaaccagttcggagaagggtccctgttcttttttctgaaggaattccaagtttgtgcggataaggtgctggggattgagagtcaccacgatttcctggtcaaggtcaaagtggggaagttcatggcaaagctagccgaacatatgttcccaaagtcacaagaatag

SEQ ID NO: 26883 - DNA, 6873 bp, Artificial Sequence
  Description of Artificial Sequence: Synthetic coding sequence
atgggccggatccaggaggtgggctgggtcacagccggactggtaatatgggctggcacatgctactacatatacaagttcactaagggaagggctcaatcagtgcggacactggcaaggaatgggagtacagtgaagatggaaaccgttgttggagtgcaaagccagacactggctattaatgaggccgagattaaaacaaagccccaagttgagattggcgctgagactggcgctaggtccggaccacgagccgaggtggaaaccaaggcgactgcaatcgccatacatcgcgccaattcacaggccaaggctatggtcggcgctgagcccgaaacgcagtctgagtctaaggttgtggcaggaactcttgtgatgacggaagcagtgactctgaccgaggtaaaagcaaaagcccgcgaggtggccatgaaagaagctgtgacccagacagatgcagaagctggcaagatagtcaaaaaggaggcagtcacgcaaactaaggctaaggcctgggctttggtggctaagaccgaggcaaaacgcgaggctatgactcaaacaaaggccgagacccacatcctcgcagagaaggagactgagatcaaccgcgtaatggtgacacaaagcgagacgttggctgtccctcgcgaggttgctaaaatgggggcgacgaacaaaaccggtatcgtggatgagactaaaacccgggctcttgaagagacagtgtctgtcgcaaaaacacagtcagaggcacggcccggcgcaactgttgacgctaggggaaatcccaacggaatgtctcgggaagtggctggcgtggatatgaagtcctgcgctcagtctcaagccgtgaccaagattcagggtgacgatatgcccgggacaggtgtggaagacatgggaaattgtaaaactatgagcagagccgaaagcggtgccgacacacgagcctctgctcagccccaaatctttgcaaaaacacagactgaggccatccccggggcaaaaattgatgcaggcgggaacacaaacgccatgtgcaaggtcggcgccggagccgacgtcagagcttgtattcagccacagactgtggctaagaaacaggccgaagtgaccagtggagcacgcgtggacggtaggggtaacacaaacgtcatctctaaggcaatcactggcgccgacatgcgcgctgcagcccagccccaagcggtggcatcaactcatgcagaggctatgagcgatgctaaggtgaaaaataggggaaatccgaacgccatgaccaaagcaggtgccaaggcgaatctcagagccaattctcaggtcgaggccctgcccgacgcacgcgataagtcaagggggaaccccaatgtaatggcaaaagttggtgacggaacagacatgctatcttgtacccagccccagctcgtcgcgtccgtacaggccgatactctgtcagatggcaagattaaggtgcgcggcaatgttaatactatgcctaaagagggcgccggggttgatatgaaagcccagggtatggcccagtcacaaggggaggcattacctaataccaggggtaaagctcgcgggaaggccaaggcaaagtgcaagacagggccagggatggacatgaagacttgcacacagccacaggcaggcgtcaagacaccagcagaggctctgctggatagcagggtggatggtcgaggcaatcctaacgcgacgtcaaaggccggtaccaaggccgaccaaagagtctgtggtcagcccttggtggtggccaatccgcagggggaagccttacccggagccaaaaataaggtgaaaggtaatcctcataccgtgctgaaggttggggctggcgaaggtacgactgactctgcccaacctgaggccgttgtgagctttcagggtgaagccctgctgggaacaaagaacaaagttaaaggcaacccaaatgtagttctgaaggctgaggtgggcgaaggagccatgggcacggctcagctgcagatcatggccagtagcaagggcgaggccttactggatagcaagaataaagtgaaagggaatagcaatgcagtctctaaggctggagccggcacagacacaaccggctcagtccagccacagattgtcgcgaacagtcagggggaagttctgcctggcgctaaaaataagattaggggaaaccctactaccgttcctaactcaggggtcggaccctataccacggacagcgcccgtcttcaggcagtcgccaattctcagggagaagttctgcccggagctaagaataaggtgaaggccaacctgaatgccgtctctaaggctgaagccggcatgggggctaccggcagtgtgcaaccccaagctgtggctaactcccactgtgaaacactaccaggagctaaaaacaaagtcagagggaactggaatgcagtctccaaggccggcgcagggatggatacaagaggctctgcccagcctcaggctgtggctaactctcagggggaagtgctgccgggagccaagaataaggtcaaaggcaaccccaatgtcgtaagcaaagctggggcacgagaagacactgtaggaagtacccagccccaggtcctagccagttcccaaagagagactctgcccggcgcccgaaataaagttaagggcaactccaatgtcgtgtcaaaagcgggtgcacgcgaagacacaatgggctctgcgcagccccaggtcgtggccaattctcaacgcgaaacactccccggggcacgaaacaaggttaaaggaaattcaaatgctatcagtaaggctgaagctggggccggcatcatgggctctgtgcaggttcaggtagtggcaagtttccaaggcgaggtgctgccaggcgccaagaacaaggtccgtgggaactcgaacgcggtaccaaaagcagaagccggtgcagataccgtgggcagcgcccagccacaagcagttgcaaattcacagagcgaaactctgctcggggcccggaataaggttaagggcaatacgatagccgtgcccaaagccgggactggagctggcacccgtcacagcgcgcagccccagatcgttgccggaagtcaaggggaaactcttcccggagccagggataagagtatgtcaacatctgaggccgaagctaccgccgaagacgaagcctacgcgaaacccgaggcagaggctatgccgaccagcgagagtgagggggggtccggcacccaggcctgtaggaagacacaaccgaacatccacgactactattggaatggcatcggagtagaggattggatagcagcagagcggtggattaagtttagattccagaccatggacggtgactgggagaattccgtcagctgggcagatgacgagaacgaagcttcgattggcagttggtctggagctagtgataaagcaggaatcattcgtagttgggccgtagcatgtgacgagacctccgtaaagtcgtgggctggggcccgggctgagaatgtggtgggtattggaacatgggccagggccggcgaacaggcctcaggcgggctgtgggctggcggtcagacaagtgaagggacttgggccggcgacaaagctagcggaggtgcgtggactggggccgaaaaccaggcatctggcgggtcttgggcgttggcggggaaccaggcaattggtgaactgtgggccgcgggtcaggcctcagatggtagttggccaggagggcaggcttcgggggtcagctgggttggggaagaagctatcggaggatcttggaccggagcggaaaaccaagcctcggaagggagctgggcaggcgctggcgctggcaacatgtcctcagtgagctactgggccggagtggtggaccaagcgggaggggggtcttgggctggtacatcggaccaaagtggcggaggatcgaagccacgattcgaggaccaagccagtggcgagggaagttgggccggagccggtggacaggcatctggcggatcgatgcttggtccagaagatcaaagctcagggaggtcctgggccgatacggctgatcaggcttccggcggctctcgacttggccatgttgaccagtcgtcaggcggcgcttgggccggcactctcgaccagtctggcggggggtctaagccgagattcgaaaaccagacaactgaggaggggtcatgggcaggtgcaggagggcaggcaggagggggatcgaaagtgggcccagaggatcagtcatcgggacgctcctgggcgaattctggggaccaaatctccggggggtttcttgttgggatcgtggatcaggctaatggcggctcgtggacgggcgcagggcatcctgcgagcgtcggcccgaagcctatcttcgaagatcaggtttcagggcgcggatcatgggccgacgccagggagcaagtagtaggcgacagtcggctcggtctccgcgaccagtcttccggagacagttgggctgacaccggcgatcaggcctccggctggttctgtgtctgcccaggtagtcagacaaatggagggagctgggggggagcatcggggcaagacgtagggggatctaggcccggaccgacaaatcagagctcagctggttcatgggactctcctggctcacaggtttccggctcgtgctggacaggggccggagcagtagatcaggccggcggctgtagcaaacctggttttgaagaccaggctattgggggcggcttttggcctggcgccggggatcaaactggaggcggtagccggcccggctcagaagaccagtccagtggaatcggctcctggggagtcgcgggaggacaggttctcggtggggcgcgaccggggcctgcggaccagtcctctggagggtcatgggccggtacgggtaaccagtccagcgggcgctcgtggattggcccgggcgatcaggctgttgactgctcaaaacctgagttcgaggatcaggcctgcggggggggctcttgggccggggcaggttctcaggccagcggcgagtcctgggccgggtccaggccaggaaacgaagccatcggtggatcgaggatgggaagtgaagaccaggcaacgggcggctcttgggctcggagcgaggaccaggcctctggacggttccaggtgtcttttgaggttgaagcaaacgaaggattctggtttggccctggagcggaggcagtgatcggttcttggtgctggactgaagagaaggccgatattgttagcagacccgacgacaaagacgaggctactacagcctctagaagtggagccggggaagaagcaatgatctgcagccggatcgaggcggaaaacaaagcgagtagcggcagctggatcaggtccgaagaagtagcatacatgggttcttgcgtaggagcagaggccggggctggcgccgaagccggcgccggggcggaagctggggccggtgctggagcagaggctggagcggaagcaggggcaggagctggagccggccccgggactgagtcaggcgcaggcatctggagctgggatggagatgcaacaactgtggaatcccggctgggcgcaggcgaagaagcaggcgtggagtcttggaccctcgctagaaatgtcggtgaggacgaattaagccgcgagagcagccccgacatcgaagaaatttctttgaggagtctcttctgggccgagagcgagaatagtaatacttttcgatctaaatccggaaaagatgcctcattcgagtccggtgccggcgacaacactagcattaaagataaatttgaagccgccggaggcgtagatataggctcctggttttgcgcaggtaacgaaaacacaagcgaggacaaatccgctccaaaggcaaaggcaaaaaagagctccgaaagtcgcggtatttacccatatatggtaccaggcgcagggatgggatcttgggacggcgcgatgatctggagtgagacaaagttcgcccaccagtctgaagcctcatttccagtggaggatgagtcacggaagcagacgaggacgggagaaaagaccagaccctggtcctgccgctgcaaacacgaagccaatatggatcctcgggatctggaaaagctcatctgcatgatcgagatgacagaggacccaagtgtgcacgagatcgctaacaacgcactgtataacagcgctgattattcatattcccatgaagtggtgagaaatgtggggggcattagtgtaatagaatccctcctgaataacccctacccctctgttcgacaaaaggcccttaatgccctcaacaacattagcgtggctgcagagaaccacagaaaggtaaagacctatctgaatcaagtgtgtgaagataccgtgacctacccgctgaactctaacgtccaactagccggactacggctgatcaggcacctgaccatcactagtgagtaccagcacatggtgaccaactacatttctgagtttctaagactgctgaccgtcggctccggcgagactaaagaccacgtgctagggatgctgcttaacttctcgaagaatccttccatgacgaaggatctactgatcgccaatgcacccacaagcctgatcaacattttctcaaaaaaagaaaccaaggagaacattcttaatgccttatccctgttcgagaacattaattatcatttcaaacggcgcgcgaaggccttcacacaggacaaattttctaagaactcactgtactttctctttcagcgccccaaggcctgtgccaagaagcttcgcgcccttgccgcggaatgcaatgacccagaagtgaaggaaagagtggaactccttataagcaaactatag

SEQ ID NO: 26884 - DNA, 903 bp, Artificial Sequence
  Description of Artificial Sequence: Synthetic coding sequence
atggggcgagcacgcgaagttggctggatggccgccgggctgatgataggagctggtgcatgttactgtgtgtacaagcttaccattgggcgcgacgattcagaaaagctggaagaggaaggtgaagaagaatgggatgacgatcaggagttggacgaagaggaacctgatatttggttcgacttcgaaaccatggccaggccttggaccgaagatggagactggaccgaacccggagccccgggcgggaccgaggatcggccatcaggaggggggaaggccaatagggcccaccccattaagcagcggcctttcccatatgagcataagaacacctggtccgctcagaactgtaagaacggcagctgcgtcctggacctcagtaagtgtttattcatacagggcaagctactattcgccgagcccaaagatgcaggctttccatttagccaggacatcaacagtcacttagcaagcctcagcatggctcggaacacttcaccgacgccagatcctacggtgagggaggccctctgcgcccctgataatctgaacgccagcatagagtcccaggggcaaatcaaaatgtatattaacgaagtatgcagagagactgtttctcggtgttgcaactcatttctgcaacaggcaggcctcaacctcctgatctcaatgaccgtaattaataacatgcttgctaagagcgcctctgatctgaaatttccactaatatctgaaggctcaggttgcgcaaaggtgcaggttttgaaacctttaatgggtctctctgaaaaaccagtgctcgccggagagttggtgggagcccagatgttgttcagctttatgtcgctcttcatacgtaatggcaatagagagatcctgctcgagaccccagcaccttag

SEQ ID NO: 26885 - DNA, 903 bp, Artificial Sequence
  Description of Artificial Sequence: Synthetic coding sequence
atgggcagggccagagaagttgggtggatggctgccggtttgatgatcggcgcaggtgcctgttactgtgtgtacaagttgactattgggagggatgacagtgaaaagctcgaggaggaaggtgaggaggagtgggatgatgaccaggaactggatgaggaagaacccgatatttggttcgatttcgaaaccatggctagaccatggacagaagacggcgattggactgagcctggggctcccgggggcaccgaggataggcccagcgggggaggtaaagctaacagggctcaccccatcaagcagagacccttcccctatgaacacaagaacacatggtctgctcagaattgtaagaatggatcctgcgtcctggatctgtccaaatgtctgttcattcaaggcaagttgctcttcgccgaacctaaggatgctgggttccccttcagccaagacattaactcccatctcgccagcctttccatggcccgcaataccagcccaaccccagacccaaccgtcagagaggccctgtgtgcccctgacaaccttaacgcttcgatagaaagccagggccagattaagatgtacattaatgaggtgtgcagggagactgtgtctagatgctgcaacagttttctccaacaggctggactaaatctgctgatatcaatgaccgttatcaataatatgctggccaagtctgcctctgacttgaagtttccattaatcagtgaaggtagcggttgcgccaaggtgcaggtgctcaaaccactgatggggctgagtgagaagcccgtgctggccggcgagctggttggagcacagatgctgttttcattcatgagcctttttattcggaatggcaacagagaaattctgctcgagacaccagccccctag

SEQ ID NO: 26886 - DNA, 903 bp, Artificial Sequence
  Description of Artificial Sequence: Synthetic coding sequence
atgggacgtgcaagagaggtggggtggatggccgctggactgatgatcggagccggggcttgttactgtgtgtacaaactaacaattggccgggatgacagcgaaaagctggaagaagaaggcgaggaggagtgggatgatgatcaggaactggatgaagaggaacccgacatctggttcgacttcgaaaccatggccagaccatggactgaggacggtgactggacagagccgggtgcacctggcggcacagaagaccgcccttcaggcggtgggaaagccaacagggcccacccgatcaaacagcgtccgtttccttacgagcacaagaacacctggagcgcccagaactgcaaaaacggcagttgcgttctggacctgagcaaatgcctcttcatccagggcaaactcctgttcgcagaacccaaggacgcaggatttcctttctctcaggacatcaacagccaccttgcgagcctctcaatggcgaggaatacctctcctactccagaccccacggtgcgcgaagcgctctgtgctccagacaacttgaacgcatccatcgagtcacagggacagattaaaatgtacatcaatgaggtctgcagagagaccgtatctagatgttgtaattcgttccttcagcaggctgggctcaacctcctgatctctatgacagtgattaataatatgctcgccaagagcgcctcggatctgaaatttccgttgatctcagaaggcagtggctgtgcgaaagtacaagtcctgaagcccctgatggggctgtccgaaaaacctgtactcgccggggaactggtaggggcccagatgctattttcttttatgtctcttttcatccgaaatggcaatagggaaatcctgttggaaacccccgccccctag

SEQ ID NO: 26887 - DNA, 1677 bp, Artificial Sequence
  Description of Artificial Sequence: Synthetic coding sequence
atggtggattctggaactgaagctagagctagagggaaggccgaggctgggctccaggatgggatctcaggacctgccacagcccgggtgaatggcaagacccaggccgaagcagtagctgaagcagaactgaagaccgagtctgtgacccaggccaaggctggagacggagcgatgaccaggactcatacggtaacatacagggaggctatggcagttacccgggaggttattaaggtcgaggataccaccaaaacacgagtgatggttgaaaccaagactaagccactcgctgaacggtcgatcgtgccgcagaccaaatccaaagccatgcccatgtcaagggtgtctaccgtgaccaagagcgaggtgaaagtagtagcggtgattgaggccaacattcggtcctacgccaaaagccacgataaagccaatactggcagcagacctgaccgccgggaagaaacgtcaatcggcatgaaaagttccgacgaggatgaggagaatatctgtagttggttttggaccggcgaagagccctccgtcggttcttggttctggccagaagaggagacttcgttgcaggtgtacaaaccgttaccgaagatccaggagaagcccaagcccactcacaagccgactctcacaattaagcagaaagtaattgcgtggagcagagcaagatacatcgtgttggtgcccgtggaggggggcgaacagtcacttcctccagagggcaactggaccctggtagagacattgattgagactcctttgggcattcgaccacttactaagatacccccttaccacggcccatactatcaaacactggccgagatcaagaagcagatcaggcagcgcgagaagtatgggcctaaccccaaagcctgccattgtaaatcccgtggcttcagcctcgaacctaaagagttcgataaactcgtggcccttctcaagctgacaaaggatccctttattcacgagatcgctactatgatcatggggatatctcccgcttatccatttacccaagacattatccacgacgtgggtataacagtcatgattgaaaacttagtgaacaaccccaatgtgaaggagcaccctggggccttgagtatggtagatgactcttccgagtcaagcgaggagcccaagtccggcgaatcttacattcaccaggtgtgtaaggggatcatctcctgcccccttaacagtcctgtccagctggccgggctgaagcttctagggcatctgagcataaaatttgaggaccattatgttatcacatcatacattcccgattttttgacattgctcaacaaaggcagcgtgaagacaaagttctatgtgttaaaggtgttttcttgcctgtcaaaaaaccatgcgaatactagggagctgatctctgcaaaagtcttgtcgagcctcgtcgccccattcaacaagaacgagagcaaagcaaatatacttaacattatcgaaatcttcgaaaacatcaattttcagttcaagaccaaagccaaactgtttacaaaggaaaagtttacgaagtccgaactgattagcatctttcaggaagccaaacagttcggtcagaaactgcaggacctcgctgaacattctgaccccgaggttagggacaaggtaatacggctgatactgaagttgtag

SEQ ID NO: 26888 - DNA, 1677 bp, Artificial Sequence
  Description of Artificial Sequence: Synthetic coding sequence
atggtagattcagggacggaagctagggctcgggggaaggccgaagcaggccttcaggatgggatatcggggccggccaccgcgcgggtgaatggcaaaacccaggccgaagccgtcgccgaggcagagctgaagactgagtctgttactcaggccaaagctggagacggagccatgactaggacgcacactgttacttatagggaagcaatggccgtaactagagaagtaattaaggtcgaagacacgaccaaaacaagagtaatggtcgaaactaaaactaagcccctcgctgaaaggtcaattgtgccgcagactaagtccaaggctatgcctatgagccgagtctcgactgtgacaaagtctgaagtgaaagtagtagctgtgatcgaggccaatattcggtcttacgccaagtcgcacgacaaagccaacactggcagtcgaccagaccggcgggaggagacttccataggcatgaaatccagcgacgaggacgaagagaatatctgctcgtggttttggaccggggaagagccatccgtcggttcatggttctggccagaagaggaaacatcgctacaggtgtataagcctctgcccaagattcaggagaaaccgaagcctacccacaaaccaactctgaccataaagcagaaagtgatcgcatggagccgggcccgctacattgtgctggtacccgtggaagggggggagcaaagcctccctcccgaagggaactggaccctggtggaaaccttaatcgaaaccccgctgggcatacgcccactgacaaagattccaccctaccacggcccgtactaccaaacacttgctgaaatcaagaaacaaataaggcagcgcgagaaatacggtccaaatccaaaggcctgccactgtaaaagtcggggtttcagccttgagccaaaggagtttgacaaactggtggcattactgaagctcactaaggatccttttatccatgagatcgccactatgataatggggattagccccgcctatccgttcacacaggacattatccatgatgttggcattaccgttatgattgaaaacctggtgaacaatcccaatgtgaaggagcacccaggcgccctctcaatggtggatgacagctccgagtcatcagaggagcctaagtctggcgaaagctacatccaccaggtatgcaagggcattattagctgtccacttaatagccctgtgcaactagccggccttaagctcctagggcatctgtctatcaaattcgaagatcactacgtgattacatcttatatacctgacttcctcacccttcttaataaagggtccgttaagacaaaattttacgttctgaaggtgttttcctgcctgagcaagaatcacgccaatacccgtgagctgatttcggccaaagtgctttccagcttggtggccccattcaataaaaatgagtcaaaagcaaacatcctcaatattattgagattttcgagaatatcaatttccagtttaaaaccaaggccaaactcttcactaaagagaaattcactaagagcgagctgatttcaattttccaggaagcaaaacagttcgggcagaagttacaggacttggcagaacacagcgatcctgaagttagagacaaagtgatcaggttaatcctgaagctgtag

SEQ ID NO: 26889 - DNA, 1677 bp, Artificial Sequence
  Description of Artificial Sequence: Synthetic coding sequence
atggtggactccggaacagaagccagagccagaggaaaggctgaggctggactgcaagacggaatctcagggccagctaccgcccgagtgaatgggaagacccaggctgaggccgtcgcggaagcagaacttaaaaccgagagcgtgacacaggctaaggctggtgacggcgcaatgacgcggacacacacagtgacctaccgggaagccatggctgtgacgagagaggtgatcaaggtggaggataccacgaagactcgtgttatggttgagacgaagactaagcccctggctgagcgcagtatcgtacctcagaccaagtctaaggcaatgcccatgagtagggtctcaacggttaccaagagcgaagtgaaggttgtggccgtcatcgaagcaaatatccgttcatacgctaagtctcatgacaaggcaaacaccggaagtcgacctgatcgacgcgaggaaacctctatcggcatgaaatcctctgacgaggatgaagagaatatttgttcatggttttggactggcgaagagcctagtgtgggatcatggttctggcctgaggaagaaacaagtctgcaggtctataagcccctgcctaaaattcaagaaaagccgaaacccacccacaaaccaactctcactataaaacagaaggtgatcgcatggtcgagggcccgttacatcgtcctggtgccagtggaagggggagagcagtcattgcctccagagggtaactggacactggtggagacactgatcgagactcctctcgggatcagacccctgaccaagattccgccgtatcatggtccgtattaccagaccctcgccgaaataaagaaacagatccggcagcgagaaaagtatggtcctaaccctaaagcatgtcactgtaaatctcgcggcttctctcttgaaccaaaagaattcgacaagttggtggcgctgctgaaattgacaaaagatccatttattcacgaaatagcgactatgatcatggggattagccctgcctacccttttacacaggatattattcacgatgtcggcatcacagtcatgattgagaatctagtgaacaatcccaacgtcaaggagcaccctggcgccctgtccatggtagatgacagttccgagagttccgaagaaccaaagtccggggagtcctatattcaccaggtgtgcaaagggatcatcagctgtcccctgaattctcctgtacagctggctggattgaagttgctggggcacctgtccatcaagtttgaagaccattatgtcatcacttcgtacatccctgattttctcactctgctgaacaagggctccgtgaaaacaaaattttacgtgcttaaggtcttttcttgcctaagcaaaaatcacgccaatacccgggagttgattagcgcgaaggtcctatctagcctggtagcaccctttaacaagaatgagtccaaggcaaacatcctaaacatcatcgagatctttgagaacattaacttccagttcaaaaccaaagctaaactgtttacaaaagaaaagttcacgaagtcagaactgatctccatctttcaagaggcgaagcagtttgggcagaaattgcaggacctggccgagcatagtgaccctgaggtccgggacaaggtcatacgcctgatcctgaagctatag

SEQ ID NO: 26890 - DNA, 1677 bp, Artificial Sequence
  Description of Artificial Sequence: Synthetic coding sequence
atggtagactcagggacagaagctcgagctcgagggaaggctgaagccggcttgcaggatggcatatcggggcccgccactgctagggtgaatggtaagacccaagcagaggccgtggcagaagctgagctcaagaccgagtccgtaacccaggccaaggcgggagatggggccatgactcggacgcacacagtcacatatcgcgaggccatggccgtgacacgcgaggtaatcaaagttgaagacaccacaaagacacgcgtgatggttgagacgaagactaaacccctggctgagagatccattgtgccgcagacgaagagcaaggccatgcccatgagtcgcgtgtctactgtcaccaaatctgaagtcaaagtggttgcggtgatcgaggccaatattcgctcctatgcaaaaagtcatgataaggccaacaccggctctagacctgatcgcagagaagaaacaagcatcgggatgaaatcttcagacgaagatgaagaaaatatttgcagctggttctggactggggaagagccctcagtgggaagctggttctggcctgaggaagagacctctcttcaggtatataagcccctaccaaaaattcaggaaaaacccaagccaacgcacaagcccacccttacaattaagcaaaaagtcatagcctggtctagggctcggtacatagtgctcgtaccggtcgagggcggggagcagtctcttccacctgagggcaattggactctcgtcgagaccctcattgaaacccccctgggtatccgcccactgacaaaaatccccccttaccacggaccatactaccaaacgctggcagaaattaagaagcagatcagacaacgagagaagtatgggcctaaccctaaagcatgtcattgcaagagccgtggcttcagtctcgagccaaaggagttcgacaagctggttgctctactgaagctcactaaagacccttttattcacgaaatcgcaacaatgattatgggaatttctccagcctacccatttactcaagatattattcacgacgtcggtataaccgttatgattgagaatctcgtgaacaatcctaacgtcaaagaacaccctggggctctgtcaatggtggacgactcctctgaatctagcgaggaaccaaagtccggggaaagttatatccaccaagtgtgcaaggggatcattagttgccctcttaattcgcctgtgcagctggccggcctgaagctgttgggccacctgtcaattaagtttgaagaccattatgtaattacttcctacatccctgatttcctcacgctgctaaacaagggcagtgtgaagactaagttttacgtcctaaaagtgtttagttgcttgagcaagaatcatgcaaacactcgggagctcataagtgctaaagtgctgagctctctggtggctccttttaacaaaaatgagtccaaagcaaatatactgaatatcatcgagatctttgaaaatatcaactttcagttcaagacgaaggcaaagctgttcaccaaagagaaatttacgaagtctgaactgatctccatcttccaggaggcgaaacagttcggtcagaaactgcaggatctcgcagaacatagtgatcccgaagtcagagataaagtgattaggctgattctcaaattatag

SEQ ID NO: 26891 - DNA, 1677 bp, Artificial Sequence
  Description of Artificial Sequence: Synthetic coding sequence
atggtggacagcggtacagaggccagggcgagaggaaaagcagaagccgggctgcaagacggaattagcggcccagccacagcccgggtgaatggaaaaacacaggcggaagccgtggctgaggcagaattgaagaccgagtccgtaacccaggcaaaagcaggagacggagccatgacccgcacacatacggttacatacagggaggctatggcagtgacacgcgaggtaatcaaggtggaggacactaccaagacccgggtcatggtggaaaccaaaactaagcccttagctgagcgaagcattgtgcctcagactaagtccaaggctatgcctatgtccagagtgagcacagtaacaaagagtgaggtcaaggtcgtcgcggttattgaggctaatataagatcgtatgcaaaatcccacgacaaagccaacacaggcagccgtcccgaccgccgagaggaaacgagtatcgggatgaaaagctcagatgaggatgaagagaacatctgcagctggttctggactggcgaggaacctagtgttgggtcttggttctggcctgaggaagagacaagcctccaagtctataaacccctgcccaaaatccaagagaagcccaagcctacgcataagcccacgttaacaattaaacaaaaggttatagcctggtcccgggcgcgctacatagtgctagttccagtggagggtggggaacagtcgctgccccctgaaggcaattggactctggtggaaactcttatcgaaacacctctcggtatccgccctctaacaaaaattcccccgtaccatggcccatactaccagacactggccgagattaagaagcagatccgccagcgtgagaaatacggcccaaatcctaaagcatgtcactgtaaaagcaggggcttttctcttgagccaaaggagtttgacaaactggtggctcttctcaagctgacaaaagacccctttatccatgaaatagccacaatgataatgggcatatcccctgcgtatccttttacccaggacatcatccatgacgtgggtatcaccgttatgatcgaaaacttggtcaataatcccaacgtcaaggagcaccccggtgctctgtcgatggtggatgatagtagtgagagctccgaggaacctaaatcaggcgaaagttatatccaccaggtgtgcaaaggaataatctcgtgccccctcaatagtccagtccagctggcaggcctgaagctcttgggccacctgtctatcaagtttgaagatcactacgtaatcacaagctatatccctgacttccttacactgttaaacaagggatcggtgaaaacaaaattttacgtgctaaaagtcttcagctgcctgtccaagaatcatgcgaacacacgggaactgattagtgccaaggtgctcagcagcctcgtcgcccccttcaacaaaaatgagtctaaggcaaacatacttaacattatagagatcttcgaaaatatcaactttcagtttaaaaccaaagcaaaactgttcacaaaggaaaaattcaccaaatccgaactcatttccatatttcaggaggccaaacaattcggccagaagctgcaggaccttgccgagcactcagacccggaggttagggacaaagtgatccggctgatcctcaagctgtag

SEQ ID NO: 26892 - DNA, 633 bp, Artificial Sequence
  Description of Artificial Sequence: Synthetic coding sequence
atgttcgaatcgtttaacgtgccaggtctgtacatcgctgtgcaggcagtgctggccctcgcagcatcatggacctctcgacaggtgggggaaagaacactgaccggcattgtgatagatagcggcgacggcgtcacccatgtcattcctgtggccgagggctatgttatagggagctgtattaaacacattcctatcgcaggacgagatatcacctacttcattcaacagcttctgcgcgagcgggaggtaggcataccaccagagcagtcgctggagacagcaaaagcgattaaagaaaaatactgttatatttgtcctgacattgtgaaagagtttgctaagtacgacgttgatccccagaagtggattaaacagtacactggaatcaacgctattaatcaaaagaagtttgtgattgatgtcggttacgagcgatttctaggccccgagatcttcttccaccctgagttcgccaaccccgatagtatggagtctattagcgatgtggtggacgaggttatacagaattgtcctatcgatgtaaggcgcccactgtacaagatggagcagatccctctgagctatccacagggccacggcttccacccccttagtccacctttccactag

SEQ ID NO: 26893 - DNA, 156 bp, Artificial Sequence
  Description of Artificial Sequence: Synthetic coding sequence
atgttcgaaagcttcaatgtgccggggttatatatcgcagtgcaggccgtcctcgccctcgccgctagctggacgtctcggcaagtgggagagcgaacgttgacaggaatagtcattgacagcggcgatggcgtgacacacgttatccccgtgtag

SEQ ID NO: 26894 - DNA, 633 bp, Artificial Sequence
  Description of Artificial Sequence: Synthetic coding sequence
atgtttgagtcttttaatgttcctggcctgtacatcgccgttcaagcagtgctggctctggcagcatcatggacttctagacaggtgggggaaaggaccctgacaggaatcgtgattgactccggggacggagtcacccacgtgattcctgttgccgaagggtatgtgataggaagctgcattaagcacatccctatagcaggacgggatattacctattttatccaacaactgctgagagagagggaggtaggaatcccgcccgagcaatccttagagaccgccaaagccatcaaagaaaagtattgctacatttgtccagacatcgtcaaggagtttgccaaatatgacgtggatcctcagaaatggatcaagcagtatactggcattaacgccatcaatcaaaaaaaatttgtgatcgatgtggggtatgaacgtttcctggggcccgaaattttcttccacccggaattcgctaaccccgacagcatggagtctatctccgacgtcgtggacgaagttatccagaactgtcctattgatgttcgacgccctctttataagatggagcagatccccctgagttatcctcagggccacgggttccatcctttgagtccacctttccattag

SEQ ID NO: 26895 - DNA, 1878 bp, Artificial Sequence
  Description of Artificial Sequence: Synthetic coding sequence
atgaccgccaccttgcggccttacttgagcgccgtgagggcgactctgcaggccgcactctgtctggaaaatttcagcagtcaggtggtcgagcgccataataaacccgaagtggaagtcaggagctctaaagagttgctgcttcagcctgtgaccattagcagaaacgagaaggagaaagtgttgatcgagggaagcatcaacagtgtccgggtctcgatcgcagtgaagcaggctgacgaaatcgagaagattctctgccacaaatttatgcggttcatgatgatgcgcgccgaaaattttttcattctgcgacgaaagcccgtagagcaaaagaaaatctttacaatacagggctgctatcccgtcataaggtgtcttcttcgcagaaggggatgggtggagaaaaagatggtacaccgatccgggccaacactgctgccgccccagaaagacctggacagctcagccatgggggatagtgacacaaccgaagatgaggatgaagatgaggatgaagagtttcagccctcacaacttttcgacttcgacgacctgttaaagtttgacgacctggacggtacacacgcgctcatggtcggcctgtgcctgaatctccgcaacctgccatggttcgatgaggtggacgctaattctttcttcccccgctgttattgcctaggcgctgaggatgacaaaaaggctttcatcggcgacaagcaacctaagaaacaagaaaagaatcccgtcttagtgtctcccgaatttgttgatgaggctctctgcgcctgtgaggagtacctgagcaacctcgctcacatggacatcgacaaagatctggaggccccactgtacctaacacccgagggatggtctctgtttctgcaaagatattaccaggtcgtgcacgaaggcgccgagcttagacacctggatactcaggtccagcgctgcgaggatatcctgcaacagctgcaagccgtcgttccccagattgacatggaaggggacagaaatatttggatagttaagccaggcgccaaatcacgcgggcggggcataatgtgtatggatcatttagaagagatgctgaagttagtgaatggtaatcccgtcgtgatgaaggatggcaagtgggtggtgcagaagtacatagagaggccgcttctgatcttcgggactaaatttgatctccgccagtggtttctggtgaccgattggaatcccctgactgtgtggttttacagggactcctatatccgcttctccacccagccattttcactgaagaacctcgataactcagtacacctatgcaataatagcatccagaaacacctcgagaactcatgtcatagacatcccctgcttccaccggacaacatgtggagcagtcagagattccaggctcacctccaggagatgggagccccgaacgcatggagcaccatcatcgtgcccggcatgaaagatgccgtgatccacgcactgcagacctcccaggacacggttcaatgtcgtaaagcctcattcgagctgtacggggccgacttcgtctttggggaggatttccaaccctggctgattgaaatcaacgcaagccctaccatggccccgtcaacagctgttacggccagattatgtgccggtgtgcaggcagacaccttgagagtcgtaatcgatcggatgctggatcggaattgcgatactggtgctttcgaactgatatataagcagcccgtaaccacctcgccagccagcacgcctaggccgagttgcctccttccaatgtattccgatacgagggccagatctagcgacgactcgactgcctcttggtgggcattgcggccgtgtagacctcaggcgcggccctag

SEQ ID NO: 26896 - DNA, 1683 bp, Artificial Sequence
  Description of Artificial Sequence: Synthetic coding sequence
gctggcccaagagccgcttgttccgaaccaaacccctgtacccaggtggtgatgaattcacactcctacaatggatccgtcgggcgccctcttgggtccggccctggggcacttggtagggacccaccggacccggaagccgggcatccaccgcagcccccacacagccctggtctgcaagtggttgtggccaagagtgaacccgcacgaccgtcccccggcagccctcgggggcaacctcaggatcaggatgatgatgaggatgatgaggaggacgaggccggaagacagagggcgagtggtaagccgtcaaacgtcggtcacaggttaggccataggcgggccttgttcgagaagaggaaacgattaagcgattatgctctgatattcggcatgtttgggatcgtggtgatggtgacagaaacggagctgagctggggggtgtataccaaagaatcattgtactcttttgcgcttaagtgtctgatctctctgtctaccgcaattttattgggcttagtcgtactatatcacgcccgagaaatccagctatttatggtcgataatggagccgacgactggagaattgcgatgacttgcgagcgcgtgttcttgataagccttgagttggccgtctgtgcaatccaccccgtgcctggacattatcggttcacttggactgctagacttgcgtttacttacgccccaagtgtggcagaggccgacgtggatgttttactcagtattcctatgtttctgaggctctatctcttagggcgggtgatgctcctgcactcgaagatatttactgacgcttctagccgttccatcggtgctctgaacaaaattaccttcaatacacgtttcgtgatgaagacactgatgaccatatgtccagggacggtgcttctggtcttcagcatctcaagttggattatcgccgcgtggaccgtccgagtgtgcgaaagataccatgacaagcaagaggttacttccaattttctgggcgctatgtggttgatctccatcacctttttgtctataggatacggcgatatggtcccccatacttattgcggcaagggcgtgtgcttgctcacagggataatgggcgccggatgcaccgctctggtcgtggctgtggtggcgagaaaactggagttgactaaggcggaaaagcacgtgcataacttcatgatggacactcagctgacaaaaagggtcaagaacgctgctgctaatgtgctgagagaaacgtggttgatatataagcatactagactggtgaaaaaacccgatcaggcccgcgttcgcaagcaccagaggaaatttctacaggccatccaccatgggcggatgttaagatctgttaagatagagcagggcaaattaaacgatcaggcaaataccctcaccgatctggccaaaactcagacggtcatgtatgatttagtctcagagcttcatgcccagcatgaggaactcgaagcccgcctcgccacacttgagagccgcttagatgccctaggagcttcattacaagccctccccgggctcatcgctcaggccatccgtccccctccccctcctctgccccccagacctggaccaggtccgcaagaccaggctgctcggtccagcccctgccgctggacaccggtagccccctcagactgcgggtag

SEQ ID NO: 26897 - DNA, 1209 bp, Artificial Sequence
  Description of Artificial Sequence: Synthetic coding sequence
atgaggagtggcggcgtgagatcgtttgctttggagctggctcgcggccctggtggcgcttaccgtggcggcgaacggctttgcggaagggtattgttggaagccgccgctcctttacgcgtgcgtgccctcgaagttaaggctcgcggcggtgctgcaactcattggttggaagggaggtcagtgggagtaaacgcagtatcatcagactatgcagccgcagagacctacctaaggcgcaggcaacttctgcttcgggacactggggagacaaccactttacccccgggtagacacgaatttctgttcagcttccagctgccccccacgcttgttacctcattcgaagggaaacatgggtccgtccgatattgcatcaaagccacccttcataggccctgggtgcccgcccggcgcgcccgcaaggtattcaccgtgatagaacctgtcgatatcaatacccctgcgctgctagctccccaggcgggagctcgtgagaaagtcgcccgcagctggtattgcaaccgaggtctggtgtcgctatccgctaaaatagatcgtaagggatatacaccaggcgaggtaatccctgtatttgctgaaatcgataacggatctacccgcccagtgctcccccgcgcagcagtggtccaaactcaaactttcatggccagaggagcccgcaagcaaaaaagggctgtcgtcgccagcctggcgggggagcccgttggcccagggcagagagcactctggcagggtcgcgcacttcgcatccccccggtaggaccatccatcctgcactgccgggtcctgcatgtggattacgctttgaaggtgtgcgtcgatatccctggtacatctaagctcctgctcgagttgcccctagtgatcgggacgataccccttcacccctttgggtcccgatcttcctcggttggtagtcatgcctctttccttttagactggcgcctgggcgcactgccggaaaggcccgaagccccccccgagtacagcgaagtagtggccgatacggaagaagcagctcttggccagtccccattcccactcccccaggaccccgacatgagtctagaaggccctttcttcgcctatatccaagaatttcgatacaggcctcccccactgtattccgaggaggatcccaaccccctgctgggagacatgcgtccccggtgtatgacctgttag

SEQ ID NO: 26898 - DNA, 1257 bp, Artificial Sequence
  Description of Artificial Sequence: Synthetic coding sequence
atgggcggcgaggctggatgcgctgctgctgtgggggctgaggggagagtcaagtctctcggactcgtgttcgaggacgagaggaaaggctgctactcatcgggtgaaactgttgcaggccatgttctcctggaggccagcgaaccagtggcccttcgggccctgaggcttgaggcccagggtagagcaaccgcagcctgggggccaagcacttgtcctcgcgcctccgcatccaccgcagccctggccgtcttctccgaggttgaatatttaaatgtgcgacttagtttgcgagagcccccagctggagaggggattattctgctccagccaggaaaacacgaatttccatttagatttcagcttccctctgaacctctcgtaacctcctttaccggaaagtacgggagcatccagtactgcgtgagggcagtgctggaaaggcccaaagtgcccgaccagtcagttaagcgggagctccaggtcgtcagtcacgttgacgtaaatacccccgctctcctcacccctgtccttaaaacgcaggagaaaatggtcggttgttggtttttcacctccggaccagtgtccttgtcggcgaaaattgagcggaaagggtattgtaacggcgaggcaataccgatctacgccgagattgaaaactgttcgagtcgtctgatcgtccccaaggcagctatctttcagacacagacctatctggctagcggcaagactaagacaatcagacatatggtggccaacgtccgaggcaaccatatcgcatccgggagcacagacacatggaatgggaagactctgaagattccccccgtgacccctagcattctcgactgctgtatcatccgcgtggactatagcctcgccgtttacattcacatcccaggagccaaaaagttaatgctggagcttccactggtcattggtacaattccttacaatggatttggttctcgcaattcaagtatcgcttcacagttcagcatggacatgtcatggctgacactcaccctgccagagcagcctgaagctcccccaaattatgctgacgtggtgtcagaagaagaatttagcagacatatcccaccttacccgcagccacctaattgcgaaggtgaggtgtgttgtcccgtctttgcctgtatccaagagttccgttttcaacccccccctctgtactccgaagtggaccctcatccttctgatgtggaagagtcacagccagtgtcattcatactttag

SEQ ID NO: 26899 - DNA, 996 bp, Artificial Sequence
  Description of Artificial Sequence: Synthetic coding sequence
atgcaaggtgaagccgatgccaggaccggctgtgctgagtggcaaggtgaagggatcatcctgctccagcccggcaaacacgagtttcctttcagatttcagctgccaagtgagccacttgtgacatcttttacgggcaaatacggatccatccagtactgtgtgagagcggttctagaaaggccaaaagtccccgatcagtcagtgaaacgtgagctacaggtggtgtcacatgtggatgtgaataccccagccttgttgacacccgtcctgaaaacgcaggaaaaaatggtgggctgctggtttttcactagtggccccgtcagtctgagcgccaagatagagaggaagggatactgtaatggcgaagctatccccatttacgcggaaattgagaattgctctagcaggctcattgtgcctaaagctgcaatcttccagactcagacgtatctggcctctggcaaaaccaagactatacggcatatggtggccaatgtacggggaaaccatattgcttctggttctaccgacacttggaacggcaagactttaaaaattccgcctgtcacaccctccatcctggattgttgtatcataagggtcgactactcactggctgtttatattcatatcccgggcgccaagaagttaatgctggagctgcccctggtcattggtacgattccctacaacgggtttggatcgcgcaatagctccatcgcaagccaattttcaatggatatgtcttggctcacgctgactctacccgagcaacctgaagcgcccccgaactacgctgacgtggtgagtgaagaggagttctctcgccacatccccccctatccccaaccccccaactgtgaaggagaggtctgttgcccagtgttcgcctgtatccaggagtttcggttccaacctccaccgctgtactcggaggtagatccacatccctccgatgtcgaggagagtcagccagtttcctttatactatag

SEQ ID NO: 26900 - DNA, 1029 bp, Artificial Sequence
  Description of Artificial Sequence: Synthetic coding sequence
atgggtgacagagaggagtgcctgtcaactcctcagccacccatgagcgttgtgaaaagcatcgagctggtgctcccagaggaccggatatacctcgctggttcaagcattaaggggcaggtaattctgaccctgaattcaacgctcgtggacccaattgttaaggtcgaactagtaggtagaggatacgtggagtggagtgaggaagccggtgcaagttgcgattacagtaggaatgtaatttgcaacaacaaggctgattacgtacacaaaactaagactttccccgtggaagataactggctaagcgccggaagccacaccttcgactttcacttcaacctgcctccccgtttgccctcaacattcacctccaagttcggccatgtgttctacttcgtgcaggcatcctgcatgggccgcgaacatatcctcgccaaaaaacgtatgtacctcctggtgcagggcacaagcacgttccataaagagacaccgtttcaaaatcctctgttcgtggaggccgaggagaaggttagttacaactgctgtcgacagggcacagtgtgcctgcagattcaaatggaacggaatacctttacacccggagagaaagtcgtgttcacaaccgagatcaataatcagaccagcaagtgcattaagaccgtcgtgttcgccctctacgcacacatacagtacgagggctttacacctagtgctgaacgaagaagccggctggacagttctgagctgctcaggcaagaagctaacacccctgttacccgctttaacactacaaaggtcgtaagcaccttcaatttgccattgttgctgtcagtgagcagttctacgcaagatggggagatcatgcacacaaggtatgaactggttactaccgtccacctgccttggtctctcacaagcttgaaagcaaaagtgcccatcatcattacatcggcctcagtggactcagccatatgtcagctcagcgaagacggcgtgctgccggttaaccctgatcatcagaattag

SEQ ID NO: 26901 - DNA, 843 bp, Artificial Sequence
  Description of Artificial Sequence: Synthetic coding sequence
atggaaacccatcatggtatttgcagcagactgtgcaaagaatctgactccgtcgtgcttgcagtcgggtacagaaagctgcctaagcacaagttccccgtgcctgtgagggactgcctggtcgccaccattcattttctgaagtcgctcgacgcctatggcgttgaccctgcccgagtcgtcgtttgcggcgacagcttcggaggggctatcgccgccgtggtgtgtcagcagctcgttgatcgcccagatctaccacgaatacgtgctcagatccttatttacgccatcctgcaggctcttgacctgcagacgcccagctttcagcagaggaagaacatacctctgcttacctggagtttcatctgttattgcttttttcagaaccttgatttctcaagtagttggcaggaggtgattatgaagggggcgcacctcccagccgaggtatgggaaaagtacagaaaatggcttggccctgagaacatacctgagcgtttcaaggagcgcggctaccagctgaaacctcatgagcctatgaatgaagccgcctacctagaagtatctgtggtcctagatgttatgtgttctcctttgatcgctgaagacgacattgtgtcgcaactgcctgaaacctgtatcgtgtcctgcgagtatgacgcattaagggataactcgttactgtataagaaaaggttggaggatttaggtgttcctgtcacatggcaccacatggaggacggatttcatggtgttctgcgtaccatagatatgagttttcttcactttccctgcagcatgaggatcctgtcggctcttgtgcagtttgtcaaaggcttatag

SEQ ID NO: 26902 - DNA, 1053 bp, Artificial Sequence
  Description of Artificial Sequence: Synthetic coding sequence
atgatttttgagaagttaaggatttgtagcatgccccagtttttctgctttatgcaggacctcccacccctcaagtatgatcccgatgtcgtggtcaccgatttcaggttcggcaccattccagtgaaactgtaccagagcaaggcaagcacctgtacacttaagccaggtattgtgtactaccatggcggcgggggtgtgatgggttccttgaagactcatcacgggatttgcagccgattgtgtaaagagagtgactctgtcgttctggcggtcggctaccgaaaactcccaaaacacaaattccctgtgcccgtacgggactgtctggtagccaccatccattttctgaaatccctagacgcatatggtgtggacccagcgcgagtggtcgtgtgtggcgactcattcggcggtgccatcgccgccgtggtttgccagcagctcgtcgaccggcctgacctgcctagaattagggcccagatcctcatttacgccattctccaggcccttgatctacagactccttctttccagcaacggaaaaatattccactgctaacttggtcgttcatctgttattgtttttttcagaacctagatttttccagctcctggcaggaggttattatgaagggggcccacttgccagcggaagtgtgggagaagtatcgcaaatggctcggccctgagaatatacctgaacgttttaaagagcgagggtaccagctgaaaccacacgagcccatgaacgaggctgcatatctcgaagtatcagtggttctcgatgtgatgtgctcgcctctgatcgcagaggacgatattgtttcacagctccctgagacttgcatcgtcagttgcgagtatgatgccctcagagataattccctcctctacaagaaaaggctcgaagacctgggcgtgcctgtgacctggcaccatatggaggacggattccacggggtattaaggaccatcgatatgtcctttctgcatttcccttgcagcatgcggatcctgagcgcactcgtgcagtttgtgaaggggctctag

SEQ ID NO: 26903 - DNA, 1578 bp, Artificial Sequence
  Description of Artificial Sequence: Synthetic coding sequence
atggggtggctgttcctgaaagtcttactggccggcgtctcatttagcggctttctgtatcccttggtcgatttttgtatctctggcaagacacgtgggcagaagccaaacttcgtgattatcctcgccgacgacatgggttggggtgacctgggagctaattgggccgagaccaaggacacagcgaatctagacaaaatggcctctgaaggaatgcgctttgtcgattttcacgccgcagcgtcaacgtgttctcctagtcgcgcatcccttctgaccggtaggttgggactccgcaacggcgtgacgaggaactttgcagtgacatcggtgggcgggctgccgctgaatgagaccaccctcgccgaagtgctccagcaagccggatatgtgactggcattattgggaagtggcatctcggacatcacggatcataccaccccaactttcggggtttcgactactactttggtattccctattcccacgacatgggctgtactgacacccccggttacaaccacccaccttgccccgcctgtccacaaggagacggcccttcccgaaatctgcaacgggactgttataccgacgttgcgctgcctctgtacgaaaatcttaacatagtagaacagccagtgaacctctcaagcctggctcagaagtacgcggagaaggcaacacagtttatccagcgagcctcgacaagtggacggcccttcctgctttacgtggctctcgcccatatgcacgtgcccctgcctgtaacacaactgccagcagcccccagaggcaggagcttatatggcgccgggttgtgggagatggattctctggtgggccaaataaaagataaggtagaccacacagtcaaagagaatactttcctctggttcacaggtgacaatgggccctgggcccagaagtgtgagctagccggcagcgtgggccccttcacagggttctggcagacccgtcagggcggttcccccgctaaacagaccacctgggagggaggccatcgggtacctgccttagcttactggcccggccgcgtgcccgttaacgtcacctcgacagctctgctgagtgtgctggacattttcccgactgttgttgctttggcccaggcctctttaccccagggacggcgcttcgacggggtggatgtgtcagaggttcttttcggcagatcccagccagggcatagagtcctgtttcaccccaacagcggggccgccggagaatttggcgctctgcagacagtacgcttggagcgctacaaggccttctacatcactggaggcgcccgggcttgtgatggctccactggccccgaattgcagcacaagtttcctctcatattcaatttggaggacgacaccgcggaagccgtccccctcgaaaggggcggagcagagtatcaggccgtcctccctgaggtcaggaaagtgctcgccgacgtactccaggacatcgctaacgataacatctcttcagccgattatacccaagacccatctgtgactccttgctgcaatccatatcaaatcgcctgtcgatgccaggccgcctag

SEQ ID NO: 26904 - DNA, 1932 bp, Artificial Sequence
  Description of Artificial Sequence: Synthetic coding sequence
atgtgcggaatctgctgttcagttaacttttctgcagagcacttttctcaagacctgaaggaggatttgctgtataacctcaaacaacgcggccccaattcaagcaaacagcttttaaagtccgacgtgaactatcaatgccttttttccgcccacgtattacacctgaggggagtgctgacaactcagccagttgaggatgaacggggcaacgtgttcttgtggaatggggagatcttcagcggcattaaagtcgaggctgaggagaatgatacacagatcttattcaactacctttcgtcatgtaagaacgagtccgagatcctttcactattctctgaagtccagggcccctggtcatttatctactaccaggcgagttcgcactacctgtggttcggccgggatttttttggccggaggtcactgctatggcacttttctaatcttgggaaatctttctgccttagttctgtgggaacacagacgtctggactcgctaaccagtggcaggaggtacccgcatctgggctttttcgtatcgacctgaaaagcaccgttatcagcggctgtattatcctgcagctgtatccgtggaagtatatttcacgagagaacattatcgaggaaaacgttaattctctttctcagatttcagcagatctgcccgccttcgtgtcagttgtggctaacgaggctaagctgtacctcgagaaacccgtggttccgcttaacatgatgttgccacaggccgccctggagacgcactgttctaacatctcaaatgtgccccccactagggaaatccttcaagtatttctcaccgatgtccatatgaaggaagtcatacagcaatttattgatgttctttctgtggcagtgaagaaacgggtgctgtgcctgcccagggacgagaacctgactgctaatgaggtgctcaagacatgcgaccgtaaggcgaacgtggcgatcctgttttctggtggcattgactctatggtaatcgcaacactggctgatcgccatatcccgctggatgagccgatcgacctcttaaatgtagcctttatagccgaggaaaagactatgcctaccacatttaaccgggaaggcaacaagcaaaaaaacaagtgcgaaatccctagtgaggaatttagcaaggatgttgctgccgccgccgctgactcaccaaacaaacacgtgtccgtgcccgatcggatcaccggcagagctggcctcaaggagctgcaggccgtcagcccatctagaatttggaactttgttgagattaacgtgtcaatggaggagcttcagaagcttcggagaacgcggatctgtcacctgattaggccgctagataccgtgcttgatgactccatcggctgcgcagtgtggttcgcatcgcggggaataggatggcttgtggctcaggagggggtgaaaagctaccagtcaaatgcaaaagtagtgctcactggtatcggtgctgacgagcagcttgctggttatagccgacatcgcgttcgtttccagtctcatggactggagggactgaacaaagaaatcatgatggaactgggacggatctcatcacgaaatttggggcgtgatgatcgagtgataggagatcatggcaaagaggcacgcttcccgttccttgatgagaacgttgtgagctttttgaattccttacccatctgggagaaagccaatctcaccctgccacggggcatcggcgagaagctccttctgagactagccgccgttgaactggggctgaccgcatccgcactgttgcctaagagggccatgcagttcggttctagaatcgccaaaatggaaaaaatcaatgagaaggcctccgacaaatgtgggcgcctccagatcatgtcactggagaacttgagtattgaaaaggagacaaagttgtag

SEQ ID NO: 26905 - DNA, 1857 bp, Artificial Sequence
  Description of Artificial Sequence: Synthetic coding sequence
atgtgtgggatctgctgctcagtgaacttttcagctgagcactttagtcaggaccttaaggaggatctactgtacaatctgaagcaacggggacctaactcttcaaagcagctccttaaatccgacgttaactatcagtgtttattctccgcccatgtgctgcacctccgcggggtcctgaccacccagccagtggaagacgaaagaggtaacgtcttcctctggaacggtgagatcttttccggcattaaagtggaggctgaggagaacgatacacaaatcctattcaattatctttcaagctgcaagaacgagtctgaaatcctcagcctcttctcagaggtgcaggggccctggtccttcatttattatcaggcctcttcccactacctctggttcgggagggatttcttcggccgtaggagcttgctgtggcactttagcaatctgggaaagtccttttgcctctccagtgtcggaacacaaacatctggcttggcaaaccagtggcaggaagtccctgcctcaggcttgttccgtatagatcttaagagtaccgtgattagcggttgcatcatcttacaactctacccctggaagtatatttcccgggaaaacatcattgaagagaatgttaactcactgtcacaaatttcggcagatcttccggcctttgtgagtgtggttgccaacgaggctaaattgtatttggagaagcctgtagttccactcaacatgatgctgccccaggctgccctcgaaacccactgctccaatattagcaatgtgcctccgacaagggaaatcttacaggtgttcttaaccgatgtacacatgaaggaggtgattcagcagttcatcgatgttctcagcgttgccgtgaagaagcgggtgttgtgtctccccagggatgaaaacttgaccgccaatgaagttctcaagacctgcgacagaaaggcgaacgtggccattttattcagtggaggcattgatagcatggtgatcgcaaccctggctgacagacatattcccctcgatgaaccgatcgacctcctgaacgtggccttcattgccgaggagaaaacaatgccaaccaccttcaacagagaggggaataaacagaaaaacaagtgcgaaatcccctccgaggaattctccaaggatgtggccgcagcagctgctgacagccccaataaacatgtttcggtgccagaccgcatcaccgggcgggccggactgaaagaactccaggccgtctctccaagccggatctggaactttgtcgagatcaacgtttcgatggaggagcttcagaaattgcgaagaacaagaatttgccatcttatcaggccactggatacggtgctggacgattcaattgggtgcgctgtgtggtttgctagccgcggaatcggatggctggtagcccaggagggagtgaagagctatcaatccaacgctaaagtagtactcactggtataggtgctgatgaacaactcgcgggctatagtagacacagggtgcgtttccagtcgcacggcctggaggggctgaacaaggaaattatgatggaactcggcagaatttcttctcggaatctgggcagggatgaccgagtgatcggtgatcacggcaaagaggcccggtttccttttctggacgagaatgttgtgagctttctaaactccttgcctatttgggagaaggcaaacctcacccttccccggggcattggggagaaacttctacttaggttggccgctgtcgagctcggcttaacagcttccgctctgctgcctaagagagctatgcaatttgggagccgcattgcaaagatggagaaaatcaacgagtag

SEQ ID NO: 26906 - DNA, 222 bp, Artificial Sequence
  Description of Artificial Sequence: Synthetic coding sequence
atgtgtggcatctgttgtagtgttaacttttccgccgaacacttctcacaggacctcaaggaagatctgctttacaatctgaagcaaagggggcccaattccagcaaacagctgttaaagagcgatgttaattatcaatgtctgtttagtgctcatgtcctgcacttgcggggtgtcctgacaacacagcccgttgaagatgagcgtggcaatgtcttttag

SEQ ID NO: 26907 - DNA, 564 bp, Artificial Sequence
  Description of Artificial Sequence: Synthetic coding sequence
atggaaaggagcgctttcatggaactagatgccggtagccggttagtgatgcacctcagggaatggccagcactgctcgtcagcagcacagggtggactgagtttgaacagctcaccctggacggacacaacttacccagtctggtgtgcgtgatcacaggttccgtagatcttggagtctgtctgcatatgagcagctcaggcttggatttgcctatgaaagtagtggatatgttcggctgctgtctgcccgtgtgtgccgttaacttcaaatgccttcacgagcttgtaaagcacgaggagaacggcctggtgttcgaagacagtgaggagcttgcggctcttcagatgttatttagcaattttcccgaccccgccggtaagctgaatcagttctggaaaaatttgcgggagtcccagcagttgcgctgggatgaatcctgggtccaaaccgttcttccactcgtcatggatatacagctcctcggtcagcgcctcaaaccccgagacccttgctgtccatctaggtccttctttagcgaatcacaaggtaagccattctag

SEQ ID NO: 26908 - DNA, 537 bp, Artificial Sequence
  Description of Artificial Sequence: Synthetic coding sequence
atgggggatcgggttaaggggtctaaatcccggaggccagatctagttgttgaagtcgcccatcctaagataatccacgagagcggagcccaaatcctgaggcacgccaaccttttgtctctgagggtcactatggccacgcaccctgatggctttaggttagagggccccctagcggccgcccatagccctggaccatgcaccgtgttgtacgagggaccagttaggggcctgtgtccattcgcccctagaaacagtaataccatggccgcagccgctctggccgcaccttctcttggtttcgatggagtaatcggcgttttggttgcggatacctcgctcaccgatatgcacgtagtagatgtggaactgagtggtcctagaggccccacaggcaggagtttcgcagtccacactaggagagagaacccggccgagcccggagcagttacgggcagtgctactgtaaccgcattttggcagtccctgttggcctgttgccagctgccttcacgccctggaatacacctctgttag

SEQ ID NO: 26909 - DNA, 852 bp, Artificial Sequence
  Description of Artificial Sequence: Synthetic coding sequence
atggccgacagggggccttggagggttggcgtggtgggctacggaaggctgggacagagtctggtatcgcggctcctcgcacaaggtccagaactggggctggaactggtgttcgtctggaaccgcgacccagggaggatggcggggagcgtacccccctccttgcagctccagaatttagcagcccttggagagagacgccccgacctggtagtcgaagtggctcaccctaagataatccacgaatctggcgcgcagattttacggcatgccaatctcctggtcggctctccttctgccctctcggatcagactacagagcgtcagctcttggaggctagccaacattgggatcacgctgtctttgtcgcgcggggggcgctgtggggggccgaggacatcagacggctggacgcagccggcggcctgaggtcactcagagtcacaatggctacacaccctgatggctttcggctggaggggccactggctgccgcgcatagccctggaccctgcacggtactgtatgagggcccggttaggggcctttgtccattcgccccacggaacagcaacacaatggccgctgccgccctagccgcacccagtttgggcttcgatggagtgattggcgtgctcgttgccgacacgagcttgacagatatgcacgttgtggatgtggagttatctgggccccgtggccctactggacggagcttcgccgtgcatacgcggagagaaaacccagccgagccaggcgccgtcacagggagcgccaccgtgaccgctttttggcagagcctgctcgcctgctgtcaattgccgagtcggccaggtatccacctgtgctag

SEQ ID NO: 26910 - DNA, 1458 bp, Artificial Sequence
  Description of Artificial Sequence: Synthetic coding sequence
atgagcgggcactctcctactaggggggccatgcaggtggctatgaatggaaaagcccgcaaggaggcagttcaaacagccgcaaaggagctgttaaagtttgtgaaccggtctcccagcccctttcacgctgtagccgaatgtagaaaccggctgttgcaggccggctttagcgagctcaaagaaaccgaaaaatggaacatcaagcccgaatcaaagtattttatgaccaggaacagctccacaatcattgctttcgctgttggcggtcagtatgtccctggcaatggattctctcttatcggcgcccatacagatagtccctgccttcgggtgaaaagacgctcacgacgcagccaggtgggctttcagcaggtcggtgtggaaacctatggaggcgggatttggagcacttggttcgacagagatctaaccctggccggacgggtaattgtgaaatgcccaacttctggcagattagagcagcaactcgtgcatgtggaaagacctattctgagaattcctcacttggctatccacctgcagagaaacatcaatgaaaactttgggcctaacacggagatgcacttggtccccatcctggcaaccgcaatccaggaagagctggagaagggaactcctgagcccgggcccctgaatgcagttgacgagcgacaccactctgtactcatgtcactgctgtgcgcccacctggggttgagccctaaggatatcgttgaaatggaactgtgccttgccgatactcagcccgtggtcttaggcggtgcttatgatgaatttatcttcgcaccaagacttgataacctgcattcttgcttctgcgcactacaagcccttattgactcatgcgctggacccggttcacttgccactgaaccccatgtcaggatggtgactctgtatgacaatgaggaggtaggcagtgaaagcgcacaaggcgcgcagtccctgctgactgaattagtgctgcgacggatcagcgcttcttgccagcatcctactgcatttgaagaagcaattcctaagtcttttatgatctctgccgacatggcgcatgcagtgcaccctaattatctggataagcacgaggagaaccacaggcccctctttcataaaggacctgtaattaaggtaaattccaaacagcgttacgcttcgaacgctgtctccgaagcgttgattagggaagtggccaacaaagtgaaagtgccgctgcaggatctcatggtgcggaacgacactccgtgtggcacaacgattggtcctatccttgccagcaggttaggtttacgcgtgctcgatctggggagcccacagctggctatgcactctattcgcgagatggcctgtaccactggcgtgctccagacgcttactttgttcaagggattcttcgagctgtttccctcgctctctcataacctgctggtcgattag

SEQ ID NO: 26911 - DNA, 1326 bp, Artificial Sequence
  Description of Artificial Sequence: Synthetic coding sequence
atgagcggtcatagccccacccggggcgccatgcaggttgcaatgaatgggaaagcacggaaggaagctgtccagacagccgctaaagaactcttaaaatttgtgaacagatccccctccccgttccacgctgtggccgaatgcaggaaccggctgctccaggctgggtttagcgaactgaaggagacagaaaaatggaacattaagcctgaatcgaaatacttcatgaccagaaactccagtactatcattgcctttgctgtcggtggtcaatatgtcccagggaacggattcagcctgattggggcacatactgattccccttgcctgcgggtgaaacgcaggagccggcggagccaggtggggttccaacaggtcggcgtcgaaacatacggcggcgggatttggtccacctggttcgacagggatctgacacttgcaggccgagtgatcgtgaagtgcccgacatcaggccggttagagcagcaactagtccatgttgagagacccattctgcgtattccacacctcgccatccatctgcagagaaacattaacgagaacttcggccctaatacggagatgcatttggttccaatcctagccactgccattcaggaagaactagagaaaggcactcctgagcctggcccactgaatgccgtggacgagcgccatcactctgtgcttatgtcgctgctgtgtgcgcatcttggccttagtcctaaggacatcgtagagatggaattgtgtctggctgacacacagccagttgtgcttgggggcgcttatgacgagttcatattcgccccaagactggataacttacactcatgcttctgcgcactccaagccctgatcgattcttgcgccggacccggatcgctggccaccgagcctcacgtgcggatggttaccctgtatgataatgaggaagtggggagcgaatctgcacagggcgcgcagagcctactgacagagctggtgttgaggagaatctcagccagctgtcaacacccaacggcattcgaggaggctattcctaaaagctttatgatctctgcagacatggcccatgctgtccacccaaactacttagataagcatgaagaaaatcaccggcctttgttccataagggccccgtgataaaagtgaatagtaaacaacggtacgcctctaatgccgtttccgaagccctgattcgtgaagtggccaacaaatctcggtccccctgtaggatctcctggagcggaatgacacccccagttgaaccccccttagacttatcctggctcctagggtggggttgcgggtgctggatttag

SEQ ID NO: 26912 - DNA, 1137 bp, Artificial Sequence
  Description of Artificial Sequence: Synthetic coding sequence
ctgtctctgagtcttagcctgtcattgtttttggacgttagcctgtcattgagtgtgtcactgtccttttcgctaagccaccccggttccacctggttcgaccgcgatctgacgcttgctgggagagtcattgtaaaatgtcctacctccggaagactagagcagcagctcgtgcacgttgagcgacccattctgcgcattccacatttggccatccacttacagcgcaatattaacgagaactttgggcctaatacagagatgcaccttgtgcccatcctagcgactgctattcaagaagagctcgaaaaagggacaccggagccaggccctcttaatgctgtcgacgagcggcaccattctgttctgatgtcccttctgtgcgcccacttgggcttgtcccctaaagatatcgtggagatggaactatgcctcgccgatacacagcctgtggtgcttggcggagcttatgatgagtttatttttgcaccccgcctcgataatctgcactcctgtttctgcgcattgcaggccctcattgactcgtgtgccgggcccggctccctggctacagagcctcacgtcagaatggttactttgtatgacaatgaggaagtgggatccgagagtgcacagggagcacagagtctgctgaccgagctagtgcttcggcgaatatcggccagctgccagcacccaacagcattcgaggaggccatccctaaaagcttcatgatcagtgctgacatggcacatgcagtacatcccaactatctggacaaacatgaagaaaatcatcggcctctctttcacaagggccccgtgattaaggtgaacagtaagcagcggtacgcctccaatgctgttagcgaggccctgattagagaggtggctaacaaagtaaaggttcccctccaggatcttatggtccgtaacgataccccctgtggtaccaccatcggacccattcttgcttctcgcttggggctccgcgtgttggatctgggatccccccagctggcaatgcattctatcagggagatggcctgcactactggcgtcttgcagactttgactctattcaagggctttttcgaactgtttccttcactctcccataacctgctggttgactag

SEQ ID NO: 26913 - DNA, 1296 bp, Artificial Sequence
  Description of Artificial Sequence: Synthetic coding sequence
atggaaggggtcggcggactgtggccctgggttcttggactactgagccttcccggggtgatcctgggggccccccttgccagcagctgcgcaggtgcctgtgggaccagctttccggacggcctgacgccagaagggacacaagctagtggcgataaagatataccggccatcaaccagggcctgatcctcgaagaaacaccagaaagcagtttcctgatcgaaggagatataataaggccctcacctttccgtctcctctccgccacgagcaataaatggcctatggggggaagtggcgttgtcgaggtgccgtttctgctgtcgtctaagtacgacgaaccatctagacaggtgatcttagaggcactggccgaattcgaacgctcaacatgcatccgctttgtgacttaccaggatcagcgcgactttatttccatcatccctatgtatggttgttttagttccgttggacggagcggcggcatgcaggtggtgagcttggccccaacgtgcctccagaagggacggggaattgtcctgcacgaactaatgcacgtgctgggcttctggcatgagcataccagagctgatcgcgatcgttacattagggtaaactggaatgagatcctgcccggctttgagattaattttattaaatcccagagctctaatatgttgactccctatgattactcatctgtcatgcattatgggcggctagcattcagcaggagggggcttccaactataacccccctttgggccccctctgtgcacattgggcaaagatggaatctgagtgcctccgacataacgagggtccttaaactctatggttgcagccctagcggcccaagaccgcggggacgtggctcgcatgcccatagcactggacgctcaccggcgcctgcgtctctgtccctgcagaggctgctggaagccctgtccgcagagagcagatcgcccgatccatctggctccagtgctggaggccaaccagtacccgctggtccgggtgagagcccccatggatgggagtccccggcgctgaaaaagctctctgccgaggccagcgcccgccagcctcagacactggcatcatcccccagatccaggcctggggccggagcgcctggggtagctcaggaacaatcttggctcgctggcgtttctactaaacctacggtcccttcctctgaagccggaatccagccagtaccagtgcaaggcagtccagccctcccgggcggttgtgttcctagaaaccattttaagggcatgtcagaagactag

SEQ ID NO: 26914 - DNA, 2040 bp, Artificial Sequence
  Description of Artificial Sequence: Synthetic coding sequence
atgggcatccgagggttgatgtcgttcgtcgaggaccattcaaatgaattcttcactgacctcaaactgagagatacaaagatcgtaattgacgggtacgccctgtttcaccgcctatgcttcagcagtaatttggatttgagatatggaggggactacgattcattcgccgacgtcgttcagaaattcttcgaaagtttattcgcttgtaatatttgtccatacgttgttctggatggtggctgtgatataagcgataaaaagctgacaaccctgaaagaccgtgcccgggagaaaatccaaatggcccactcactgagtgtgggtgggtcaggctatgtgtgtccacttctgataagggaagtctttatacaggtcctgattaagctccgtgtgtgctttgtccaatgtttctccgaggcagaccgggatatcatgaccctggccaaccattggaactgtccagtgctgagctcggattctgatttttgcatattcgatttaaaaacgggcttctgcccgttgaattcttttcaatggaggaatatgaataccatcaaaggtacccaaaattacatacctgcaaagtgcttctcacttgatgctttttgccaccacttttctaatatgaacaaggctttgctgccgctatttgccgtgttatgcgggaatgaccacgtgaatctcccaatcatggagactttcctgagtaaagctcgcttgcccctgggagccacctcttctaagggcagacggcatcaccgcatcctcgggctcctgaactggctgagccatttcgccaatccgacagaggctctcgataacgtgttgaaatatctccccaagaaggatcgcgagaacgtgaaagagttactatgttgtagtatggaagagtaccagcagtcgcaggttaagctgcaagattttttccagtgcggtacgtatgtgtgccctgatgcactcaatttgggattgccagaatgggtgcttgttgccctggctaaggggcagctgtctcctttcatttcagatgccctggttctgaggcgaactatcttgcctacccaggtggagaacatgcagcaacccaacgctcatagaatctctcagcccattcgacagattatctacggcctcttgctgaatgcttcaccgcacctggacaagacatcttggaatgccttgccaccacagcctcttgccttcagcgaagtcgagcgaatcaataagaacatccggaccagcattatcgatgccgtggagctcgcaaaagaccacagtgacctgagcagattgactgagctgagtctgagacgccgtcagatgctgctcctggaaacgcttaaggtaaaacagacaattctcgagcccatcccaactagcttaaaactgccaatagcagtgtcttgctattggctgcagcacaccgaaacaaaagctaagttacatcatctgcagtctcttctgctgacaatgttagtaggcccgctcattgctataattaattcccccggaaaggaggagctacaggaggacggcgctaaaatgctgtacgccgagttccagcgcgtgaaagcccagacccggctaggcacacggctggatctcgacacagcacacatattctgccagtggcagagttgtttacagatgggtatgtacttgaatcagctcctgagtacacctctgccagagcccgatctgacccgtctatactccggcagtttggtgcatggtctctgtcagcagctcctcgcctctacctcagtggagagcttattaagtatctgcccagaggcaaaacagctttatgaatatttgttcaacgccacccgtagctatgcgccagctgaaattttcctgccaaagggccgcagcaactcaaaaaagaaacgtcaaaagaaacagaatacctcttgctcaaaaaacagagggcgcacaacggcacataccaaatgttggtatgagggcaataaccgttttggcttgcttatggtagaaaatctggaggaacactcagaggcctccaatatcgagtag

SEQ ID NO: 26915 - DNA, 1194 bp, Artificial Sequence
  Description of Artificial Sequence: Synthetic coding sequence
atgggaatccgaggacttatgagcttcgtggaagatcacagcaatgagttctttacggacctcaagcttagggatacaaagattgttatcgatggatacgccctgttccaccgcttatgcttctcatctaacctggacctccggtatggaggggactatgactcttttgcagatgtcgtgcagaaatttttcgagtccctctttgcatgcaacatttgtccctatgttgtgttggatgggggttgtgacatctccgacaagaagctaaccaccctgaaagatcgagcaagggagaagatacagatggcgcactccctgagtgttggtggttcagggtatgtatgccccctactcattcgggaggtgttcatccaggtgctcatcaaacttagggtatgctttgtgcaatgttttagcgaggctgacagagatataatgacactcgccaaccactggaactgtcctgtgctatcttccgactccgatttctgtatttttgatcttaagactggcttctgtccacttaattctttccagtggcgcaacatgaatacgatcaagggcacccaaaactatattccagccaaatgtttctcactggatgccttttgtcatcacttttcaaatatgaataaggcgctgttaccccttttcgctgttctgtgtggaaacgaccatgtgaacctgcctattatggagactttcctgagcaaggctagactgcctctcggtgctacctctagcaaagggcggcgccatcaccgcattttgggtctgctgaactggctgagtcactttgctaatccgaccgaggcccttgacaatgtcttaaagtacctgcctaaaaaggacagagagaacgtgaaggagctgctatgttgtagcatggaggaatatcaacaatcccaggtgaaactgcaggacttctttcagtgcggtacatatgtgtgtcctgacgccctcaatctgggcctcccggagtgggtgctggtggcgctcgccaaagggcagctctcgcccttcattagcgacgctctggtgctgcggagaaccattcttcccacacaggtcgagaatatgcaacctctggcattctcagaggtcgaaaggatcaataagaacataaggacttccatcctaacagcccataatgcctctggggcactcgactgtcacaaccaacaaccttggtag

SEQ ID NO: 26916 - DNA, 147 bp, Artificial Sequence
  Description of Artificial Sequence: Synthetic coding sequence
atgggtatccggggcctgatgtcttttgtggaggatcactcaaatgaattctttactgacctgaaattacgtgacacaaagatcgtgattgatggctatgcgcttttccatcgcctttgcttttcttcaaatctcgacctccgctag

SEQ ID NO: 26917 - DNA, 153 bp, Artificial Sequence
  Description of Artificial Sequence: Synthetic coding sequence
atgggaataagagggctaatgtcttttgtggaggatcattcgaacgagttttttactgacctcaagttaagggataccaaaatcgtgatcgatggatatgctcttttccatcggctgtgtttctcctccaaccttgaccttaggtatgggtag

SEQ ID NO: 26918 - DNA, 24 bp, Artificial Sequence
  Description of Artificial Sequence: Synthetic coding sequence
atgggaattcgcggtttgatgtag

SEQ ID NO: 26919 - DNA, 255 bp, Artificial Sequence
  Description of Artificial Sequence: Synthetic coding sequence
atggagcggaagaacgacccacttccaatcagcactgtaggcactcgcggcaagggaccgaaaagggatgagcaatatagaatcatgtggaacgagcttgaaactctggttagggcccacattaataattctgagaaacatcagagagttcttgaatgcctgatggcctgcagatctaagcccccagaagaagaagagcggaagaaggaagaagaacgaggaaagactaagaggacttcacaaaggaaacaatag

SEQ ID NO: 26920 - DNA, 2121 bp, Artificial Sequence
  Description of Artificial Sequence: Synthetic coding sequence
atgaagatattttcagagagccataagaccgtttttgttgtagatcattgtccttatatggcagaaagctgcaggcagcacgtggagttcgacatgctcgtgaaaaacagaacccagggtataatcccactcgcccccattagcaagagcctgtggacctgttcagtggagagttccatggaatactgccgcatcatgtatgatatcttcccttttaaaaagcttgtaaacttcattgttagcgatagcggtgctcacgtcctaaattcctggacccaagaggatcagaatttgcaggaactaatggcagccttggctgcagtgggcccacctaacccacgggccgatccggagtgttgttctattctgcacggtctcgtggccgccgtggagaccctctgcaagatcacggagtaccaacacgaggcccggacccttctcatggaaaacgcagagagagtgggcaacaggggaagaattatttgtattactaacgctaagagcgactcacacgtgcgtatgttggaggattgtgtccaagagaccatccatgaacataataagcttgctgccaacagcgaccacctgatgcagatccaaaaatgtgagctagtgctgattcacacttacccagtaggggaagattcacttgtgtcggatcgcagtaagaaagagttaagccctgtgttaaccagtgaagtacattcagttcgggctggccggcacctagcaacaaagctgaatatcttggtccagcagcactttgatcttgcttctaccacgatcaccaacatccctatgaaggaggaacaacacgcaaatacatcggctaattatgatgtagagctactccaccataaagacgcccacgtcgattttctcaagagcggcgatagccacttgggcggcggctccagagagggctcctttaaagagactatcacccttaagtggtgtacccccaggaccaataatattgagctccattattgtactggcgcttacagaatctcacctgtggatgtgaatagtagaccgtccagctgtctcactaactttctcctgaatgggcggtctgtgctcctcgagcagccacggaagtctgggtctaaggtgatcagtcacatgctgagttcccacggcggggaaattttcctccacgtcctgtcatccagtcgctctatcctggaggaccctccgagcatcagtgagggttgtggggggcgtgtcactgattatcggataaccgactttggtgaatttatgagagagaaccggctgactccattcctggaccccaggtacaagattgacggatccctcgaagtgccgttggaacgtgctaaagatcagctggagaagcacactcgctactggcctatgatcatttcccagactacgatcttcaatatgcaggcagtggtgccacttgcatccgtgatcgtcaaggagtccctaaccgaggaagacgtgctgaactgtcagaagaccatctataatctcgtcgatatggaaagaaagaatgatccactgcccatttcaaccgtgggtacgcgaggtaaggggccaaagcgcgatgagcaataccgtatcatgtggaatgagctggaaacgctggtgcgcgcgcacataaataactcagaaaagcaccagagggtactcgagtgtttaatggcctgcagatcaaagcccccagaagaagaggagcggaaaaagcgtggaaggaagcgcgaagacaaggaggataagtccgaaaaggcggtgaaggattatgagcaggagaagtcctggcaggatagtgagaggctgaagggcattctcgagcgaggcaaagaggagttagctgaggccgagataatcaaggactcaccagacagccctgaaccacctaacaagaaacccctggtggaaatggatgagacaccccaggtggaaaaatcaaagggcccagtaagcttgctgtccctttggagtaatagaattaataccgcaaacagtcgcaaacaccaggaatttgccggaaggcttaacagcgttaataacagagctgaactgtatcagcacctgaaagaagaaaacgggatggaaaccaccgagaatggaaaggcatccaggcagtag

SEQ ID NO: 26921 - DNA, 882 bp, Artificial Sequence
  Description of Artificial Sequence: Synthetic coding sequence
atggtcgttctcttctattggaataaccacgagtctcaggtgcttaaatctttggtgatatgtctggttgcgatggaagagcgttttctgcacgtcctaagcagttccagaagcatcttggaagaccctccaagcatctcagagggttgtggaggtagagtcacagactacagaatcaccgtggtcccccttgcatcagttatagtcaaggagtctctgactgaagaagatgtcctgaattgtcagaagacgatttacaatctagtggatatggagcgcaagaatgacccactgccgattagtaccgttgggacccgcggcaaaggccctaagagagacgaacaatatcgcatcatgtggaatgagctcgaaaccctggtgagagcccatattaataacagcgagaagcaccagagggtgttggaatgcctgatggcctgtcgatccaagcctccagaagaggaggagcgcaagaagcgagggaggaagagagaagacaaggaggataagagcgaaaaggccgtcaaagactacgagcaagaaaaatcctggcaggacagtgaaaggctcaagggcatactagagcgcggtaaggaagagctcgccgaggcagaaattatcaaagactcgccggactcccctgagccacccaataagaagccactggttgagatggacgagaccccacaggtggaaaagtcaaaaggcccagtttcgctgctgagcctatggagcaaccgcattaacaccgctaacagtagaaagcatcaggaatttgcgggcaggctgaatagtgtgaacaatagagccgaactctaccagcatctaaaagaagaaaacggaatggaaaccaccgaaaacggtaaggcttccaggcagtag

SEQ ID NO: 26922 - DNA, 492 bp, Artificial Sequence
  Description of Artificial Sequence: Synthetic coding sequence
atgaagatcttctccgagagtcacaagacagtgttcgttgtcgatcactgcccctacatggctgaatcgtgtaggcagcatgtggaatttgacatgttagtaaaaaatcgtacccagggaatcatcccattagccccgatctcgaaatctctgtggacctgctcagtggaatcctctatggagtactgccgaattatgtacgacatcttcccttttaagaagctcgtcaattttattgtttccgattctggcgcccatgttttgaattcttggacccaagaagaccagaatcttcaggagttgatggctgctttagctgcagtgggccccccaaatcctcgcgcggatcctgagtgttgcagcattctgcatggtctggttgccgccgtggagaccctgtgtaagataacagagtatcagcatgaagcacgcaccctcctgatggaaaacgccgaacgcgtcggcaataggggcaggattatctgcatatag

SEQ ID NO: 26923 - DNA, 375 bp, Artificial Sequence
  Description of Artificial Sequence: Synthetic coding sequence
atggccgccctcgcggccgtgggtccaccaaaccctagggcagacccagaatgttgctcaattctgcacggtctcgttgcagcagtcgagacactctgcaaaataaccgagtaccagcacgaggcacggacgctgttaatggaaaatgcagaacgggtgggtaataggggtcggattatctgtataacgaacgcaaaatctgattcacatgtccgaatgctggaggactgtgtgcaggaaacaattcatgagcacaacaagctcgcggctaactcagaccacttgatgcagatacaaaagtgcgagttggtgctgatccatacttaccccgtcggagaggactctctggtctcagacaggtcaaagaaggagtag

SEQ ID NO: 26924 - DNA, 1818 bp, Artificial Sequence
  Description of Artificial Sequence: Synthetic coding sequence
atggccgcactggcagccgtcgggccacccaatcctagagctgaccccgagtgttgctccatcttacacggtttagttgccgccgtagagactttatgtaaaatcactgaataccagcatgaggctcggaccctgctgatggaaaatgctgagagagtcggaaatagaggcaggataatatgcattaccaatgcaaagtctgatagccatgttaggatgctcgaggactgcgtccaggaaacgattcatgaacataataagctggcggcaaactccgatcatctgatgcagatacagaaatgcgagctcgtcctaatccacacctaccctgtgggcgaggattccctggtgtctgaccggagcaagaaagagctaagccctgtgttaacaagtgaagtccactctgtgcgtgctgggcgccacctggccaccaaactgaatatcctcgtgcaacaacattttgatctcgcaagcaccaccattaccaacatcccaatgaaggaagaacaacatgccaataccagcgctaattacgatgtcgagctgttacaccataaggacgcccacgtcgacttcctgaagtctggagatagccatttgggggggggatctcgagaggggagctttaaagaaaccatcacactgaaatggtgtacccccaggactaacaatattgaacttcattattgcaccggtgcatacaggatttcaccagtcgatgtgaactcccggcctagcagctgcctaacaaacttcctgcttaatggtcgctcggtccttctcgaacagccacgcaaatcagggagtaaggtcatctctcacatgctcagtagccacggaggagaaatcttcctgcacgtgctttcgtctagtcggtcaatcctggaagatcccccgagtatctcagagggctgcggcggcagagtcacggactataggattacagactttggtgagttcatgcgtgagaatcgcctgacaccgtttcttgatccacggtacaagatcgacgggagcctggaggttcccctggaacgcgctaaggaccagctggagaaacatacaagatattggccaatgataatctctcaaaccactatctttaacatgcaggccgtggtgccactcgcaagcgtgatagtgaaggagtcgttgactgaggaggatgtgctgaactgccagaagaccatatataatctggtggatatggaacgaaagaacgatccactgcccatctccactgtgggtactcgcggcaaggggcccaagcgcgacgagcagtaccgaattatgtggaatgaattggaaaccctggtgagggcccatattaacaacagcgaaaagcatcagcgcgtgctagagtgcttgatggcatgcaggtccaaaccgccagaagaggaggagcgtaaaaagcggggtcgcaagagggaggataaagaagataaaagtgagaaggcggtgaaggactacgaacaagaaaagtcttggcaggactccgaaagactcaaggggattcttgagcggggcaaggaagagctagcagaggccgagattattaaggacagtccagatagccctgagcctccaaataaaaagccgctcgttgaaatggacgagacaccacaagttgagaaaagtaaggggcccgtgtcactactgtcactctggagcaatcggatcaataccgcaaattccagaaagcatcaggagttcgctggtaggcttaatagtgtgaacaaccgtgccgagttgtaccagcatctcaaggaggaaaatggcatggaaactacagagaatgggaaagcctctcgtcagtag

SEQ ID NO: 26925 - DNA, 678 bp, Artificial Sequence
  Description of Artificial Sequence: Synthetic coding sequence
atgaaaatcttctctgaaagtcacaaaactgttttcgtggtagaccattgcccctacatggccgagtcatgccggcagcatgtagaatttgacatgcttgtaaagaatcggacccaaggaataatcccattagctccaattagtaagagcctttggacctgcagtgtcgagtccagcatggaatactgcaggattatgtacgatattttcccattcaaaaagctcgtgaacttcatcgtgtcagattcgggggcccacgtgctgaacagctggacacaggaggaccaaaaccttcaagaattaatggccgcattggccgctgtgggaccgcctaatccccgggcggacccagagtgctgttcaatcctgcatggccttgtcgccgcagtggaaaccctgtgcaaaatcaccgaatatcagcatgaggctcgcaccctccttatggagaacgcagaacgagtggggaacagggggagaatcatttgtatcaccaacgctaagtccgattcacacgtgaggatgctggaagactgcgtccaggaaaccattcatgagcataacaagctcgcagccaactccgaccacttaatgcagatccaaaagtgcgaactcgtgctgattcatacctatcccgtgggagaggatagcttggtgtctgatcgatcaaagaaagagtag

SEQ ID NO: 26926 - DNA, 4812 bp, Artificial Sequence
  Description of Artificial Sequence: Synthetic coding sequence
atgcgcgtgaagccacagggacttgtcgtgacatcctccgccgtgtgtagctcacctgattaccttcgcgagcccaagtactaccctggagggccaccaactcctcgtcctttactccctacccggccacctgccagtccacccgataaagcattctccactcacgctttctccgagaatccaagaccaccgccccgccgtgatccttcaacacggaggccgccagtgctggctaagggggacgacccccttcccccccgggccgctcgtccagtttctcaagcgaggtgtcccacaccagtgggggatggcagttcttcacgccggtgctgggataacggaagagttaatctgagaccagtagtacagctcatcgacattatgaaggacttgaccagacttagtcaggacctgcagcactcaggggtacatctagactgcggaggcctgaggttgtccaggcctcctgcaccccccccaggcgatcttcagtacagtttttttagctcaccgagcctcgctaattccattcgctcacctgaggagcgcgctactccccacgctaagagcgaacgccctagccatcctttgtatgaacctgaacctgaaccccgggattccccccagcctggccaggggcacagtccaggagcaactgctgccgctacaggcttgccacccgagcccgaacctgattcgaccgactactccgagctggctgatgctgacattttgtccgagctcgcctccttgacctgccccgaggcccagttgcttgaagcgcaggctctcgagcctccctcaccagagcccgaaccccaactcctggaccctcaaccaaggttcctggacccacaggctctggagccactaggtgaggctcttgagttgcctccactccaaccccttgctgatcccctgggattgcccggcttagccctgcaggccttggatactctgcccgactccttagaatcccagcttttggatcctcaggcattagatcctcttccaaagctattggacgtaccaggtaggcgcctagagccacagcagcctctgggacactgcccactagccgagccattaaggctcgatttgtgctctccccacggccctccaggcccggaaggccatcccaagtacgctctacgcagaaccgaccgacccaagatcctatgccgcaggagaaaagctggacgaggcagaaaagcagacgccggcccagaagggagactgttgcccctgcccatgccaactggcctcgttgccgccctggctgaacctcccccgcctcccccaccacccccaccggcccttccaggaccagggcccgtttcagtccccgaactgaaacccgagtccagccagactcccgtcgtcagcacacgaaagggcaagtgtaggggagtgaggcgaatggttgttaagatggccaaaattcctgtgagcctagggagaagaaataagacaacttataaggttagcagcctgtcttcatccctctctgttgaaggcaaggagcttgggcttagggtttctgcagagccaactccactgcttaaaatgaaaaataatggtcgtaacgtggtggtcgtgttcccaccgggcgagatgcctatcattctcaagaggaagaggggccgacccccaaagaacctgctgctgggaccaggcaagcctaaggaacccgccgttgtggccgctgaagcagctaccgtggctgcagccacaatggccatgccagaggtgaagaaaagaagacgtcgcaaacaaaagctggccagcccccagccatcgtatgccgctgacgcaaacgacagcaaagctgagtatagcgatgtactggccaagctggctttcctgaaccgccagagtcaatgcgccggtaggtgttcccctccccggtgctggaccccatccgagcctgaatcagtccatcaggcacctgacacgcagagtattagccactttctacacagggtgcaggggtttcgcaggcgcggcggcaaagccggcggatttggaggacgggggggaggtcacgctgcaaaatctgcaaggtgtagttttagcgatttctttgaggggattggcaagaagaagaaggtggtggctgtggctgctgcaggggtggggggcccaggcctgacagaacttgggcaccctaggaagcggggacgaggtgaggtggacgccgtcacaggcaaaccaaaaagaaaacggcggtctaggaagaatggcacactcttccccgagcaggtacccagcgggccaggattcggagaagcaggtgccgaatgggccggtgataagggcggcggttgggcacctcatcacggacaccctggagggcaggccggcaggaactgcgggtttcaaggaactgaagcaagggctttcgcctccactggccttgaatctggcgctagtggccggggctcgtattatagcactggagctccgtccggtcagacagagctctcacaggagaggcaaaatctgttcaccgggtacttccgctctctcttagattctgacgattcttccgatctcttagattttgccctctcagcgagccgacccgagtctaggaaggcatcaggcacctacgccggccctccaaccagcgctcttcctgctcagcgtggactggccactttcccaagtaggggcgcaaaggcctcacccgtcgcagtagggtctagcggcgcaggcgccgacccatctttccagcccgtcctgtccgcgaggcagaccttcccgcccggcagagcagcttcgtatgggctgaccccagctgcatccgactgccgggctgccgagactttccccaaactggttccccctccaagtgcaatggcccgctctccaactactcatccgccagccaatacgtatttgccccagtatgggggctatggagccgggcagtcagtgtttgcccccaccaaaccctttaccggccaggactgtgcaaacagcaaagactgctcgttcgcgtatggttcaggtaactcacttcctgcaagtccttcatccgcccattctgccggctatgcccctcccccgactggcgggccctgcctgcccccttctaaggctagttttttctccagttccgagggcgcccctttctcaggatccgcacctactcccctgcgatgtgacagcagggcttcgacagttagtcctggtggttatatggtgccaaaaggtaccaccgcctccgccacctcggctgccagcgctgcttcttcttcctcctcctcttttcagcccagccccgagaattgtcgtcagttcgccggagcaagtcagtggccctttcgccaggggtacggtggactggattgggcgagtgaagctttttcccagctgtataacccctcctttgactgtcacgtcagcgagccaaacgtgattctcgacatttcgaactatacccctcaaaaggtgaagcagcagacagctgtgtcggagactttttccgagtcctcgtccgactctacccagttcaatcagcccgtgggaggtgggggtttccgcagagccaactccgaggcctcaagctccgaggggcaatcttccctgtcctctctcgaaaagctcatgatggattggaacgaggcttccagcgcccccgggtacaattggaatcagtctgtgctctttcaaagctcctccaagcccggccggggtagacggaagaaagtggatttgttcgaagcgtcccatctgggcttcccaaccagcgcaagcgcagctgccagtggatatccatctaagaggagcactggacctcgacaaccccgtggcggtcgtggaggaggcgcatgtagcgccaagaaggaacggggtggtgccgctgccaaagcaaagttcattcctaagccccagcccgtgaacccactgttccaggacagtccagacctgggtctggactactatagtggtgactcgtctatgtctcctctaccttctcaatccagagctttcggcgtcggtgaacgggacccttgcgactttataggaccctactcaatgaatccctcaactccttcagatggtacgttcggccaaggttttcactgtgattcaccttctctgggagcaccagagctcgacggcaagcactttcctcctctcgcacatccccctacagtatttgacgcgggtctccagaaagcctactctcctacgtgctcacccacccttggatttaaagaggagctccgccctcctcccaccaagctggcagcatgcgaaccattgaagcatggtctccagggcgcctctctagggcatgccgcagctgcccaagcccacctgtcctgccgggatttgccactgggacagccacactatgattcacctagctgtaaaggcacagcttactggtatccaccaggctcggctgctcgttctcctccttacgagggtaaagtcggtaccgggctcctggcagactttctcggaaggactgaggcggcatgccttagtgcaccccatctggcatccccaccggccactccaaaggctgacaaggagccacttgagatggcgcgccccccgggccctccgcgcggaccagctgcggccgccgctgggtacggttgcccgttattgtcagatctgactcttagccccgtgcctcgggatagcctcctgccgctgcaggacactgcctaccggtaccctggttttatgccgcaggcgcatcctggtcttggcggaggccccaagagtgggtttctgggaccgatggctgagccacatcctgaggatactttcacagttacatccctgtag

SEQ ID NO: 26927 - DNA, 4812 bp, Artificial Sequence
  Description of Artificial Sequence: Synthetic coding sequence
atgcgggttaaacctcaagggctggtggtgacctccagcgccgtgtgtagcagcccagactatctccgagagccaaaatactaccccgggggacctcccaccccacgtcctctgctcccaactcgaccaccggcgtccccccctgataaggcattcagtacccatgcattctctgaaaacccacggcctcctccaagaagggatcctagtacacgtaggccccctgtccttgccaaaggcgacgatcctttgccgccccgcgctgctcgccctgtgtctcaggctcgctgtccaacccctgtaggggacgggtcttcctcacggcgctgttgggataacgggagggtgaacctgaggcctgtggtccagctgatcgatatcatgaaggatttaacacggctgtcccaggacttacagcacagcggtgttcatctggactgcggaggactgcgactttcaagaccacccgctcccccacctggggatctgcaatacagcttcttctcctctccttcactcgcgaacagcatacggtcccctgaagaaagagcaacaccccacgcaaaatctgaacgacccagccatcctctgtatgaaccagagccggagcctcgggacagtcctcagcctggacagggccactctcctggcgccaccgccgcagctactgggctcccaccagaaccagagccagactcaacggattatagcgagctggcagatgcggacattctttcagagctagccagcttaacatgtcctgaagcccagctgttggaggcccaggccctagagccgccatcccctgagccagagccacaactactcgatccccaacctagatttttagacccacaggctctggaaccactgggcgaggcattagagttaccccctttgcaaccattagcagacccgctggggctgcctgggttagccctccaggctctggacaccctccctgattctcttgaatctcaactcttggatcctcaggccctggatccattgccaaaactgttagatgttccagggcgcagactcgagccccagcaaccattgggccactgcccacttgctgagccgctacggctggacttgtgcagcccccatggccctccgggccccgagggccaccctaagtatgctctccgtagaacagacaggcctaaaattctttgccgccggaggaaggctggtcgcggacgcaaggccgacgcgggaccagaaggaaggctgcttccgctgcccatgcccacaggcctcgttgcagccctggccgagccccctccgcctcccccacctcctcccccggctctgccagggccgggcccagtgtcagtaccagagctgaagccagagagcagccagacacccgtggtttccactagaaaaggaaagtgtaggggggtccgccggatggttgtgaaaatggccaagatccccgtaagccttggccgtcgcaataagacaacttataaagtgtcgagtttgtccagcagtctctctgttgaagggaaggagcttggacttagggtgagcgccgagccaactccactgctgaagatgaaaaacaacggacggaacgtggtcgtggtgttcccaccaggggagatgcccatcattctgaaacgcaagcgggggaggccgcccaagaatctgctactgggaccaggaaaacctaaggaaccggcagttgtggccgctgaagctgcaacagtggccgccgcgaccatggcaatgccagaagtgaaaaagagaaggagacgaaaacagaaactggcctccccccagccatcctatgcagccgacgccaatgactccaaggcagaatactcagacgtactggccaagttagcattcctcaataggcagtctcagtgcgccggacggtgcagcccaccacgttgttggaccccaagtgagccggaatctgtgcatcaggccccagacacccaaagcatctcacacttcctgcatcgtgtgcagggattcaggcgcaggggaggcaaggcagggggctttggaggtagaggagggggacatgccgcaaagtcggcaagatgttccttctcagatttctttgagggcattggaaaaaagaagaaggttgttgccgtcgcggccgccggcgtggggggacctggactgaccgaattagggcacccacggaagcggggtaggggggaagtggatgccgtgacgggcaaacctaagcggaaacgaagaagcaggaagaatggaaccctatttcccgaacaagttcctagtggaccaggctttggcgaggccggtgctgaatgggcaggcgacaagggcggtgggtgggcacctcatcacggccaccccgggggccaggccggccgaaactgcgggtttcaggggacagaggcacgagccttcgcttctaccggcctagagtccggagcctcaggcagaggctcatactactctacaggggctccttccggccagactgagttgtcacaagaaaggcagaatctattcaccggctactttcgttcactcctggattccgacgactcctcagacctactggactttgccctttcagcctcaagacctgaatcacgcaaagcctcgggaacatacgccgggcctcccaccagcgccctcccagcccagaggggtctggcaacattcccctcaaggggcgcaaaggcgtcacctgttgctgtcgggagcagtggagccggagctgacccttctttccagccggttttgtcagcccggcagaccttccctcctgggcgggccgcaagttacggactaaccccagcagcgagtgattgtcgggcggctgagacttttcccaaactggtgcctccaccatctgcgatggctcgttcgcctacaacacaccctccggctaacacttatttgcctcagtacgggggatatggcgccggccagtctgtatttgcaccgacaaagccatttacaggacaggactgcgccaactccaaagactgctctttcgcctatggtagtggtaattctctgcccgcatcaccctcgagtgctcatagcgccggctacgcgcctccccctacaggaggaccctgcctgccaccctccaaggcttctttcttctcatccagcgagggggcgccgtttagcggcagcgccccgacaccattgaggtgcgattctagagcaagtacagtgtcaccaggcggctacatggtacctaaaggcacaaccgcttctgccacctccgccgcaagtgcagctagctcctcaagctcctcttttcagcccagccccgagaactgtcggcagtttgcaggagcaagccagtggccttttaggcagggctatggcggactcgactgggccagtgaagccttcagccagctgtacaacccttcgttcgattgtcacgtctcagagcctaatgtgattctggacatatcaaattacacccctcagaaggtcaagcagcagacagctgtcagtgagaccttttccgaaagcagcagtgactcgacccagttcaatcaaccagtcggtggaggcggctttagaagggctaattcagaggccagcagttcggagggccagagcagtctctcctccttggaaaaactgatgatggactggaatgaagcctctagcgcccccggctataattggaaccagtctgtactgtttcagtcttcaagtaagccgggccgcggccgcagaaagaaggtggatctgtttgaagcctcccacctgggtttccccacttccgccagcgccgcagcaagtggatacccatcaaaaagatctactgggccacgacagccgcgtggaggcaggggtgggggcgcctgctcagctaaaaaggagagaggtggcgccgccgcaaaagcaaagtttatcccgaaaccccagccagtgaaccctctcttccaagactccccagacctgggattggattactacagtggagactcgtctatgtcccccttgccgtcgcagtcacgggccttcggcgtgggagaacgggatccctgtgacttcattggaccttacagtatgaacccctctacaccatcagatggaacttttgggcagggattccactgcgattcgccctctctgggggctcccgagctcgatggaaaacactttcccccactagcacaccccccaactgtatttgacgccgggttgcagaaggcatatagcccgacgtgttctccaaccctgggatttaaggaagaactgcgcccccctccaacgaagctggccgcttgtgaacctctgaaacacggactacagggcgcttcccttggacatgcagcagctgctcaggcacacctgtcctgtcgggacctgccacttggtcaaccccattacgactccccaagctgtaagggaacagcttattggtatccgccaggcagcgccgcccgcagccccccctacgaaggcaaggtaggaacgggactgctagcggatttcctgggacgtactgaggctgcctgcttgagcgctccacacctggcctcaccccccgcgacgccgaaggccgacaaagaaccattggaaatggcacggccccctgggccgccccgggggcctgctgccgcagctgcaggctacgggtgccccctgttgtccgatctgacactcagccccgtgcccagagatagcttgctgcctctccaagatacagcttaccgataccccggcttcatgcctcaagctcacccgggccttggcggcgggccaaagagcggattcctgggtcccatggccgaacctcaccctgaagacacgttcacagttactagtctttag

SEQ ID NO: 26928 - DNA, 450 bp, Artificial Sequence
  Description of Artificial Sequence: Synthetic coding sequence
atgcgggtgaagccgcaggggctagtggttacctcctccgccgtgtgctcaagtccagattacctcagagagcccaaatattacccgggagggccccctacacccaggccccttcttcccacgaggccaccggcctcacccccagacaaagctttttccactcatgctttcagcgagaatccgcgtccacccccaaggcgagacccaagcacccgacggcccccagttcttgccaagggagacgatccactgcctccccgtgccgctagaccagtctcccaggccagatgccctactccagttggtgatggcagcagttcgcgcaggtgctgggataacggacgggtcaatctcaggccagtagtccagctcattgatatcatgaaggatctcacaagactgtcgcaggatttacagcatagcggggtgcacctggactgtggtggatag

SEQ ID NO: 26929 - DNA, 1239 bp, Artificial Sequence
  Description of Artificial Sequence: Synthetic coding sequence
atggaagcactgcaaaagcagcaggcggccaggttggctcagggagttggccccctggcaccggcctgtccattactgcccccgcagccaccactacctgaccatagaacgctccaagcacccgagggtgccctcggtaacgtgggcgccgaggaggaagaagatgccgaggaagatgaggagaagcgcgaagaggcaggcgccgaagaggaggcggccgaagagagtaggccaggcgcccaggggcccagctcaccctcatcccaacccccagggctccatccccatgaatggacttatgaagaacagttcaagcagctgtatgagctagatgccgatcctaagaggaaggagttcctagacgatcttttctctttcatgcagaagcgcggaactcctgttaatcgcgtgccgattatggccaaacaggtcttggacctgtatgcccttttcaggctcgtcaccgccaaaggaggccttgtggaggtgatcaatagaaaagtttggcgagaggtgaccagagggctgtcccttccaactacaattacctcagccgctttcaccctgcgcacacagtatatgaaatacctgtacccctatgaatgcgagaccagagcactttctagccctggtgagttgcaagctgcaatcgatagcaacaggcgcgaagggaggcggcaggcatataccgctacaccccttttcggactcgccggcccgcctcctcggggggcccaggatccggcgctcggcccggggcccgccccaccagcaacacagagcagtcctggcccagctcaggggtccacaagcggccttccagcgcacgcttgtgcacagctctcaccaagtccaattaagaaggaagagagtggtattcctaatccttgtctggctctgccagtcgggctggctctgggcccaacgagagaaaagctagcgcccgaggaacctcccgaaaagcgcgcagtgctcatgggccctatggaccctccaaggccctgcatgccgccaagcttcttacctcgcggtaaagttcccctgcgggaagagagactggatggtcccctgaacttggcagggtcaggcatttctagcatcaatatggcccttgaaattaacggagttgtgtacaccggagtccttttcgccagaagacagcccgtgccggcatcccaagggcctacaaaccccgctcccccgcccagcaccgggcccccatcctcaattctgccatag

SEQ ID NO: 26930 - DNA, 441 bp, Artificial Sequence
  Description of Artificial Sequence: Synthetic coding sequence
atgaccagcgaaaggtcgagaatcccctgcctgagtgccgccgctgcggaggggacgggcaagaagcagcaggagggccgcgcaatggccaccctggacagaaaggttcctagccccgaggcgttcctcggcaaaccctggtccagttggatagatgccgctaaactgcattgctctgataatgtagatctggaggaggcaggcaaagaggggggaaagtccagagaagtaatgagacttaataaagaagacatgcacctgttcgggcactatcccgcccatgacgatttttacctcgttgtctgcagcgcctgcaatcaagtggtgaagcctcaagtcttccaaagtcactgtggccggaaacaagataatagaagaaacgagggtatcagcagatctggccctgaatcctcacaggctatcgagaaacaccaggtgtag

SEQ ID NO: 26931 - DNA, 1602 bp, Artificial Sequence
  Description of Artificial Sequence: Synthetic coding sequence
atggacggagcggatgagagtgagaaacttgattgccaattctcaacacaccatccaagaccattagcattttgtagctttgggtccaggcttatgggcaggggttactacgtattcgataggagatgggaccggttccgcttcgccctgaacagcatggtcgagaaacacctcaatagtcagatgtggaagcatcggaatcctagccaccgcgcctcaggaccgtcccccttattcagaacttgtttaacaaaccttctcagcctttctaatatcggtgctgcctgggtgtccactcttgaatccgtggctcccaggtacccactgaatctcgcagcacagactcctggaccaggaggccccgaacccggtggtatggctgcggatggcggcgtagaagatatccgtaagaagcgtaacggccaggactcgtttttcttcaacaaacatctcacccttcaccaagagccgcccacacagtactcactttcggcaagaaaaatccctccagccgctgactcaccgctgccctctcctgccgcacatattaccacgcccgtgcctgcctccgtactgcagccattttctaatccgtcagctgtgtacctcccatccgcccctatatcatcacgcctgactagcagttatataatgacctcagcaatgctttctaatgccgccttcgtgaccagccccgaccccagcgccttgatgtctcatacgacagcctttcctcatgtggcagctactctatcaatcatggacagcacttttaaagctcccagtgctgtttctccgattcctgctgtgattccctccccgtcccataagcctagcaaaacgaagacttctaagtcctccaaggtgaaggaccttagcacccgctctgatgagagcccttctaacaagaagagaaagccacagtcctccactagttcatctagttcctcatcctccagctctctgcagacctccctgagttcacctctttccggtccccacaagaagaactgtgtcctgaacgctagcagtgccctaaattcttaccaggctgcaccaccatataacagcctctcagtgcataattcaaataatggcgtgtccccactgtctgctaagctggagccttctggccgcacttcgctccccggcgggcccgccgacatcgtgcggcaagtgggagctgttggaggttcctccgacagttgccccttgagcgtgccatctctcgccttacatgccggagatctgtcgttggcctctcataatgccgtgagctcgttgcctctgagctttgacaagtccgagggaaagaaacgaaaaaattccagttcatcctccaaggcatgtaagatcactaaaatgcccggaatgaattcggtgcacaaaaagaaccccccttccctccttgcacccgtgccagaccccgtgaactctaccagctcacgccaagtgcgcgacctcctggctccaccaagcccagcacttggtggaaggggatcctgggctgcacccctactgagtagagcggctccgactggcaataccagccttattcctgtgcttgtgttccctgaaggctcttttcatcctctgctttag

SEQ ID NO: 26932 - DNA, 2586 bp, Artificial Sequence
  Description of Artificial Sequence: Synthetic coding sequence
atgacgtccgagcgtagccgaattccctgcctgagcgccgccgctgccgagggcaccggaaagaagcaacaggagggccgtgcaatggcaacgttagacagaaaagtccccagcccagaagcctttctgggcaaaccctggagctcatggattgacgccgccaaactgcattgcagtgacaacgtagacctggaggaggccggtaaagagggcgggaagagccgagaagtgatgagattgaacaaagaggacatgcacctgttcggacattatcccgcacacgatgacttctatttagttgtgtgctcagcctgtaaccaagtagtcaagccgcaggtcttccagagtcactgcgaaaggaggcacgggagcatgtgcagaccttcccccagcccagttagccctgctagtaatcctcggacatcattggtgcaagtgaagacgaaggcttgcctgagtggccatcactcggcctcatcaaccagcaaaccgtttaaaacccctaaggacaacctactcaccagcagtagtaagcaacacaccgttttccctgctaagggctctcgcgataagccctgtgtccccgtgccagtggtgtctctagaaaagattcccaatttggtgaaggctgatggagcaaatgttaagatgaattccaccaccactactgccgtgtctgcctcaagcacctcttcaagtgctgtatccactccgccactaataaaacctgttctgatgtccaagtctgtgccccctagtccagagaagattctcaacggcaaagggattctccccacaacgatagataagaagcaccagaacggaacgaagaattccaataaaccctatcggcgcctgtcagaaagagaatttgatccaaacaagcattgcggtgtgctagaccccgaaacgaagaaaccatgcacccgaagcctgacttgcaagacccactccctgtcacacaggcgcgccgtccccggccgtaagaaacaattcgatctgctgcttgccgaacataaagctaagtcacgcgaaaaagaggtgaaagacaaggagcacttgcttacctccacccgtgaaatcttaccatctcagtccgggccagctcaagatagcctgctggggagttcagggtcaagcggcccagaacccaaggtggcatcaccagcaaagtcacggccacccaattctgtccttccccggccttccagtgctaacagcatctcaagtagcacatctagcaaccactcaggacacaccccagaaccacccctgccacccgtcggcggagatcttgcttcaagactgtccagcgacgaaggcgagatggatggcgctgacgagagtgagaagcttgactgccaatttagtacacatcacccccgcccacttgcattctgtagctttgggtcccggctgatgggacgaggctattatgtgtttgatcgacgctgggacaggttcaggttcgcattgaattctatggttgagaagcacctgaattcccaaatgtggaagaagatcccgccagccgctgactctccactcccctccccagctgctcatattactaccccggttccggcctcagtcctgcagccatttagcaacccgtctgctgtctatctgccatcagctcccatttcttccaggctaacctccagttatattatgacctctgccatgctctctaatgccgcttttgttacgagtccggatccctccgctttaatgagccacaccactgccttccctcatgtagctgccacactctcaattatggattccacttttaaggcaccctcagctgtgagccccatcccagctgtaatcccgtcccctagtcataaaccctcaaaaacaaagactagtaaatccagcaaggtcaaagacttgagcacacgttcggatgaatcccctagcaacaagaagagaaagcctcagtcctctacctcttcttcttcgtctagcagctcctcttcattgcagacatccctcagctctccgctgagcggacctcataagaaaaattgtgtgctgaacgcttcttctgctctgaactcttatcaggccgcgccgccttataatagtctgagcgtccacaactctaacaatggagtgagcccgttgtccgccaagctggagccatctggcaggacctccctgcctggcggcccagcagatattgtacgccaggttggggcagtcgggggcagtagcgattcttgccctctctccgtgcctagtctggccctccatgccggcgacctctcactcgccagccacaatgcagtttcctctcttcccctgagcttcgacaaatcagagggaaagaagagaaagaattccagctcttctagtaaggcctgcaagattaccaaaatgcccggtatgaattccgtgcacaagaaaaacccgccatctctgctcgcccctgtgccagatcccgtaaactctacgagctcccgtcaggtggggaagaatagtagcttagccctgagccagtcttccccaagtagtatatcaagtcccggccactcaagacagaacacaaatcgaaccggacgtatcagaacattgccatag

SEQ ID NO: 26933 - DNA, 2217 bp, Artificial Sequence
  Description of Artificial Sequence: Synthetic coding sequence
atgtgtaggcccagcccctctcccgtctctccagcctcaaatcccagaacatctctggtccaggtgaaaactaaagcatgccttagcggtcaccatagtgcctcttctacctcaaaaccctttaagactcctaaagataacctcttaacgtcctcatccaaacagcatacagtgttccctgctaaaggatcccgggataagccctgtgtcccagtgcccgtcgtgtcccttgagaaaattcccaacttagtgaaagccgatggggcaaacgtcaagatgaacagcaccacgaccaccgcagtatctgcaagttccaccagctcctccgctgtgagcacaccaccccttatcaagccagttttgatgtctaaatccgttcccccctccccagagaagattctcaacgggaagggtatattgcccaccactatcgacaaaaagcaccaaaatggcacaaaaaactccaacaagccctatcggcggttgtctgagcgtgagttcgaccccaataaacattgcggagtgctggatcctgaaacgaaaaaaccttgtactaggtccctgacatgcaagactcatagcctctcccaccgccgagctgtgcccggtcgtaagaagcagttcgatctgctcctggctgagcacaaggcaaaatccagagagaaggaagttaaagacaaggagcacctcttaaccagcactagggagatcctgccctctcagagcgggcccgctcaagatagcctcctcggctcttctgggtcttcggggcccgaacccaaggtggccagccctgcgaagagcaggccacctaattcggttctgccccggcctagttccgccaatagcatctcatcatccacttcatccaaccactcaggacacactccggagcctcctctcccaccagtgggcggggatctggcctcccgcctcagtagcgatgaaggggagatggacggagccgacgaatccgagaaattagactgccagttctccactcatcatcccagaccattggccttctgctccttcgggagccgtctcatggggcgcggctattacgtcttcgaccgcagatgggacagattccgttttgcactgaactccatggtggagaaacatttgaacagtcagatgtggaaaaaaattccaccggccgccgattcccccttgcccagccccgcagctcatattactacccctgtccctgcctcagtgctgcagcccttcagcaacccctccgctgtgtacctgccatccgcaccgatttcctccaggctgacaagttcgtacattatgacatctgcaatgctgagcaacgccgcatttgtcacttctccagatccgtcggccctaatgtcacacactaccgctttccctcacgtggcggcgactctgtctattatggattcaacatttaaagcgccctcagctgtgtccccgatccctgctgtcattccatctccaagccacaaacctagcaagaccaagacatccaagtcgtccaaagtgaaagacctcagtacaaggtctgacgaatcaccatccaacaaaaagcgtaagcctcagtctagcacctctagctctagttcttcttctagttcctccctgcagaccagcctctcatctcccctttccggacctcacaaaaagaattgcgtcctgaatgcctcctctgctctgaattcctaccaagccgcaccaccctataactcactgagtgtgcataactcgaacaatggggtcagcccactgtccgctaaactggagccatcgggccgcacaagtctgccgggtggccccgcggatatagtgcggcaggtgggcgccgtcggaggaagctctgactcgtgtccccttagtgtgccctcgctggcgctccacgccggcgatctcagtctggcttctcacaatgctgtgagtagcctgccgctttccttcgataagagtgaggggaaaaagagaaagaatagctcctcatcttcgaaggcatgtaaaatcacaaagatgcccggaatgaactccgtgcacaagaagaaccctcctagcctcctcgccccggtgcccgatcccgttaacagtacatctagtagacaggtcggcaagaactcttccctcgccctgagtcagtcatctccaagcagtattagctcgccgggccactccagacagaaaaatactaatcgcacggggcgaatcagaaccttaccttag

SEQ ID NO: 26934 - DNA, 1050 bp, Artificial Sequence
  Description of Artificial Sequence: Synthetic coding sequence
atgccgcggggtggaacccaagcatctagcgaggagtccgaagaagaggggacatccgacgacttgcatcccccccctgattgccactacgccacacgcccgccccgtcctcaggccttttgcactttcggcagtaggctggttagccccggctgttatgtgttctctcgacgcttagacagattctgttcagccctttcaagtatgttggaaaggcacctgagcacccacatgtggaaaaagattcctcccgctgcggagccccctgcacatttggtgaactcgccactcagcgcccctctgtcaccctcaagtaccgggacctgtccccggctcccaggccccactctgcggcctgcttgcccagcatccatgcctccaaccaaggataatctggtgccgagttaccctgccggcagcccgtccgtggctgccgcttgttctcaggctgagtgtatgggtggcagccaggctattaccagcccactccctgccaataccccaagcccaagcttcagcaagctgccaccatccaaggccagcaagagttcgaaggggaaagacggggtcgaagttgaagctcctagtcgcaaacgcaaactaagccccgggcctaccacacttaagcgtacgtgtatacttgagcccacaggaaagggaaagccctccggctgccggggcctcagcgctaagaccaagacagcactgagtatgggcctcaacggcacaatgggcccccgcgttaaacgcgctggacccttggattgtaggggatcaccacatcaactccctacaccagtaaaggcgagccaacttgaaaatcgcggcgccgctgggcacccggcaaaggctctgcccacaaactgtctctcggaggaggaagtggcgaagaagcggaaaaatttggccacctattgccggcccgtaaaagccaagcactgccaggccggagctccagcggatgtggcttgcagcgtcagacggaagaaaccaggcccagcgcttgcttttgaagaaaagtgcagcaccttaaagtctaaagcgcattag

SEQ ID NO: 26935 - DNA, 2169 bp, Artificial Sequence
  Description of Artificial Sequence: Synthetic coding sequence
atggctgtgagagaaagggccgctgccgccatggcggccctggagcggcgggtgccgagcctggatgattttgctggccagtcatggtcgtcctgggtcgaaagggccgacttgccagcggctgacggggctgaactcgaggagtcatctaagaatacaaagaaactcgatgcgatgacattgatcaaggaggatatgtcaatcttcggccactgcccagctcacgacgacttttacttggtggtgtgtaatcactgtagccaggtggttaagcctcaagcattccagaagcattgtgaaagacgccatggccctttgtccaagctgtatggcagggcccctcccccacccccagccccagcatcatctcaaaagtgccatgtggtcaatggacagggccccgcctgtcgggctccgggctccacaaaaacttcctcacgagaaaagggacagggaagcagaagtcgtggtcatcaaccgcctgaaaagacccagaaggataatctgtgtcagcctggcgggcttactaaggattccccaggcaagccgcccatggcgccaccatctaaagaaccacccgggcgggaaaacatcgaaatcatcccaagcgagggttccagtcattgggctgaagggagccctccggagaaagagccatccggaacccgtctgccacctaagacacaccgaaaaatggcccgcaaagaatgcgatctgaatcgtcagtgcggtgttatcaaccctgagactaaaaagatttgtacgcggcttctgacttgtaagatccacagtgtccaccaacgaagagaagtccaagggcgcgcaaaagatttcgatgtgctagtggctgagctgaaagccaattcgcgcaagggcgagtcaccgaaagaaaagtcacctggtcggaaagagcaagtcctcgaacgcccgtcacaggaacttccatcttcagtgcaagtcgttgcggctgtggccgcaccctcatccactttttcggtgcgcgctaaacagacatatccgtattgtgcgctgccaaggtctcgcgccagttctgagtccgagctggacgacgagggcccatgcgggggcgatggagatcccggactcttccctttccctatgccaagaggtggcacacaagctagctccgaagagtctgaggaagagggaacaagcgacgatctacaccccccacctgattgccactatgcgaccagaccaccccggccgcaagccttctgcaccttcggttcacgtctggtgtctccaggatgctatgtgtttagtagacggctggaccggttctgttctgcattatctagtatgctggagaggcacctatccacccacatgtggaagaaaattccccccgccgccgagccccctgctcacctcgtgaacagcccactgagtgcgcctctgagccccagtagcacggggacatgtccgcgactgcctggtcccactttacgacctgcctgccccgcgagcatgcccccaactaaggataatctggtgccaagctacccagctggctccccatccgtggccgcagcttgctcccaggccgagtgcatgggggggtcacaggccatcacttcccctttgcccgccaacacaccttcgccatcgttctccaaactccccccttccaaggctagtaaatcaagcaaggggaaagacggcgtcgaagtcgaagcaccctcgcgcaaaagaaagctctcacctggacctactaccctgaaaagaacatgtatcttggaaccgactggcaagggaaagccctcgggatgtcgcggtctcagcgccaagaccaagacagctctgtcaatgggactcaatggaacaatgggaccaagagtaaagcgggccggcccattggattgtcggggcagcccacaccagcttccaacacccgtgaaagccagtcaactggagaaccggggggccgcaggccatccagccaaagcactcccgaccaattgcttgagcgaggaggaggtggccaagaaacgtaagaatcttgcgacctactgcagaccagttaaagctaaacactgtcaggcgggtgcacccgcagatgtcgcctgctctgttcggaggaagaagccgggtcctgcgctggcatttgaagagaaatgcagtaccctcaagtcgaaggcgcactag

SEQ ID NO: 26936 - DNA, 1743 bp, Artificial Sequence
  Description of Artificial Sequence: Synthetic coding sequence
atggccgttagagagagagcagctgctgccatggcagctctcgagcgtcgcgtgccatccttagatgattttgcaggtcagtcatggtcttcatgggttgagagggccgatttaccagcagcagacggcgccgagctggaagaaagcagcaaaaacaccaaaaagctggatgcgatgacgcttatcaaagaggatatgtctattttcggacactgtcccgcgcacgacgatttttatctcgtggtctgtaatcactgtagccaggtggttaagcctcaggcctttcagaaacattgtgaaaggaggcacggacctctctcaaagctgtatggtagggcccctcccccaccacctgcccctgcatcttctcagaagtgtcatgtcgtgaacgggcagggccccgcttgtagggccccagggtccacaaaaacgtcatcccgggaaaagggccagggttctagatccaggggacaccagcctccagaaaagacacagaaggataatctatgtcaaccggggggactcaccaaggactcacccggtaagccacccatggcaccccccagtaaagagcctccagggcgggagaatatcgaaattattccctcagaaggtagctctcattgggctgagggtagtccccctgaaaaggaaccctcaggaacccgactgcccccgaaaacacatagaaagatggcgcggaaagagtgtgaccttaatcggcagtgcggagtcattaaccctgagacaaagaaaatctgtacgcggcttttgacctgtaaaattcacagcgtgcaccagaggcgggaagtgcagggcagggcaaaggatttcgatgtgctggtcgcggagctgaaggcgaattccagaaagggcgagtctccgaaagaaaagagccccgggcggaaagagcaggtcctagagagaccatcgcaggagcttccaagcagtgttcaggtggtcgccgcagtcgctgccccttcgagcacattttcagtccgcgccaagcagacatacccatattgtgccttacccagatctcgcgcaagctctgagtcagagctcgatgacgaaggcccttgcggcggggacggcgatcctgggctatttccatttccaatgcctagaggcggtacccaggccagctcagaggagtctgaggaggaaggcacttccgatgacctgcacccgccaccggactgccactacgcaacccgtcccccaaggccccaggcattctgcaccttcgggagccgtctggtgtctcccggttgttacgtgttctccaggagacttgaccggttttgttccgcgttgtcctctatgttggaaaggcatttgagcacccatatgtggaaaaaaatcccccccgcagccgaaccaccagctcacctggtgaattctcctctctcggcacctcttagtccaagtagcacaggcacgtgtcctcgcctccctgggcctactctgcggccagcgtgtccagccagcatgcctcctactaaggataacctggtccctagttacccagccggcagccccagtgtggccgccgcctgctcccaagccgagtgcatgggtgagcctggctaccatctcacgaccgcctgtcagcacgccatcccagtgcttcagcaggctgcagcttttcagggtcaacaggtcatccagcgacaaggaaggggaggggggggcggcccattctcaaaggcagaggtaatcccatggccctaccactcttag

SEQ ID NO: 26937 - DNA, 294 bp, Artificial Sequence
  Description of Artificial Sequence: Synthetic coding sequence
atggaggaaatttccttggccaatcttgatacgaacaaattggaagctatcgcccaggagatctatgtcgacctgattgaggatagctgtttgggtttctgtttcgaggtccacagagctgtaaagtgtggatatttttatctggagtttgctgagacaggaagtgtcaaggatttcgggatccagcctgtcgaggacaaaggcgcatgccggctacccctctgctctttgcccggtgagccagggaatgggccagaccaacagctccaaagaagcccacctgaattccaatag

SEQ ID NO: 26938 - DNA, 1860 bp, Artificial Sequence
  Description of Artificial Sequence: Synthetic coding sequence
atgcttctggcaagcgccgtggtggtgtgggaatggctgaatgaacatgggagatggaggccctactctcccgcagtgagtcaccatattgaagcagtcgtacgggccggacccagggcaggcggcagcgttgttcttggacaagttgacagtcgtctagctccctacattattgacttgcaatccatgaaccagttccgccaggatactggcaccctcagacctgtgaggcgaaactattacgacccctcttctgcacccgggaaaggagttgtctgggaatgggaaaatgacaatggctcctggacgccatatgacatggaagtagggataaccatccaacacgcttacgaaaagcaacacccctggattgatcttacgtccattggctttagctacgttattgatttcaatactatgggccagattaatcggcagacccaaagacagaggcgggtaaggcgcaggctggacctgatatatccgatggtgaccgggaccctgccaaaggcccagagttggcccgtctcccccgggcccgcgaccagcccaccgatgtctccttgttcatgtcctcaatgcgtcctagtgatgagcgtgaaggcagcagtcgtcaacggatctactggcccactgcagctgcccgtgacacgcaagaacatgcctccaccaggcgtggtcaagctgccgcccctccccgggtcaggagccaagcctctggactcgaccggtaccatccggggaccactgaagactgccccttcacaggtgattcgcaggcaggcttccagcatgcctactggcacgaccatgggatctcctgcctccccacccggacctaactcgaagacagggcgcgtagcactggcaaccctcaaccgcactaacctgcaacgcctcgctattgcccagtctcgtgtccttatcgcctccggggtgcccaccgtcccagtgaaaaatttaaatggctcctcaccggtgaaccccgcactagccggaatcactgggatcctgatgtccgccgctggtttaccggtgtgcctaacccgacctccaaaactggttttgcaccccccaccagtatctaagagtgagatcaaatccatacccggagtgagcaatacctctcggaagactaccaaaaagcaggctaagaaaggaaaaacacccgaggaggtcctcaagaagtacctgcaaaaagtccggcacccgccagatgaagattgcacaatctgcatggagcggctcacagcgccatctgggtataaaggcccccagcctactgtcaagccggacctagtcgggaagctttcacgttgcggccatgtataccatatttactgcctggttgcgatgtataacaatggcaacaaggatgggtctctgcagtgccccacctgtaagaccatttatggtgtaaagaccgggacgcagcctcccgggaagatggagtaccacctgattcctcacagcctgccagggcatcctgattgcaagaccattcgtataatctactccattcctccgggtatccagggaccagagcatcccaaccccggcaagtcttttagcgcccggggattcccacgacactgttacctccctgattctgagaaaggccgtaaagtgctaaagctcctgctcgtggcctgggaccggcgactgatcttcgccattggcacaagctctaccacaggcgagtccgatactgtgatttggaacgaggtccatcacaagaccgagtttggctctaaccttacaggccacggatatcctgatgctaactacctggacaatgtgctcgccgagttagccgctcaggggatttcggaagacagcaccgctcaggagaaggattag

SEQ ID NO: 26939 - DNA, 996 bp, Artificial Sequence
  Description of Artificial Sequence: Synthetic coding sequence
atggctgtggccatggtcaagctgtgcgagagggctggactgcccttacttgcagctccactcttacgcagtctcctgcctagggccccacagcccgggccagcacagccccgctctgtgcagggacaaaggtgccccgctaggcatccccccggcaatctcgtttgcgaaagaggcgcgggagtcaacggagtcacagctggtgccggtggaaggttaagagggcttcatcggggtggccgcgccctcggatgttctgcccatcgtccactccattccgcccgagtgcggcccccagctcatttggcagcaccaccaggatcaagcgctagaggttgcaggcttactgaactcggttacgcactgaacgagtggctccaagatatacgtaaaaatcagcttcccggactgttaggtggcgtgggacctatgcacagcgtcgtacagctcttccagggctttcgcgacctgctctggctgcctatcgaacaatacaggaaagatggtaggttaatgcggggccttcaaagaggggcggcttcttttggaagctctacagcctccgcggctctggagctatccaaccggcttgtgcaggcaatccaggctaccgctgaaacagtttacgacatcctctccccggcagcccccgtgtcacggtcgcttcaggacaaacgaagcgctcggcgcctccgccgcggccagcaaccagccgacctcagagagggcgtcgcaaaggcctatgacacggtgcgcgagggaatcctggatacagcccaaaccatttgtgacgtggcttccagagggcatgaacagaagggactgaccggcgccgtgggcggcgtgatccggcagctgccaccgacggtggtcaagcccttgatccttgcgactgaggcgacctcctcactgctgggaggtatgagaaatcagatcgtgcccgatgcacacaaggatcatgccctgaagtggagatcagactctgcccaggactag

SEQ ID NO: 26940 - DNA, 5817 bp, Artificial Sequence
  Description of Artificial Sequence: Synthetic coding sequence
atgagccggtggctatggccatggtccaactgcgtgaaagaaagggtttgtcggtacttgctgcatcattatctggggcactttttccaagagcacctctccttagatcagctttctctggacttgtataagggttccgtcgctctgagagacatccacctcgagatctggagcgtgaacgaagtgctcgagtccatggagagccccctggaactagtggaaggcttcgtaggctccatcgaggtggcagttccttgggccgccctcctgaccgatcactgtaccgtccgcgtgtcaggactccagttgaccctgcagccacgccgcggccctgctcccggcgctgctgatagtcaaagctgggcgtcgtgcatgacaacttcactacaactggcgcaggaatgcttgagagacggtctgcctgaacctagtgagccaccccagccattggaaggcctcgagatgttcgcacagacaattgaaacagtgctcagacggatcaaagtgacgtttcttgataccgtggttagagtcgagcatagccccggagatggggaacgtggcgttgcggtagaggtacgggtacagcggttagaatactgcgacgaagcggttagggacccctcacaggctcctcctgtggatgttcatcaaccgcctgccttcctgcacaaactgctccagctggccggggtgagactacactacgaggagttgccagctcaggaggaaccgcctgaacctcccctccagattggatcatgttccggttacatggaactcatggtcaagctgaagcagaacgaagccttccccgggcccaagctggaggtggccggacagcttgggtctcttcaccttctgctcactcccagacagttacagcagctgcaggagctactctccgccgtctcgctgacggaccatgaagggctcgcagacaaactgaataaatcaagacccttgggcgcagaagacctgtggcttatcgagcaggatctcaatcagcagctgcaggcgggggcggtagcggaacctctctcaccagaccccctcacaaatccattgttgaacttggacaacaccgacctgttcttttccatggccgggctaacatcaagtgtggccagtgccttgagcgaactgtcattgtcagatgtcgacctggccagcagcgtgcgctccgacatggcaagtcgcagactcagcgcccaggctcaccccgccgggaaaatggcccccaatcccctgttggatactatgcggcctgactctcttttaaaaatgacacttggtggggtgacgttgactctgcttcagacctctgcaccaagctctggccccccggacttagccactcacttttttacagaatttgatgcgacaaaagatggccctttcgggagtagggatttccaccatctcagacctcgctttcagcgcgcctgtccatgttcacacgtgcgactgaccggcaccgccgtgcagctgagttgggagctgaggacaggcagtaggggacgacgcaccactagcatggaggtccacttcgggcagctggaggtcttggaatgcctatggcctcgaggcacttcagagcccgagtacaccgaaatactcaccttccctgggacgctggggtcccaggcctccgcgaggccctgtgctcacctgagacacacccagattcttaggcgagttccaaagtctaggcctcggcgctcagtggcatgccactgccacagcgagttagctctggacttggcgaacttccaggccgacgtggagctgggagctctggatagattagccgccctgctcagattagctaccgtgcccgctgagccgccagcgggcctgttaacagaaccattgccggccatggaacagcagactgtgtttcgactgtccgctccccgggccaccctgcgcctccggttccctatcgcggacctgaggccagaacccgatccatgggccggccaggcagttcgtgctgagcagctgagacttgaactctccgaaccccaattcaggagcgagcttagttccggacccgggccccccgtgcccactcacctggaactgacatgcagcgatctccacggaatctacgaggatggggggaagcccccggtcccatgcctccgcgtgtccaaggccctggaccccaaaagtaccgggcgtaagtattttttaccgcaggtggttgtgactgtcaatccccagagcagttccactcagtgggaggtggcccccgaaaagggagaggagctagaactctccgtggagtcgccatgcgagctacgggagcccgagccatcgccattcagcagcaaacgaaccatgtacgaaacagaagagatggtaatccctggcgaccccgaggaaatgaggacattccagagccgaaccctggccctctctaggtgcagtctcgaagtcatcctgccatcggtgcacatatttctgcctagtaaggaagtttatgaatcgatctacaatcgcatcaataatgacctgctgatgtgggagcctgccgatctgttgccgactcccgatcccgccgcccagccatcaggatttcccggaccatctggtttttggcacgattctttcaagatgtgtaagtccgccttcaagctcgctaactgctttgacctcaccccagacagtgatagcgatgatgaagatgcacacttttttagcgtcggcgcctccggcggcccacaggcagccgcgcccgaggccccctctcttcacctgcagtccacgttttctacactcgtgaccgtcttgaagggccggataactgccctgtgcgagacgaaagacgagggaggaaagagattggaagcagtccacggcgagctggtgttagatatggagcatggtacccttttctccgtttcccagtattgcggacaacccggcctggggtatttctgccttgaggcggagaaggccactctgtaccaccgcgcagcggtggatgactatccactcccctcccacttggatttaccctccttcgctcccccagcacagctggcccccactatatacccatccgaagagggtgtcacagaaaggggggcatccggaaggaaaggccagggcagaggtccccatatgctttctactgcagtgaggattcacctcgaccctcacaagaatgtcaaggaatttctcgttacgctgcgccttcataaggccactctgcgccactacatggctcttcctgagcagtcatggcatagtcaactgctagagttcctggacgttctggacgaccccgtgctgggctacttgccacccactgtgataacaatactgcacactcacctgttttcttgttcagtggactaccggcccttgtatctccctgtcagagtgcttattacagcagagacattcaccttgtcgagcaacatcattatggacaccagtaccttcctgctccggttcatccttgacgactcagccttgtatctgagtgataaatgcgaggtggagaccctggacctgcggcgagactacgtttgcgtgttagatgtggacttactcgagctggtaattaagacttggaaagggagtacagagggcaaattgtcacaacctctgtttgaactgcgctgcagtaataacgtggtgcatgttcattcctgcgcagacagttgcgcactgcttgtgaacctgttgcagtatgttatgtctactggcgatctccacccgcccccgcgcccgcctagccctacagagattgccgggcaaaagctgagcgaaagtccagcctccctgcctagttgtccccctgtggagacagccttaatcaaccagcgagatctagcagatgcactcttggataccgagagatcacttcgggagttggctcagccctccggcggtcacctgccgcaggcttccccgataagcgtctacctatttcccggcgagcggtccggggcaccgcccccaagccccccagtgggtgggcctgccggcagtctgggaagttgcagcgaagagaaagaggacgagagagaagaggagggagatggggatactctcgactccgatgaattttgcatcctggacgcccccgggctggggatccctcccagggacggggagcccgtagtgacacagttgcaccccggaccaatcgtggtgagagacggctatttttctcggccaataggctcaacagacctattgcgagcacccgctcactttccagtgcctagtactagagttgttctgcgggaagtgtcgctggtctggcacctctatggggggcgcgattttggtccacatcctggccatcgggcgagaacggggcttagcgggcctagatcaagtccgagtcggtgctctggaccgaacagaccgcagaattcttggcgcacccagggcggtagcgggcgccagcaccacgttctgatggagattcagctcagcaaggtatcgtttcagcacgaagtgtaccctgccgaaccagctacaggacctgccgcgcctagccaggaattagaagagcgcccacttagccgccaggtcttcatcgtgcaggagctggaggtcagggataggctagcgtccagccagatcaacaaatttttatatctccatacgtctgagcgaatgccgaggagggcccattccaacatgctgacaataaaggctctccatgtggcccctacgactaacttagggggcccggagtgctgcctgcgggtgagcctaatgcccctgcgattgaacgttgatcaggacgccctgttttttctgaaggacttttttacatcactcgttgccggtataaatcccgtcgtgcccggggagacctcggcagaggcccgccccgaaacacgcgctcagccatcgagccccttggaggggcaggcggagggggtggagactaccggaagccaggaagcccctgggggagggcactccccctcccctcctgaccagcaacccatctatttccgtgagttcaggttcacaagtgaagttcctatttggttagactatcacggaaaacacgtgaccatggatcaggtgggaacctttgcgggtctgctgattgggttggcgcaacttaactgctcagaattaaagctaaagcgcctctgttgtcgccacggcctcctcggcgtggacaaggtcctgggatacgccctgaacgagtggctccaggacatcagaaagaaccagctcccaggtctgctgggtggtgtgggacctatgcactcagttgtgcagttgtttcagggatttagagatctgctgtggctgcccattgaacagtatcggaaagatggtaggctaatgaggggcctacaacgaggtgctgcatccttcgggagctcaacagcatctgcagctctggagttgagcaataggctagtgcaggccattcaggccacagcagagacagtttacgacattctcagcccggcagcccccgtgagcaggagcctgcaagacaaacggtctgcaagacgactgcgtcgcggccagcaacccgccgatctgagagaaggtgttgcaaaagcctatgacacggtgcgagaaggaattctggacaccgcccagacgatctgtgatgtggcaagccgggggcacgagcaaaagggcttaacaggcgccgtgggaggagtgatacgacagctgccccccaccgttgtcaaacccctgattctggccactgaggccacttccagcctcctcgggggcatgcgcaaccagatagttcccgacgctcataaggatcacgctttgaaatggcgaagcgacagcgcacaggactag

SEQ ID NO: 26941 - DNA, 5823 bp, Artificial Sequence
  Description of Artificial Sequence: Synthetic coding sequence
atgagtcgatggctctggccatggagtaattgcgtgaaggaaagggtgtgccggtatctactgcatcactaccttgggcacttttttcaggagcacttgagcctggatcagctttcactcgatttgtacaaaggcagcgtcgctttaagagatatccatcttgagatttggtcggttaacgaggttctggagagtatggagagtcccttagagctagttgaaggcttcgtgggctccattgaagtggctgtcccgtgggcagcactgctcaccgatcattgcacggtgcgagtttccggcctccagcttacactccagccaagaaggggtcccgccccgggcgcggccgacagccaatcttgggcctcttgcatgactacaagcttacaactggcacaggaatgcttgagagatggcctgcccgaacctagtgagccaccacagcccttggaaggactagagatgtttgcacaaactattgaaaccgtgttgcgaaggattaaggtgacatttttggataccgtcgttcgggtcgaacactcacccggcgatggcgagcgcggagttgccgtggaagtgcgggtgcagaggcttgagtattgcgatgaggcagtcagggaccccagccaggcaccgcccgtggacgtacatcaaccgccagcctttctgcataagctgttacagctggccggggttagactgcattatgaagaacttcccgctcaggaggaaccccctgagcccccattacagatagggtcctgttctgggtatatggagctgatggtcaagctgaagcagaatgaagcctttcccggtcccaaattggaggtggctggacagttgggttctctgcacttgctgttaacccctaggcagctgcagcagctccaggaattgctgtcggccgtgagtctgaccgatcatgaaggcttggcagacaagcttaataaatctagacccttgggtgcagaagatctctggcttatcgaacaggatctaaatcaacagctgcaggctggcgcagtggctgagcccctgtccccggacccacttaccaacccgctgttaaatttagacaatacagacctttttttttcaatggctggcctcaccagtagcgtcgcctctgcattatccgaactgtccctcagtgacgtggacctggcatccagtgtgaggtctgacatggcctcacggaggctatctgcccaggcacaccccgcgggaaagatggcccccaacccactcttggacacgatgcgaccagatagccttttgaagatgactctggggggtgtaaccctcactctgcttcagacctcagctccgtcctctggaccccccgacttggcaacccacttcttcacagaattcgacgctacgaaagacggaccttttggaagtcgggactttcaccacctcaggcccagattccagagggcttgtccatgctcacatgtacgtcttactggcaccgccgtgcaactatcatgggaattgcgcactggcagcaggggcaggcggaccacctcaatggaagtgcatttcggccagcttgaagttctcgagtgcctatggcctaggggcacgagtgaaccagagtacacggagattctcaccttccctgggaccctcggctcccaggcctccgcccgcccctgcgcccacctgagacatacccagattctcagacgggttcctaagtccagacctagacgctcagtcgcgtgccactgccatagcgagctcgcccttgacttggccaactttcaggccgacgtggaactgggggccctagatcgtctggccgccctgctgcggcttgctaccgttcccgccgaacctcccgcgggactgctgaccgaacccctgccagctatggagcagcagaccgtttttaggctttctgcaccccgggcaacactgcggcttaggttccctatcgcggatttgcgccctgagcccgacccatgggcaggacaggcagtgagagctgaacagctccgattggaattatctgagccccagttcaggtcggaactgtcttctggcccaggcccaccagtacccacccacttagaattaacatgttccgacctccatgggatttacgaagacggaggtaagcccccagttccgtgcctgagggtgtccaaagctctggaccccaagtccaccggccgcaaatactttctgcctcaggttgtagtcacagtgaacccacagagtagtagcacacagtgggaggtcgcaccagagaagggcgaagaattggagttatctgtcgaatctccttgtgagttacgggagccagagccgtcacccttctcaagtaagagaacaatgtacgagacagaggaaatggtcattcctggagaccccgaagagatgcggacatttcaatctcgtactttggccctttctagatgctcactggaagtgatcctcccaagcgtacacatcttccttccttcaaaagaggtttatgagagcatatataacagaatcaataatgacctgctgatgtgggagcctgccgatcttttacccacacctgaccccgctgcccagcctagtggattcccgggtcccagtggattttggcatgattctttcaaaatgtgtaagtcagcttttaagcttgccaattgctttgacttaactccagactcagatagtgacgacgaagacgctcatttcttcagcgtcggcgcctcaggggggccccaggctgctgcccctgaagctccgagtctgcacctccagtctaccttctctaccttagttacagtcttgaaggggcggataacggcgctatgcgagactaaggatgagggcggaaagcggctcgaagcagtgcatggcgaattggttctggacatggagcacgggaccctattcagcgtgtctcagtattgtgggcagcctgggctgggttatttctgcctcgaggcagaaaaggccacactataccaccgggcagccgtggacgactacccattgcccagtcacctggatctccccagctttgccccgcccgctcagctggcccccaccatctatccatctgaggaaggagtcaccgagcggggcgcgtcaggtagaaagggacagggacgtggacctcatatgctgtctacagccgttcggatccacctcgatcctcataagaacgtgaaagaatttctggtgacactcaggttgcacaaagccactctgcgacattacatggccctccccgaacagtcatggcattcccagctgctcgagtttctagatgtgctagacgaccccgttcttggctatcttccccccaccgtgatcacaattctgcacacccaccttttttcctgttccgtcgattacaggccattgtatctcccagtaagagtgcttattaccgccgaaacctttacactcagttctaatatcattatggatacaagtacgtttctgctccgcttcattctggacgactccgccctgtacctctccgacaagtgcgaggttgagactctggacctgcgcagggattatgtctgcgtcctggacgtagatctgttggaacttgtgattaagacatggaagggttctacggagggcaaactctctcagccactgttcgaactgaggtgcagcaataacgtggtgcatgtgcacagctgtgctgattcgtgtgcactactggtcaaccttctccagtacgtgatgtcgaccggcgatctacatccacctccccgccctccaagccccaccgagattgcaggccagaaagtgcagctgtccgagtcccccgcctcattgccatcttgcccccccgtggaaacagccctgataaaccagcgcgatctcgcggatgcgctcctagataccgaacgtagtctgcgggagttggcccagcctagcgggggccatctcccccaggcgtctccgatctccgtttatctcttccctggagagcgaagtggggctcctcctccaagtcccccggtcggtggcccggcggggagccttgggtcatgctccgaggagaaagaggacgaacgagaagaagaaggagacggtgacaccctggatagcgatgagttttgtatcctggatgcccccggcctcgggattcctccccgcgacggagagcctgttgtaacacaactccacccgggtcccatcgtggtcagggacgggtactttagcaggccaattggcagcaccgacttacttagagcacccgcccacttcccagttcctagcactagagtggtactgcgggaggtttcgctggtgtggcacctgtatggaggtcgcgacttcggcccacatccgggtcatcgggccagaaccgggctgagtggccccaggtcttcaccttcccggtgttcgggaccaaaccgccctcagaacagttggagaacgcaggggggaagtggcagacaacatcacgtgctgatggagatccaattgagcaaagtctcttttcagcacgaggtgtatcctgccgaaccagccaccggccctgccgccccgtctcaggagctggaagaaaggcccttgtccaggcaggttttcatcgtacaggagcttgaagttagggacaggttggcctcaagtcaaatcaataagttcttgtatcttcacacaagcgagcgtatgccacgcagggctcactctaacatgctgacaattaaggccctccacgtcgccccgacgaccaatctcggtgggcccgaatgttgcctgcgcgtttccttgatgccgcttaggctgaacgttgaccaggacgctttattctttctgaaagattttttcacctccttggtcgcgggcattaatcccgtggtacctggcgagacttctgcagaagcgcgcccagaaactagagcacaaccttcttcccccttagaaggccaggccgagggtgtcgagaccaccggttcgcaggaagctcccggcggtggccattcaccctcgccacctgaccagcagcctatttatttccgggaattccgttttacaagtgaggttcccatctggctagactatcacggaaaacacgtgacaatggaccaggtgggaacctttgctggcctgctgattgggttggcacaactgaactgttccgaactgaagttgaagcggctgtgctgtcgacatggactgctaggagtagacaaggttcttgggtatgcattgaatgaatggttgcaagatattcgcaagaaccagcttccaggacttcttgggggcgtggggcccatgcactctgtggtgcagctctttcagggatttcgcgatctgctgtggttgccaatcgaacagtatcgtaaagacggtaggctaatgcgaggtctacagcggggcgctgcttcattcggctcttctactgcttcagcagccctggagctgtctaataggcttgtacaggcaattcaggctacggccgaaaccgtctatgatattctcagccctgcagccccggtgtcacggagtttacaggacaagcggtccgcacgtagacttcggagagggcagcaaccagccgacctcagggagggcgtggctaaggcttacgatacagtgagggaagggatcctggatacagcccagactatctgtgatgtcgcttcacggggacacgagcagaaggggctgaccggggctgtcggcggcgtcatcaggcagttgcccccaacggtagtgaagccattgatcctagctacggaggctactagctccttattggggggcatgcggaatcagattgtgccagacgcccacaaagaccacgcattgaaatggcgttctgattctgcacaggattag

SEQ ID NO: 26942 - DNA, 6237 bp, Artificial Sequence
  Description of Artificial Sequence: Synthetic coding sequence
atgccatggcccttttcggagagtataaagaaaagagcctgccgatatctgctccagagatacttagggcatttcctgcaagaaaaactgtcgctggaacagcttagcctggacttgtatcagggaacgggcagcctcgctcaggtacctctggacaaatggtgtcttaacgaaatcctggagagcgcagatgctcctctagaggtaacagaaggctttatccagagcatttccctgtccgtgccttggggttctcttctccaagacaattgcgccttggaagtgcgtggcctggaaatggtctttcgccctcgacctcgcccagcgacaggtagtgaaccaatgtactggagcagcttcatgacctcttcgatgcagctagccaaggaatgtctgagccaaaagctcactgacgagcagggtgaaggctcacagccatttgaaggattggaaaaattcgccgaaactatcgaaaccgtcttgcgacgagtgaaagtcaccttcatagatacagtgctcagaattgaacatgtcccagaaaattctaaaaccggaaccgcactggagatcagaatcgagcgaactgtatattgtgatgagaccgccgatgagtcctcgggaattaacgtgcaccagcctaccgccttcgctcataaattgcttcagctcagcggcgtcagcctgttctgggacgaattctctgcatcagcaaaatcgtccccagtgtgttccacggcccccgtggagactgagccaaagctgtctccctcatggaatccaaagattatttatgaaccacacccacaattaacgcggaacctccctgaaatcgcgcccagcgacccagtacagattggtaggctaatcggccgactcgaactgtcactcactttgaaacagaatgaggtccttcccggcgctaagctcgacgtggacggccaaattgattctatacacttgctactgtccccccgacaggtgcatctgctgctagatatgctggccgccatagctggcccagaaaacagcagcaagattggactggccaacaaggatcgcaaaaacaggccaatgcagcaagaagatgaatatagaatccagatggagctgaaccggtactatttacggaaggatagtctgtccgtgggtgtctcaagtgaacagagcttctacgagacagaaacggcgcggacaccatccagccgggaagaggaggtgttcttcagtatggctgacatggacatgtcccattctttgtcctccttgcctcccttaggcgaccctccaaacatggatcttgaattaagcctgacctcaacctacactaatacaccagctggaagccccctgtctgccacagttctgcaacctacctggggtgagttcctagaccatcacaaagagcaaccagtgagaggatctacctttcctagcaacctggtacaccctacccctctgcagaagacctctctgccgtcccgtagcgtcagcgtggatgagagtcggccagaactgatttttcggctggctgtgggcaccttcagcatctccgttctccacatcgaccccctatcaccaccggagacttcccagaacctgaatccactgactcccatggccgtggccttcttcacttgtattgagaagatagacccagctaggttctcaaccgaagacttcaaatcatttcgcgctgtctttgcggaggcgtgtagccacgaccacctgcggttcatcggcacaggcataaaggtgtcctacgagcagaggcaacgcagcgccagtagatacttttccaccgatatgtcaatcggccagatggaatttctggagtgcttgttcccaacagatttccactccgtgcccccccattatactgagcttctgaccttccacagcaaggaagaaaccggatcacacagccctgtatgtctgcagctccattataaacattcggagaacaggggcccacagggtaaccaggctagattgagttcagtgcctcacaaagcagagctccagatcaagcttaaccctgtatgttgtgaattggacattagcattgtggaccgattgaattctttgctccagccgcagaagcttgcgaccgtagaaatgatggcctctcacatgtatacctcatataataaacatatatccctgcataaggcgtttacggaggtcttcttagatgattctcacagccctgccaactgcaggatcagcgtccaggtggctacaccagcactgaatctgtctgttagattcccaatccccgatctcaggtctgatcaggaacgaggcccctggttcaaaaagagtttgcagaaagaaatcctgtacctggcgtttaccgatttggagtttaagacagagtttataggcggcagtactccggaacaaatcaagctggagctgactttcagggagctcatcggctcttttcaggaggagaaaggggatccgagcatcaagtttttccatgtgtcctccggagtagacggggataccaccagttccgatgatttcgattggccgagaattgtactaaagatcaatcctcccgccatgcactccattctcgagcgtatcgccgctgaagaggaagaggagaacgatggtcactatcaggaggaagaggaaggcggtgcccatagtctgaaagacgtttgcgatctgcggagacctgctccctctcccttttctagtcggcgcgtcatgtttgaaaatgagcaaatggtaatgcccggagatcccgtagaaatgacggagtttcaggataaagctatttctaatagccactacgtcctcgaactcactctgcccaatatttacgtaacgttgccgaacaaatctttttatgaaaaactctataaccggatcttcaatgacctactgctttgggagcctacagccccgtctccagtcgagacttttgaaaacattagttatggaattgggctgagtgtggcttcacaattaattaacacctttaacaaagacagcttttctgcctttaagagtgccgttcattacgatgaagagtctgggtccgaggaggaaactttacaatacttttctaccgtggatcctaactaccgaagccggaggaaaaagaaactggatagccaaaacaagaactcccagagcttcctaagcgtgttactgaacattaaccatgggctgatagctgtgtttaccgatgtgaagcaggataatggggatctgctcgaaaacaagcacggcgagttctggctggaatttaacagtggctcgctgttctgcgttaccaaatacgaaggatttgacgacaaacactacatctgcttgcattcctctagtttctcattgtaccataaaggcatcgtgaatggcgtgatattgccaacagagactaggcttcctagcagcactcgacctcattggcttgagcctactatatattccagtgaagaagacggcctgtctaagacctcatcagacggcgtcggcggggattcactgaacatgctgagtgtggccgtgaagatattaagcgacaagagcgagtctaacaccaaggagttcttgattgctgtgggtctcaaaggggccacgctgcagcaccgaatgttgcccagcgggctttcctggcatgaacaaatactgtattttcttaatattgccgacgagccagtgttgggttataatccaccgacatcttttactacattccacgtacatctgtggagttgcgctctggactataggcctctgtatctgccaatcagaagcctgctcactgtggaaactttcagcgtgtcttcttcagttgctctggataagagcagctctaccctgcggattattctggacgaagccgccctgcatctgagcgataagtgtaacaccgtgacaattaatctgagtcgcgactacgtgagagtcatggatatggggcttctcgaattgactataaccgccgtcaaaagcgactccgatggcgagcaaaccgagccaaggtttgagttacattgctcaagcgacgtggtccacatcagaacgtgcagtgacagctgtgcagctctgatgaaccttatccagtacattgcatcttacggtgacctgcaaacgcctaacaaggcagatatgaagcccggggcctttcagagacgctctaaggttgatagttcgggccgctcttcttctcggggccctgtgctgcccgaagcggatcagcagatgctccgggacttaatgtctgacgcgatggaagagatcgacatgcagcagggaactagtagcgttaagcctcaggcaaacggagtgcttgacgagaaatcacaaatacaggagccgtgttgttctgatctgttcctgttcccagacgagtctggcaatgtcagccaagagtctgggccaacttacgcctccttttctcaccattttattagcgatgccatgacaggagtcccaaccgagaacgatgacttctgcatcctgtttgcacccaaagccgcaatgcaggaaaaggaggaggaacccgtgatcaagattatggtagatgacgccatcgttatccgagataactacttttccctgcctgtgaataaaaccgatacctccaaagcgcctctgcatttcccgatccccgttataaggtatgtggttaaagaagtcagcctagtatggcatctctacgggggtaaggacttcggaatcgtccctccaacaagccccgccaagtcttacatctcaccccacagtagcccctcccacacccctactaggcatggcaggaacactgtctgcggtgggaagggccgcaatcacgatttcctcatggaaatccagctatctaaagttaagtttcagcacgaggtgtatccaccatgtaagcctgactgcgactcctctttgagtgagcaccctgtatctagacaggtgttcattgttcaggatctcgaaatacgcgatagactggcaactagccagatgaacaagttcctatacctgtattgcagcaaggagatgccccgtaaggcccactccaacatgttgacagtaaaggctctccatgtatgcccggagtccgggaggtccccacaagaatgttgtctccgagtatccctcatgccgctcagactgaatatcgaccaggatgctctgttcttcctgaaggatttctttactagtttatctgccgaagttgagctccagatgactcccgaccctgaagttaaaaaatcacccggagccgacgtaacatgttccctacctcggcatctgagcacctctaaggaacccaatctagtgatcagctttagcggtcctaagcagcctagccagaatgattctgccaatagtgtggaggttgtaaatggcatggaggaaaagaatttctccgcggaagaagcctcctttagggaccagccggtcttcttcagggaatttagatttacaagtgaagtgcccatcagactggactaccatggcaaacacgtgagtatggaccagggtactctagctgggatcttgattgggctggcccaactgaactgtagcgaactgaagttaaagcggctgagttacaggcacggacttttaggcgtggacaaattattttcatacgcaatcactgagtggctaaacgatattaagaagaatcagctgccaggtattctgggaggagtgggacccatgcattcccttgtgcagctcgtccagggtctgaaggacctcgtctggttacccatcgaacaatatagaaaggatggacgaatagtgcggggatttcagcgcggggccgctagttttggcactagtactgccatggctgcactagagttgactaaccgcatggtgcaaaccatacaggccgcagcggagactgcctacgacatggtcagtcccgggaccttaagcatagaacccaagaaaacgaaacggttccctcatcatcgactggcgcaccaacctgtagatctccgggagggtgtggctaaggcttacagtgtggtcaaggaaggcatcacggacacggcccagactatttatgagacggctgcgagagaacacgaatcacgaggggtaaccggtgccgtgggggaggtgctgcgtcaaattcccccagctgtggtcaaaccactaatagtcgccactgaggccacctcaaacgtgctgggcggtatgcgaaaccagatcagacccgacgtgaggcaggacgagtctcagaagtggcgccacggcgacgattag

SEQ ID NO: 26943 - DNA, 2214 bp, Artificial Sequence
  Description of Artificial Sequence: Synthetic coding sequence
atggaggacgcgggtgaggatcccacaacatttgccgcccattccctcccttcagatcctcggctcctagcgacagttactaatgcctatctcggtacacgagtgtttcacgacaccctgcacgtctccggcgtgtataatggggccggcggagacacccaccgagccatgctgcccagccctctgaatgttagactcgaggcacctgccggtatgggcgagcagctgactgaaacttttgctttggacacaaacacaggatctttcttgcatactctggaagggccccggtttagggccagccagtgtatttatgctcatcgcacgctgcctcatgttctggcctttagggtgtccatcgcaagactcgccccaggctctggccctatcacactcctactccggtccgccttctcccccgagtcacccgacctggatttgcaccagggtcctgactttcaaggtgcacgatatctttatggccacaccctgacgcccgaacaacccggaggtcctcagcaggaggtgcacatgctgtggacgcctgctccacctgatctcacattgggagagggcgaggaggctagaacctgggacttcctcaccgctgtgggagggagccaagccgaggctcaggcttgtctgacagaggcactccagctgcaggcacggggagcattgtacaccgcacatgctcaggcatgggctcagttatgggtggaatgtggactggatgtagttgggcctctgcaactccgccaagccttgcgaggatccctttactatcttctctcagcgctgccccagcccaaggcacccgggtacatctgtcatggcctgtccccaggcggcctctccaatgggtcacgcgaggagtgttactggggtcacgtgttctgggaccaagatctctggatgtttccttctatactgatgttccatcccgaagccgccagagctattctcgaatataggatcagaactcttgacggagctctcgagaacgctcaaaacctgggttaccagggtgcaaaattcgcgtgggaatcagctgattccggcctcgaggtgtgccctgaggacatatacggggtccaggaggtgcatgtgaatggcgctgttgtcctggcctttgaactttattaccacaccacccaagatttgcagttattccgagaggcaggcgggtgggatgtagtcagggctgtcgccgagttctggtgctctagggtagaatggagccctcgggaagaaaaataccacctgcgaggagtaatgagcccggacgagtatcatagtggtgttaacaattccgtttacaccaacgttctggtgcagaattcgctgcgatttgccgccgctctcgcacaagaccttgggctaccaattccctctcagtggcttgctgttgctgacaaaattaaggtgccattcgatgttgagcagaatttccaccccgagtttgatggctacgagcctggcgaggtagtgaaacaggctgacgtggtgctgctgggctaccccgtcccattttctttaagccctgatgtgcgtagaaaaaacctcgaaatttacgaagccgttaccagcccccagggtcctgcgatgacatggagcatgtttgcggtcgggtggatggagctgaaggacgcggtgcgcgccagaggactccttgaccgatcttttgctaatatggcggagcccttcaaggtatggacagaaaatgctgacggctccggtgcagtgaattttcttaccggcatgggaggcttcctacaagccgtagtgttcggctgcacaggcttccgggtaacacgcgcgggggtgacattcgatccagtctgtctgagcggcatcagcagggttagtgtgagtgggattttttaccaggggaataaattgaactttagcttcagcgaggattcagttacagtagaagtgacagcgcgcgctggaccttgggcacctcacctcgaggccgaactgtggccgtcacagtcacggctgtctttattgccaggtcataaagtatctttccctcggtctgccggacggattcagatgtctccacctaaactaccaggatctagcagctccgagtttcctggtagaactttctctgacgtgagggaccccttgcagtctcctctttgggtcacactgggtagctccagccctacagaatcactcaccgtggatcctgcgagcgagtag

SEQ ID NO: 26944 - DNA, 804 bp, Artificial Sequence
  Description of Artificial Sequence: Synthetic coding sequence
atgcgggtggccgcgctgatctcaggcgggaaagacagctgctataacatgatgcagtgcatcgctgctggacaccagatagtcgctctggcaaacttgcgacctgcagaaaatcaggtcggtagcgatgagctcgacagttacatgtaccaaacggtggggcatcatgcaatcgacctgtatgcagaagccatggccttacctctctacaggagaacaatccgaggccgctcattagacacacggcaggtctatacgaagtgtgaaggcgacgaggtcgaagacctgtatgagctgttaaagctcgtcaaagaaaaagaggaagtggaaggaatttccgtgggtgctatcctgagcgactatcagagaattcgcgttgagaatgtgtgcaagaggctgaatttgcagccacttgcttatctctggcagcggaatcaggaggacctgctccgggaaatgatatccagcaacatccaagctatgatcataaaagtggcagcgctggggctggatcccgacaagcatctgggtaagaccctggatcagatggagccttacctgatcgagttgtctaagaaatacggcgttcacgtgtgtggcgaggggggagaatacgaaacttttactctcgactgccctttgttcaagaagaagatcatcgtcgactcgtcggaggtggttatccacagtgcggatgcctttgctccagtggcttatcttcgcttcttagagctgcatctcgaagacaaggtgtcttccgtgcccgacaactaccggacttcaaactatatttacaacttctag

SEQ ID NO: 26945 - DNA, 498 bp, Artificial Sequence
  Description of Artificial Sequence: Synthetic coding sequence
atgcgcgtggctgccctgatctccggcggcaaggactcctgttataacatgatgcagtgtatcgccgcgggacaccagattgtcgctttagccaatttgaggcctgccgagaaccaggttggcagcgacgaacttgattcatatatgtatcaaacagttggacaccacgctattgatctgtacgcagaagctatggcgctgcccctgtatcggcgtactattcgcggacggtctctggacacaagacaggtgtataccaagtgcgaaggcgatgaagttgaagacctctacgagctcctaaaattggtgaagggcattacaagaatgaccctgctggccgagtacgatgcccttaaccttcaggactttcacatgcacctgaaagtgggtagtcaggcaattgtatacagaaccccaaacgagctttgcactcactcaaagttcgacaagcacacgtttcctcccttcattagtgaaattgccaagtgcgaggtttag

SEQ ID NO: 26946 - DNA, 3306 bp, Artificial Sequence
  Description of Artificial Sequence: Synthetic coding sequence
atgtccgcgaaggccatctctgaacagaccggcaaagaactcctgtacaagttcatctgcacgacatcggctattcagaatcgtttcaaatatgcgcgcgtgaccccggacacagattgggctcggttgcttcaggatcacccctggctcctgtcccagaatcttgtggtcaaacctgaccagctgattaagagaaggggaaaactcggtcttgttggtgtcaacctgacccttgacggtgtgaaatcatggcttaagccccgcctaggtcaggaagcaacggtggggaaggcaacaggatttctgaagaacttcctgatcgaaccatttgtgccccattcccaagcagaggagttctatgtctgcatctatgccacccgcgaaggagattatgtgctgtttcaccacgagggaggagtggacgttggggatgtggacgcaaaggctcaaaagctcttggtgggtgtggatgaaaagttgaatcccgaagacataaaaaagcacctgctcgtccatgcaccagaagacaaaaaagagatcctcgcatctttcatcagcggtctgttcaatttttacgaggacctttacttcacctatcttgaaattaaccccttggttgtcactaaggacggagtgtatgtgttagaccttgccgctaaagtcgatgcaaccgcggattatatatgtaaggtcaaatggggtgacatcgagttcccaccaccgtttggacgggaggcatatccggaagaagcctacatcgccgatctggacgctaaatcaggggcatcgctcaaactgacacttcttaatccaaaaggcagaatttggacaatggttgccggtgggggagccagtgtcgtgtacagtgacaccatctgcgacctagggggtgtgaacgaactggctaattacggagagtactccggtgcacctagtgaacaacagacctatgactacgctaaaacaatactttccttgatgacacgggaaaagcaccccgacggtaaaatacttataattggaggctcaatcgcaaatttcacaaacgtagccgccacattcaaaggcattgtacgggccattcgagactaccaagggcctttgaaggagcacgaggtaactattttcgtgagacgaggcgggcccaactatcaggaaggcctgagagtcatgggtgaagtgggtaaaacaacagggatacctattcacgtatttggaaccgaaacccatatgaccgccattgtgggtatggccctgggacataggcctataccaaaccagccaccaaccgcagcgcatacagctaactttctattgaatgcctctggtagcacttcgacacctgctccctcccgtacggcctcgtttagcgaatcccgtgcagatgaggtggctccagcaaaaaaagccaagccagctatgccacaagattccgtgccaagtcctcggagcctgcagggaaagtcaactacactgttctcacgccatacaaaggccatcgtatggggcatgcagacgcgcgctgtgcagggcatgctggacttcgactacgtctgttccagagacgaaccgtccgtagctgccatggtatatcctttcactggcgatcataagcagaaattctattggggccacaaggagatcctcattccagtgttcaaaaatatggcagacgctatgcgcaagcacccagaggtagacgttctgatcaactttgcctcactgcggagtgcttatgacagtactatggaaaccatgaactatgctcagattcgcaccattgccattatcgcagaaggtatacccgaggcactgacccgaaagctgatcaaaaaggccgatcagaagggcgtgactatcattgggcccgccaccgtaggcggtatcaagcctgggtgttttaaaatcgggaataccggtggcatgctggacaacatcctagcctctaaattataccgccccggctctgtggcttatgtgtcacgcagtggaggtatgtccaacgagctcaataatatcatttctaggacaaccgacggggtctacgaaggcgttgctatcggtggtgacaggtacccaggttccaccttcatggatcatgtgctgcgataccaggatacaccaggcgtgaagatgatcgtggttctgggtgaaattggagggaccgaagaatacaagatctgcagaggtattaaggagggcagactgacaaaacccatcgtctgctggtgcataggcacctgtgcaacgatgttttcttctgaagttcagtttggccacgccggggcctgcgcaaatcaggctagcgaaaccgcggttgctaagaaccaagccctcaaagaagccggtgtgttcgtcccccggagcttcgacgaattaggggagatcatccagagcgtctacgaggatctggttgccaacggggtgattgttccagctcaggaggtgcctcctccgacggtacctatggactactcttgggcccgggaacttggcttgatcagaaaacccgcaagctttatgacgagcatctgtgatgaacgcgggcaggagctgatttacgctggcatgcccattaccgaggtattcaaagaggagatgggcatcggaggcgtactgggtctgttgtggttccagaaacgcctcccaaagtacagttgtcagtttatcgaaatgtgcctgatggttacggctgaccacgggcccgcagtatcaggggcgcacaacacaatcatatgtgctcgggcaggaaaggatctggttagcagcctgacaagcggactgctcaccataggcgatcgctttgggggtgctctagacgccgcagctaagatgttttccaaggctttcgacagcgggataatccccatggagtttgtcaataagatgaagaaggagggaaagctgattatgggcattgggcacagggttaagagtataaataatccggacatgcgcgttcagattctgaaagattacgtacgacagcactttcccgccacgccgttgcttgattatgcactagaggtagagaaaattacaactagcaaaaaacccaacttgatcctgaatgtggatgggctcattggagtggcattcgtcgacatgctgaggaactgtggaagcttcacccgagaggaggctgacgagtacattgatatcggagcccttaacggaatattcgtgctcggccggtccatgggtttcatcggccattatctcgaccagaagaggctgaaacagggcctctatagacacccatgggatgacatatcttatgtgctgccggaacacatgtcaatgtag

SEQ ID NO: 26947 - DNA, 288 bp, Artificial Sequence
  Description of Artificial Sequence: Synthetic coding sequence
atggcacacttcaaggatgacttgcagaccaatgtcgagatcataccgggagaatcagccccgcgaaaggagagcccaagacctcccgcacccccttcaagcgcggcaggcgtaggaggctgttctaatcattctccttccgtgcaggaatcccccctcagcccgccagccctggcccagctgggttctgcccagcagccctctatgcgaacagagctaagcttctccgaaaaaaaagacacgatgatcatctggcaaattacaattactgtctggtgccagaggtag

SEQ ID NO: 26948 - DNA, 288 bp, Artificial Sequence
  Description of Artificial Sequence: Synthetic coding sequence
atggctcactttaaagatgacctgcagacaaacgtggaaataattcccggcgaatctgcaccaagaaaggagtctccccgtcctcctgctcccccatctagcgctgccggagttggcgggtgttccaaccactctccctctgttcaggagtctccactctctccacccgccctggctcagcttggatcagcccagcagccgagcatgcggaccgagctttcctttagcgaaaaaaaggacactatgatcatatggcagatcaccatcaccgtgtggtgtcagcggtag

SEQ ID NO: 26949 - DNA, 1173 bp, Artificial Sequence
  Description of Artificial Sequence: Synthetic coding sequence
atgcctccctccgggctgagattactccccctgctgttgcccctgttatggctccttgtcttaacgccagggaggccagccgccggactatcgacatgcaaaacaattgacatggagctggtcaagaggaaaagaatcgaggctataagggggcagatactgagcaaacttaggcttgcaagtccgccgtcccagggcgaagtgcctcctggcccgctcccggaggctgtgctggctctttacaatagtacaagggaccgggtcgccggcgagtccgccgaacccgaacctgagcccgaagccgattactacgcgaaggaggtgacccgcgtgctaatggtagaaacacacaatgagatctacgataagtttaaacaatccacacacagcatttacatgttttttaacacttcagaactcagggaagctgtacccgaacctgtcctccttagccgagcagagttgcgactacttcggctcaaactgaaggtcgagcaacacgtggaattataccagaaatattccaacaactcatggcgttacctcagtaatcgactgcttgccccaagcgattcgcctgagtggctgtccttcgacgtgactggggtcgtgcgccagtggctgagccgtggtggagagatcgaagggtttcgcctctccgcacactgtagctgcgactcacgcgacaatacactgcaggtcgatatcaacggctttaccacagggcgacgaggtgacctggctaccatacacggaatgaaccgtccttttcttctgcttatggccacaccactggagcgcgcccaacacctccagtcctctcgtcaccggagggccctagacaccaattattgtttctcatccaccgaaaagaactgctgtgtacgacagctctacatcgactttcggaaggatttggggtggaagtggatccatgagcctaaaggataccatgcaaatttctgcttgggaccatgcccgtacatctggagcctagatacacagtatagcaaggttctcgcactgtataatcagcataacccgggagcgagtgcagccccctgctgtgtacctcaagctctcgagcccctccccatcgtgtactatgttggccgcaagcctaaggtggaacagctctcaaacatgattgtacgctcctgtaaatgctcctag

SEQ ID NO: 26950 - DNA, 576 bp, Artificial Sequence
  Description of Artificial Sequence: Synthetic coding sequence
atgtgggacctcgttctcgaagacagaagaatgaattcattacggctggtagcacctatgtggaacggccggattcggggtattcacagattaggcgcagctgttgctccagaaggaaatcagaaaaaaaaaagaaccattttgcagttcttaaccaactacttctatgacgtggaggcgctgagggattacctcctgcagcgggaaatgtacaaggtgcacgagaagaatcggtcatacacctggctggaaaagcaacacggaccctatggggccggcgcgtttttcattttaaagcaagggggcgctgtaaaatttcgggacaaggagtggattcggcctgacaaatatgggcacttttcccaggagttctggaatttttgcgaggtacctgtggaggcggtggacgccggggattgcgacatcaattatgagggcctcgataatctgcgcacgtccgcaggatggacatcccgcacctcgctcccctgcccaacgctcgcctccttgcgatattggtggcgaaggtgctgccctattgcccgactctgggaaagtaccggacttcgggcctag

SEQ ID NO: 26951 - DNA, 792 bp, Artificial Sequence
  Description of Artificial Sequence: Synthetic coding sequence
atgtgggatctggtgctggaggatcggcggatgaacagtctgcggcttgtagcccctatgtggaatggtcgtattcggggtatccaccgcttgggggcagccgtggcaccggagggaaaccagaaaaagaagcgtactatcctacagttcctaacgaactacttttatgacgtggaggcactgcgggattacctcctgcagcgagaaatgtacaaggtgcacgagaagaacaggtcatatacttggctggagaagcagcacgggccctacggcgctggggcttttttcatcctgaagcaggggggcgcagtgaagtttcgcgacaaggagtggatcaggcccgacaaatatgggcacttctcgcaggagttttggaacttttgcgaggttcccgtcgaggccgtggacgctggcgactgcgatatcaattatgaagggctcgacaacttgctacggttgaaggaactccaatcactcagcctgcaaagatgttgtcatgttgacgactggtgcctgtctcgcctgtatccactggcagactccctccaggaactgtctctggctggatgtccccgcatcagtgaacggggcctggcctgcctccaccacctgcagaacctccggcgcctggacatttctgaccttcctgccgtgtccaaccccggactaactcagatactcgtggaggaaatgctgccaaattgcgaagtggtgggagtggactgggccgagggcctgaagagcggcccagaagagcagcctcgggacacagcctcaccagtccccgcttag

SEQ ID NO: 26952 - DNA, 693 bp, Artificial Sequence
  Description of Artificial Sequence: Synthetic coding sequence
atggctgccccttgggcatccctgagactggtcgccccaatgtggaatggtagaatacggggtattcacaggttgggcgctgcagtcgctccggaaggcaatcaaaagaaaaaaagaaccattctgcagttcttaaccaactacttttatgatgtggaagcattgagagattacctgctgcagcgagaaatgtataaggtccatgaaaaaaataggtttcgcgataaggagtggataagacctgataaatacggacatttcagccaggagttttggaatttctgcgaagtgcccgtggaggcggtggatgccggcgattgcgatatcaactacgagggattagataatctgttgaggctgaaggaacttcagagcctgtcccttcaaagatgctgccatgttgatgactggtgcctctcacgcctctatcctctggcagacagtctccaagaactttcactggccgggtgcccacgtatttctgaaaggggcctggcatgtctgcaccatctgcagaatctgagacggttggatatcagcgacctgcccgctgtctctaacccgggactcacacagattctggttgaggaaatgttgccaaattgtgaagtcgtgggagtcgactgggcagagggattgaaatccgggcctgaagagcaaccacgtgatacagcgagccctgtacccgcctag

SEQ ID NO: 26953 - DNA, 1002 bp, Artificial Sequence
  Description of Artificial Sequence: Synthetic coding sequence
atggagttagacattcatagcgctcaagtgccacttcctgtggggcgggggaggcacagggacgctactccggagtccaaaggatctcttcaggacctgggctggtcagccgtggctcagagtcagctcactgctacctcaactagtcctgcccaggttattccacccccccagcctaggtggagcaggacgccaggcttcaagcgttgtttccgcctcgggctgcacaaagtactgggaagccaatcccttaggcttgtggcaccaatgtggaacggccgaatcagggggatccatcgactgggagctgcggtggcgccggagggaaatcagaagaaaaagcgcacaatcctgcagttcttaacaaactacttttacgatgtggaagctctacgtgattatctgctccagagggagatgtacaaggtgcacgagaagaacaggtcatacacgtggctggaaaagcagcatgggccctacggcgctggagccttctttatacttaaacagggcggtgcagttaagttcagggacaaggagtggatccgcccagacaaatacggacatttctcgcaggagttctggaatttttgtgaggttcccgtggaggctgttgatgccggtgactgcgatatcaactatgagggccttgataatttactgagattaaaggagctccagtcactgagtctgcagcgatgctgccacgtcgatgattggtgtttaagcagactgtaccctctggcggatagcctgcaggagctttcccttgcgggttgtcctaggatttcagagaggggcctcgcctgtttacaccatctgcaaaatttaagaagacttgatatctccgatctgccggcagtatccaatccaggtctgacccagattctggtggaagagatgctgccaaactgcgaggtcgtgggtgtggattgggcagagggccttaagtccggacccgaggaacagcccagggacaccgcttctcccgtcccagcctag

SEQ ID NO: 26954 - DNA, 693 bp, Artificial Sequence
  Description of Artificial Sequence: Synthetic coding sequence
atggcagctccctgggcgagccttcgactcgtggcacctatgtggaatgggaggatccgcggaatccaccggctgggagccgctgtggctccagagggaaaccaaaagaagaagagaacaatcctccagtttcttaccaactacttttacgatgtggaggccctgcgggattatctgctgcagcgggagatgtataaagtgcacgaaaaaaaccgatttcgtgacaaggagtggatacgtcctgacaaatacgggcattttagccaagagttttggaatttttgtgaagtccccgttgaagctgtggatgcgggtgactgtgatatcaactacgagggccttgacaacttgctccgcctgaaagagctgcaatccctgtctctccagaggtgttgtcacgttgacgattggtgcctgtcccggctctatccccttgccgattcactccaagaattgtcgctcgccgggtgtccaagaatcagcgagcgcggtctcgcatgcctgcatcacttgcaaaacctgcgcaggttggatatctcggatctgcccgcggttagtaatcctggactgacacagatcctagtggaagaaatgttacccaactgcgaggtggtaggcgtcgactgggcagaggggctgaagtctggccctgaagagcaaccccgggacactgcctctcccgttccggcatag

SEQ ID NO: 26955 - DNA, 3663 bp, Artificial Sequence
  Description of Artificial Sequence: Synthetic coding sequence
atgggagacatggccaattccagcatcgaatttcaccccaaaccccagcagcagagagatgtgccccaggctggagggttcggatgcacactcgctgaattgcgcacgttaatggaacttcgcggagcggaagcactgcagaagattgaggaggcatatggtgacgtgagcggcctgtgcagacgactgaaaacaagtcccaccgagggcctcgcggacaacacaaatgatctcgagaagcgcaggcagatctacggccagaacttcattcctccaaagcaaccaaagactttcctgcagcttgtgtgggaagcactgcaggacgtgaccctgatcattttggaggtagcggcaatcgtgtcattgggtctttccttctacgctccgcccggagaagagagcgaggcctgcggcaacgtatccggcggagcagaagacgagggggaggccgaggccggttggatcgagggcgctgcgatcctgctgtcagtgatctgtgtcgtgctcgtcacggcctttaacgattggagcaaggagaagcagtttcgcggtctccaaagtcggattgagcaggagcagaagtttacggtaattagaaatggtcagctcctgcaggtgcctgtggcagctttggttgtgggagacatcgcccaggtgaagtatggtgatctcttacccgctgatggtgtcctgatccaggctaacgacctcaagatcgatgagtcttccctgaccggcgaatctgaccacgtcaggaagtccgcggacaaggatcctatgcttctttctgggactcacgtcatggagggttcgggaagaatggtggtgactgctgtcggagtgaacagtcagacgggcatcatattcacccttctaggagctggcggggaggaggaggaaaaaaaggataagaagggaaagcaacaggacggagcaatggagagcagtcagaccaaagctaaaaaacaggatggggctgtggctatggagatgcagccactgaagtccgcggagggtggggaaatggaggaaagggagaagaagaaggccaatgcacccaagaaggaaaagagtgttctccagggcaaactgacgaagctggctgtgcagattgggaaagctggactggttatgtcagctattactgttatcatcctggtgctctactttgtgatagagacctttgtggtggaaggtcgtacatggctggcggagtgtacaccagtgtacgttcagtactttgtgaagttcttcatcatcggggtgactgtcttggtagttgcagtgcctgaaggcctgccattggccgttacaatttcactggcttactctgtgaaaaaaatgatgaaagacaataacctggtccgacaccttgacgcatgcgaaacaatgggaaacgctaccgctatctgcagcgacaagacggggaccctaacaaccaaccgtatgacagtggtccaatcttacctaggcgatacgcactacaaagaaatccctgccccctcagccttgacacccaaaatccttgatttgttggttcacgctatcagtattaattcagcctacacaacaaagatactgcccccggagaaggagggcgcactccccaggcaggtgggtaacaagaccgagtgcgcactcctggggttcgtgctggacttaaaacgcgactttcagccagtccgagagcagatccctgaagataaactctataaggtctacacatttaattccgtgcggaagtccatgtccactgtgatacgaatgcctgatggcggcttccggttattctccaagggagcctcagaaatccttttgaaaaagtgcactaacatcttgaatagcaacggcgagctgaggggctttaggcccagggaccgggacgatatggtgcggaagattattgagccgatggcttgcgacgggctccgcaccatatgtatagcctatagggacttcagcgccggacaggaaccggactgggacaacgagaacgaagtcgtcggggatctgacatgtatcgcagtcgtggggatcgaggaccctgtgcgtcccgaagttcccgaagcaattcggaaatgtcagagagccggaatcactgtccgtatggtgaccggagacaacattaacactgcacgtgctatcgctgccaagtgtggtatcatccagcctggtgaggatttcctgtgcctcgaggggaaggagttcaacaggcgcatccgcaatgagaagggtgagattgagcaggagaggctggataaggtctggcccaagcttcgagtcctggctcgcagttcccctacagacaaacatacccttgtgaaagggattatcgattccacaacaggcgagcagcgtcaggtagttgccgtgacaggtgatggcaccaatgatggacctgcgctgaaaaaggccgatgtgggattcgcgatgggcattgcaggcaccgacgtggctaaagaagcttccgacatcattctgacagacgacaattttacatcgatcgtcaaggctgtaatgtggggccggaatgtgtacgattctattagtaaatttttgcagttccagctaactgtaaacgtcgtggccgtcattgttgcatttaccggggcatgtattacccaggactccccactcaaagccgtccagatgctgtgggtgaatctgattatggatactttcgccagcctggcactcgctacggaacccccaaccgagtccttgctgcttaggaagccatatggtcgggacaaacctctgattagtcggacgatgatgaagaacattttagggcatgccgtgtatcagctggcaatcatattcacgcttctgtttgtgggggaactattcttcgatattgatagtggccgaaatgccccgctccatagtcctccatctgagcattacactatcatctttaatacatttgtaatgatgcagcttttcaatgagatcaatgcaagaaaaatccatggcgaacgcaatgtctttgacggcattttttctaatccgatcttttgtactatcgtactcggtaccttcggaattcagattgtcatcgtgcaattcggcggaaaacccttttcctgctccccgctgagtacagaacaatggctgtggtgtcttttcgtcggtgtaggcgagctggtttggggccaggtgattgccactattcccacgtctcagctcaagtgcctgaaggaggcggggcacggccctggcaaggacgaaatgacagacgaggaactggcagagggagaagaagaaatcgatcatgccgagcgggaactgcgccgcggccaaattctgtggtttcgcggtttgaacaggatccaaacccagatcagggtggtcaaggccttccggagtagcctttacgaaggcttagaaaagcccgagagcaagacctccatccacaatttcatggcaacacccgagttcctgattaacgactacacccataacattccgctgatcgacgacacagacgtggacgagaatgaggaacgcctgagggccccaccacccccctccccaaaccagaataacaacgccattgactctggtatatatctgacgactcacgtaactaaaagcgccacctcctccgtgttctcctcctcaccaggatcaccactgcatagcgttgaaacatcactctag

SEQ ID NO: 26956 - DNA, 4377 bp, Artificial Sequence
  Description of Artificial Sequence: Synthetic coding sequence
atggtcaatacaagaaaatcttcgctccgactgcttggatcaaagagccctggaccagggccgggacccggcgctggcgccgagccaggagctacgggtgggagtagccacttcatctcctcccgaaccaggagcagcaagacccgggccgcctcctgcccagccgctaaggctggaggctctgggggtgctggagttacgctcgacgaggctcgtaaagttgaggtcgatggctccctcagcgactcccacgttagccccccggccaagagaactttaaagcaaccagactccgtttgcaaggataaatccaaatccaggtctaccggacagcgcgaggagtggaatctgagcaccggccaggctcgcctgacatcccaaccaggcgctaccctgcccaacggccactccggtctgtcattgcgaagccaccctctgcgcggcgagaaaaagggtgacggcgatctgagctgtatcaacggggatatggaagtcagaaaatcctgtcgcagtagaaagaatcgttttgaaagcgtgaaccaaagcctcctcttcgaccagctcgtcaacagtacagctgaggccgtactgcaggagatggataacataaacattagacagaaccggaggagtggagaggtagaacgccttcgcatgtggaccgacacagaattcgagaatatggacatgtattcgagggtaaaaaggcgacggaaaagcttgagacgcaattcctatggcatccagaaccatcacgaagtgtctaccgagggggaggaggaggagtcgcaggaagaagatggcgacatcgaggtagaggaagccgagggagaagagaatgacaggccctacaacctacgccagcggaagaccgtggacagatatcaggccccacccatcgtccctgcacatcagaaaaagcgggagaataccctgtttgatatccaccgctctcctgccaggaggtctcacattagaagaaaaaaacatgccattcactcttctgatacgacctcatctgatgaggagcgattcgagcgccgcaagtccaaaagtatggctcgagcaaggaaccgatgtctgccgatgaattttagagccgaggatctggcctccggcatactcagagaacgcgtgaaggtcggcgccagtttggccgacgttgaccccatgaatattgacaagtcagtccgctttgactcgattggtggtttgtcccatcatatccatgccctgaaggagatggtggtttttccacttctgtaccccgaaatctttgagaagttcaaaatacagcccccacgaggatgtttgttttatggaccacccggcaccggcaagactctggttgccagagcgcttgctaacgagtgcagccagggtgataagaaagttgcgttttttatgcgaaagggagccgactgcctgagcaagtgggtcggagagtctgagcgtcagctgcgcctgctcttcgatcaggcttacctgatgaggccaagcatcatttttttcgacgagatcgatggactggcaccagttagaagttcacggcaggatcagatccatagcagtatcgtgtccaccctgctggcgctgatggatggactggacaaccggggagagattgtggtgattggcgctaccaatcgcctggatagcatcgaccccgctctccggaggccaggaagatttgatagggagtttcttttcaacctcccggaccaaaaggcccgaaagcatatcttgcagattcacactagagactggaatcccaaactgtccgatgctttccttggggaactggctgagaagtgtgtaggttattgcggtgccgacatcaaggccctctgtacagaagcggctctcatcgccctacgtcggagatatccccagatatacgctagttcccataaactccagctggacgtatctagtatagttttatcagcccaggacttttaccatgccatgcaaaacattgtgcccgcttctcagcgagctgtgatgtcctccggccacgccctgtcacctatcataaggccattgttggagcgaagctttaataatatccttgcggtgcttcagaaagtgttcccccatgctgagatttcccagtctgataaaaaagaagatatagagacccttatcctagaggacagcgaggatgagaacgccctttcaatcttcgagactaactgtcattcaggctcccccaagaaacagtcgtctagtgcggccatacataaaccatatctgcacttcaccatgagcccatatcaccaacctacgtcttatcggccacggttgctcctctctggcgagagagggagtggacagacatcgcatctcgcccccgcattgctgcatacgctggagcgctttagcgtgcacagactggacctgcccgccttgtatagtgtttcggcaaagacccccgaggaaagttgcgctcaaatatttagagaagcccgcagaaccgtgccgtcaattgtgtatatgccccacattggagactggtgggaggcagtgtcagagacagtccgggctacctttctaaccctgctgcaggatataccatcatttagccctatttttctccttagcacttccgaaaccatgtacagcgagctgcccgaggaagtaaaatgtattttcagaatccagtacgaagaagtcctctatatccaaaggcctatcgaggaggacagacgaaagttctttcaggagctcatcctaaatcaagccagcatggcccccccccggcgcaagcatgctgccctgtgcgcaatggaggtattgcccctggcactgccaagtcctccccgtcagctttcagagtcagagaagtctcgcatggaagatcaggaagagaacacccttagagagctgcggttgtttttgagggatgtcaccaagcggttggcaactgataaacggtttaatatcttctctaaacccgtggatatagaggaggtctccgattatctggaggtaattaaggagcctatggatttatcaactgtgatcaccaaaatagataagcataactatctgacggccaaggatttcctgaaagacattgacctgatctgctccaacgcactggaatataatccggacaaagaccctggggataagattattcgccaccgcgcttgtactctcaaagatactgcacatgctataattgctgccgaattggaccccgagtttaacaagctctgtgaagaaattaaagaagcgagaattaaacgtggactgtccgtgacctccgaacagatcaatcctcatagtaccggagccagaaaaaccgagacccgggtcgaagaggcatttcgccataaacagcggaaccccatggacgtttggcacaatagcgctaacaaatgtgcatttagggtcaggcggaagtctcgcaggcgttcgcagtggggcaaggggattattaagaaaagaaaagtgaataatctgaaaaaggacgaagaggacacaaaatttgccgattacgaaaaccatactgaagatcggaagctgctagaaaacggagagttcgaggtctccaccgactgtcatgaagagaacggggaggagacgggagatcttagtatgaccaacgatgaaagctcttgtgacataatggacttagatcagggccagcgactgaataacggggccggcacaaaggagaatttcgcatccacggaagaagaaagctctaatgaaagcctgttagtgaatagtagctccagtctgaaccccgaacagacgagtagaaaggagactttcctgaaaggcaactgtctgaatggagaagcctcaactgattcctttgaaggtatccccgtgctggaatgccagaatggcaagcttgaggtggtcagcttctgtgattctggagacaagtgtagcagtgaacagaaaatcttactcgaggatcagagcaaagaaaaacctgagacaagcactgaaaaccatggggacgaccttgagaagctggaggccctggagtgctctaataacgaaaaactggagcctgggtcggatgtcgaggtgaaggatgccgaattggacaaggaaggtgcaagcaaagtgaaaaaatacagaaaactcattctggaacaagccaaaacaacttcactggaactggtgcccgaggagcctagcgaaccggtgccacccctgatcgttgatcgtgagcggctcaaaaagctcttggacttgctggttgacaaatccaacaacctggccgttgatcagcttgagcggctttattcattactttctcaatgcatctacaggcatcgtaaggattatgacaaatcccaactggttgaagaaatggagaggacggtgcacatgttcgagacctttttgtag

SEQ ID NO: 26957 - DNA, 639 bp, Artificial Sequence
  Description of Artificial Sequence: Synthetic coding sequence
atggaagtgagaaagagctgtcgctctaggaaaaatcggtttgagagcgtcaaccagtctctgctcttcgatcagcttgtgaactccaccgctgaggccgtgctgcaggaaatggacaatattaatatccggcagaaccggcgctcaggagaggtcgaaaggctgcggatgtggacagacaccgagttcgagaatatggacatgtattctcgggttaagaggagacgcaagtccctccgcaggaactcttatgggatccagaaccaccatgaggtaagcacggaaggggaagaagaggccaggaccagtaaactcctgcctttggaaaagatcagtatagagtcccaagaagaggacggggacatcgaagtagaggaggctgaaggcgaagagaatgatcgaccctataatctgaggcagcgcaagaccgtcgatcgatatcaggcacctcctattgtgcctgcccatcagaaaaagcgggagaacacgctgtttgacattcatagatctcccgccagaaggagtcacatacggcgcaagaaacatgccatacatagctccgacacgacatcttccgacgaggagcggttcgagcggcggaagagcaagtccatggctcgtgcaagaaatcgcaaatag

SEQ ID NO: 26958 - DNA, 1881 bp, Artificial Sequence
  Description of Artificial Sequence: Synthetic coding sequence
atgccacacatcggtgattggtgggaagctgtatccgagacggtccgggcgacgttcttaactctgcttcaggatattccttcattctcccctatcttcctcttatctacatcagagaccatgtacagcgagttgccagaagaagtgaaatgcatcttccgaatccagtacgaggaagtcctgtatattcaacgcccaatcgaagaggaccggaggaaattctttcaggaattaattctaaaccaggctagtatggctccaccacgtaggaaacatgccgccctttgcgctatggaagttctgcccctggccctgccctctccaccacgccaactgtccgaatcggagaagtccaggatggaagatcaggaggagaatactctgagggaactgcgccttttcttacgagatgtaacgaaacgccttgccaccgataaacggtttaacatcttctcaaagccagttgacatcgaggaggttagcgactacctcgaggtgatcaaagagcccatggacttaagcacagtgatcacaaagatcgataagcacaattatcttaccgccaaagattttctcaaggacattgatctgatatgttcgaacgccttagagtacaatccggataaggatccaggagacaagattatacgacatcgcgcttgcacgttaaaagacacagcgcacgcaatcattgccgctgaactggaccccgaattcaacaaactgtgcgaagagatcaaagaggctcgtatcaaaaggggactgtccgtgacatcagagcagatcaatccacattccaccggtgccaggaaaaccgagacacgggtggaggaggctttccgacacaaacagcggaatccgatggacgtgtggcataattccgcgaacaaatgtgcattccgcgtgagaagaaagagtaggagacggagccagtggggaaaaggcattataaaaaaacggaaagtcaataatctgaaaaaagacgaagaagatacaaagtttgcggactacgaaaatcatacagaggataggaaactccttgagaatggagaattcgaagtgtcaacagactgtcacgaagaaaacggggaggaaactggcgacctctccatgactaatgatgagtcctcgtgcgatatcatggatcttgaccagggacagcgcttgaacaatggcgctggtacaaaggagaatttcgccagtacagaggaggaaagctctaatgaatccctcctcgtcaactcctcgtcttccctgaatccggaacagacgtcccggaaagagactttcctgaaaggcaactgtctgaatggcgaagcctcaaccgatagttttgagggcataccagtcctggagtgccagaatggcaaactcgaggtcgtctccttctgtgatagcggagataagtgcagtagcgaacagaaaatcctgcttgaggatcaatctaaggagaagccggagacatcaaccgaaaaccacggcgatgacctagaaaagttggaggctcttgagtgctctaacaacgagaagctggagccaggatccgatgtggaagtcaaagacgccgaattggataaagaaggggctagcaaagttaaaaaatataggaagcttattctggaacaagcaaagaccacgtcccttgagctggtgcctgaagagccttccgagccagtaccgccgctgattgtcgacagagaacgcctcaaaaagttgctggacttactcgtcgacaaatcaaacaacctcgccgttgaccaactcgagcgcctttattctctacttagccagtgtatttatagacacagaaaagattacgataagtctcagctggttgaggaaatggaacggacagtgcacatgttcgaaaccttcctgtag

SEQ ID NO: 26959 - DNA, 1236 bp, Artificial Sequence
  Description of Artificial Sequence: Synthetic coding sequence
atgtccaaggacgcattgaacctagcccagatgcaagaacagaccctgcagctcgagcaacaatctaagctgaagcagctagtcaacgaagatcttcgtaaacaggaggagtctgttcagaagcaccaccagacttttctggagagtatcagggccgctgggaccctattcggcgagggatttagagccttcgtcaccgacagggacaaggttacagcgaccgtggccgggctgacccttctggccgtgggggtgtattcagcgaagaatgcgacagccgtcaccggccggtacattgaggcccggctaggaaaacctagtctcgtgcgggagacatcccggattacggttctcgaagctcttcggcacccaatacagcaggtcagccgtaggctgctctccagacctcaggacgtactggagggagtggtcttgtccccatctctggaggcaagagtccgggacattgcgatcatgacgcggaatattaagaaaaatcgaggcctttatcgacacattctactgtacgggccccccggcaccggcaaaacactgttcgcaaagaaattggcccttcattccggcatggactatgctatcatgactggcggcgatgtcgcacccatgggccgagaaggggtgacagctatgcataaactgttcgattgggccaacacatcaaggagggggttgcttctattcgtcgacgaggccgacgctttcttgcgcaaaagagccactgaaaagatcagtgaggatctccgagcaacgcttaacgcattcttatatcgaacaggccagcattcaaacaagtttatgctcatcctcgcgagctgccatccagagcaatttgactgggccatcaatgcctgcatcgatgttatggtgcacttcgacctgcctggtcaggaggagcgtgctaggttggtgcgcatgtacctaaatgagtatgttctaaagcctgcgactgaaggaaagaggcgactgaagctggcccaattcgactacggccgcaagtgtctggaaattgccagactcacagagggcatgtcatgtaggaaaatcgcacagctggccgtatcctggcaggccaccgcatacgcctctaaggacggcgtcctaaccgaggcaatgatggacgcatgcgtccaggatttcgtgcaacagcatcagcagatgatgcgttggctgaaaggtgaaaggcctgggcctgaagatgaacagccttctagctag

SEQ ID NO: 26960 - DNA, 2112 bp, Artificial Sequence
  Description of Artificial Sequence: Synthetic coding sequence
atggctacgtgcgccgaaattcttcgcagtgagttccccgagatcgacggccaggtattcgactatgtaacgggtgtccttcatagtggctccgcggactttgaaagcgttgatgacctggttgaagcagtgggggagctgctccaggaggtgtccggcgattcaaaggacgacgccggaattagagctgtctgccagcggatggcggagcctcagtcccagggaaactcacaggtacttctggatgcacctatccagttatcaaaaataacggagaattatgactgcggaacaaagctgcccggactgctgaagcgagagcagtcttctacggtgaatgccaagaaacttgagaaagccgaggcccgactgaaggcaaaacaagaaaagaggtccgagaaggacacactaaaaacctctaatcccctggtgttagaggaagcctccgcatcacaggccggctctagaaaggagtcccggttagagtcctcaggaaagaacaaatcctacgatgtcaggatagagaatttcgatgtcagctttggcgaccgcgtcctgctcgcaggcgccgatgtcaacctggcatggggacggagatatggtctggtcgggcgtaatgggctcggcaagacaacacttctgaagatgctggctacccggtccctcagggttcccgcacatatctctttgctgcatgttgagcaggaagtggctggcgacgacacacctgctttgcagtcagtcctggaaagtgatagtgtgcgtgaagacctcttaaggagagaacgggaactcacagctcagattgcagctggaagagctgagggaagcgaagcagcggaactggccgaaatttatgcaaagctcgaagagatcgaggcagataaagcacccgctcgcgcgtccgtcattctggcgggactcggctttacgcccaaaatgcaacagcagccaacacgggagtttagcgggggctggcgcatgcgattggcattagccagggctctctttgcacgtccagatctgctgctgctggacgaacccacaaacatgctcgacgtgagggccatcttatggttggagaactatctccagacctggccttccacaatcttagttgtctcacatgacagaaactttcttaacgccatcgccaccgatattatccacctgcatagccaacgattggacggttaccggggcgatttcgagaccttcatcaaatccaaacaagaacgtttactcaatcagcagcgcgaatacgaggcgcagcagcagtaccgccagcatatccaggtttttatcgatcgattcaggtacaacgccaaccgagcctctcaggtgcagagtaaactgaaaatgttagaaaaattgcccgaactcaagccggtggataaagaatctgaggttgttatgaagtttcccgacgggttcgagaagttcagccctcccatactgcagctggatgaggtagacttttactacgacccaaaacacgttattttcagccgcctttccgtttcagctgatctggagtcccgcatctgtgtagtcggagagaatggggccggcaagagcaccatgcttaaacttttgttgggtgatctcgctcctgtgagaggtattaggcatgcacatcgaaatcttaagatcggttatttttcccagcatcacgtggaacagctggatctaaatgttagcgcggtagaattgttggcccgtaagttccctggcagaccagaggaggagtatcgtcaccagttgggcaggtatggcatcagcggggagttggcaatgcgacctctcgcatccttgtccggaggccaaaagtccagggtggcattcgcacagatgaccatgccttgccctaacttttatatcctcgatgaaccgacgaaccacctcgacatggagactatcgaagccctgggaagggcactgaataacttcagggggggagtgatactggtttcccacgacgaacgcttcatcaggttagtttgccgcgagctctgggtgtgtgagggcggaggggtaacacgcgtagaaggtggattcgaccagtacagggctctgctccaggaacagtttcggagagagggcttcctttag

SEQ ID NO: 26961 - DNA, 2130 bp, Artificial Sequence
  Description of Artificial Sequence: Synthetic coding sequence
atggcgacttgcgccgagattctgaggagcgagttcccagaaatcgatgggcaggtgtttgactatgttactggtgtcctgcacagcgggtcagcggatttcgagagcgtagatgacctggtcgaggcagtgggggagctgctgcaggaagttagcggagactccaaagacgacgccggaattcgcgcagtctgccagcggatgtacaataccttgcggctggcggagccacaaagccagggcaatagtcaggtgctcctggatgcccccatccagctcagcaagattacagagaactacgactgcgggaccaaactgcctggcctgttaaaacgtgaacagtcatctactgtgaatgccaaaaaactcgagaaagctgaggcacggttaaaggccaagcaggagaagcgcagcgaaaaggatacattaaaaacgtctaatcctctggtgctcgaggaggcttcagcttcccaagcaggctcaaggaaggagagtcgcctggagtcctctggaaaaaataaatcgtacgatgtgagaatcgagaattttgatgtgagtttcggggatcgggtcctgctagccggtgcagatgtgaatctcgcgtggggccggaggtacggtctggtgggtcgtaacggtctcggcaaaaccacactcctgaagatgcttgcaacaaggtcattgcgtgttccagcccacattagtctgttgcacgtggagcaggaggtggcaggagatgacacacccgctcttcagtcggtgctggagtctgactccgtgcgagaggacctactgcgcagggaaagagagcttacagctcagatcgccgccggcagggctgagggcagtgaagccgctgagctggccgagatctacgctaaactcgaggaaattgaggcagataaagcccctgccagagctagcgttattctggccggcctggggttcacacccaaaatgcagcagcaacctaccagagagttcagtgggggctggagaatgcggctggcgctagcccgggctctgttcgctaggcctgatctgcttttattagacgagccaaccaatatgctagacgtccgagcaattctgtggctcgagaactacctgcaaacgtggccaagcactattctggtcgtcagccacgacagaaattttctgaacgccatcgccactgatatcatccatctccattcacagagactcgacgggtacaggggcgactttgaaacctttattaagagtaagcaggagcgcttgcttaatcagcagagagagtacgaagcccagcagcagtatagacaacacatccaagtgttcattgacaggtttcgttataatgcaaaccgggcttcccaggtacaatctaagctgaagatgctcgagaagctccctgaactcaagcccgtagataaggaatccgaggtggtgatgaaatttccggacggttttgagaagtttagtcctcctatcttgcagctggatgaagtcgacttttactacgaccccaagcacgtcatcttctcccggctgagtgtgagtgctgacctggagtctcgaatctgtgttgtcggcgagaatggggctggaaagagtacgatgctgaagctcctcctgggcgatttggctccagtcagaggcatcaggcacgctcaccggaatctgaagatcggctactttagtcagcatcatgtcgagcagttagatctgaacgtctccgcggtagaattgttggcacggaaattcccagggaggccagaagaggagtatcgacatcagctcggtcggtatggaatctccggagaattggccatgagacctctggcctccctgagcggggggcagaaatcccgggtcgccttcgcccagatgaccatgccctgcccaaacttttacatcctggatgagccaacaaaccaccttgacatggagacgatcgaggccttgggaagagcccttaacaacttccggggtggtgtgatcctggttagtcacgacgagcgatttatccggttggtctgcagggaactgtgggtatgtgagggaggcggagtcacaagagtggaaggtggattcgatcagtatcgcgccttgttgcaggaacagttcagacgagaaggttttctttag

SEQ ID NO: 26962 - DNA, 3573 bp, Artificial Sequence
  Description of Artificial Sequence: Synthetic coding sequence
atgaagaccagacagaataaggatagcatgagcatgaggagcggcaggaagaaagaggctcccggaccccgtgaggagctgcgcagtcgtggcagagcgtctcccggaggcgtaagcacctctagttcagatggcaaggcggagaaaagccgtcagaccgccaaaaaggcgagggtggaagaagcctccactcccaaggttaataaacagggacgaagtgaagaaatctcagaaagtgagagcgaggaaaccaatgcccccaaaaaaactaagacagaacaggagctcccgcgccctcagtcccccagcgacctcgactcattggacggccggtcattgaatgatgatggctcttccgacccaagagacattgatcaggacaatcgctcaacttcaccatctatctactccccggggtcagtggagaatgacagtgatagtagctcaggcctgagccagggaccggccagaccataccatccgccgccactctttcctccctccccacaacctcctgatagtacaccccgacaacccgaagccagtttcgagcctcaccctagcgtgacaccgactggctaccacgcccccatggaacctccaactagccgaatgttccaggcgccgcccggagcgcccccgccgcatccacagctgtaccctggcgggactggcggggtgctgtctgggcctcccatggggcctaaggggggcggagccgcctccagtgtcggtgggccaaacggcggcaaacaacaccctccacccaccacccccatcagcgtgtcttcttccggcgcttcaggtgccccccctacaaagccacccacaacccccgtcggcggagggaacctgccaagcgctccacctccagccaacttcccccatgttaccccaaatctccctccaccaccagccttgaggcccctcaataatgcatcggcctcccctcctggcttgggagctcagcctttgcccggtcacttgccctcgccacatgccatgggacagggaatgggaggtctcccacctggaccggaaaagggtccaacactcgcaccatcgccccattcacttcctccagcgtcatcttcagccccagcgccccccatgcgcttcccttactcatccagctcttccagctctgctgccgccagctcctcaagcagctcttcttcatccagtgcgagtcccttccccgcatcccaggctttgccgagctaccctcacagctttccccctcctacttccctttccgtttcaaaccagccaccaaaatatacccagccctcgctgcctagccaggctgtctggagccaaggcccacccccaccacccccatacgggaggctgctcgcgaacagcaatgcccatcctggacctttccccccctccacaggagctcagtctaccgcccatcctccagtgagcacacatcaccaccaccatcagcagcagcagcagcagcaacagcagcaacagcaacaacagcagcagcagcaacagcatcacgggaacagtggacctccaccccccggagccttccctcaccccttggaaggtggcagctcccatcatgcccacccatacgcaatgtccccatcactcgggtcacttcgaccttatccacccgggccagcccatctccctcctcctcattcccaggtctcctacagtcaagcgggaccaaacggcccccctgtgtcaagttctagtaactcttcctctagcacctcccagggatcctacccatgctcccatccgagtccctcccagggcccccagggagccccataccccttcccccccgtgcccactgttaccacttcatcagcaaccctcagtactgtgatcgcgacggtagcgtcatctccagccggctataaaacggcttccccccccgggcctccgccatatggcaagagggctccatccccgggagcctataagacagctacacccccgggatataagcctggatccccaccgtcattccggaccgggactccgccgggatacaggggaacctctccgcctgctggaccagggacattcaagcctgggtctccgaccgtgggtccaggccccttaccaccagcgggaccttccgggctcccatcactgcctcctcctccagcggccccggcatccgggccaccgctgtccgctacccaaatcaagcaggaaccggctgaagaatacgagacccccgagagccctgttcccccagctcgcagtccttcccccccacccaaggtcgtggacgtgcccagccacgcctcccaatccgcaagatttaacaagcacttagacaggggctttaacagctgcgcccgcagcgatctgtatttcgtacctctggagggaagcaaactcgccaagaaacgggctgatttggttgagaaagtcagacgggaagcagaacagagagcacgggaagagaaggagagggaacgtgagagagagcgcgaaaaggagagggagcgggaaaaggaacgcgaacttgagcggagcgtgaagctggctcaggaaggccgcgcacctgtggaatgcccctccctgggtcctgtaccgcatcgcccccccttcgagccaggcagtgccgtggccacagtgcctccctacctagggccagacaccccggccctgagaaccctctcagagtacgctcgtcctcacgtgatgagtcccggtaaccggaaccatccgttttatgttcctctaggcgccgtcgatccgggcctgctaggctacaacgtgcctgcactatactcttccgacccagctgccagggagagagagcgcgaagctagggaaagagatctgagagacaggctgaagcctggtttcgaggtaaaacccagtgagctggagcccctgcatggtgtgcctggtcctggccttgacccgttcccaaggcacggtgggttggccctgcagcccggtcctccgggcctccaccccttccccttccacccctctctcggaccactggaaagggagagacttgccctggctgctggcccagcactcaggcctgacatgtcatacgctgaaagactggctgcagagagacaacatgctgaaagggtcgcagcgctaggcaatgacccactagcacgcctgcagatgctgaacgtgacccctcatcaccatcagcatagccatatccacagtcacctccacctgcaccagcaggatgccatccatgccgcatctgccagcgtccatccacttatagatcctttagccagtggctctcaccttacacgcatcccataccctgctgggacgctgcctaatcctcttcttccccacccgctccacgaaaacgaggtcctgcggcatcagctgttcgcagcaccctacagggatctcccagcgagcctgtctgccccaatgagtgcggcgcaccaactacaagccatgcatgcgcagtcagcggagctgcagagactcgcactggagcagcagcagtggcttcatgcccaccatcccctgcatagcgtccctctacctgcccaggaagattactactcccatctgaaaaaagaatcagataagcctctttag

SEQ ID NO: 26963 - DNA, 3573 bp, Artificial Sequence
  Description of Artificial Sequence: Synthetic coding sequence
atgaaaactaggcagaacaaggacagcatgtcaatgaggagtggccggaaaaaggaggcccctggacctcgagaggaactacgcagcagaggacgcgcttcaccagggggagtgtctacttcatcaagcgacggtaaggcagagaaaagcagacagaccgcaaagaaggccagagtagaggaggctagtacacccaaagtgaataaacagggccgcagcgaggagatttcagagtcggaatccgaagaaaccaacgcccccaaaaaaaccaaaacagaacaggagttaccgagaccgcagagcccctcagacttagattctctcgacgggcgtagcctgaacgacgatggcagctccgaccccagggatatagaccaagacaaccggtctacgagccctagtatatactctccaggaagcgtggaaaacgattcagatagcagttctgggctgagtcaggggccggcccgaccgtatcatcctcctccactttttccccctagcccccagccacctgactccaccccaaggcagcctgaggccagttttgaaccacaccccagtgtgactccgacaggctaccatgcccctatggagccaccaacgtcacggatgtttcaggccccaccaggcgccccgcccccacatccccagttgtatccgggtggcaccggcggggtgctgagcggaccaccgatggggcccaaaggagggggggccgccagctctgtcggcggtccgaatggcggcaagcagcaccctcctccgaccactcccatctcagtgtcctcatccggtgcaagcggcgcgcctccaaccaagcctcccactacgccggtgggaggcgggaatcttcctagcgcgccaccgcccgcaaacttccctcacgtcactcctaacctaccacctccgcctgctctgagacctctcaataatgcttcagcatcccctcctggcctgggagcccagccactgcctggtcacctgccaagtccccacgctatggggcaaggcatggggggactccctcccggcccagagaagggtcctacactggccccatcaccccacagtttgccaccagccagttcatcggctcccgcgcctccaatgcgcttcccgtatagttccagttctagcagctccgctgctgcctcatctagctcctcctcatcctcatctagcgcctctcctttcccagccagccaggccctccctagctaccctcacagctttccaccccctacttccctgagcgtctccaaccaaccgccaaagtacacccagccctcacttccttcccaggccgtgtggtcacagggcccaccaccaccaccaccatacggccgcctgctagccaactcgaatgcccacccaggacccttccctcctagcactggcgcccaaagcacagcccaccccccagtgtccacgcaccaccaccaccatcagcagcagcagcagcagcagcagcagcagcagcaacaacaacagcagcagcaacaacatcatgggaactctggacccccgcctccaggcgcatttccacaccctctggagggaggctcgagccaccacgcccacccctatgctatgtcaccttctcttggatccctcaggccttatcccccggggcccgcacacctgccccctcctcactcacaagtgtcctatagccaggccggccctaacggaccgccggttagcagctcctcaaacagtagctcctctacaagccaaggatcttacccatgtagtcatccatctcccagccaggggccccagggcgcaccctatccattcccgcccgttcccaccgtgaccacatcgtctgctactctttctacagtgatagctacagtagcttcgagcccagcagggtataagacggcctcaccaccaggccctcctccctatggcaagcgggctccaagtcccggggcgtacaagacggctacacctccaggatataagcctgggtctccacctagcttccgaaccggtaccccacctggttacagagggacttcgcctcccgccggcccaggcaccttcaagcctgggtcccctacagtgggccccgggccactgccccctgcagggcccagtgggcttccaagtttacctcccccccctgctgcccccgctagcgggcccccccttagtgctacccagattaagcaggagcccgctgaggagtacgaaacaccagaatccccagtcccccccgcccggtcgccgtctcccccccctaaggtagtagacgtgccatcgcacgcgagccagtctgctcgatttaataaacatctggatcgcgggtttaactcatgcgctagatctgacctgtattttgtcccgcttgaaggctcaaaactggccaaaaagcgggcagacttggtggaaaaggtgcgccgcgaagcagagcagcgtgccagagaggagaaggagagggagcgagaacgagaacgcgagaaggagcgtgagcgggagaaagagcgcgaactcgagaggagcgttaagctggcccaggaggggcgggctcctgtggaatgtccaagcctcgggcctgttcctcacaggccaccctttgagcccggaagtgcagtggctaccgtacccccctacctcggccccgacacacctgccctccggaccctgtcagagtacgctaggcctcacgtgatgtcaccaggcaaccgcaaccatcctttctatgttcctctgggagccgtcgacccgggcctattgggatacaacgtgcctgccctctacagttcagatcccgcagctcgagaaagagaacgggaggcacgcgaacgggaccttagggatcggttaaagcccggtttcgaggttaaaccgtcagagcttgagcctctgcatggcgtgcccggccctggattagacccttttcctcgtcacggcggcctggcactgcagcctggccctcccggactccacccattcccttttcatccttcactgggaccactggagcgcgagcgactggctctggcagccggtccggccctccggccagacatgagttacgccgagagacttgccgcagagcggcagcatgccgagcgggtggccgcactgggaaacgacccattagctcgcctccagatgttaaacgtgacaccgcatcatcaccagcacagccatatacacagccatttacatcttcatcaacaggacgccatacatgcagcttctgcatcagtgcacccattgattgatcctttagctagtgggtctcacctcactaggatcccatacccagccggtacactcccaaacccactgctgccacacccgctgcacgagaacgaggtgctgaggcaccagctgttcgccgccccttatcgggacttacccgcttcactgagcgcccccatgtctgccgcccaccaactccaggccatgcatgcgcagtccgccgagcttcagagattagccctcgagcagcagcaatggctgcacgcacatcatccactgcacagcgtgcccctccccgcacaggaggattattattcgcatctcaagaaggaatcggataagcccttatag

SEQ ID NO: 26964 - DNA, 3780 bp, Artificial Sequence
  Description of Artificial Sequence: Synthetic coding sequence
atggatggccctacccgtggtcatggtctgcgaaagaagaggaggtccaggtcacagcgggatcgcgagcggcggagccgcggaggattgggcgcgggcgctgcaggtggtgggggagccgggagaacccgcgcgctgtcattggcatcatctagcggaagcgataaagaggataatggcaaacctcctagctcagcaccttcccgtcctcgcccgccgcgcaggaagagaagggagtctaccagcgcggaggaggacatcatcgatggctttgcaatgactagctttgtgacattcgaggcactggagaaggacgtggcgctgaagcctcaggagagagtcgaaaaacgacagacccctcttacaaagaagaaaagggaggccctcaccaacggcttgtccttccactctaagaagtcccgtctatcacacccacaccactattcatctgatagggaaaatgacaggaacctctgccaacatctgggaaagcggaaaaagatgccaaaggcactcagacagctgaagccaggccagaattcttgccgagacagcgacagcgagagtgcatcaggcgagtccaaaggctttcataggtcttcctcaagagaacggttatcagattcaagcgcaccgtctagtctcggcactggctatttctgtgattccgatagcgatcaagaagagaaagcatctgacgcttcaagcgagaagctgttcaatacagtgatcgtaaacaaggatcccgagctgggcgtcgggaccttacccgagcatgattctcaggacgctggtccgatcgtccctaaaataagcggactggagcggtctcaagagaagtcacaagactgttgcaaggaacctatcttcgagcctgtagtgctgaaggacccctgtccccaggtcgcccagcctatcccacagccccagactgagccccagctaagagcaccatctccagacccagacctggtgcagcgcacggaagccccacctcagcccccacctctgagtacccagcccccacaaggtccaccagaagctcagctccaacccgccccccagccacaggtacagaggccgccccggcctcagagccctacacagcttcttcaccagaacctccccccggtacaggcccatccctccgctcaatcattaagccagccattaagtgcttacaattctagttcgctctctctgaacagcctgagcagttcccgctcttcgactcctgctaaaactcagcccgcgccaccccacatatcacatcatccaagcgccagcccttttcccctgtccctgccaaaccatagtccgttacactcgttcaccccaacactgcagcctccagcgcactctcaccatcccaatatgttcgcgcccccaacagccctgccacccccaccaccacttactagtgggagtttgcaagtggcagggcatccggccgggtcaacttacagtgaacaggatattctgcgtcaagagttgaatactcgcttcttagcaagccagtcagcggaccgcggggcatcgcttggaccaccaccctaccttagaactgagttccatcagcaccaacatcagcaccagcacacccaccagcacacacaccagcacacattcactcctttcccacacgccataccgcccacagcaatcatgcccaccccggccccacctatgttcgacaagtatcctactaaggtggaccctttttaccgccattcgctgtttcattcataccctcctgccgtgtctggcatacctcccatgattccacctaccggaccatttgggtccttgcaaggagctttccagcccaaaactagcaatccaatagacgtcgctgctcggcctggcaccgtcccccacaccttgctccagaaagacccacgcctcaccgatccatttaggccgatgctcaggaagccagggaaatggtgtgcaatgcatgtacacatcgcatggcagatttaccaccatcagcagaaggttaaaaaacagatgcagtctgatcctcacaagctagacttcggactgaaaccggagtttctatccagaccacccggtcctagcttgttcggcgcaattcaccacccccatgatctggccaggccctcaaccttattttctgccgctggcgccgcccaccccactgggaccccgttcggcccacctcctcatcattccaactttttaaacccagccgcgcatcttgagcccttcaacagaccaagcaccttcacaggattagctgcagtggggggaaacgcgtttggcgggctgggaaaccctagcgtaactcccaattcaatgtttggtcacaaagatggtccctcagtgcaaaattttagcaatccccatgaaccctggaacaggctgcatcggactcctccatcctttcccacgccaccaccttggctgaaacctggcgaactggaacggtccgcgagtgcagctgcacatgatagggatagggatgtggataaaagagactcctcagtttccaaagacgataaggagcgggagtccgtggaaaaaaggcactcttcccaccccagtccggcaccagtcctgccggtaaacgccctcggacacaccagatcttcaaccgaacagattagagcccacctcaatactgaggctagagaaaaagataagcccaaggaaagggagagggatcatagcgaaagtaggaaagacttggccgccgatgaacataaggccaaagagggccacttacctgagaaggacggacatggacacgaaggccgtgcggccggcgaagaggcgaagcagctcgcccgggtgccctcaccctacgtccgcacgcctgtggtggagagcgcccgtcccaacagcacgagcagtagggaagctgagccgagaaagggcgaacccgcttacgaaaaccctaaaaagtcttcggaggtgaaagtgaaggaagaacggaaggaggatcatgacttgcctccagaggctccacagactcatagagcctcagagcctccacccccaaatagcagtagctcagtacatcctgggcccctggcttccatgcccatgactgtgggcgtgaccggcatacacccaatgaactctatctcatcccttgacagaacaagaatgatgacaccctttatgggtatcagtcctctgccagggggtgagagatttccttaccccagttttcactgggatccaatccgggacccgctgcgtgacccatacagggaactggacatccacaggagggacccactggggcgggattttttgttgcggaacgacccattgcaccgactcagcacaccacgcttatatgaggccgataggagcttcagggatcgcgaaccgcatgattactctcatcatcatcatcatcaccaccaccccctgagcgtggacccaaggcgcgagcacgagaggggggggcacctggatgagagggagagactgcacatgctgagagaggattacgaacacaccaggttgcattcggtccatccagcttctctggacggccatctgccacacccgagtttgatcacaccaggacttccctccatgcattacccgagaatttccccgaccgcagggaatcagaatggccttctgaacaaaactcctcccactgccgcgttgtcagctcccccccctcttatttctaccctgggagggagacccgtatctcctcgccgaactacccccctgtccgccgagatcagggaacggccacctagccatactctcaaagacatcgaggccagatag

SEQ ID NO: 26965 - DNA, 801 bp, Artificial Sequence
  Description of Artificial Sequence: Synthetic coding sequence
atggatggaccaaccagggggcatggcctgagaaagaaacggaggagtcgctcacagcgggatcgggagagaagatcgagaggcggattaggcgctggagccgcagggggcggaggtgcaggtagaacacgtgcgctctcgcttgcatcatcatccgggtcagacaaggaggacaacgggaagcccccctcatcggctcccagcagacctcggccgcccaggcgcaagcgccgtgaatccacctcggccgaagaagatatcattgatggctttgcgatgacatcctttgtaactttcgaagcattagagaaggatgtggcactaaagccacaggagcgcgtggagaaacgccagacgccattaactaagaagaagcgggaggccctgaccaacggtctgtccttccatagcaaaaagtcccggttaagccatccccaccattattcctccgacagggaaaatgataggaatctttgccagcatctggggaagaggaagaagatgcctaaggcacttaggcagctaaagcccggtcagaactcatgtcgagatagcgattccgagtcagcctccggggagagtaagggtttccacagatcctcttctagggaaagacttagtgattcatccgcccccagttcgctggggacaggttatttcagatccggaaaaatgtgtctgggcgaggaggcctgcctgaagtcaggtaatgacatgaagcgtgacgtgagtaatacctctagttgggcttccaaccgcgagagctttttcagtcttgttaagctattgaaaggcttttag

SEQ ID NO: 26966 - DNA, 3708 bp, Artificial Sequence
  Description of Artificial Sequence: Synthetic coding sequence
atggatgggccaacgagaggtcacggactgaggaagaaacgcagaagtaggtcccagcgcgatcgggagcggagatctagaggaggcctgggcgccggtgcagcaggtggcggtggcgcgggacgcactcgggccctgtctctagccagctcttcaggcagcgataaggaggataacggaaaaccccccagtagcgcgccttcgcgaccgcgaccccccaggcggaaacgtcgcgagagcacaagcgccgaggaggatattatcgacggctttgccatgacttcgtttgttaccttcgaagctctcgaaaaagacgtggctcttaagccccaggaacgggtggagaaacggcagacacccttaacgaaaaaaaaaagagaggcgttaaccaatggactgtcattccactccaagaaaagcagactgtctcacccgcatcactactccagtgatagagagaacgacaggaacctctgtcagcatctggggaagagaaaaaaaatgcccaaagcgctgaggcagctgaagcccgggcagaattcatgccgggactctgattcagagagcgcttccggagagagtaaaggctttcacagaagttcttctagggaacggctgtccgactcctcggctccgtcctccttgggaacaggatacttctgcgactctgatagtgatcaagaggagaaggctagcgacgcctccagtgaaaagctgtttaacacagtaatcgtaaataaagaccctgagctgggagtgggaacccttcccgagcatgattcccaggacgccgggcccattgtgcctaagatttctggcctggaacgaagccaggagaagtcccaggactgttgcaaggaacccatctttgagcccgtagttttgaaagatccctgcccacaggtagcccagccaatcccgcagccccagacagagccacagcttcgggccccctcacccgatccagatttagttcagagaaccgaggcccctccacagccgccacctttaagcacacaacctcctcaaggcccacccgaggcccagctgcagccggctccacaaccccaagtgcagcgcccgccccgaccccaaagccctactcaactgctgcaccagaatctcccacctgtgcaagcacacccttctgcacagtctttaagccagccgttgtcagcttacaacagctcatccctctcccttaattcactatcgtcaagccgctcctccacaccagccaaaactcagccagcaccaccccacattagccaccacccctcggcttcaccttttcccttaagtcttcctaaccacagcccattgcactccttcacccccactctgcagccaccagcccactcgcaccatcccaatatgttcgctccgcccactgctctccccccccccccccctctcaccagcgggagccttcaagtagcaggccaccccgcaggcagcacctattccgagcaggacattctgagacaagagcttaacaccaggttcctggcgtcacagtcggcagaccgaggcgcctccctcggtccacccccatatttgcgcaccgagtttcatcaacaccagcaccaacaccagcatactcaccagcatactcatcagcacacattcacaccatttccacacgccattccacctaccgccatcatgcctaccccagctcctcctatgtttgacaaataccctacgaaagtggacccattctatagacacagcctttttcatagctacccccctgctgtatcagggatacctccgatgatccctccaaccggcccattcgggagcctgcaaggcgcgttccagccgaaattgacagacccattcagacctatgcttaggaagccaggcaagtggtgcgcaatgcatgtgcacatcgcctggcagatttaccatcaccagcagaaggtgaagaaacagatgcagagcgatcctcacaagctggactttggattgaagcccgagtttctctcccgtccccctgggccctccctcttcggagccatccaccacccgcatgatttggcaagaccgtcaaccttgttcagcgctgccggcgctgcacatccaactggcacccccttcggtccgcccccacatcactcaaattttctcaatccggcagcgcacttggaaccgtttaaccggccctcaacctttacaggactggctgccgtcggcgggaacgcgttcggagggctgggcaacccctctgtcacccctaatagcatgttcggacacaaagacggcccatcagtgcagaacttctccaaccctcatgagccatggaaccgcctgcacagaactccaccaagctttcccacgcccccgccttggttgaaacctggagagctggaaagaagcgcctcagctgccgcgcatgatcgcgatcgcgatgtggacaagagggactctagtgtgtctaaggatgataaggaaagagagagtgtcgaaaaaaggcacagttcccaccctagcccagcacctgtgctgccggtgaatgccttaggccacacgcggagctccacggagcagatcagagcccaccttaacaccgaagcacgagagaaggacaagcccaaagaaagagagcgcgaccacagcgaatcaaggaaagacttagccgctgatgagcacaaggccaaagagggccatctgccggagaaagatggacatggccacgaaggcagagccgccggcgaagaggccaaacagctcgcaagagtgccatctccttacgtgcggacacctgtcgtggaatccgcacgaccgaattccacctcttcacgggaagcagagccgcgcaaaggcgagccagcgtacgagaatccgaagaagagctcggaagttaaggttaaagaggagcgaaaagaagaccacgatctcccaccagaggctccccaaacccaccgggcctctgaacccccacctccaaacagtagctcctctgtacacccgggaccgcttgcctcaatgccaatgactgtgggcgtaaccggaatccaccccatgaactctatcagtagcctcgatcgtacgagaatgatgacacccttcatggggatatctcctctgccaggtggcgagaggttcccttatccttctttccactgggatcccattcgcgacccgctgcgtgatccgtatagggaactggacattcatcggcgcgaccctttagggagagatttcctactccgtaacgaccctctgcaccgattgagcacgcccaggctttacgaggctgacagatccttccgagatagagaacctcatgattattcccaccaccaccaccaccaccatcatcctctcagcgtggacccgcggcgcgaacacgaaagagggggccacctcgacgaacgcgagcgactccacatgctacgcgaagattacgagcacacccgactgcactcagtacacccagcatctctggatggccatcttcctcatcctagcctcatcactcctggcctgccaagcatgcactatccgagaattagccctacagccgggaatcaaaacggactccttaataaaacaccccctaccgccgcactaagtgccccacctcctttgatatcaacgctcggtgggcgccctgtttctccacgacggactacacctctgtcagctgagattagagagcggcctccttcgcataccctcaaagatatcgaagcaagatag

SEQ ID NO: 26967 - DNA, 423 bp, Artificial Sequence
  Description of Artificial Sequence: Synthetic coding sequence
atggttacggcgatggcactgtcaaagagcacgaactcccataagaatgccacagaggatctgtacgaagtcgacaagctcaaaaaggaatgttatgaatggatcaacacctgtagctgtctgttatccaacataaagggtcgcaagataactctgctgacatacgaggagatagagcggttgctggaagaggaggccgtgaaagaatttattgagccagagatcgatgagagctttaaggaagacgaagaggaatccaaagaagatcggaaacttcaggaggagaacaaggagcgcgctgaggagcagccttccacttctacagagaaagagaagctgatacgatttatcggtgaggatgaaaatgtacattcaaagccgcttttcgaaactgatgtgctctcaagttggaaaaatatatag

SEQ ID NO: 26968 - DNA, 2691 bp, Artificial Sequence
  Description of Artificial Sequence: Synthetic coding sequence
atggttgatcgatccaaactgctgccgactagcctgcagaatgagtttattcctaaggaagtgctgctctctctgacatatgcagccaacgcgggcccctgtcccgagaacctgctccctcccaagaagattaagaccccaaaaggtaccctccctcggctagtcgaccacgtttggcaccatccggtgcgccgaaacaagttcaagtatctcatagaccacccagtcagtctgacaggcgctggcagagatatcagttttctttacgacgttacatacgctaaggggcagacacgagagaaggctgtgtgtcccccgcacttagcacggagtcttcagagccacgacggcgttattgtgcctcataaacctaagacgctcaccgataccctgataccagaagaatttcacattgtttcaagtactggcgtgagcggattggaatgttatgacgataagtatacaaccctgctgactgacagtgaaaacagactgctgctcttccccagcatgaagcccaacaaacgcgtagaagtcgctcaactgaacgatgtgatggacacaatgctcgagagggccggggtcgagaatcaggagtacaccggcccgactaagatgcacaagcttctgcatattttgaagaaagaacaaaccatctacaatatgatcttccatgaattgatccgtcaggtgtcggtggactgtgccgatcgcggcgaacttttgtcgaaggttcgggagcgttacgtgcagatgctcgaccagatcgccaggcaaatgatcgacttttacaaagatctagttactcagagggttatggatcagcgcatcctggaggagctctataacttcaaacatgtgattgaagaacttactcgagagctgtgtctggtgcgtgcacacgacgttaagctcactaaagaaaccgaaaaagctcataaggatctggcccaggccctgctgaatgctgaaaaaaatgctaaaatcgttgaagaataccatgatctgtacacattgcagagagaaagaatggagaatgacatgaagaaactcgtggctgagcgggacatctggagttccgcaacgtacgaactggccctaaaggtgatcgagcgtaatcgagtgatcctggcacgtaggctttacctcaatgagaagggatggaataagtataccaagcactttatcatccttctgtccaataaagatacagaggatctagctctccttcagaaactcacacagaagtggaggaatctcgtcaataagctcaagcaagaggtggagcagatggaggagagcacatccgagacactcaagattgtgaaggatgggctcatcaagtggcaggagttcttcaacgagaaggacattctgtcccccaacaaaggcaacatttttaactctgtgttgcttgatttcaaacagtggcagaagattcttaacgagaagaaagaggagtttaccggggatgtgctgttgagcaagtacgacacactgaaaatcatcaagcatctgcaagagaactgggccgatatcggacttggcatttttaatcggcacaagagtctagaaggcgaaatgccaagtgaaaggcaatacatggaagagatcatcaaaaacatccagaaactgtacaaagagtatgagattaggattaacggtgacaatgggtatagcaaaatcctgccaagcttgatttctagccttgacttttgcagttttaaactcgaaaacctagaattccccgatactccgctggaggagtggcaggagatcgacgaaaaaatcaacgaaatgaagtcccatctcgacatcctgttgaacctgactggtatcgttccccaacacatcgacgtcgatagtgtcagcgtgctgcaggcctacatcttcaatatgatccagcagtggctccttaagattggaaacgagatcaataacggaaacatcgaattgcagcaccacatggatgaactgcatatcagtatgatccaatggatggtgaacttgcttattttaatgataccgaactttactgaccaggactgcctccttaaattggaggaagaaagtgccgagaagcatgatattggcgtcgcacggcttgagctggacgccatcgaactgaccagaaagctgtatcaatactcatcatacctgagctcttgttgcaaggggatggtcactgccatggctctgtccaaaagcaccaacagtcacaaaaatgctacggaagatctgtatgaggtcgacaagcttaagcagccctctaccagtacagagaaggagaagctcatcagattcattggcgaggatgagaacgtccacagtaagcctctctttgagacggatgtcctgtcctcttggagggaatccgccaagcagggaacgctcgcgcaaaaatatctggaggccatggcagtgattgagcacatgcaagagaagctgttagaggtagaaaatagagccaggcaggcagaggagaaattcgaagatgcttacgagaagctgcatcacaccctgattaagaataaagatttggaagagctggttatgacaagcaggaaggagagcaaggaggagaaggagaaccaagacgaacgcgaagtaaaagaggaagaagagcagcaggaggaggaggaggtcagatcagctgaaaactctagcaaaagccctaaaaaaggacattag

SEQ ID NO: 26969 - DNA, 3039 bp, Artificial Sequence
  Description of Artificial Sequence: Synthetic coding sequence
atgagcctgcctaagacaccctccacccctctaaatagcacatcaacctccgaatcaaagaaattgaaagtttccgtggcaaaagaaggcacaagaggcctgccagagctcaaagagaagaaaaatatggttgacagaagcaagctgcttcccacatctcttcagaatgaattcattcctaaagaagttctgctctccctgacttatgctgctaacgcgggcccgtgccccgaaaacctgctaccgcctaaaaaaattaagaccccaaaggggactctcccgaggctggttgaccacgtctggcaccatcccgtcagacggaacaagtttaaatatctgattgaccatcctgtgagtctaacaggggccggcagagacatttccttcctgtatgacgtaacctatgccaaaggccagactagggagaaggctgtctgtccccctcacttggccagatccctccagtctcacgatggtgtgatcgtgccacacaagccaaagacactaacagatacccttattcctgaagagtttcacatagtgtccagcacgggcgtgagcggtttggagtgctacgacgataaatacaccactctgctgacagattctgagaacagactcttactgtttccatctatgaaacccaacaaaagagtggaagtcgcccagttgaatgacgtcatggacaccatgttagaacgggccggagttgaaaatcaggaatacacaggtcctacaaagatgcacaaactcctccatatcctcaaaaaagagcagacgatctataatatgatctttcacgagctcatccgacaggtcagtgtcgactgcgccgatagaggtgagctgctgtcaaaggtccgggagcggtatgttcagatgttagaccaaattgctcgccaaatgattgacttttataaagatctggtcacccagcgggttatggaccagagaatcctagaggagctctataactttaagcatgtaattgaagaactgacacgggaattatgccttgtgagggcccacgatgttaaacttaccaaggaaaccgagaaagcccacaaagatcttgcacaagccttgctgaacgcagagaagaatgccaaaattgtggaggagtaccacgacctgtacactctgcagcgagagcgcatggaaaacgacatgaagaaattggttgccgagcgggatatctggtcttcagcaacatatgaactggccctcaaagttatcgaacgcaatagggtcatcctcgcccgacgtctctacctcaatgagaagggatggaataaatacacaaaacactttatcatcctgttatccaataaggatactgaggatctcgctctgcttcagaaactgactcagaagtggcgtaacctggtgaataagctgaaacaggaggtcgaacagatggaggagagcacctccgaaacactaaaaatagtgaaggacgggctcattaaatggcaggagttctttaacgaaaaagacatcttgtcaccaaacaagggcaatattttcaattccgttttattggactttaagcaatggcagaagatattaaacgaaaagaaagaagagttcaccggagacgtattgctctcgaaatacgacactctgaaaataatcaaacatctccaggaaaattgggcagatattggactcgggatctttaaccgacataaatccttggaaggagagatgcctagcgaacgccagtacatggaggaaatcattaaaaacatccaaaaactttataaagagtacgagattcgtatcaatggggacaatgggtactctaaaattctaccatctctcatctcaagtctcgacttttgctcctttaagcttgagaatttggaatttcctgatacaccactggaggaatggcaggaaattgacgagaaaatcaacgaaatgaagtctcaccttgacattttgctgaacctgacaggcatcgtcccgcaacatattgacgtagactcagtcagtgtactgcaggcttatattttcaatatgattcagcagtggctgctgaagatcgggaatgaaattaacaacggtaacatcgagctgcagcatcatatggatgaactgcatatttctatgattcaatggatggtcaatctgttaattctcatgatacctaactttacagaccaggattgcctgcttaagctggaagaagaaagcgctgagaagcatgacatcggtgttgcccgactggaactggacgccatcgagctaacacgaaagctgtatcaatattcgtcctatctctcaagttgttgtaagggaatggtgacagctatggctctgagcaagagtactaactctcataaaaacgccacagaagatctatacgaggtggacaaacttaagaaagaatgctacgagtggataaatacatgcagctgtcttctgtcgaacataaaagggcgcaagattaccttactcacatatgaagaaatcgaacgcctgttggaggaagaggctgtgaaagagtttatcgagccagagatcgatgagagcttcaaggaggacgaagaggagtcaaaagaggaccgcaaactccaagaggagaataaagaaagagcagaagaacagcccagcacatcaaccgaaaaagagaagctcatcagatttattggagaggacgaaaatgtccacagcaaacccctttttgaaacggatgtgctgtcttcttggcgggagtctgctaagcaaggcaccctggcccagaagtacctcgaggccatggctgttattgagcacatgcaggaaaagctgctggaggtcgagaacagggcccgacaggccgaagaaaagtttgaagacgcatacgaaaaactccatcataccttaattaagaataaagatctcgaggaactcgtgatgacttccaggaaagagtccaaagaagagaaggagaaccaagacgaaagggaagttaaggaagaagaagaacagcaggaggaggaggaggttagatccgcggagaactcctccaagtctccgaagaagggccactag

SEQ ID NO: 26970 - DNA, 1968 bp, Artificial Sequence
  Description of Artificial Sequence: Synthetic coding sequence
atgagcctgcctaagacgcctagcactcccctgaatagtacttccaccagcgagtctaagaagcttaaagtctccgtcgcaaaggaaggcacccggggcttaccagaacttaaggagaagaagaacatggtcgatcgcagcaaactgttacctacttcactgcaaaacgaattcatccccaaagaagtgttactgtcgcttacttacgccgctaacgccggtccttgccccgaaaatttgcttcctcccaagaagatcaaaacacctaaaggcacgcttcccaggttagtggatcacgtctggcaccacccggttcggaggaataagttcaaatacctaatcgatcacccagtttcactgactggggcaggccgcgatatctcattcttgtacgatgtcacatatgccaagggacagaccagagagaaggcggtttgccctccgcacctagcaaggagcctgcaaagccatgacggcgtgatcgtcccccacaaaccaaagacccttaccgatacactgattccagaggagttccatattgtctcctctacaggcgtaagcggccttgaatgctacgacgataagtacactaccctgctgaccgactccgagaacagactgctgctgtttcccagtatgaagccgaacaagcgggtcgaggtcgctcagctgaacgatgtgatggacactatgcttgagcgggccggtgttgagaatcaggaatacaccgggcctaccaaaatgcataagctgctgcatattctcaagaaagagcagaccatttataacatgatcttccatgagcttatccgacaagttagcgtcgattgcgccgaccggggtgagctgctctcaaaagtgcgagagaggtatgtccagatgctggaccagatcgcacgtcagatgatagatttttacaaggatctggtaactcagagggtgatggaccagaggatccttgaggagttatacaattttaaacacgtaatcgaggagctgacgcgggaactctgtttagtgcgtgcccatgatgtgaaactgacaaaggaaactgagaaagcgcacaaagatcttgctcaagctctgctgaacgcagagaaaaacgccaagattgtggaggaataccacgacctgtacaccctgcagcgtgaacggatggagaacgatatgaagaaactcgtcgctgaacgtgacatttggagtagcgccacgtacgagttggctctgaaggtgatagaacgaaatcgagtcattttggctaggcgcctttacctgaacgaaaaagggtggaacaaatacacaaaacactttattatcctcctcagcaataaagataccgaggaccttgctctgctgcagaagctgacacagaagtggcgaaaccttgttaacaagctaaagcaggaagtcgaacagatggaggaatcaacatccgaaacactgaaaatagtgaaggatgggctcataaagtggcaggaattctttaacgagaaggatatcctttcaccgaataaggggaatatttttaattccgtgttgctggacttcaaacagtggcagaaaatattaaacgaaaagaaggaagagtttacgggagacgttcttttgtcgaaatacgatactcttaagatcattaaacacttacaggaaaattgggcagatatcggtctggggatcttcaaccggcacaaatccttggagggcgagatgccaagtgagaggcagtacatggaggaaatcattaagaacattcagaaactctataaggaatacgaaatccggataaatggcgacaatgaaacagggtcacaccgggttgcccaggccggacttaaattactgggaagtagtgaccacccaacgtctgcaccccagtctgctggtattagaggaattattcaccggacatggccatgggtgaatttctacattgtgtgcgaagtgacgccgaagttcttccaggtgtag

SEQ ID NO: 26971 - DNA, 237 bp, Artificial Sequence
  Description of Artificial Sequence: Synthetic coding sequence
atgagtctgcccaaaacacctagcactccactaaacagcaccagcaccagtgagtctaaaaaactcaaggtgtcagtggccaaagagggcactcgagggctgcctgagcttaaggagaaaaagaacatggttgatcgatccaagctcttacccacttccctccagaatgagtttatccccaaggaggttctgctgtcacttacatatgcagccaacgccggcccttgccccgagtag

SEQ ID NO: 26972 - DNA, 378 bp, Artificial Sequence
  Description of Artificial Sequence: Synthetic coding sequence
atgtctctgccaaaaactccgagcacaccacttaatagcacttctacgtctgagagtaagaagctcaaggtgtcagtggcaaaagagggaacgaggggcctgcccgagctgaaggagaagaagaacatggtggataggtctaagttattgcctaccagccttcagaacgaattcatcccaaaggaggtgttacttagcctcacatacgctgccaacgcgggaccgtgtcctgaaaacctcttaccccccaaaaagatcaagactccaaagggtaccttgccccgccttgtggatcacgtgtggcatcatccagtgcgtcggaataaatttaagtatttgattgatcacccagtgtctttgaccggcgccggtcggtag

SEQ ID NO: 26973 - DNA, 120 bp, Artificial Sequence
  Description of Artificial Sequence: Synthetic coding sequence
atggccgccggcgccgttttccttgcgttgagcgcccaactacttcaggccagactgatgaaagaggagtctccggtcgtttcctggcggctagagccggaggatggcacagctttatag

SEQ ID NO: 26974 - DNA, 147 bp, Artificial Sequence
  Description of Artificial Sequence: Synthetic coding sequence
atggccgctggagcagttttcctggcattgtctgcacaacttcttcaggccagactgatgaaggaagtttctcctgtagtgtcttggcgcctggaacctgaggacggaacagccctcagtggtgtcagtctttgtcgtcctggttag

SEQ ID NO: 26975 - DNA, 582 bp, Artificial Sequence
  Description of Artificial Sequence: Synthetic coding sequence
atgcctctgccatgggattatccagaggctccttggcggaggctgcactcatccccccctcggccctgtcctcgggcactccagggaggagggaggagaggtcctaacccggacccacgaggcagtaagggcctgaagcaaactgtgggagctttgaatcccaatcttcacctgtggggcatctgttcctgccagttcctgttacgctccaaggggcgggatttcgtccacagtgtccaggagacccattctcagctcctgggctcttgggacccctgggaagagcccgaggacgcggcccctgtagccccgagtgttccagcctctggctaccctgagctgccaacacctcgtagggaggtacagtcagagtccgcacaggagcctggggctcgggatgtagaagctcaactccggagactgcaggaggagaggacgtgcaaggtatgcctggatcgcgctgtgtcaatcgtcttcgtcccatgcggccatctggtgtgcgctgagtgtgctccggggctgcagttatgtcctatatgccgtgccccagtccgctcaagggtgcggacattcctatcttag

SEQ ID NO: 26976 - DNA, 7827 bp, Artificial Sequence
  Description of Artificial Sequence: Synthetic coding sequence
atggatggccgcgatttcgcacccccacctcatctactgtccgaacgggggtcactcggtcacaggtccgctgccgccgcggcccggctagccccagccgggcccgctgcccagcctcccgcccacttccaacctggcaagtactttccttctcccctcccgatggcctcccatactgggtcagcacgcaagatgggtagttgtccagcacccagcttcctcccatctttcttggagcgtccattgtatccggcccctactaaaaccgtgagcggacccagcctccgcccccctacagctgctatccggtctcctacaccagattgcgcccagaagtggtcccagaatgcccatgaagcacctggctacccccgcttttcgggttctctggctagtacatttctccccgtgagccatctcgaccaccatggaaattctaatgtcctctacggtcaacataggttttatggcacccagaaggacaacttctatctgcgtaacctcccccctcagccgacgctgctaccagccaatcacaactttccttcagtggcccgggctgcccctgcccatcctatgggtagctgtagccgggatagagatagaggcgaagcgggcagcctgcagaagggccctaaggattttgaccgctttctggtagggaaggagctgggtagagaaaaagccggcaaggcggcggaaggtaaggagaggcccgctgctgaagaggatggcgggaaagagagacacaagctggtgctccctgtgcctgccgatggacactgccgggagggcggacctgccccacgcggcgcctgcgaaggacgacccaaacacttgacttcctgccttctcaatacaaaagttctcaacggcgaaatgggtcgcgcggcactggcaagctgcgccgggggaatgctcgggagacctggtacaggcgtagtgacgagtggaagatgtgccaaggaggccgccggacccccagagcctgggccagccttctctgagtgcctggagcggcgtcagatgctccaccatactgcatcgtatgcgggcccccctccaccgctgtctacagcggccgggtctttcccatgcctccagttacatggcggcccagacggattgtgtcctctccaggacaaagctccgcgggacctgaaggccagcgggccaacatttgtcccatctgtgggtcatttggccgacaagggtaggccatttcaggcagccgaggcttgcgccgtggctggagaggggaaagaccggcatctcgaaggcacaatggctccggaccatgcagctccatatggggtgtcttacgctcatttaaaagctgaggggaaaggcgagcggagacccggcggatttgaagctgctctcaatcctcgtttgaaaggtctggactatctgagtagtgccggaccggaggcttcctttcctggcctccctaaaagcggactcgacaaatccggttattttgagctgccaaccagctcacaggactgtgctcggccaggacaccaggaccccttgggtggcaaggcgccacaagcctgctgtacccttgataaaactgtcggaaaagaagccccagctggaccccccggcgcccagaaagttgctcgcattagacatcagcagcatctgatggccgcagaggtagaacaggggggcatcggggcagaagctaagagaaagagtctggagctagcttctttgggatattccggaccacatctccctccatggggggttcaagcgggccagggcaccgccatggctatctctgaagagcggaaagccggggcatatctcgaccccttcgggtccggcctgcaacaggctgcgctgctgcctcaggagttacctgccccgccggacgaagtgtccgccatgaagaacctgctaaagtatagcagccaagcactcgtcgttgggcagaaagcacctttggtgggccttggtggcctgaaagcttcgtgcatccagcaggaggctaaatttctctcgtctaagggacctggtcaatccgagcgtcctgattgcgctagatcacgtgagcacgacaccacgcatggggatggcgaagttaggcagcctccagtggggatcgcagtagctctggcaaggcaaaaagacactgttagtcgttcagaggctgcttatggcaccaataccgcaagacaggggcgtgccgcaccagcttttaaagggggcggggggcctcgaagtacacatgccctagacctggaggctgaagaagaaaggacgcggctgtgtgacgatcggttgggtttggcttcccgcgaattgctgctgcaggatagcaaggaccgtgtagagtttgcacgtatccacccacctagcagctgtcccggggacctggcaccccatctgatgatgcagtctggacaactcggtggcgatcccgctcctcacactcatccacatccgccgtggctccctcgcactcgtagccctagcctgtggatggggggtcattcttacggcttgggacacccagcactgcaccagaacctcccccccggcttcccagcgagcgttgcaggcccagtgccatccgtgtttccactgcctcaggatgcccccacccagctcgtgattcttcctagcgaaccaactcctcatagtgcacctcacgcccttgctgacgttatggaccaggcctcattgtggcctccaatgtatggaggccgaggccctgcaagccatatgcaacaccctggccagctgccggtttatagcagacctcagttactgcggcagcaggagctctacgcgcttcagcagcagcgggctgcacagttccagcgaaaacctgaggatcagcacctagatctggaagaacccgcacaagagaaggctcctaagagcacacacaagccggtggccctgactccgaccgccccaggcgccccctctcccgcagccggccctacgaagctccccccatgttgtcacccaccagatccgaaaccccctgcttcgtcccccacaccacccccaaggccatccgccccttgcactctgaatgtctgccccgcaagttcacccggaccaggcagtagggtacgctcagcagaagagaagaacggcgaagggcagcagtctactgccgatattattacaagcgaaccggacctgccccctgggtatctgagacccatggctgggctcggattcagtctgccgtcagacgtgcattcgtccaatttagaggatcctgagacaatgcagacaactgccccgggcgcccagcctgagcctacgagaaccttcctccccggagagccaccaccatgttcccctcggtctctggaggagcccgggctgcttagcggtgccagggaggcaacgcaggacttggccgccactccttacccaactgaaagaggcccccagggtaaggcagctgatccttctcccttggagggactgcaagagctgcagtgtgccgctctcctcgaggccggcgggcctgaggctaccgggcaagcccactcgacgcagggcggagcgagagaagagcggtctagagaggaaggcgaacagggcccttcctctggagctagctcccaagtactggaacagagagctggcagccccggcgccctggaagatgagggcgaacagccagctcctgaagaagacgaactggaagaggacgagctgggacagcagtcaatggaagactcagaagaagactgcggaggggctcccgataattctcatcccccccgtgccctccccggtctggacgcacttgtcgcggcaactattaatcttggagatttacctagtgatagccctccagatcctcagccccccgcagcttcaggccccccgtcaaccgttccacttccccattccagtggaatccacgggatcgccttgctgagcgaactggctgacctagccatccagcggcagaggagtgagcgtaccgtgcctgaggaagaggaagatgtgctcgccttcaacttgcagcacctcgcaactctcgcgactgcctggtccctagttgaagccgcaggactagactcctctaccgcccctgcgcaaccacccactgcaaacccttgtagtgggccacgcctgacgcctaggatgcaaattcttcagcgcaaggatacttggacgcctaagacaaagccagtctgccctctcaaggcagcgatcgatcggctcgatactcaggaagtgggaatgcgcgtcagactagcagaactccagcgtcgctacaaagagaaacagcgggagttggccagactacagcgaaagcatgaccacgagcgtgatgaatccagccgttctccggctaggcgcgggcctgggaggcctcggaaacggaagcattccagcagtttgcctgctcccaggcctactggcccactccctagaagcgacgggaaaaaggtgaaggcggtccgaacgtcattgggattactctgcgccgaactacgcgggggctctggaggggagccggctaagaaacggagcaaattagaacgctccgtgtacgccggcctacagaccgctagcgtagagaaagcccaatgtaagaaatcctcttgccagggtggcctggccccatcagtggcacatagagtagcacagttgaagcctaaggtgaagtcaaaaggcctgccaacaggcctgagcagtttccagcagaaggaggcaacccctggtgggcgcatccgagagaaattatcccgggccaaatcagctaaagtgtctggagctacccgccatccccagccaaaaggccatgggagtagggagaccccacggtgccctgcgcagcccagcgtggccgcctctcaggaagccggatccggctacgatagcgaggattgtgagggcctgctgggtacagaagcacccccacgggaggccgggttgctcctgcacactggcgcttccgtggctgtgctgggaccctccccaagttccgtggttaagatggaagccaatcaaaaagcaaaaaaaaagaaagagcgacagggtcttctaggtgcctgtcgactttcctccccagaatcggaggtgaaaatcaaaaggcgcagcgtcaaggctaaggtaggaaccacactggaacgcgcccccggtcagcgcccacctggcgccctgggaaaaaagaaggcgaagggtaaagcaaaaggatcactgcgcgcggaaccaggtgctaccccgagccgcgacgcactcttcaacccttctagagcattcgcctgtagagaggagggatctcagctggctagcgagcgcctgaagagggccactcgcaagggcacagtacttcaaccagtgctgcgccggaagaatggagctctttctattacgctcgcaacacgaaacgccaaggccatcctgggtaaaggccgcaagctcagcaaagtaaaacacaaggcagggaaacaggggaagggtagggccgtgtcacgcttgctggagtcttttgccgtggaggaggacttcgagtttgatgacaatagctcctttagcgaggaggaggaggatgaggaggaagaagaggaggatagtggtcctctcagcgcagagcagtctgctgcactggcaaggagctgcgccatccataaggaggatctccgagacgggcttcctgtcttgatcccgaaggaagacagcttactgtacgccgggagtgttcggaccctgcaacccccggacatatattctatcgtgattgaaggtgagagaggtaaccgccagagaatttactcacttgaacagctgcttcaggaagccgtattagatgtgcgcccccagagcagtaggtatctccccccggggacgagagtgtgtgcatactggtctcagaagtcgcgttgcctgtaccctggaaatgtcgtcagaggtgcaagcggcgatgaggatgaggatctggattccgtcgtagtagagtttgatgacggcgataccgggcatatcgctgtatccaatgtccgcctgctgccaccagacttcaaaatacagtgcaccgaaccttcacccgctctgttggtgtccagcagttgcagaaggactaagaaggtgtcctccgaggcccccccgcccagcgaggccgcgacaccaagcctgagccctaaggcgcaagatgggccagaggccctgaagaccccgggcaagaagagcattagcaaggacaaagcaggtaaggctgaactacttacttcgggcgctaagtctccaaccggtgcaagcgaccacttcctggggagacgcggatcaccactgctgtcctggtcagctgtcgcacaaactaagcgaaaagccgtggcagcagccagtaaggggcccggagttctgcagaacctcttccagttgaacggtagctctaaaaagctccgtgctagggaagccctttttcctgtgcactcagtcgccacacccatcttcggtaacggttttagagccgactccttcagctccctggcgagctcatatgcaccctttgtcggcggaaccggccccggcttgcctaggggcgcgcataaattgttgagagctaaaaaggcagagcgggtcgaggccgaaaagggcggcaggagaagagctggaggcgagtttctcgtcaagcttgaccatgaaggcgtgactagtcccaagaacaaaacctgcaaagcacttctcatgggagataaggatttttcaccgaagttaggaagacctctgcccagtccttcctacgtgcacccagccctggtgggcaaagacaaaaagggtagggcccccatccctccactgcccatggggctcgctcttcggaagtatgcagggcaggctgagtttcctttaccgtacgacagcgattgccacagctccttttctgatgaggatgaggatggccccggtctggcagccggggtcccaagtcgatttctagccagactgagcgtgagttcctctagcagcggtagttccaccagttcatctagcgggtcagtcagtacgagttcgttatgtagtagcgacaatgaagactctagctatagctctgacgatgaagatcccgcacttttgctccagacctgtctaactcacccagtgcctactctgctcgcccagccggaagccctccgctctaaaggatcggggccccacgctcatgcccagcgatgctttctctctagagcaactgtagccggaacaggggcaggaagcggaccatccagttcttctaagtctaagctgaagcgaaaggaggcactctcattcagtaaggctaaggaactatcacgcaggcagagacctccaagtgtagaaaatcgcccgaagattagcgcttttcttcccgctagacagttgtggaaatggtcaggcaatcccacacagagacgtggaatgaagggcaaagcaagaaaactgttctataaggcaatcgtgcgcggtgaggaaacacttcgagtaggtgattgtgccgtcttcctgagtgctggccgtccaaatctcccttatatcggcagaattgagtctatgtgggagtcatggggaagcaatatggtggtcaaggttaagtggttttaccaccccgaagagaccaagttgggcaagcggcagtgtgacggtaagaatgcactgtaccaaagttgccacgaggacgaaaacgacgtacagaccatttctcataaatgccaagtggtagccagggagcagtacgagcagatggcccgatcaaggaaatgccaggacagacaagacttgtattacctggccggaacgtatgatcccactaccggtagactggtaacggctgacggcgtgccgatactgtgttag

SEQ ID NO: 26977 - DNA, 1260 bp, Artificial Sequence
  Description of Artificial Sequence: Synthetic coding sequence
atgaacaaacatcagaagccggtgctgactgggcagcggttcaagaccagaaagcgggatgagaaggagaagtttgagccgacagtattccgtgacactttggtccaaggcttgaatgaagcaggagatgatctggaagccgtggcaaagtttctagactccaccgggtcacgattggattataggaggtacgcagataccctgttcgacatcttggttgctggatcaatgctcgctccgggggggacccgcattgacgacggcgataaaacaaagatgaccaatcattgcgtgttctccgccaatgaggaccacgaaaccattcggaattacgcccaggtgtttaataagctgatacgacggtacaagtaccttgagaaagcctttgaagatgaaatgaagaagctcttgctatttttaaaggcattctccgagacagaacaaacgaagctcgccatgctgagcggaatccttctgggaaacgggacactccctgctaccatactaacatctcttttcaccgattccctggttaaggaggggatcgccgcgtccttcgcggttaaactcttcaaggcctggatggcggaaaaggatgcgaactctgtcacgagttcactccgtaaggctaacttggataaacggttgctggaacttttccctgtaaatagacagtccgtggaccactttgccaaatacttcactgatgctggactcaaagagctctccgactttcttcgggtccagcagtcattagggactaggaaggagctacagaaagagctgcaagaacgcctctcccaggaatgccccattaaggaagtagtgttgtacgttaaggaggaaatgaagcggaacgatttaccggaaacagcagtgatagggctgttatggacgtgcattatgaatgctgttgagtggaacaaaaaggaggaacttgtggccgagcaggctctcaagcacctcaaacagtatgcgcccctactggcagtcttcagctcacaaggccagtcggagcttattctgctgcagaaagtacaggagtactgctatgataatatacattttatgaaggcattccagaagattgtggttctcttttacaaagccgacgtcctatccgaagaggctatccttaaatggtataaggaggctcatgtcgccaagggcaaatccgtgtttttggatcagatgaagaaatttgtggagtggctgcagaatgcggaggaagagtccgagtccgaaggcgaggaaaactag

SEQ ID NO: 26978 - DNA, 1227 bp, Artificial Sequence
  Description of Artificial Sequence: Synthetic coding sequence
atgaacaaacatcaaaagccagtgctgactggccagcgctttaagactagaaagcgtgacgagaaggaaaaattcgagccgactgtgttccgcgacactttggtgcagggactgaacgaggccggcgatgacttggaagcagtggccaaatttctggattcaacagggtctcggctggactatagacggtacgctgataccttgttcgacatactagttgccggttcaatgctggcccctggagggaccagaattgatgatggggataaaaccaagatgactaatcactgtgtgttcagcgctaacgaggaccatgagacaattcgcaattacgcccaggtctttaacaagttgatcaggagatacaaatacctggagaaagcgtttgaggacgagatgaaaaagctcctcctcttcctcaaggccttctcagaaactgaacagaccaaactagccatgctgtcaggcattctgctcgggaatggcacgctccccgctaccatcttgacgtcactctttacagactcactcgtgaaagaggggatcgcagcatccttcgctgttaagttattcaaggcctggatggctgaaaaggacgccaattctgtgacctcttctctacggaaggcaaacctggacaaacgtctgctggagttatttccagtgaatcgccagtctgtagaccactttgccaagtattttaccgacgcaggactgaaggaattatccgattttttgagggtccagcagtcactgggcacacgcaaggagctgcaaaaggagcttcaagagaggctttcccaggaatgccctattaaggaagttgtgctttatgtgaaagaggagatgaagagaaatgacttgcccgaaacggcggtgattgggctcctctggacgtgtattatgaatgccgtggaatggaataaaaaggaggaattggtggccgagcaggccctgaaacacttgaagcagtacgccccacttctggctgtgttctcatctcaggggcaatcagagctcatcctgctgcagaaagtgcaagagtattgctacgataatattcatttcatgaaagcttttcagaaaatcgtagtgctcttctacaaagcggatgtcctctccgaggaggccatcctgaagtggtacaaggaggcccatgtagcaaagggaaaaagcgtgttcttggatcaaatgaaaaaatttgtggaatggctgcagaatgcctag

SEQ ID NO: 26979 - DNA, 492 bp, Artificial Sequence
  Description of Artificial Sequence: Synthetic coding sequence
atgaataaacatcaaaagccagtgttgaccggtcagcggtttaagactcgcaagcgggacgagaaagaaaagttcgaacccacagtgtttagagatacattggtgcagggtcttaatgaggctggcgacgatctcgaggccgtagccaaattcctggacagtaccggctcacgcctcgactaccggaggtatgctgacaccctcttcgacatactcgttgctggctcaatgctcgcccccggcggcaccaggatcgacgatggagacaagacgaaaatgaccaatcattgtgttttcagtgcaaacgaggatcacgaaacgattcggaactatgctcaggtcttcaacaaactcattcggcgctacaagtacctggagaaagctttcgaggatgaaatgaagaagcttctgctcttcctgaaggctttctctgaaactgagcaaactaaacttgctatgctgtcagggatcctattgggaaatgggacatag

SEQ ID NO: 26980 - DNA, 1260 bp, Artificial Sequence
  Description of Artificial Sequence: Synthetic coding sequence
atgaacaagcaccagaaacccgtgcttaccggccaaaggttcaagactcgcaagcgcgatgaaaaagaaaagttcgagcctacggtctttcgtgataccctggtacagggcctgaatgaagccggtgacgatctggaggcagtggcaaagttcttagacagcaccggaagtcgcctcgattaccgacggtatgcagacacccttttcgatattttggtggccggcagcatgctggcacccggagggacccgcattgatgatggagataaaaccaaaatgacaaaccactgcgtgttcagcgcaaacgaagaccacgagaccataagaaattacgcccaggtgttcaacaagctgattcgccggtataaatacctggaaaaagcgttcgaggatgagatgaagaagctacttctctttctgaaggcatttagcgaaacagaacagacaaagctggccatgctgtccggaatccttctggggaacgggactctgccggccacaatcctcaccagcctgtttaccgactccctggtgaaggaagggattgccgcctccttcgcagtgaagcttttcaaagcctggatggccgaaaaggatgctaatagtgtgacatcttcactccgtaaggccaacctcgataagcggctcctcgaactgtttcctgtgaatcgccagtccgtcgaccatttcgcaaaatatttcacagacgccggtctcaaggagctctccgacttcctgagggtgcagcagtctcttggaactagaaaagagctacagaaagagttgcaagagaggctgtcccaggaatgccccatcaaggaggtcgtattgtacgtgaaggaggaaatgaagcggaacgacctgccagagaccgctgtcattggactgctatggacatgtataatgaacgcagtcgagtggaataaaaaagaagagctggtggcagagcaagccctgaagcacttgaaacagtacgcccctttgttagccgtttttagctcccagggacaaagtgaactgatccttttgcagaaggtacaggaatactgttatgataatatccacttcatgaaagcttttcaaaaaattgttgtactcttctacaaggccgacgtgctaagtgaggaagcaatactcaagtggtataaagaagcacatgtcgccaagggtaagtccgtgttccttgaccagatgaagaagttcgtggaatggctgcagaatgccgaagaagaaagcgagagcgagggagaggagaactag

SEQ ID NO: 26981 - DNA, 627 bp, Artificial Sequence
  Description of Artificial Sequence: Synthetic coding sequence
atgaataaacatcagaagccagtcctgaccggccagaggttcaaaactaggaaaagggatgaaaaggagaagttcgagcccacagtgttccgcgacaccctcgtgcaaggcttgaacgaagccggagatgaccttgaggctgtggctaaattccttgatagtacaggttcccgcctggactaccgcagatacgctgacacactgttcgacattctggtggccggttcgatgctggcaccaggcgggacaagaattgatgacggggataagaccaagatgaccaaccattgcgtgttttctgcaaatgaggaccatgagaccatccgcaattacgcccaggtattcaataaactgatcaggcggtacaaatacttggaaaaggcatttgaagacgaaatgaaaaaactgttgctgttcctgaaagctttctcagagacagagcagacaaagctggcaatgctttccggtatcctgctgggcaacggcacccttccagcaactatacttacgagtctcttcactgactccctggtgaaggaaggcatagctgcctccttcgccgttaagctgttcaaagcatggatggctgagaaagacgcgaattccgtgactagctccctgagatag

SEQ ID NO: 26982 - DNA, 825 bp, Artificial Sequence
  Description of Artificial Sequence: Synthetic coding sequence
atgaacaagcaccagaaacccgtgctgacggggcagcggttcaagactcgtaagcgggatgagaaagaaaagttcgaacccacggtcttccgcgatactctggtgcaggggctgaatgaggccggtgacgacctcgaggccgttgctaagttcctggacagcaccggttcaagattggactaccgaaggtatgccgacaccctctttgacatattggtcgctggctcaatgctggcgcctggcggaacaaggattgatgatggggacaagactaagatgacaaaccattgtgtgttcagtgctaacgaagaccatgagacgataaggaattatgcgcaggtgttcaacaagcttataaggcgctataagtacttggaaaaggcattcgaggatgaaatgaaaaagctgttgctttttctcaaagctttctccgagaccgagcaaactaaactcgccatgctctcagggatcctcttggggaatggcactctgcctgcaactatcttgacctccctgtttaccgactcactggtaaaagaaggcatcgctgcaagcttcgccgtaaagctttttaaggcttggatggcggagaaggatgcgaattctgtcacctcaagcctgagaaaagcaaatctcgacaaacggttactcgaactttttccagtgaatcgccagtccgtggatcacttcgccaagtatttcaccgacgcgggcctcaaggaactctccgactttcttcgggttcagcaatctttgggaacccgtaaggagctgcagaaggagttacaagagagactgagccaggaatgccctataaaagagtag

SEQ ID NO: 26983 - DNA, 486 bp, Artificial Sequence
  Description of Artificial Sequence: Synthetic coding sequence
atgaataaacatcagaaaccggtcttaactggtcagagatttaagacccgcaaacgggatgagaaggaaaaatttgaaccgacagtcttccgagatacccttgtccaggggttgaatgaggccggtgacgacttggaagccgtagctaagtttttagatagtaccggctccaggttagattaccggcgatacgccgacacactgttcgatatcttggtcgccggctctatgttggcaccgggcggtacaaggattgacgatggggataaaactaagatgacgaatcattgcgtattctccgccaatgaagatcatgagacaatccgcaattatgctcaagtctttaacaaactgattcgcaggtacaagtatctggagaaagcatttgaagacgaaatgaagaaggccctccgtccacacctgctctcctccttctcgaaacatgggtggcaaaagaagatgcctacactgctgccccggctgtag

SEQ ID NO: 26984 - DNA, 477 bp, Artificial Sequence
  Description of Artificial Sequence: Synthetic coding sequence
atgaaccaggaaaagctcgcgaaactccaggctcaggtgagaattggggggaagggcacagcccggaggaagaagaaggtggtccaccgtacggcaaccgcagatgacaagaagttgcagagctcccttaaaaaactggctgtgaacaacatagcaggcattgaagaagtgaatatgataaaagacgatggcaccgtgatccatttcaacaaccccaaagtgcaggctagcctaagcgccaataccttcgctatcaccggccatgcagaagcaaaacccatcactgaaatgctcccaggaattctgagccagctcggggctgacagcctgacaagcttgcgcaagctcgctgaacaatttccaagacaagtgctggactctaaagctccaaaacctgaagatattgatgaggaggatgatgacgttcccgatctggtagagaattttgacgaggcctctaaaaacgaagccaattag

SEQ ID NO: 26985 - DNA, 303 bp, Artificial Sequence
  Description of Artificial Sequence: Synthetic coding sequence
atgataaaagacgacggcaccgtcatccatttcaataatcctaaggtccaggcaagcctgtctgcaaacaccttcgctatcacagggcacgccgaggctaagcctataacagagatgctcccagggatcttaagccaattgggggcggactccttaaccagtctcagaaaactcgccgaacagtttccccgacaggtgctagactcaaaggctcctaagccagaggacatcgacgaagaagatgatgatgtgccagacctggtcgaaaactttgacgaagcctccaaaaatgaggccaactag

SEQ ID NO: 26986 - DNA, 213 bp, Artificial Sequence
  Description of Artificial Sequence: Synthetic coding sequence
atggcagaggtcaaatcaatgttccgtgaagtgcttcccaaacagggcccactctttgtcgaggatataatgactatggtgctctgtaagcccaaactgctgccccttaagtctcttaccctggagaaactggaaaaaatgcatcaggccgctcaaaacactatcaggcaacaggaaatggcggaaaaggatcagaggcaaattacccattag

SEQ ID NO: 26987 - DNA, 213 bp, Artificial Sequence
  Description of Artificial Sequence: Synthetic coding sequence
atggcagaggtgaaatctatgttccgcgaagtccttcccaagcagggccccctgtttgtggaggacataatgactatggtcctgtgcaaaccgaagctgctgccgctgaaatccctgacgttggagaaactcgaaaaaatgcaccaagcagctcaaaacaccattagacagcaggagatggctgaaaaagatcagagacaaatcactcattag

SEQ ID NO: 26988 - DNA, 279 bp, Artificial Sequence
  Description of Artificial Sequence: Synthetic coding sequence
atgctgaaagccgcggctaagcgacccgagttaagcggaaaaaataccatctctaacaactcagacatggccgaagtgaaatcaatgtttcgagaagtgctcccaaagcaggggcctctattcgttgaggacataatgactatggtcctgtgtaagcctaagttgctccccctgaagtcactgactctggagaagctggagaagatgcatcaggcagcccaaaataccataagacagcaggagatggctgagaaagaccagcgacagataactcactag

SEQ ID NO: 26989 - DNA, 204 bp, Artificial Sequence
  Description of Artificial Sequence: Synthetic coding sequence
atgctgaaggcggcagcgaagcgtcctgagctgagcggacctctctttgtcgaagatataatgacgatggttttgtgcaagcctaagctgcttcccctgaaatcccttacactcgaaaagttagagaagatgcatcaggctgctcagaatacaatccgtcagcaggaaatggccgaaaaggaccaacgccagattacacattag

SEQ ID NO: 26990 - DNA, 312 bp, Artificial Sequence
  Description of Artificial Sequence: Synthetic coding sequence
atgctaaaagctgctgctaaacggccggaattgtcgggtctgctgaagttcaataattacgggattctgtcagaaagcccactcacaagtcagcgcactacatggttgctgtatcagtccccctccttcattcctgggttcgcataccctagtagatgcctcaaaaccataggaggggtctacaagcaagcacggaagaagcactacatacagcaacttcgctacgggcgctcagaggttaacgtccccggtagctcatctaaagctcgcgccacagtctgtggacggtacaatgataatggggccgtgtag

SEQ ID NO: 26991 - DNA, 879 bp, Artificial Sequence
  Description of Artificial Sequence: Synthetic coding sequence
atggctgtaccaactgaattggatggagggtcagtcaaagaaaccgcagcggaagaggaatccagagtactcgccccaggggctgccccttttggtaattttccccattatagtcgcttccaccctcctgagcagcgactgagactcctcccccctgagctgctgcgccagttattccctgagtcccctgagaatggccccatcctgggattagacgttgggtgtaattctggtgatttgagcgtcgctctttataagcatttccttagcctcccggatggggagacctgctccgacgcctctcgcgaatttcggctgctttgttgtgatatcgaccccgtgctggtgaaacgcgcagagaaggaatgccctttcccggacgctctgaccttcatcaccctggattttatgaatcagaggactcgaaaagtgctcctgtcctcctttctatctcagtttggacggtccgtgttcgacatagggttttgcatgtccatcaccatgtggatccacctgaatcatggagaccacggactgtgggaattcctggcgcatctgagttcgttgtgtcactacctgcttgtcgagccacagccatggaaatgttacagagccgccgcaagacggttgcgcaaacttgggctgcatgacttcgaccacttccattcactcgctatccgtggcgatatgcctaatcagatcgtgcagatcctgactcaggatcacgggatggagctcatttgctgcttcgggaacactagctgggaccggtcgctgctgctcttccgcgccaagcagaccattgaaacgcatcccataccggagagtttaatcgaaaaaggaaaagagaagaatcggctatcctttcagaagcaatag

SEQ ID NO: 26992 - DNA, 741 bp, Artificial Sequence
  Description of Artificial Sequence: Synthetic coding sequence
atgagcttgcagtggactgcagtggccacgttcctctacgccgaggtgtttgttgtcctgctgctttgcattccctttatctctcccaagcgctggcagaagatttttaaaagccggcttgtcgagctattagttagttatggcaacacctttttcgtagttctgattgtaatcctggtcctgctggtcatcgatgccgtgcgggagattcgcaaatacgacgacgtgactgaaaaggtaaacttacagaacaatccaggcgcaatggagcactttcacatgaaactgttccgggcacagagaaatctgtatattgctggattctctctgttactgagcttcctcctgcggaggctcgtgaccctcatcagccagcaggcgacactgctcgcatccaatgaagcctttaagaagcaagccgaatccgcatcagaggcagcgaaaaagtacatggaggaaaacgatcagctcaagaaaggcgcagccgtggatggcgggaagcttgatgttggaaatgcggaagttaaattggaggaagagaaccggagcctgaaggctgatctccagaaactgaaagatgagttggctagtaccaagcaaaaattggagaaagcagagaaccaggtgctcgcgatgagaaagcagagcgagggtctaactaaagagtatgatcgtctcctggaagagcacgctaaactgcaagccgccgtggacggtcccatggacaagaaagaggagtag

SEQ ID NO: 26993 - DNA, 741 bp, Artificial Sequence
  Description of Artificial Sequence: Synthetic coding sequence
atgtcattacagtggaccgcggttgcaactttcctctatgccgaggtttttgtcgtccttctgctttgtatcccttttatttcccctaagcgctggcaaaagattttcaaaagcaggctcgtggaactcctggtgagctacggtaacacttttttcgttgttctcatcgtgattctggtcctcctggtgattgacgctgtcagggaaatcagaaagtacgatgacgtgacggagaaagtgaatctgcaaaataaccccggagctatggaacactttcacatgaagctctttagagcccagcggaacctctatatcgccgggttctctctcttgctgagctttttacttagaaggcttgtcactctgatctcacagcaggccaccctgttggcaagtaatgaggccttcaaaaagcaggctgagagcgccagtgaggctgcaaaaaagtacatggaggaaaacgaccagctgaagaaaggggcggctgtggacggcggaaagctcgatgtgggcaacgctgaggtcaaactggaagaggagaatcgatccctgaaagcggatctccaaaagctgaaggatgaactggcaagcaccaaacagaagctggaaaaggctgagaaccaggtgctggccatgcgaaaacagtctgagggcctcactaaagaatacgataggctccttgaggagcatgccaaactgcaggcagctgtggatggaccaatggacaagaaggaggagtag

SEQ ID NO: 26994 - DNA, 636 bp, Artificial Sequence
  Description of Artificial Sequence: Synthetic coding sequence
atggcacaggccaaaatcaacgccaaggccaatgaaggccgcttttgccgatcctcctccatggcagacagaagcagccgcttgttggaatccctcgaccaactcgagctcagggtggaggcgcttcgggaggccgccacagctgtcgaacaggagaaggaaatcttactggagatgatccacagtatccagaactcgcaagatatgaggcagattagtgacggtgagcgggaggagctgaacctgacagccaaccgtttgatgggacgtaccttgactgtggaggtttctgtcgagaccattaggaatcctcaacaacaagaaagcttgaaacacgccactagaatcattgacgaggttgttaataaattcctagacgatctgggcaacgcaaagtcccacctgatgtcattgtattccgcctgctctagcgaagtgccccatggccctgtggaccagaaatttcagagtatcgtcatcgggtgcgcattagaggaccagaaaaagataaagcggaggcttgaaacactgctgcggaatatagaaaactccgataaagcaataaagctgctggaacactccaaaggagcaggaagcaagacattgcagcagaatgcagaatcacggttcaattag

SEQ ID NO: 26995 - DNA, 327 bp, Artificial Sequence
  Description of Artificial Sequence: Synthetic coding sequence
atgccccacatgtgggtcgaggctcttagagaggcagctaccgctgtcgagcaggagaaggagattctcctcgaaatgatacactctattctcacggccaatcggcttatgggcagaactctgaccgtcgaagtgagcgttgagaccattagaaaccctcagcagcaggagtctctgaaacacgcaaccaggatcatagacgaggtggtgaataagtttctggacgacctgggtaacgccaaatcccatcttatgagcctatattcggcatgctcctccgaggtccctcacggaccagtagaccaaaagtttcagagtattgtgtag

SEQ ID NO: 26996 - DNA, 537 bp, Artificial Sequence
  Description of Artificial Sequence: Synthetic coding sequence
atgccgcacatgtgggtggaagctctacgcgaagcagctacggccgttgaacaagagaaggagattctgcttgaaatgattcattcaatccagaattcacaggatatgagacagatttccgatggggaacgagaagaattaaacttgacagcaaaccgactaatgggacgaacgctgacagtggaagtgtcagtcgaaaccattaggaaccctcagcagcaagagagtctcaagcacgccaccagaattatagatgaggtagtgaacaaattcttggatgatctaggaaatgccaagagccatttgatgagtttgtattccgcctgctcttctgaggtgccacatggccccgtcgatcagaaatttcagtctattgtcatcggatgcgctctggaggaccaaaaaaagataaagcgacgccttgaaacattgctaagaaatattgagaactccgacaaggccattaaactgctggaacacagtaagggcgctggttccaaaaccttacagcaaaatgcagaaagtagattcaactag

SEQ ID NO: 26997 - DNA, 1938 bp, Artificial Sequence
  Description of Artificial Sequence: Synthetic coding sequence
atgagtgaacggactcaggaacaggatttcgtaattatcacagtcgatgattccgatgataacaacgactgtagtatcgaaatggtggaggtcagcgaaaccgcagataactctacgaacgacattgcagatgactcaacctatgtcaccgctgacaatcccacagatgatacagccacacagcctaattttcccggcggcaacgatggccaccacagaccgctccagatgagttacggctccgggtcagtgactcaggccggagtgcaatggcatgaccacagtagtctgcaaccacaacctctcggcttgaagcagttcttccacctcagcctgccctcctcttgggacgacagacgcacgcctccctgtcctgtggcccatggcgatcagatagtttctcagatcaaccatcctgtgcatttgcggagatattcgtataactcagaagaagtcgattttcccaagaggggcagattttacacaccagaagtgcagtccagcatatccccccctgcggaacgtcaggagacgcacgcgtgggcgtcacctgctgtaacatcccttgaaagtgctgcatgccacgaattgcaggaagctgacctaagcgagtcgctgagttatccccgtatagtgagtagctccagcttacagcagtacgtcgctcagggtggctcgtttccctgcttcggcatgccttggaactttattagcggtggggcagaaagcactaatgcagttatctcttttgccaatgcgaccacagctgtccccatggcagtactaagccggagagagtcctccctggctaataatcccggagttgtcaactacagcgccctccctgaaaatgaaaatgtcggacccggtagagcattgtctagtttctgtttccaccctaacctcgaatctggcccacagatgtcgtatggtacgatgagctactccaccgaaatgaagaataattgcgaccaggatgacgcctccgcaagcgcctgcctaacccccgactttgcccttcttcctttgaatatccttgtaaaggtggacaccaacacggagaattccgttaacactatgaatcggagcaccttgctcgatagcgactccgggcaggactcctcgtcgagctctgtgtgtattcctcctaagtacggctacttgggggacccgaaacgaaacgttagggttctgaagattcatttgctggccgtgcagaacatggctaagcccaagcaggccgcttgctacctggtgcgaatactgtttagtaaggaaatcctaattagcagtagtgtggacatccacctaaaagactctcaatccctggatcccaataagatggctgcattgagggagtacctggctacaacattccctacctgcgacctacacgagcacggtaaggattggcaggattgcatcagcggtatcaacagtatgatatactgtctatgcagcgagggcaaatcaaccccgaagacagtgcgaaaaaacaagaaaaggaccaaccgagtggcttcggctagcgctgaccgcaatgaccagaggggcagggacggcggggaggggtgcagctggatgttccagccaatgaataactctaagatgagggagaagagaaacctgcagccgaatagtaacgccatccccgaaggaatgcgtgaaccctctaccgacaatccagaagagccaggcgaagcgtggagctatttcggcagaccttggcggaatatcagaatgccatgctccgtgttaacgttggctaaaaccaagagctgcgccagtctaagtgctcggtatctcattcagaagctcttcaccaaagacgtgcttgtccaatcaaatgtctatgggaacttaaagcacggcctgtgcgctttagatcctaacaaaatctccgccctgagaggccttctgcacatagaatatgtgtag

SEQ ID NO: 26998 - DNA, 2400 bp, Artificial Sequence
  Description of Artificial Sequence: Synthetic coding sequence
atgagcgagcgcacacaggaacaggacttcgtgataatcaccgtcgatgacagcgacgacaacaatgactgttctattgaaatggtggaagttagtgaaaccgccgataattccaccaacgatatagccgacgacagcacttacgtgacagctgataatcctaccgatgataccgccactcagcccaattttccaggaggcaatgatggtcaccataggccactacagatgtcgtacggtagcggctccgtcacccaggccggagtgcaatggcacgaccacagttcactgcagccccagccgcttgggttgaagcagttctttcacctttctctgcctagctcttgggatgacaggaggacccctccttgccctgtcgcacacggggaccagattgtttctcagattaatcaccccgttcacttgcgacgctactcctataactccgaggaggtcgactttccgaagcggggacggttctataccccagaagtccagagcagcatctcacctcctgccgagcgacaagagacccacgcctgggcttcacccgcggtaacatccctggagagtgcagcctgccacgaactccaggaggcggatctgagtgagtccctatcgtaccctcgcatagtcagtagcagctctctgcaacaatatgtcgcacaaggaggatcgttcccttgctttgggatgccttggaacttcatctctggtggcgccgagagcacaaatgctgtcatttcttttgcaaacgccacaactgccgtgcccatggctgtgttgtccaggcgagagtcaagcttggccaacaatcccggagtcgtcaattactctgccctgccagagaatgaaaacgttggaccaggccgggcgctgagctccttttgttttcatcccaacctggaaatgcccgagaggccggctaacagcagtaagaattccactgaaactgccaactacccaacccttatggggaattacaacgggcagaatacggcaagtttgtctgtatttatccctccctactttgccgaaaaaattattctgactgagatgccaggaacaacggagacaaatgtggagaacaactcccagacagtttattatccggctctctcgggcaataccagcgctccatatcccgcatcctcttatttgcccatcacttctaacttcgagtctgggcctcagatgtcgtacggcacgatgtcatattccaccgagatgaaaaataattgcgatcaagacgacgcatcggcgtcggcctgtctaaccccagattttgcattgttgccattgaacatcttggtgaaagtggacaccaacaccgaaaacagcgttaatacgatgaatcgctccaccctcctagactccgactctgggcaggattcatcttccagttccgtgtgcattccccccaagtatggttacctcggagaccccaagcggaatgtgagagtactaaaaattcacttgttagccgtgcaaaacatggctaaaccaaaacaagcagcgtgctatctggtgagaatattgttttccaaagagatcctgatatccagcagcgtggacatccatctgaaagattcccagtcactggaccccaataagatggctgcactccgggagtacctcgcaaccacctttcctacttgcgacctccatgaacatggtaaagattggcaggactgcatcagcggaatcaactccatgatctactgtctgtgcagcgaaggtaaatcaactccgaagacagtaaggaaaaataaaaaacgaacaaaccgggtagccagcgcttccgccgatagaaatgatcagagaggaagagacggcggcgagggctgtagttggatgttccaaccaatgaacaatagtaagatgagagagaaaaggaacctgcagccaaattcgaacgccatccccgaaggcatgagggagccctctaccgacaaccctgaagagccaggagaagcctggtcctacttcgggcggccttggcgcaatatccgcatgccttgctcagttctaaccctcgcaaagaccaaaagctgcgcaagcctctcagctcggtatctaatacaaaagttgtttacaaaggacgtgttggtacagagcaatgtgtatggaaatctcaagcacggtctctgtgctcttgatcctaataagattagcgctctcagagaattccttcaagagaattatccaatctgtgacctatctgagaatggccgtgactggaagagctgcgtgactagcatcaacagcggaattcgctcgctgcggcatgatgtaagacgcgcagaagccagatctcaatcactcccagccgtgacacccccggagctggaacaggagtctaaacctggcgaccctgacgcgacggatccatctacttag

SEQ ID NO: 26999 - DNA, 2487 bp, Artificial Sequence
  Description of Artificial Sequence: Synthetic coding sequence
atgaactccacagaattcaccgaggatgtcgaggaggtactgaaatcaattactgtgaaagtcgagaccgaagcagaggacgccgcactggactgcagtgttaatagcagaacatcggagaagcattcagtggacagtgtgctgaccgcgcttcaagatagctccaagcgcaaacagctggtctccgacggattgctggattctgtccccggcgtcaaaagacgtcgcctgatacccgaagctctgcttgccggcatgcgtaacagagagaatagttctccatgccaaggaaatggggagcaggccggacgcggacgatcccttggcaacgtgtggcccggcgaggaagaaccttgtaatgacgcgacaaccccttcctacaagaagccgctttatggcatctctcataaaatcatggaaaagaaaaaccccccctctggcgacctactcaacgtctacgagctgtttgaaaaggctaatgccagcaatagtccttcatccctccgactactcaacgagccgcagaagagagactgcgggagcactggcgcgggtacagacaatgatccaaatatatatttcctgattcaaaagatgttttacatgcttaatactctgactagcaacatgtcacaacttcatagcaaggtagacctgctatctctcgaggttagccggataaaaaaacaagtcagccccacagaaatggtcgctaaatttcagcctccgcctgagtatcagttgactgctgcagaactgaagcagatcgtcgatcagagcctgagcggcggagatcttgcttgccgcctcttggtgcagctgtttccagaactgttttcagacgtcgacttttcccggggctgcagcgcctgtggctttgcagccaagcgcaagctcgagagcctacatctccagctgattcgcaattacgtggaggtgtactacccttctgtcaaggatactgccgtatggcaggcagaatgcctgccccagctcaatgatttcttctcccgcttctgggctcaaagggagatggaggattctcaaccgtctgggcaggtggcttcattctttgaggccgaacaagtggatcctggccactttctggacaataaagatcaggaggaagccctttctctcgatcgctcgagcactatcgcgagcgatcatgtggtcgacacacaggatttgaccgagttcctggacgaagcaagctctccaggagaattcgctgtatttttactgcacagactctttcctgaactctttgatcatcgcaagttgggcgaacagtatagctgctacggtgatggcggaaaacaagagctggatcctcagagacttcagattattaggaactataccgagatttactttcctgacatgcaggaggaggaggcctggctccagcaatgcgcccagcggatcaatgacgaactggagggcctcgggctggatgctggctccgagggcgaccccccacgggacgattgctatgacagctcctcccttccagacgatatctccgtggtgaaggtggaggactccttcgaaggagagcgtcccggcagacggagtaagaaaatttggctcgttcccattgatttcgacaaactggaaatcccccagcccgacttcgaggttccaggggccgactgtttgctaagcaaggagcagcttcggagcatttacgaatcatcactgagtatcggtaattttgcatccaggctccttgttcaccttttccccgagctgttcactcatgaaaatctcaggaagcagtacaattgcagtggaagtctgggaaagaaacagttagatccgagtcgcattaagctgatcagacattacgtccagttattatacccgcgggccaaaaacgatagagtgtggacccttgagtttgtcgggaagctcgatgaaagatgtaggcgccgggatacagaacaacgccggagctaccaacagcagaggaaggtccatgtgccaggccccgaatgcagggatctgacatcctatgccatcaaccctgaaaggtttagagaggaatttgagggtcctccactacctcccgagcgatcaagtaaggacttttgtaagatccccttggacgagctggtcgtccccagtccagacttcccggtgccatccccttacttgctttcagacaaggaagtgcgcgaaattgtccagcagagcttgtcggttggcaatttcgctgctaggttgctcgtgagactgtttccggaactcttcaccgcagagaacttgcgacttcagtacaatcacagcggtgcatgcaataaaaaacagctcgaccctactcggctccgcctgattcgccactacgtggaggctgtgtatcctgtggagaaaatggaggaggtgtggcactacgaatgcataccttccatcgacgagagatgtcggcggcctaaccgcaaaaaatgcgacatcttgaaaaaagccaagaaggtcgaaaagtag

SEQ ID NO: 27000 - DNA, 2487 bp, Artificial Sequence
  Description of Artificial Sequence: Synthetic coding sequence
atgaactctaccgaatttaccgaggatgtggaggaggtgttgaagagtattacagtcaaggtcgaaaccgaggccgaagacgctgccttagactgttcagtgaattctagaacctctgaaaaacacagtgtagacagtgtcctgactgctctgcaggattccagcaagagaaagcagttggtgtccgacggtctcctcgactcagtgccaggagtgaaaaggcgcaggctgattcctgaggcactgctggcagggatgcggaacagggaaaattctagcccctgtcagggcaacggtgagcaggccggtaggggccgctccttgggaaacgtgtggcctggcgaagaggaaccctgtaatgatgcgaccacccctagctacaagaaaccactatatgggatcagccataagatcatggagaaaaagaacccccccagcggggatcttctgaatgtctatgagctgttcgaaaaggcaaacgcctccaacagcccctcttcactccgcctgttaaatgaaccccagaagagagactgcgggtcaacaggggcaggcaccgataatgaccccaacatttacttcctcatacagaaaatgttttacatgctaaacactcttactagcaacatgtctcagttgcactctaaagtggacttgttgagcctagaagttagccgcattaagaagcaagtttcccccaccgagatggtcgccaagtttcaaccaccgccagaataccagctgactgctgccgagctgaagcaaatagtggatcaaagcttaagtggcggggatctggcttgccgtcttctcgtgcagctgtttcccgagctatttagtgatgttgattttagccgtgggtgtagcgcctgcggatttgcagcaaagcgcaaactggagtcactccacttgcagcttatcagaaattatgtcgaggtttattatccctctgtaaaagatactgcagtctggcaggccgagtgtttaccacagctgaatgacttttttagcagattttgggcccagagggaaatggaagattcccagccctccggacaagtggctagtttcttcgaggcagagcaggtggaccccggacacttcctggataataaggatcaggaagaagccctctcacttgatcggtcatccacgatcgcatctgatcacgtggtggacactcaggatttgactgagttcctggacgaagccagtagtccgggggaattcgccgtgtttttgcttcacaggctgttcccagaattattcgaccaccgcaagttgggtgaacaatatagctgttacggtgatggtggcaaacaggagttagatccacaaagactgcagattatcagaaattacactgagatctactttccagatatgcaggaggaagaagcatggctccagcagtgtgctcagcgcattaacgatgagcttgagggcttagggcttgacgcgggttctgagggagatcccccccgcgatgattgctacgattccagttccctgccagacgatatcagtgtggtgaaggtcgaggatagctttgagggggagaggcccggacgccggtctaaaaagatttggctggtgccgattgatttcgacaagctcgagatcccacaaccagacttcgaggttcccggcgcagactgtcttttgagcaaggaacagctgcgatcaatatacgaatctagcctgtccattggcaacttcgcgagcagactcctggtccacctctttccagaacttttcacacatgaaaacctccgcaagcagtataattgttcagggagcctaggcaagaaacagctggatccttccaggattaagttaatccgccactacgtgcagctgctgtatcccagggcaaaaaatgaccgcgtttggactttagagttcgtgggaaagctagacgagcgctgtcgtcggcgcgacacagaacagaggaggtcctaccagcagcagaggaaagtgcacgtgcccggtcctgagtgtcgagacctaaccagctatgctattaaccccgaacgattccgagaggagttcgaggggccccctctgccacccgagcggtctagtaaggacttctgtaagattcccctcgacgagctcgtcgtgccgagccctgactttccagtcccgtccccttacctgctgagcgataaagaagtacgcgaaatcgtacagcagtcattaagcgtggggaactttgccgcaagattattggtaagacttttcccagagctgttcacagccgagaatctgcggctgcaatacaaccattctggcgcgtgtaataagaagcagctggaccctaccagactgaggttgattaggcattatgtggaagcagtgtacccagtagagaaaatggaagaagtttggcattacgagtgcattccttctatagatgaaaggtgtaggcgtcccaatcgtaaaaaatgcgatattctcaagaaggccaagaaggtcgaaaagtag

SEQ ID NO: 27001 - DNA, 1218 bp, Artificial Sequence
  Description of Artificial Sequence: Synthetic coding sequence
atgcagcctgcggaggagggacccagcgtcccgaagatctacaagcagcgctccccgtactcagttctcaaaacgtttccttccctgaacgtggtttccgagagccgaatgatcttggacgcattcgcccagcagtgttcccgcgtacttagcctgctcaactgtggaggcaagctgttggatagtaatcattctcaatctatgattagttgtgtgaagcaggaggggtcctcttacaatgaacgccaagagcattgtcacattggaaaaggcgtccattcacaaacatctgacaacgtcgatatcgaaatgcagtatatgcagcgtaaacagcagaccagcgcctttttgagggttttcacggactccctgcaaaactatctcctcagcgggagctttccaacaccaaaccccagctccgccagcgagtacggccacctggcagatgtggatcctctgtccacgtcaccagttcacactttaggagggtggacgtcccccgccacatctgagagccacggccacccatcaagcagcacgttgccggaggaagaggaggaagaggacgaggaggggtactgtccgcgttgtcaggaattggaacaagaagtgatcagcctacagcaagagaatgaagagcttcgccgcaaactggaatccatacccgttccctgccagacggtgctcgattatctgaagatggtactgcagcaccataatcaattactgattccccagccagctgaccagcctacagagggttccaaacaattactcaataattaccccgtctatattaccagcaagcagtgggatgaagctgtgaattcgtcaaaaaaagacggcaggcgcttgttgagatatttaattaggtttgtgttcacaaccgacgaattgaagtattcctgcggactcgggaagcggaaaagatccgtccaatccggcgagacgggacctgagcggaggccactggaccccgtgaaggttacttgtttgagagaattcatccgtatgcattgtacttcaaacccagactggtggatgccctctgaggaacaaattaacaaggtgttctccgatgctgtaggacatgccagacagggccgggccgtcggcacatttttacacaacggtggatcattttacgagggcatcgaccaccaggcctcccaggacgaagtgttcaataagtcaagtcaagatggatccggcgactag

SEQ ID NO: 27002 - DNA, 1605 bp, Artificial Sequence
  Description of Artificial Sequence: Synthetic coding sequence
atggaggaggaaatgcagccagcagaggagggaccatctgtccccaagatctacaagcagcgatcaccttattccgtactgaaaaccttcccttctaaaaggcccgcccttgctaagaggtatgagcgccccaccctggttgagcttccacatgtccgcgctcctcccccccccccacccccattcgcgccacatgctgcagtgtctatatctagctccgagccccccccacaacaattccaggcccagagttcctaccctcccggccccggcagagcagcagccgccgcatctagcagttctccttcatgtacacccgcaacgagccaggggcatctccgcacccctgcacaaccaccgccggcctctcctgccgcttcgtccagctcgagctttgcagcagtggtacggtacggcccaggggccgccgccgccgccggaacgggtggtaccggatcggatagcgcttccctggagctgtcagccgagtctagaatgatcttagacgcctttgcacagcaatgtagccgggtgcttagcctactgaactgcggaggaaaactgctggatagtaaccactcccagagcatgatctcatgcgtcaagcaggagggatccagctacaacgagcgtcaggaacactgtcacattggtaagggagtgcattcacagacaagtgataatgtggacatcgagatgcagtacatgcagcgaaaacagcagacttctgcctttttacgcgttttcaccgactccctgcagaactacttactgtccggatcattcccaacccccaaccctagctcggctagtgagtacggccacctggctgatgtcgatcctctgagcacttctccagtacacactctgggagggtggacatcccccgcaactagcgaatctcatggccacccctcatcgtcgacactgcccgaggaagaggaggaggaagacgaggagggttattgcccgagatgccaagagctggaacaggaggtgataagcctccagcaggaaaacgaggagctgcgtcggaaacttgagtcaatccccgttccatgccagaccgtgctcgattatcttaagatggtattgcagcatcataatcagcttctgatcccccagcccgcggaccagcctacagaaggatcaaagcaactactcaataactacccagtctatatcacttcaaaacaatgggatgaagccgtcaacagctctaagaaggatggtaggaggctgcttcgatatctgattcggtttgtcttcacaacagatgagcttaaatatagctgcggattaggcaaaagaaagaggagcgttcagtccggtgagactgggcccgaaagaaggccacttgaccccgtgaaggtgacatgcctcagagaattcatccggatgcactgtacttctaaccccgattggtggatgccctcagaagaacagataaataaggtgttcagtgacgcagtgggccacgccagacaggggagagcagtgggcaccttcctccataacgggggcagtttctatgagggaatcgaccatcaagctagccaggacgaagtcttcaacaaatcgtcacaggacggcagcggagactag

SEQ ID NO: 27003 - DNA, 1314 bp, Artificial Sequence
  Description of Artificial Sequence: Synthetic coding sequence
atgcagccagcggaagagggacccagtgtgccgaagatctacaagcaacgatcaccgtactccgtactgaagacattcccatcgaagcggcccgcgctggcgaagcggtatgaacggcctactctggttgagctgcctcatgtgagggcaccaccaccacctccacctcctttcgcacctcacgccgcagtctctatctcatcctccgagccacctccacaacaatttcaagcccagtctagctacccacccgggcctggaagagccgcggctgccgcatcctctagtagcccatcttgtaccccagcaacttcccagggccatctgagaacacccgcccaaccaccacctgctagccccgctgcctcgtcgagctcgtcgttcgcagccgtggtgcgttacgggccaggcgccgctgcggccgctggaacaggaggcacgggttctgatagtgcaagcctagagttgtccgccgagtcgaggatgatactggacgcttttgctcaacagtgttccagagttctctccctgctcaactgtggaggaaaacttctggacagtaaccactcacagagtatgatttcatgcgtcaagcaggagggctcttcctataatgagaggcaggaacattgccacatcggcaagggcgtccatagtcagacaagtgataatgtcgacatcgagatgcaatacatgcagagaaaacagcagacctccgccttcctgcgggttttcactgactccctgcagaattatctcctttcaggaagcttccctacacctaatccctcatccgcctcggagtatggacacctggccgacgtggacccactgagcacgtcccccgtacataccctgggtggctggacgagtccagcgacatctgaatcccatggacacccgtcctcgagcacactccctgaggaagaagaggaggaagatgaggaaggatactgccccagatgtcaggagttagagcaggaagtcatctcgctgcagcaggagaacgaagaactgcgccggaaactagaatccatcccagtgccgtgtcagacagttctggactacctgaaaatggtcctgcagcaccataaccaattactgatcccacaacctgcagaccaaccaacagaaggcagtaagcaattgctcaataattacccagtctacattacatctaagcagtgggacgaggccgtgaactcttcaaagaaagatggcagaagacttctgcgttacttgattcgctttgtattcaccacagacgaactaaagtacagttgtggcctcgggaagcgtaaacgaatccattag

SEQ ID NO: 27004 - DNA, 570 bp, Artificial Sequence
  Description of Artificial Sequence: Synthetic coding sequence
atgcaaaaaatcgtgcagaccgacgaaataactaatacccaggcattcaggaaagggaagagaaagagaacagaaacaatggatagtgaaaacgctaattcggacatggataaaggtcagagggatccttattctggtaacgcattcctacccggcgaatcctcttcagaggacgaggaaccccttgccgagctctctaaggaagaactatgcgctaaaattaagagcctcaaggaaaaactcaccaacacccgcaaggagaactcaaggctgaggcaatccctcgtgatgctgcaggtgctgccacaggcagtgactcaattcgaggaactggtcgggatggccgaggccctgctcaagggtggggggactatgtccacaagtgcctctaccctttggcgagccactaataattcatcccccgactccttcgcctctacctgtagcaactccaacagcaacagttcctccccagtctcactgaagcctgaggaagagcaccagactgatgaaaagcagtttcagatcgagaagtggcagaatccattactgcaaggcactaaactttag

SEQ ID NO: 27005 - DNA, 390 bp, Artificial Sequence
  Description of Artificial Sequence: Synthetic coding sequence
atgcagaagatcgtccagacagacgaaatcaccaacacccaggcttttaggaaagggaaacgaaaacgaactgagaccatggattctgaaaatgccaacagcgatatggataagggacagcgggacccatactccggaaatgccttcctgccgggtgagtcgtcatcagaggacgaagaaccattagcagagctgagtaaagaggaactgtgtgcgaagataaagtccctcaaggaaaaactgaccaatacccgcaaagagaattcccgcttgcgccagtccctggttatgttgcaaggcaataagctggacattactaccgaaaagaccatccttcacgggggcatgaagacactgaatgttgtgactacatcctctcaccccgtctag

SEQ ID NO: 27006 - DNA, 840 bp, Artificial Sequence
  Description of Artificial Sequence: Synthetic coding sequence
atgcaaaagatagtacagacagatgaaatcactaacacccaagcgttccggaaaggcaaaaggaagcgcacagagaccatggatagcgaaaacgccaattccgatatggacaaggggcaaagggatccgtactcgggtaacgcatttctgcccggagaatcctcctcagaagatgaagaacctctcgccgaactgtcaaaagaagagctatgcgctaaaataaagtcgcttaaagagaagctgaccaatacccggaaggagaactcgcggctgaggcagtctctggtcatgctgcaggtgttgccgcaggccgtgacccagtttgaggagctggtgggaatggctgaggctttgcttaaaggcggcggaaccatgtccacgtcggcctccactctctggagagcaacaaacaattcatctccagacagttttgcatcaacgtgctcgaactctaactctaattcctcctccccagtgtccttgaaaccggaggaagagcaccagaccgacgaaaaacaattccagattgagaagtggcagattgctcggtgcaacaaatctaaaccacagaaatttatcaacgacctgatgcaggtcctgtatacaaacgagtatatggccacacatagccttaccggcgctaagagctctacctcgcgtgataaggccgttaaacccgctatgaaccagaacgaagtacaggagattattggggtaactaagcagttgtttcctaataccgacgacgtaagtattagaagaatgattggccagaaactgaataactgtacaaaaaagcccaacctaagtaagaatcttaattcacaggacattaagtag

SEQ ID NO: 27007 - DNA, 321 bp, Artificial Sequence
  Description of Artificial Sequence: Synthetic coding sequence
atgcagaagattgtccaaaccgacgaaataacaaacactcaggccttccggaagggaaagcggaaaagaactgaaactatggacagcgaaaacgccaatagcgacatggataagggccaaagggatccctactcaggcaatgcatttctcccaggcgaaagctcatccgaggatgaggagcccctcgccgaactgtccaaggaggagttgtgtgcgaaaattaagagtctgaaagagaagctcacaaatacgcgtaaagagaactcccggctgagacagtcccttgttatgctgcaagcctggtcccgcgagctgccttag

SEQ ID NO: 27008 - DNA, 390 bp, Artificial Sequence
  Description of Artificial Sequence: Synthetic coding sequence
atgcagaagatcgtacaaacggatgagataacaaatacacaggcgttccgtaaaggcaagagaaagagaacagagaccatggatagcgaaaacgctaactcagacatggacaagggacagcgagacccctactctggcaacgctttcttaccaggtgagtcctcaagcgaagatgaagaacccctggccgaactgagcaaggaagagctgtgtgcaaagattaaaagtcttaaagaaaagctcaccaacactcgcaaagagaatagccggcttcgacagagtctggtcatgctccagggtaataagttagacataacaacagaaaagaccatactgcatggcggaatgaagacgctcaacgttgtgacgacgtcaagtcatcctgtttag

SEQ ID NO: 27009 - DNA, 546 bp, Artificial Sequence
  Description of Artificial Sequence: Synthetic coding sequence
atgctgttgcctcaggcagttacacaattcgaagagctcgtcgggatggctgaggccctcctaaaaggggggggcaccatgtccacctccgcttcgacactgtggagagcgaccaataatagctctcctgactcttttgcatcaacctgttccaattctaattcaaactctagttcacctgtctccttgaagcccgaggaagaacatcaaacagatgagaagcagttccaaatcgaaaaatggcagatcgctcggtgcaataaaagcaagccacagaaattcataaatgacctgatgcaagtcctctatactaacgagtacatggcaacgcacagccttacaggcgcaaaaagctctacaagtcgggacaaagccgtcaagccagccatgaaccaaaacgaagtgcaggagatcatcggagtcactaagcaattgtttccaaacacagacgatgtgtctattaggagaatgataggtcaaaaactgaataactgtacaaagaaacctaatctgtctaagaatctgaattcccaggatatcaagtag

SEQ ID NO: 27010 - DNA, 1407 bp, Artificial Sequence
  Description of Artificial Sequence: Synthetic coding sequence
atggaaattaaaaagcagatcactggcatgcgccgactgctcaatgactctactggtcggatctaccaacgcgtgggtaaggagggagaaaagctgaaggaggaaccacaggatctggatctcgtttggcccccccggttaaattcctctgccgaagcaccacagagccttcacccctcaagccgaggagtgtggaacgaactgcctccccagagtggtcaatttagtggacagtatggaacaaggtctagaacttttcaaagtcagcctcaccctaccacttcctcgaacggtgaactgcctgttgtgaattcttcagccggttcaaactgttgcacatgtaattgccaatctactctccaggcaatcctgcaggaactgaaaacaatgcgtaaattgatgcagattcaggctgtgggaacccagaatcgccagcagcccccaatcagcctcatctgttcgcaacggaccgcagtgtcacgtaaacgcaacaaaaaaaaaaaagtgccccctaagacagtcgagccactgacagtcaagcaaaagccatccggtagcgagatggaaaaaaagtctgtggtggcgagcgagctttctgctctgcaggctgctgagcatacttcgcctgaagaatcccgcgttctgggctttggcatcgtactagagagtcccagctccgaccccgaggttcagctcgccgagggcttcgatgtgttcatgcctaaatctcaacttgactccatactctccaattatactagaagcgggtctctgctgtttaggaagctcgtctgtgccttcttcgatgacaagacgttggccaattcactgccgaacggaaagaggaagcgggggctgaatgacaaccgcaaagggctggaccagaacattgttggggccatcaaagtatttacggaaaagtattgtaccgccaaccatgtagataaactaccggggcctcgagactgggtccaaatcttgcaggatcagataaagctcgccaggcggcggctgaagcgcggatccgcggaaattgccgactctgatgagcgccttgacgggatagcccttccacccaccggagcttgcggcggtccttgcacagttttgccaggcggctccgccgccgtgaccctggtgctgcaatcttccccccaaaccatgagccaggaaaaggggcagatggccgaaccttgggaagaacagcatctcgtgctgctaaataacttaactcgagatcgggctgagacaggtgctctctctcagacatcacaggattttaaacatcactcatttctgattactcaggtgagcgctaccctccaccatcagagggggatcaggaacttcccaactcccggctctgccaagagcctcactctgcatatttcctgcctgagcctatag

SEQ ID NO: 27011 - DNA, 1125 bp, Artificial Sequence
  Description of Artificial Sequence: Synthetic coding sequence
atggagatcaaaaaacaaataaccgggatgaggcgcctgctcaacgattcaaccggcaggatctatcagcgtgtcggcaaagaaggcgagaagctaaaagaagaacctcaggacctggacctcgtttggcccccgcgcctgaactccagcgcagaggcgcctcaaagcctgcatccatcttcccgaggtgtatggaatgagctgcctccccagtctgggcagttttcaggacagtacggcactcgctccaggaccttccagtcccagccacacccaaccacttcaagcaatggcatggtggtgaataagcattctgaaggatcgcacggcggcgagctgcccgtcgtgaacagttctgctgggtcaaactgttgcacatgcaattgtcagtcaaccctccaggccatcttgcaggagttgaaaactatgcggaagctgatgcagattcaagcagtcggaactcagaacaggcagcagcctcccatctctctgatctgtagtcagagaaccgcagtgtcaaggaaaaggaataaaaaaaaaaaggtgccaccgaagaccgtcgagccacttacggtgaaacaaaagcctagtgggtcagaaatggaaaagaaaagcgtcgtagcatccgaattgtcagcactgcaggctgcagagcacacctcccctgaagagtctcgcgtgctcgggttcgggatcgtcctggaaagtccatcctctgatcctgaggtacaacttgctgaaggctttgatgtgttcatgcccaagtctcagctggactccattctctcgaactacacacggtctggtagtctgctgttccgaaaattggtgtgcgcattcttcgatgataaaacgctggcgaactcactccccaatggcaaacggaaaaggggcctgaatgataatcgaaaaggactggatcagaatattgttggggctatcaaggtttttacagagaagtactgcaccgcaaatcacgtcgataaactaccagggccgcgggactgggttcagattctacaagatcagatcaaactggccagaaggaggctgaaacggggttctgaaattgccgattccgatgagaggctggatggaatcgcgctgccgcctactgtcgtttag

SEQ ID NO: 27012 - DNA, 1281 bp, Artificial Sequence
  Description of Artificial Sequence: Synthetic coding sequence
atggagttctccgaaagaaaacgctctaggaagtcccagagttttaaattagtgagtcgcgactaccaccacgaggtgtacaagatcccagagttctccaatgacgtcaacggcgaggctaaagagacccagcctattttcctcggtgacgaaagtatggagattaagaagcagattacaggtatgaggaggcttttgaacgactctaccgggcgcatctaccagcgggtggggaaagagggggagaagctgaaagaggagcctcaagacctggatttggtgtggccgcctcggctcaacagctctgcggaagccccacagagtttacacccctcctctaggggcgtctggaatgaactgcctccccaatccggacagttctctggtcagtacggcactaggtcccgtaccttccaatcccaaccgcatcccaccacgtcaagcaacgggatggttgttaacaagcactcggagggatctcacggtggagaattgccggtggttaactccagtgcaggtagcaattgctgcacctgtaactgccagagcactctgcaggccatcctccaggaattgaagacgatgcgcaaacttatgcagattcaggctgttggaacacagaatcgccagcagcctcccatttccttgatctgcagccaacgtacagccgtgagtagaaagcgcaacaagaagaagaaagttccacctaagacggtcgaaccactcacagtgaagcagaaacccagcggaagcgagatggagaagaaaagcgtcgtagctagtgaactgtctgcactgcaggccgctgagcatacctctcccgaggaatcccgcgttctgggcttcggtatcgtgctcgaatcaccttcgagtgatccggaagtccaactggccgaagggtttgacgtgttcatgccgaaatctcagctggactctattctctctaactacacccgctcaggtagcctgttattccgaaaactagtctgcgctttcttcgatgataaaaccttagctaatagcctccctaacggcaagaggaaacgcggtctgaacgacaaccgcaaaggtctagaccagaatattgtgggcgccataaaagtctttaccgaaaagtactgtacggcgaatcatgtggacaaacttcccggaccccgcgactgggtgcagatcctccaggatcagataaagcttgccaggcggagactgaaaagaggctctgagatcgccgattcagatgaacgcctggacggcattgctttacctcctacagtggtatag

SEQ ID NO: 27013 - DNA, 1560 bp, Artificial Sequence
  Description of Artificial Sequence: Synthetic coding sequence
atggagttctctgaacgcaagaggtcccggaagagtcagagttttaaattggtgtctcgcgactatcatcacgaagtgtacaagatccccgagttctccaacgacgtcaacggcgaggctaaagaaactcagcctatattccttggcgatgaatccatggaaattaagaagcagattacaggaatgaggcgactgctgaacgacagcacaggcagaatttatcagagagtggggaaagaaggggaaaaactgaaggaggagccacaagacctcgatcttgtctggccaccgcgactcaacagttcagctgaggctccacaaagcctgcaccctagctcgagaggcgtatggaacgaactccccccacagtccggacagttcagcggccagtacggaacacgatcgcgcaccttccagtctcagcctcaccctaccaccagtagcaacggcgaactgcccgtcgtgaactcatccgccggtagtaattgctgcacctgtaattgccagtcaaccctccaggctattctgcaggaactgaagaccatgcgaaaacttatgcagatacaggcagttggaactcagaacaggcagcagccccccattagtctgatttgcagccagcgaaccgcagtctcaaggaagagaaacaagaaaaagaaggtgcctccaaagacagttgagccactcaccgttaagcagaagccgagtggcagtgaaatggagaagaaatccgtcgttgcctctgagttatcagccctacaggccgccgagcacactagtccagaggagagccgcgtgttgggctttggaatagtgttagagtctccttcaagcgatcctgaggtacagttggcagagggctttgacgtgtttatgccgaagagtcagttggacagtattctttctaattacacccggagtggcagtctcctttttcgaaaactggtctgcgcattcttcgacgacaaaaccttggccaactctctacctaacggtaaacgcaaaagaggtctgaacgataataggaagggactcgaccaaaacatcgtgggagcgatcaaagtcttcaccgaaaagtactgtacagctaaccacgtggataagctgccagggccgagagattgggtgcagatactgcaggatcaaataaagctggcacggcgcagactgaaacggggcagtgagatcgctgactcggatgagcggttggacggtatcgcactgcctccaaccggcgcatgcggcggcccctgcacagtgttacccgggggtagtgccgcggtgacactggttctgcagtcaagtcctcagaccatgtcgcaggagaaaggccagatggcagagccatgggaggagcagcatctggtgttgcttaataatctcacccgcgatagggccgagacaggcgctctgagccaaacgtcccaagacttcaaacaccacagcttccttattacccaggtttctgcgacgctccaccaccaaagaggaattaggaattttcctacccccggaagtgcgaaaagcctgactctccacattagctgtctgagtctgtag

SEQ ID NO: 27014 - DNA, 354 bp, Artificial Sequence
  Description of Artificial Sequence: Synthetic coding sequence
ctggactccatcctgagtaattacactaggtccggctccctgctgttcagaaagctggtttgcgcattttttgacgacaaaaccttggccaattcactaccaaacggcaagcgtaagagaggactgaacgacaatcggaaaggcttggatcagaatatcgtaggagccattaaagtctttactgagaagtactgcacagccaaccatgtagataagctgccgggccccagagattgggtccagattcttcaggaccagatcaaactggctcgccggcggttaaaacgcgggtccgaaatcgccgattcagacgagcgtctggatggaatcgctctaccacctacaggaaagtag

SEQ ID NO: 27015 - DNA, 3069 bp, Artificial Sequence
  Description of Artificial Sequence: Synthetic coding sequence
atgcctgacttccagccaggcgacacgaccgtgagactggataagcggatgagcctgaccgctatatatgacaaacgaagggaaaccgactactccgataaagggtataatttagcattcgtgagtcaggacgagcaagagaactcttcttttaccattctttacgaagagcccttacaggaagaagacaagtatgcgtctgccgaagccaggcagacacagtccgtgcttttccacgacactagcgccgacagtatgccggtcctggcctgcgagcgctcagagagccgcacggatcttgtgcatcacttcgagaaaggcaccaaactaggcgagacttttgacagcgattcgtcggaaatgtttttgagtgtggaagccaagaggtataagatataccccctggccctgtcacctatttacgaggacgattcatcccaggaggatattcttagcagcgaggtctcccctgggcatcatggaccccggaagagccgggattcagagaaccagtcaagctccgtgctgagcctgctgcagtctgtcagcgaacgactgaaaatgaacttcgatgaggacgatagagaggctgccgatgaagaagaagaggaggaggaggccgcagtgctccataagggtgacctgcgtgccggtagcggcgagcgcgtgactttccagctgcctgatccttcaatcaccttttacccggacgatcaggaatctgtcggaatctccaagaacagctacgtgatgccaaatgagccaacgacaagtaaccttcaggtaggactgtggcccgaaaagacatcttttctccagaaaagtgatctcacctctaagcttcattcaagcctgaaaagcgcttaccatcagtatttacagacaagtcagagccactcatcagagaagggagcccgatttggtggtatattccaggaacccgtttcgaagtatttccgagtgcaggatagcccaggcagactgtcgccctttatcgaaaatgtcgataagcagacactgcggtgcaacccacggccaggtaagatggtgatctatgacttgcacgagtcgacctataaacaggaagtctattgcaatatccccgacgccaccagttggtcttttcccaacggtgtgctgattaaggttgtgcggggctgctggatcttgtacgagaagccacactttcgaggccagaagtgcgtcctggaggagggggaaaaggttcttaacagggattggatcctccagaacagacgtcacccccagaggaacttcatcctggggtccctcaagcgtgtcctgaaagactgttcaattcccgaaatagagcttttcccgcagtctgatcccgcctgctgcccagtttacatccagcgggctgttcccaatcttgaggaactgaatattagcaaaagcgtaagctttacggtaaagtccggtgtttggttggcctacccggatattaactttaagggacaggctacagtgcttgaggaggaccacggcctctttgagatatcgactgcggagatgaagtcacttcacccattacaaatgggaggcctgaaagtggagatgcctatgaatctaaaggtgattatctacgagaagccacactttcatgggcaagcaaaggagtttagcgagcacattgactccgtgcccaacttccttaagaataacggcgactttcatagaatcgggtccattcgggtgataggcggcgtttgggttgcttacgagaaggaacactttaaaggacagcagttcctcttagaagaaggcgattttgaagatagtaatgcctgcggcgcactaagtagccccattctctcctttcggtacctgcaggctaattttatcgagtcctccgtgacactgtttgaaagtgacttggaaagtgggaagttcattgacatcaccaaccaggagatctctgatctggaggagattgggtttggcagcaaaaccaggagcatccacgtcaagtccggggtgtgggtggcatatcaacaaaaattcttttgcggagaacagtacatcttagaaaagggcaagtataagtgcttcttcgactggggaggctcaaacaacatcatcatgtccatacgcccaattcagctcgaacctcttggcatcaatgagcctccccatttgctgaaggctttttccaagcctggattccagggtgagtgcattgacttcaccgaagagacaagcgatctcactagtctgatgccctgttcattcaaggtcctgcgtggctgctggctgctgtactaccaggaggacatgtttgtcaaccattgtgtactggaggaaggcctttacgccgatttaacctcctgtggatgtccggccagcaaggtcaaaagtctgaagcctatagattacgtgttcgaggaaccttccattagccttttcgccctggaacactgtgaggggagagagctgcatttggaggaggctgtgaacagtgtcctgaataaggatctccatttttacacacagtctgtttgggtgaagtcagggctctggattgcctatgaaggatccaactttttgggcagacaaatcctgctcaggcccaacgagatccccaattggactgctttcagcagatggaagactatcgggtcactgagacctatgaagcagcccgcagtctacatccgtatcaagaatcgagcacaaggggagtatctaaccgtaaccggttcgctcgctgatacccgggcaaccagtgtgtgtatctcgccgtattccggcaagaacacccagatttggtactactgccggggattatttaaatccaaggcctctgatacatgcctggatgtgatcggaggccgagatacacctggagctaaagtggccctttggaccgagcatgggcagtttagacagaagtggagactcaacaagaatggcacaattagcagttacttatccgaccagctcgtactggatgtcaaggggggaaattactgtgacaagacccatgtgatcgtcaatcagccactggaaggcgaagaaactcaaaagtgggacatcgagattctgtag

SEQ ID NO: 27016 - DNA, 690 bp, Artificial Sequence
  Description of Artificial Sequence: Synthetic coding sequence
atgaatgagaaaaaaaaagtgttcgaagagccgtccattagtttgtttgcattggagcattgcgagggaagagagttgcatctcgaagaggccgtcaacagtgtacttaacaaggacctccacttttacacacagagcgtttgggtgaaatccgggctttggattgcatatgagggatccaatttcctgggaaggcagatactgctccggccaaacgagatcccaaactggaccgccttcagccgttggaagaccattggaagcttaaggcctatgaagcaaccagcagtctacatcaggatcaagaacagagctcagggcgaatatctgaccgtgacggggagtttagccgacacacgggcgacaagcgtctgcatctccccttattcaggcaagaatacccagatttggtactactgtcgtggcctgttcaagagcaaggcatccgacacatgcttggacgtaatagggggtcgggacacccccggagcaaaggttgctctgtggaccgaacacggccaatttagacaaaaatggcgtttgaataagaacggcacgatctccagctacttaagcgatcagctcgtgctggacgtcaaaggcgggaactactgtgacaagacccacgttatcgtcaaccagccactggagggggaggagacccaaaagtgggacatcgagatcctctag

SEQ ID NO: 27017 - DNA, 396 bp, Artificial Sequence
  Description of Artificial Sequence: Synthetic coding sequence
atgaacaaaaagaaggtgtttgaagaaccatctatctccttattcgctctggagcattgtgaggggagagaactgcatctagaggaggctgtcaacagcgtgctgaataaggatctgcacttctatacacaaagcgtctgggtgaagtctggcctatggattgcttacgaaggctccaacttcctcggcagacagatcttactgcgacccaatgagattcccaattggacagcattcagccggtggaagacaatcgggagtctgcgtccaatgaagcaacccgcagtctatatccggataaagaacagggcacagggtgagtatctgaccgtcaccggctctctggcggacacacgcgcaacatctgtgtgtattagcccatacagcggaaagtag

SEQ ID NO: 27018 - DNA, 9156 bp, Artificial Sequence
  Description of Artificial Sequence: Synthetic coding sequence
atggctaccaacccacagccccagccacccccacccgctcctccccccccacctccccaaccacagcctcagcctcccccccctcccccaggtcccggcgccggcccaggagcgggcggagcagggggagcaggagccggagccggggacccgcagcttgttgctatgattgtgaaccacctaaaatctcaggggctgttcgaccaattccggcgggactgtctcgccgacgtcgacaccaagcccgcctaccaaaatctacggcagcgggtagataacttcgtggccaaccatctggccacccatacttggtcacctcatctgaacaagaatcagctccggaacaacatccgacagcaagtgttgaaatctggcatgctcgagtcaggtattgataggataatctcccaggtggtggaccccaagatcaatcacacgtttaggcctcaggtagagaaggcagttcatgagttcctcgctactcttaatcataaggaggaggggtctggaaacactgcgcccgatgacgaaaaacccgatacctccctgattacgcagggggttccaactcccggcccatccgctaatgtggctaatgacgctatgagcatcctagagactatcaccagcctaaatcaggaagcaagcgcagccagggcatcaacggagacatcaaacgcgaagacctctgagagggcctccaagaagttgccgtctcagcccaccaccgacacttctacagataaagagagaacatctgaagacatggctgacaaagagaagagtaccgctgactccggaggcgagggattggagacagccccgaagagtgaagagttttcagacctgccctgcccagtggaagagataaagaactacactaaagagcacaacaatctgatactgcttaataaggatgttcagcaggagtcctctgaacaaaagaataaaagcaccgataagggagaaaaaaaaccggactctaatgaaaaaggagagagaaagaaagaaaagaaggaaaagactgaaaaaaaatttgatcactctaaaaagagcgaagatactcagaaggtaaaagacgaaaagcaggcaaaggaaaaggaagtcgagagtctcaagctacccagtgaaaagaactccaacaaagctaagacggtcgaggggacaaaagaagatttcagcctcatagactctgacgttgatggactaactgacattactgtcagctccgtgcacacgagtgacctgtcatctttcgaggaagacactgaggaggaggtggttacaagtgatagtatggaggaaggggaaatcacaagcgacgacgaagagaaaaataaacagaacaaaacgaaaactcagacctctgattccagtgaggggaaaacaaagtcggtccgtcatgcttatgttcacaagccgtatctttatagtaagtactacagtgattcagatgatgagctgactgtggaacagcggagacagtctatcgccaaggaaaaagaagaacggcttttgcggcgccaaatcaaccgggagaaacttgaggaaaagagaaaacagaaggccgagaagacaaaatcttccaagaccaagggccaaggccgaagctccgtggacctggaagagagctccacaaagtcacttgagcctaaggccgcacgcattaaggaggtattaaaagaacgtaaagtactcgagaagaaggtggctctatctaagaagcgcaagaaagacagtaggaacgtggaagaaaatagtaaaaaaaagcagcaatacgaggaagactctaaagaaacgcttaaaacaagcgagcactgcgagaaagagaagatctcatctagcaaagagctaaagcacgtgcatgcgaagagtgagccgtccaagcccgctcggagattgtccgaatcgttgcatgtggtcgacgaaaataagaatgagagtaaactcgagagagagcataagcgccgtacgtctacccccgtgatcatggagggcgtgcaggaagaaacagacacgagagatgtgaagcgacaagtagaacgaagtgaaatttgtaccgaggagcctcaaaagcagaagtccacactgaaaaacgaaaagcatctcaagaaggatgactcagagactccccacctgaaatccctgctgaagaaagaggtgaagtccagtaaagagaaacctgagcgcgagaaaaccccttcggaggataagctgagcgtcaagcataagtacaagggtgattgtatgcataagaccggcgacgaaaccgaactgcacagttctgaaaaaggcctaaaggtcgaggagaatattcagaaacagagtcagcaaaccaaattatccagcgacgacaaaaccgagagaaagagtaagcatcgtaacgaaagaaagttgtccgtgttggggaaggacggtaagcccgtctcagagtacattattaaaactgacgagaatgtgagaaaagaaaacaacaagaaagagagacgtttgtctgccgagaagaccaaggctgagcataagtctagacgtagtagtgattcgaaaatccagaaagacagcttggggtcgaagcaacacggaattacattgcagaggaggagtgaatcatatagtgaagacaaatgtgacatggacagtaccaacatggatagcaacttgaagccagaagaagttgtacacaaagaaaagagaaggacaaaatctctactggaggagaagctggttctcaagtctaagtcaaagacacaggggaaacaggtgaaggttgtggagaccgaactacaggaaggcgcgaccaagcaggccaccactcctaagcctgataaggagaaaaacacggaagagaacgattcagaaaagcagagaaagtcgaaggtggaggataaaccgtttgaggaaaccggtgtcgaacccgttctggaaactgcgagcagttcagcacacagtacgcagaaggactcctcccaccgtgctaaactcccgctggccaaggagaagtacaagtctgataaggattccactagcactcggcttgagcgcaagctgtccgatggccataagagccggagtctcaagcacagcagcaaagacattaagaaaaaagatgagaataaatccgatgacaaggacggcaaggaggtggatagttcccacgaaaaggcccgcggcaacagctcactcatggagaagaagctgtccaggaggctgtgcgagaaccgtcgtggatccctttctcaggaaatggccaaaggagaggagaaattggctgctaatacactatcgaccccttcaggtagctcacttcaaagaccaaaaaagtctggtgacatgacactgatacctgagcaggaacctatggagattgatagcgagccaggggtagagaacgttttcgaagtgagcaaaacacaggataatcgaaataacaacagtcagcaggatattgacagcgagaatatgaaacaaaaaacaagcgcaacagtgcaaaaggatgaactccggacctgcactgctgacagcaaggccacagctccagcctataagcccgggagaggaactggcgtaaactccaactccgagaaacatgcagaccacaggtctaccctgaccaaaaaaatgcatatccaatctgccgtgtccaaaatgaacccaggagaaaaagaaccgatccatcgaggcactactgaagttaatattgatagtgagacggtacatcggatgctgttaagcgcaccaagtgaaaacgatagggttcagaagaacttgaagaatacagccgcggaagaacatgtagcgcaaggcgacgctaccctggaacattccactaatctggattcatccccttccctttcatctgtgaccgttgttcctctgcgcgagtcctacgatccggatgtgattcccttgtttgataagcgcacagttctggaagggtccactgcctcaacgtcaccggctgatcattctgcactgcccaaccaatccctgaccgttcgggaaagtgaagtcctaaaaacctccgattcaaaggagggtggggagggcttcacagtcgacaccccagcaaaggcctctataacctccaaacggcacatacctgaggcgcaccaggccacgttgttagacgggaagcagggaaaggtgattatgccattaggatccaagttgacaggggtgatagtggaaaacgaaaacatcaccaaagaaggaggcctggtggacatggcgaagaaagagaatgatttaaacgccgaacctaacctgaagcagacaatcaaagctactgtggagaatgggaagaaggacggcatcgccgttgaccacgtcgtgggtttgaatactgagaaatatgccgagacggttaagctgaagcacaagcggagccccggaaaggtgaaggatatttctattgacgtggagagaagaaacgagaatagcgaggttgacacctccgcaggttcgggatcagctccttcagtgctgcatcagaggaatggccagaccgaggacgtagccaccggcccgcgccgcgcggaaaagacatctgtagcaacttccactgaagggaaagataaagacgtgacactgtcacccgttaaggccgggcccgcaacgacaaccagctccgagacccgacagagcgaagtggccctcccttgtacttctattgaagcagacgaaggcctgatcattggtacacacagtcgcaacaatccactgcatgtaggcgcggaagcctctgaatgtaccgtgttcgccgcggcagaggagggtggagccgtcgtaacagagggatttgccgaatcagagaccttcctgacctcaactaaagagggggaaagcggtgaatgtgccgtcgctgagtctgaagatcgcgccgccgatctgttggccgttcacgccgtcaagatagaagccaacgtaaatagcgtggtgactgaggaaaaagatgatgccgttacgtcagcaggcagcgaagagaagtgtgacggcagtcttagccgggacagcgaaatcgtggaagggaccatcacttttatatctgaggttgagagcgatggcgctgtgacatcagcgggaactgagattcgagccgggagtatttccagcgaagaggtggacggtagccagggaaacatgatgcgaatgggaccaaaaaaagaaactgaagggactgttacttgtacaggcgccgagggtcgttccgacaatttcgtgatttgtagcgtgaccggcgctgggccccgcgaggagcgtatggtcactggtgccggcgttgtgctaggcgacaatgatgctccgcccggcacatccgcgtcacaggaaggagacgggagcgttaatgatggtacggaaggtgaatccgctgtaacgtcaactggcatcacggaggacggggaggggcctgcaagttgcacaggatccgaggacagcagtgaaggcttcgccatttcatctgaaagtgaagaaaatggcgagtcagctatggactccactgtcgccaaggaaggtaccaatgtgcccctcgttgctgccgggccgtgtgacgatgagggtattgtaaccagtaccggagccaaggaggaagacgaagagggagaagatgtggttacaagcaccggtagggggaacgagataggtcatgcatctacctgcaccgggcttggcgaggagtcagagggcgtcctgatatgtgaatcagcagagggagacagtcagatcgggacagtcgtagaacatgtcgaggcagaggcgggggctgccatcatgaacgcaaacgaaaataacgtcgactctatgtcaggcacagagaaagggagtaaggacactgacatttgttcttctgctaaaggaattgtggagtcttctgttacatccgccgttagcggcaaagatgaggtcacaccagtgccaggtggatgtgaaggaccaatgacttccgcagcttctgaccagtctgatagtcagctggaaaaggtagaggatacaaccatttcgacaggcttagtcgggggatcctacgatgtgcttgtatctggcgaagtgccagagtgcgaagttgcccacaccagcccttctgaaaaagaggacgaggatattattacgtccgtggagaatgaggagtgtgatggcctcatggcaactacagcatccggcgatattaccaatcagaattcactggcaggaggaaaaaatcagggcaaagtgttaatcatctccacaagtacaacgaatgattacaccccacaggtctcagccattacagatgttgagggtggcttatcggatgctcttaggacagaggagaatatggagggaacacgtgtcacaactgaggaatttgaggcgcctatgcctagcgccgtcagcggggatgactcacagttgaccgcctcaagatcagaggaaaaggatgaatgcgccatgattagcacaagtatcggcgaagagtttgagctccccattagctccgctaccacaatcaagtgtgcagaatccctccaacctgtagctgctgcagtggaggagcgggccaccggaccagtgctgatcagcactgccgattttgaggggccaatgcctagtgccccgccagaagccgagtctccactggcaagcacatccaaagaggaaaaggatgaatgcgcactgatatcgacatctattgccgaggagtgtgaagctagcgtttccggggtcgtggtggagagcgagaacgaacgggctggtaccgttatggaggagaaagatggctcgggcatcatctctacctctagcgtagaggattgcgagggacctgttagtagtgcagtcccacaagaggaaggcgatcccagtgttactcccgccgaggaaatgggtgatactgccatgatctccacatccactagtgaagggtgcgaggctgtgatgatcggtgctgtgctgcaagacgaagacagacttacaatcacccgggtggaggatctctctgatgctgccattatcagcacgagtaccgccgagtgcatgccaatcagtgctagtatcgaccgccacgaagaaaaccagttaacagcagataaccccgagggcaatggagacttgagcgcaacagaggtgagtaaacacaaagtgcccatgccgagcctcattgccgagaacaactgtcgttgtcctggacctgttcggggaggaaaggaacctggacccgtgcttgcggttagcaccgaggagggccacaacgggccatcagtccataaaccctccgcagggcagggccatcccagcgctgtatgcgcagagaaggaagagaagcatgggaaggagtgcccagaaattggcccattcgccgggcggggacagaaggaatccaccttacacctgattaatgccgaagagaaaaatgtgttgttgaattctctgcagaaggaagataagtcaccagagactggcacagccggtggcagctccactgcatcatattcagctgggagaggcctggaaggtaacgcgaactcccctgctcaccttcggggtcctgagcaaacatcgggtcagaccgcgaaggatccttccgtcagcattcgatacctggctgccgtaaatactggagcaattaaggccgatgacatgccaccggtgcagggcaccgtggctgagcactctttccttccagccgaacaacaagggtctgaagataacctgaagacttctaccacaaaatgcattaccggtcaggagtcaaaaatcgctccctcacatacaatgattccccccgccacttatagcgtagctttattagcacccaagtgtgagcaggatctgaccataaagaatgactattctggcaaatggaccgatcaagcttccgcagaaaaaactggcgacgacaattccacccggaaatcttttccggaggaaggggatattatggtgacagtcagttccgaagagaacgtctgtgacatcgggaacgaagagtctccactgaatgtactggggggccttaaactgaaggccaacctcaagatggaagcttacgtgccttcagaggaagagaaaaacggagaaatcttagccccaccagagtctttatgcggcggaaaacctagcggcatcgctgaacttcagagagaaccccttttagttaacgagagcctcaatgtagaaaatagtggctttaggactaatgaggagattcactctgaatcttacaacaagggggagattagttccggaagaaaggacaatgccgaggcaatttccggccactctgtggaggccgaccccaaggaggtggaggaagaggaacgccatatgcctaagcggaagcggaagcaacattacctatcctccgaggacgaacctgatgataaccccgatgtgctagactcacggatagagacagcgcaacgccagtgcccggagacagaaccccatgacaccaaagaggaaaattcccgggaccttgaggagttgccaaagaccagctccgagaccaatagcaccacttctagggttatggaggagaaggacgagtacagcagttctgagacgaccggtgaaaaaccagaacaaaacgacgatgacacaatcaagagtcaggaagaagatcagcctattatcatcaagcgaaaaagaggcagaccacgaaaatacccggtggaaacaacccttaagatgaaggatgatagtaaaactgatacaggcatagttacagtcgaacagagcccctctagctccaaactgaaggtcatgcagacagatgagagcaacaaagagactgccaacctgcaggaacgaagcataagcaacgatgacggagaagagaagattgtgacatcggtgagaaggcgggggagaaagcctaaacggtcattgaccgtcagtgacgatgctgaaagtagcgaacctgagcgaaaacgacaaaagtcagtgagcgatccagttgaggataagaaggaacaggagagcgacgaagaggaagaagaagaggaagaagatgaacccagtggagctacaaccaggagcaccacgagatccgaggctcagcgctcgaagacgcagctctccccatccattaaacgcaaacgcgaggtgtccccacctggggctcggacgcgggggcagcagagagttgaagaagccccagtgaagaaggcaaagaggtag

SEQ ID NO: 27019 - DNA, 519 bp, Artificial Sequence
  Description of Artificial Sequence: Synthetic coding sequence
atggctgatggcggcgggggcggatccggcggtgcaggacccgcttctaccagagcatctggcgggggggggccaattaacccagcttctctaccccccggtgatccacaactgatcgccataattgtaggacaactgaagtcaagagggttgtttgatagttttcggagggattgcaaggccgacgtggacaccaaaccagcttatcagaacctctcccagaaggcggataactttgtcagcacccatttggacaagcaggagtggaatcctccggctaacgataatcagctgcatgacggactccgacagtcagtggtccagtccggaaggagcgaggcaggagtagaccgtatctctagccaggtcgtggacccaaaacttaatcacattttccggccacaaatagaacagatcattcatgagttcctggtggctcagaaggaagctgccgtcccggcacttcctccagaacctgagggacaggaccctcctgctccgtcccaggatacaagttag

SEQ ID NO: 27020 - DNA, 414 bp, Artificial Sequence
  Description of Artificial Sequence: Synthetic coding sequence
atgctttctggacgcctggtgctagggctggtgtccatggcaggacgggtctgcttatgtcagggatcagctggatctggggccatcgggccagtagaagccgccattaggactaaactggaagaagccctgtctcctgaggtactggagctgagaaacgagtctggtggacacgcagtgccacccggatctgagacccacttccgggttgccgtggtctcatctcggtttgagggcttgtctccattacagcgccaccgtctcgtacacgccgctctggccgaggagctgggagggccggtacacgcactagctattcaggcccggactccagcccagtggcgcgagaactcccaactcgacacctctcctccctgtttgggtggtaataaaaagactctcggcactccctag

SEQ ID NO: 27021 - DNA, 459 bp, Artificial Sequence
  Description of Artificial Sequence: Synthetic coding sequence
atggcatcagccaagtctctggaccgctggaaggcgaggctgttggaaggcggcagcaccgccctgacttatgcccttgtgagagcggaggtgtcattcccagccgaggtggcacctgtcagacaacaaggcagtgtagcaggagcacgtgccggagtggtgtccctcctcggctgtcgaagttcttggacagcagccatggagctttccgctgagtatctacgcgaaaagcttcagcgagacctggaagctgagcatgtggaagtggaggacacgaccctgaaccgctgttcctgcagcttcagggtgctggtagtgtctgcaaaatttgagggcaagccactcctgcagagacaccggctagtcaatgcttgcctggctgaagaactgcctcatattcatgctttcgaacagaaaactctgaccccagaccagtgggccagggaacgtcagaaatag

SEQ ID NO: 27022 - DNA, 1593 bp, Artificial Sequence
  Description of Artificial Sequence: Synthetic coding sequence
atgaccagcagtctccagcgaccctggagagtcccatggctgccatggaccattctgctggtatccactgctgcagcttcacagaatcaggagagattatgtgctttcaaggacccttatcagcaggacctcgggatcggggagagtaggatctcccacgagaatggtacaattctctgctccaaaggcagtacttgctacggcctgtgggagaagtccaagggcgacataaatcttgtgaagcagggatgttggtcccatatcggcgatcctcaggagtgtcattacgaggaatgtgttgtaactaccacccccccaagcattcagaacggcacataccgcttttgttgttgttcaaccgacctgtgtaatgtcaactttaccgagaatttccctcctccggacactactcccttatcaccaccccacagcttcaacagggatgaaacaatcattattgctcttgcgagcgtctcagtgctcgccgtgctgatcgttgccctgtgtttcgggtatcgcatgctgacgggcgaccgcaagcagggtctgcatagtatgaacatgatggaggcggccgcctctgaacccagcctggatctggacaacctgaagctcctcgaattaattggccgcggccgttacggggccgtgtacaagggctccttggacgaacggcccgtggcagttaaagtgttctctttcgctaacaggcagaactttatcaatgagaaaaatatctatagggtgcccttaatggagcatgacaacatcgcgcgatttatcgtgggagatgaaagagtgacagccgatggacgcatggaatatttgttggtgatggaatactatcctaacggatccctttgcaaatatctttctttgcacacatcagactgggttagcagttgtaggctggcacattcagtgactcgcggactggcgtatctccatacagaactgccccggggagatcactacaagccagcaataagccaccgcgatctgaattcccgcaacgttctggttaagaacgacggcacgtgtgttatcagtgacttcgggctgagcatgcgcctgactggaaacagactggtccgacctggtgaggaagacaacgccgcaatctccgaggtcggtacgattagatacatggctcccgaggtgctggaaggtgctgtaaacttgagggactgcgagtctgccttgaaacaggtggatatgtatgcattgggactcatctactgggaaatctttatgagatgtactgatctgtttccaggcgagagcgtccctgagtatcagatggccttccagaccgaggtaggaaatcatcccacctttgaggacatgcaggtattagtgagcagggagaaacagaggcccaagttccctgaggcttggaaagaaaatagcctggccgtgagatcactgaaggaaactattgaagactgctgggaccaagatgcggaggcaagactgactgcccagtgcgcggaagagagaatggctgaattgatgatgatttgggaacgcaacaagtccgtctcacccacagtcaaccctatgtccaccgccatgcagaatgaacggagatag

SEQ ID NO: 27023 - DNA, 1470 bp, Artificial Sequence
  Description of Artificial Sequence: Synthetic coding sequence
atgaataagctcagcccggttctcttattcctgaatcagcagaattatcaaattgacaaggacgtggaggacaagcgccagaaagccattgaggagttctttaccaaagatgtgattgtgcctagtccatggacagaccacgaggggaagcagctgtcacaatgccacagcagcaaatgcaccaatataaattctgatagccccgtggggaagaaactcacgatccattcggaaaagagcgacgctgcatgccagacactgcttagcttgccagtcgattttaacctggaaaatatcctgggtgattacttccgggctgacgaattcgcggaccagagcccgggcaacctgtcctcctcctctctcaggcgaaaactgtttttggacgggaatggaagcatcagtgacagcctgcccagcgccagtcccggatctcctcatagcggcgttcagaccagtcttgagatgttctattcaatcgatctgtcccccgtcaagtgcagatctccccttcagacaccttccagcggccagttcagctcaagtcctatacaggcctctgcaaagaaatactccctgggaagcattacgtcacccagtccgatctcttctcccacattcagtcctatagaattccagatcggcgaaacacccctctcagagcagagaaaatttacagtacacagtcctgatgcttcctccgggactaactcaaacggtattacgaatccctgcatccgctccccttatatagatggatgctctcccattaagaattggagccctatgagactgcagatgtacagcggtggaacccaatatcgaaccagcgtcattcagataccctttacactggagacacaaggggaagatgaggaggataaggagaatatacccagcactgacgtgagctcacccgcgatggatgctgccggcatacacctccgccagttcagcaacgaggcaagtacccatgggacccatctggttgtcactgccatgtccgtgacccaaaaccagtctagtgcttcggagaaagagttggcgcttctccaagacgtggaacgagagaaggacaacaataccgtcgacatggtcgacccaatagagattgcagacgaaaccacttggataaaagagccagtggataacggtagtctcccaatgacggatttcgtatcaggaatcgcatttagcattgagaatagccacatgtgcatgtctcccttagccgaatcgtcagtgatcccatgcgaatcaagtaacattcagatggatagtggttacaacacgcagaactgtgggagcaacattatggatacagtcggtgcagagagctattgcaaagagtcagatgcgcagacctgtgaggtagaatccaaatcccaagctttcaatatgaagcaggatcatactacacagcgctgttggatgaagaccgcatctccttttcagtgcagcagcccttag

SEQ ID NO: 27024 - DNA, 1680 bp, Artificial Sequence
  Description of Artificial Sequence: Synthetic coding sequence
atgggagacgtcaaggaatccaagatgcaaatcacacccgagactccaggaaggattccagttcttaacccttttgaaagtccttccgattatagtaatctgcatgagcagacactggcctctcccagcgtgtttaaaagcacaaaactgccaactcccggcaaatttcggtggagcattgatcagctcgccgttataaaccctgtggagatcgacccagaggacatacaccgacaggccctgtatctctctcacagtaggattgataaagacgtggaagacaaaagacagaaggccatcgaagagttcttcactaaggacgtgattgtgccctcaccctggactgatcatgagggcaaacaactgtcccagtgtcattccagcaaatgcaccaacattaatagtgacagtcccgttggcaagaaattgaccattcattccgagaagtcagacgccgcctgtcagactctgctctcgcttccagtcgatttcaacctagagaacatactgggcgattactttcgggccgatgagtttgccgatcagagcccaggtaacttgagcagttctagtctgcggagaaaactgtttcttgatgggaatggctccataagcgattccctcccttcggctagtccaggcagtccgcactcaggcgtgcaaacttccctggagatgttttattcgatcgatctctctccagtgaagtgcaggagtccattgcaaacacccagttcaggtcagttctcttccagccctatacaggcttctgctaagaagtatagcctcggttcgatcaccagtccctctcccatttcgtccccaacattttccccgattgaattccagatcggagaaactcctctgtccgagcagaggaagttcaccgtccactctccagatgcatccagcggaactaactctaacggcataacgaacccatgtatcagaagcccctacattgacggctgtagccccatcaaaaactggtccccaatgcgcctccagatgtactcgggcggcacccaatatcgcacatctgttattcagattccgtttacgctggagacacagggagaggacgaggaagacaaagagaatataccttccacagatgtgtcgtccccggctatggacgccgctgggatacacctccgacagttttctaatgaagccagcacacatggcactcacctagtggtgaccgccatgagtgttacacaaaaccagtcatcggccagcgaaaaggaacttgctttattgcaggatgtagaaagagagaaagataacaatacggttgacatggttgatccaatagagattgccgacgagacgacatggatcaaagaacctgtggacaacggcagcctacctatgactgactttgtgtccggcatcgcttttagtatcgagaattcacacatgtgcatgagtcctctcgctgagtcttccgtgatcccttgcgagtctagcaatatccagatggattcaggatataacacccagaactgtggaagcaacatcatggacaccgtgggcgctgagtcatactgcaaagagagcgatgcccagacctgtgaagtggaaagtaaatcgcaagccttcaatatgaaacaagatcatacaacccagagatgctggatgaagactgcttcccctttccaatgttcttcgccttag

SEQ ID NO: 27025 - DNA, 2007 bp, Artificial Sequence
  Description of Artificial Sequence: Synthetic coding sequence
atgacaagcacgggaaaggacggcggcgctcagcatgctcaatacgtgggtccctatcgtctggaaaaaacgctaggaaagggccagaccgggctagtgaagctcggggtgcactgcgttacttgtcagaaagtggccattaagatcgttaatcgggagaagctgtccgagagcgtcctaatgaaagtagagagagagatagcaatccttaaactgattgaacatcctcacgtgctgaaactgcacgatgtgtatgaaaacaagaagtacctatacctagtccttgaacacgtgtccggcggtgagctatttgactacctggtcaagaaagggagactcactcctaaagaggccagaaagtttttcagacagattatctctgccctggacttctgtcatagtcattctatctgccatagggacctcaaaccagagaacctgctgctggatgaaaagaataacattcgaattgccgactttggcatggccagtcttcaggtcggggactccctgctggagacttcatgtggatcgcctcactacgcctgccctgaagtgattcggggggagaagtatgacggaagaaaggccgatgtgtggtcttgcggcgtgattctctttgcactgttagtgggcgcactcccatttgacgatgacaatctgcgccagctcctagaaaaagtgaagaggggagtgttccacatgccccatttcataccacccgactgccagtctctgttgcgcggtatgatcgaagtggacgccgctcgcaggctgacactcgaacatatacagaagcacatctggtacatcgggggcaaaaatgagccggagcctgagcaacccattccgcgcaaggtccagattcgaagcctccccagtctggaggatatcgatcccgacgtactcgacagcatgcactcactcggttgctttcgcgaccgaaacaaacttctgcaggatcttttatccgaggaggaaaatcaggaaaaaatgatttacttcctacttctcgacaggaaggaacgctatccctcccaggaggatgaggatctgcccccccgaaacgagatcgatcctccgcgcaaaagagtggattccccaatgcttaatcgacacgggaagcggcgcccggagcgtaaaagcatggaggtccttagtgttaccgacggggggtctccggtgccagctaggagagctattgagatggctcagcacggacagcgcagtaggtccatcagcggagccagcagcgggttgagcaccagtcctttgtcaagccccagagttaccccgcacccaagtcctcgcggttccccccttcccactcctaaaggcactcccgtccacacaccaaaagaatcacctgcgggaacgccaaacccaaccccaccatcctctccctccgtgggtggcgttccctggagggcaaggctgaattccatcaagaacagcttccttggttctccacgttttcatcgccgaaagcttcaggtgccaactcccgaagagatgagtaacctcaccccagagagcagccctgagctggccaaaaagagttggttcgggaacttcatatccctggaaaaggaagaacagatcttcgtggtgataaaggacaagcctctgtccagtataaaggctgacattgtacacgccttcctgtctattccgagtctctcccattccgtgatctcacagacgtcttttcgagctgagtacaaggccaccggaggcccggcagtgttccagaaacctgtcaagtttcaagtggacatcacatacaccgagggaggtgaggctcagaaagagaatggcatttattcagtgacgtttacacttctatctggaccaagtcgacgctttaaaagagtcgtggagactatccaggcccaactactcagtacccacgatccgccagccgcacagcatctgagcgacaccacaaactgtatggaaatgatgaccgggcggctgtccaagtgcggtatcatccctaagagctag

SEQ ID NO: 27026 - DNA, 2091 bp, Artificial Sequence
  Description of Artificial Sequence: Synthetic coding sequence
atgacatccactggaaaggacggaggagctcagcacgcccagtacgtgggtccctaccggttagaaaagactttgggtaaaggccaaactggtcttgtgaagctgggcgtgcattgtgttacatgccagaaggtcgccatcaagattgtcaacagagaaaagctgtctgaatcggtgctgatgaaagtggaaagggagattgctattcttaagttgatcgaacatcctcacgtcctgaagttgcacgacgtctatgaaaacaagaaatatttgtacctagtgttggagcatgtgtctgggggagaactctttgactacctggtgaagaaggggaggctgaccccaaaagaagcacgaaaattcttcagacaaatcatttccgctctggatttttgccactcccattctatatgtcaccgggacctgaagccagagaacttgctcttagacgagaaaaataacattcgcatagctgattttggaatggcatcattacaggtgggcgactctctgctggagacctcttgcggatcacctcactacgcctgccccgaagtgatccgaggggaaaaatatgacggcagaaaggctgatgtgtggtcatgtggcgtcatcttgttcgcgttgttggtgggagccctcccctttgatgacgacaacttgcggcagctgctcgaaaaggttaagaggggtgtattccacatgcctcatttcataccacccgactgtcaatcactgctgcgcggtatgattgaagtggatgcggcgcgccggctgaccttggaacatattcagaaacatatttggtacatcggcggtaagaatgagcctgagccagaacaaccgatacctaggaaggtccaaatccgctcgctgcctagcctggaagacatcgacccagatgtgctcgactccatgcacagcctggggtgcttcagagatagaaacaagctcctgcaggaccttttgtctgaagaagagaatcaggagaaaatgatatactttctgctgcttgaccgcaaggagcggtacccatcgcaagaagacgaggatctccccccacgcaacgaaattgatccaccacggaaaagggttgactcacctatgctgaacagacacggtaagcgtcgacctgagcggaaatctatggaggtgctgtctgtcaccgatgggggcagtccagtccccgctcgccgcgctatagagatggctcaacatggacagagtaaggccatgttcagcaagagcctggacatcgctgaagcgcatcctcagttcagcaaagaagatcgatctcggtcaatctcaggggccagctctggcttgtccacatctcccttatctagtcctagggtcactcctcatccatcgccacgaggctctccactgccaactcccaagggaacgcccgtgcacacccccaaagaatccccggcgggaacacctaatccaacaccacctagttcgcccagtgttggcggggttccctggagagctaggttgaatagcataaagaattctttcttgggttcaccaaggtttcaccggcgtaaactgcaggtgcctacacccgaagagatgagtaacctgacgccagagagttcccccgagcttgccaaaaagtcttggttcgggaactttatcagcctggaaaaggaagagcagatttttgtagtgatcaaggacaaacctctgtcgagcatcaaagccgatattgtccatgcgtttctgagtatcccgtcgctgagccactccgtgattagccaaactagcttcagagccgaatataaagccaccggtggacccgctgtcttccagaagcccgtgaaattccaggttgacatcacttacaccgagggcggcgaagctcaaaaggaaaatggaatctactccgtgacattcaccctcctgtcaggcccaagtaggcggttcaaaagagttgtcgagacaattcaggcacaattactctctactcatgaccctcccgctgctcagcacttgtccgagcccccccccccagctccaggcttatcctggggagcgggcctaaaaggacagaaggtcgcgacctcctacgagtcctccttatag

SEQ ID NO: 27027 - DNA, 2301 bp, Artificial Sequence
  Description of Artificial Sequence: Synthetic coding sequence
atgagccctgagggccatcccagccggtgggcaagaccccggcggccgtgtatctgcccgtcatctctctgctcgcccagggaacccagatctggcccggctgtaggcaggggaggagccgcacaccaccgggtaccagccggacatacgccaggtccgcagctgctgcagcctcacttgcatcttccgcagggtcagacatggctgtgcctccaaccttcacctgccgggttggttaagcttggagtgcattgtgtgacgtgtcaaaaggtagccatcaagatcgtgaatcgtgagaagctgtccgaaagcgttcttatgaaggtcgagcgtgagattgcgatcctaaagctcattgagcacccccatgtgctcaagttacacgacgtgtatgagaacaagaaatatttgtacctggtgttagaacatgtctctggcggagagctctttgactatctggtgaagaaaggaagacttacccccaaggaggcccgcaagttctttaggcagatcatctcggccttggatttttgccactctcactctatctgccatcgagaccttaagcctgagaatctgctgttagacgagaagaataacattaggatcgccgacttcggtatggccagtcttcaggtgggagactctctgctcgagaccagctgcggctcgccacactacgcttgcccggaggtgatcaggggcgaaaaatacgacggaaggaaggcagacgtgtggtcttgtggcgtgattctgtttgccctgctggttggcgcccttcctttcgacgatgacaacttgcggcagctgctggagaaagtgaagcgcggggtctttcacatgccacactttatcccaccggactgccagagcctgttgcgagggatgatagaggttgatgccgcccgacgcctgacacttgagcacatccagaagcacatatggtatatagggggcaaaaatgagccagagccggagcaaccaattccccgcaaggtacagatcagatctctgccttcactagaagacattgaccccgatgtgctcgacagtatgcacagtctggggtgtttcagggaccgcaataagctgttgcaggatctcctctctgaagaggaaaatcaagaaaaaatgatctacttcctcctgctcgatcgtaaagagcgatacccatcccaggaagacgaggacctgccgcctcggaacgaaattgaccccccgagaaaaagggtggacagccccatgctaaataggcacggcaagaggagaccggaaagaaagtcgatggaggtgttgtccgtaaccgatggaggctccccagtgccagcccgaagggctattgaaatggcccaacacggccagcgctcaaggtccatttcaggggcctcatccggcttgtccacctctccattatcctcaccgagagtaaccccccatccttctccgcgtggctctcctctgcccactcccaagggcacccctgtgcacaccccaaaagaatcacccgccggaactccgaatcctaccccaccgagttctccttcagtcggtggagttccctggcgtgcgagactcaattctataaaaaactccttcctgggtagtccccggttccacaggcgcaagctccaggtgcctacccctgaagaaatgagtaacctgaccccagaatcaagtccagagctcgccaagaaaagttggttcggaaatttcatttcactagagaaagaggagcagatttttgtagtcatcaaggacaagcccttgagctccattaaggcagacatcgtgcacgcattcctgtccattcctagcctgagtcattctgtgatcagccagactagctttagagccgaatataaggccaccggtgggccagcagtctttcagaaaccagtcaagttccaggtggatattacatatacagaaggcggcgaggcacagaaagaaaatggcatttactccgtcacatttactcttctgtccggcccctccaggaggttcaaaagagtggtagagacaatacaggctcagctgctctccactcatgacccaccggctgcgcaacacctcagcgacaccacaaactgcatggagatgatgacaggaaggctttccaagtgcgacgagaaaaacggccaggctgctcaggcaccgtctactcccgctaagagaagcgcccacggccccttgggtgattccgccgccgcgggcccggggcccggtggtgatgctgagtacccaaccgggaaggatacggccaaaatggggccgccaacggctaggcgcgagcagccatag

SEQ ID NO: 27028 - DNA, 2091 bp, Artificial Sequence
  Description of Artificial Sequence: Synthetic coding sequence
atgacatcgaccggcaaagacggcggtgcccagcacgcgcagtatgtgggtccttaccgactggagaagaccctgggcaaaggacaaaccggcctggtcaagctgggggtgcactgcgtgacttgccagaaagtagctatcaagatagtcaatagagaaaagctgtccgaatccgtccttatgaaggttgaaagagaaattgccattctgaaactcatcgagcaccctcatgttctcaagttacacgacgtctatgagaacaagaagtacctgtacttggtattggagcacgttagcggaggcgagctctttgactacctggtgaagaaagggagacttacccccaaagaggctcggaagttcttccggcaaatcatttcggcccttgacttctgtcactcacactcaatttgccacagagatctgaagccagagaacctcttgctcgacgaaaaaaataacatcagaattgcagattttgggatggcatcattgcaggtgggagatagtcttctggaaacatcctgtggaagcccccattatgcttgtcccgaagtgatcagaggtgagaaatacgacggccggaaggctgatgtgtggagctgtggcgtgattctgtttgcgttgcttgtcggagccctccctttcgatgacgataatctgagacagctcctggagaaggtcaaacggggagtgttccatatgccccacttcattccaccagactgtcaaagtctgctgcggggcatgattgaagtcgacgccgccagacgactgactctggagcacatacagaagcacatctggtatatcggcggtaagaatgagccggagccggagcagcctatcccaaggaaagttcaaatacgttctctgccttctctggaagatatcgacccagacgtgctcgattcaatgcactcactgggctgtttcagggaccgcaataaattgcttcaggacctgttgtcggaggaagaaaaccaggagaaaatgatatacttcctcctgttagatagaaaagaaaggtaccccagtcaggaagacgaggacctgcccccccgaaacgaaatcgaccctccacgcaaacgtgtggactctccaatgctcaataggcacggaaagcgtcgaccagaacggaagtctatggaagtgttgtccgtaacagatggaggctcacccgtgcccgcacgccgcgcaattgaaatggcccaacacggtcaatccaaagcgatgtttagcaagtccttagacatcgctgaggctcacccgcagtttagtaaggaggacagatccagaagcatcagcggagcttccagtggactatcaacaagcccactttcctcaccccgggtcacgccccaccccagccctcgcgggtcccctctgccgacacccaagggcactccagtccacacgcctaaggaaagtcctgccggcactcctaatcccacacctccctcgagtccgtcagtggggggcgtgccttggcgcgctagactgaattcaattaaaaatagctttctaggatcaccacgtttccatcgtagaaaactgcaagtgccgacacctgaggaaatgtccaacctgacacccgagagcagtcctgaactcgctaagaaatcgtggttcgggaactttatctctcttgaaaaagaggagcagatctttgtggtgatcaaggataaacctttatcctcaattaaagctgatatcgtacatgccttcctatcaataccatcactgagccactccgtcatctcccagacgtccttccgcgccgagtacaaggcaacagggggcccagccgtctttcaaaaacctgtaaaatttcaggtggacattacttatacagaaggaggagaggcacagaaggaaaatggcatttatagcgtcactttcaccctactttccggaccctctaggagattcaaacgggttgtggagaccatccaggctcagctgctgagcacccacgacccccctgccgcccagcacctgtccgaaccacctccaccagcccctgggctgagttggggggccggcctaaaaggacagaaagttgccacctcttatgagagcagtctctag

SEQ ID NO: 27029 - DNA, 2211 bp, Artificial Sequence
  Description of Artificial Sequence: Synthetic coding sequence
atgacctcaacaggcaaggatggcggggcgcaacacgctcagtacgttggaccttatcgactcgagaagacccttggaaaggggcagacaggtctcgtcaaattaggagtgcattgtgtcacctgtcagaaggtcgcaattaagatcgtgaatagggaaaaactcagcgagagtgtcctaatgaaagtggaaagagagatagccatattaaagctgattgagcacccccacgttctgaaacttcatgacgtgtacgagaataaaaagtacctgtacctggttctggaacacgtcagcggaggggagctctttgactacctagtgaaaaagggccggctaactcctaaggaagcacgtaaattcttccgccagattatctccgccttggatttctgccattcccattcaatctgccatcgcgaccttaaacctgaaaacctgttgctcgacgagaagaataacattcgaatagctgacttcggcatggcctctcttcaggtgggagattctctcctggagacaagttgcggatctccgcattatgcctgcccggaagtgatcaggggggagaaatatgacggacggaaggccgatgtttggtcttgcggggttattctgttcgccctcctcgtcggggcattgccttttgacgatgacaatttgcgccagttactggagaaggtaaaacggggggtgttccacatgccccactttatcccccccgattgtcagtccctcttaagaggaatgattgaagtcgatgcggccagaaggttgacactagagcacattcagaaacacatctggtacattggcggaaagaacgagcctgaacctgaacagcctatacccaggaaggtccaaatacggagcctgccctctctggaggatatagacccagacgtgctcgactctatgcatagtctcggctgcttcagagatcgaaacaagctactgcaggacctgttgtcagaagaagagaaccaggagaaaatgatttatttcctgctgctggacagaaaagagcgttatccaagccaagaagacgaggatttgccccccaggaatgaaatagaccccccacggaaaagggtcgattctcccatgctcaacagacatgggaagaggcgcccagaaaggaagagcatggaggttctgtcagtgaccgacggaggcagccctgtacccgctcgcagggcaatagaaatggcacagcatggccagagaagccggagcatctcaggggcttccagcggactgagcacctctccattgagctctcccagagtcacccctcatccctcaccccggggcagccctttgcctacccctaaaggaacccccgtccacacaccaaaagaatctccagccgggacacctaatcccactccaccatctagtccgagcgttggaggagttccttggagagcacgcctgaatagtattaagaattccttcctcggaagccctcggtttcaccgccgcaaactgcaggtccccacccccgaggagatgagcaacctcacccctgagagctctccagagttagcaaaaaaatcatggttcgggaattttatcagtctcgagaaagaggagcaaatttttgtggtgatcaaagataaaccattgagctccatcaaggccgatatagtccatgccttcctctctatcccaagcctttcgcactctgttatttcccagactagtttcagagccgagtacaaggctactgggggacccgctgttttccagaaaccagttaagttccaggtcgatattacttataccgagggcggagaagcccagaaagaaaatggaatctacagtgtgacctttacccttctcagtgggccctctcgtcgcttcaaaagggtagtggagaccatacaggcgcagctcctcagcacccatgatcctcccgccgcccagcacctgtctgatacaactaactgcatggaaatgatgacggggaggctgtctaagtgcggttcaccgctgagtaatttctttgatgtcattaaacagctattcagcgatgagaaaaatggccaagcggcacaggcaccttctacgcccgcgaagcggtctgcacatgggcccctcggagacagcgcagccgctggtccagggccggggggcgacgcagaatacccgactgggaaagatacagcgaagatgggcccacccactgctaggagggagcagccgtag

SEQ ID NO: 27030 - DNA, 2025 bp, Artificial Sequence
  Description of Artificial Sequence: Synthetic coding sequence
atgacatcaacaggcaaagatggcggggcacagcacgctcagtatgtgggcccttaccggctagaaaagacattgggaaagggacagacaggactcgtgaaactcggagtgcattgtgttacttgccaaaaggttgccattaagattgttaatcgtgagaagctaagcgaatctgttctgatgaaagttgaaagagagatagctatactcaagttaattgaacacccacacgtcctcaaacttcacgatgtctatgagaacaaaaagtacttgtatttggtcctggaacatgttagcgggggtgaactcttcgattatctggtaaagaaagggcgactcaccccaaaggaagcacggaagtttttccggcaaattatatcggccctggatttttgccactcccactcgatttgtcacagagatttaaaacctgaaaacttattactcgacgagaaaaacaacatccggattgctgatttcggcatggcatcattacaggttggagactccctactagagacctcttgcggaagtccccattatgcttgtcccgaagtcatacgaggggagaaatacgacggcaggaaggcagacgtctggtcttgtggcgtcattctttttgcactactggttggggcgcttcccttcgacgatgataatctccgacaactccttgaaaaggtgaagagaggcgttttccacatgcctcactttatccccccagactgtcagtccctgctccgggggatgattgaggtcgacgccgcccgccgactgaccctggaacacatccagaaacatatctggtacatcgggggtaaaaatgagcctgagcccgaacagccgattcccaggaaggttcagatacgcagcttgccatctttagaggacatagatcctgacgtgctggactcaatgcacagcctgggatgcttcagagaccggaacaagctgctgcaggacttgctgagcgaggaggagaaccaggaaaagatgatatactttctcctgctggatagaaaggaaaggtaccctagccaggaagacgaagatttgcccccccgcaatgagatcgaccccccaagaaagcgggtggatagcccaatgttgaaccgacatgggaaacgtcgaccagagaggaaaagcatggaggtgcttagcgtgacagacggaggatctccggttcctgccagacgggctatcgaaatggcgcagcacgggcagcgtagcagaagcatctcgggcgcatctagtgggctgtccacctcccccctatctagtccgcgtgtgaccccacacccctctccgcgcgggagccccctaccaactcctaaaggtacccctgtccacacacctaaagaatcacccgccggaactcccaaccctaccccaccttcctcccctagtgtcggcggagtgccctggcgcgctagattaaactccataaaaaatagcttcctcggctcccctcgttttcaccgtcgtaagctgcaggtacctacaccagaggaaatgtccaacttgacaccagagtcctcacctgagctcgccaagaaatcttggttcggaaacttcatctccctggagaaggaggagcaaatcttcgtggtgattaaggacaagcccctgtccagcataaaggcggacatagtccacgcattcctgagcataccttccctgagccattcagtgatatctcagacgtctttccgagctgagtacaaagccactgggggtcctgcagtgttccaaaagccagtgaagttccaggttgacataacatacaccgaaggaggagaggctcaaaaggaaaatgggatctactccgtgacattcactctactgtcaggcccaagtcgcaggtttaaaagagtagtcgagacaatacaggctcagcttctgagcacacatgacccccctgcagctcaacatctcagcgaaccacctcctcctgcccccgggctgtcttggggggccggcctcaaggggcagaaggtggctacatcttatgaaagcagcctgtag

SEQ ID NO: 27031 - DNA, 1110 bp, Artificial Sequence
  Description of Artificial Sequence: Synthetic coding sequence
atgcacagtctgggatgcttcagagatcggaacaagttgttgcaggatttgctgtctgaagaggagaaccaggaaaagatgatttattttcttctcctggatcggaaagaacgatatccttctcaggaggatgaggatctgcccccacggaacgagattgaccccccgaggaaacgcgtggactcacctatgctgaaccgccacggtaagagacgtcccgagcgcaagtccatggaagtgctgtcagtaacagacggggggtctcccgtcccagctaggagagctatcgaaatggcccagcatggccagcgctcacggagcatcagtggcgcgtcatcagggcttagcacttcacccctatcatctccccgagtcacaccccatcccagcccaagaggcagtcctctgcccacccctaaaggaacccccgtccacactccaaaggagtctccagctggcacccccaatccaactccccctagcagcccaagtgtcggaggggtcccatggcgcgctcggttgaatagcattaagaatagcttcctcgggtcccctcgatttcatcgtcgcaagctgcaagtacctactcccgaagagatgtcgaatctcacgcccgaatcatcccctgaattggctaagaagtcctggttcggaaactttatttccctggaaaaagaagagcagatttttgtggtgatcaaggataagcctctgagttccatcaaagccgatatagtccacgcgtttctttccataccctctcttagccacagcgtgatcagccaaacatcctttcgggccgagtataaagccaccggcgggccagcagtatttcagaaaccggtcaagttccaggtcgatattacgtacaccgagggcggtgaggctcagaaggagaacgggatttactcagtgactttcacgttgctgagtgggccctcaaggaggtttaagagagttgtcgaaaccatccaagcccagctcctgtctacacacgatcctcctgctgcacagcacctcagcgagcctcctccgccggccccaggcctctcctggggcgctggtctcaagggccaaaaagtcgctacttcttatgagtctagcctttag

SEQ ID NO: 27032 - DNA, 336 bp, Artificial Sequence
  Description of Artificial Sequence: Synthetic coding sequence
atggagaatgtcccaaaggagaacaaagtcgtagaaaaggctcctgtacaaaatgaggccccggctctcggtggaggcgagtaccaggagcctggcggaaacgttaaaggagtgtgggctccgcccgcccctgggtttggggaggatgtgccaaataggcttgtagacaatattgatatgatcgatggggatggagatgacatggagcggttcatggaagagatgagagaactgcggaggaagataagggagctacagctcagatactcgctcaggattctgataggagatcctccccaccacgaccaccacgacgaattttgcttgatgccttag

SEQ ID NO: 27033 - DNA, 336 bp, Artificial Sequence
  Description of Artificial Sequence: Synthetic coding sequence
atggagaatgtcccgaaagaaaataaagtggtggagaaggccccggtacagaacgaagctccagcactgggcggtggcgagtaccaagagccaggcggtaatgtgaaaggagtctgggcacctcccgctccggggtttggtgaagatgtaccaaatagactcgtggataacattgacatgatagatggagacggcgatgacatggaaaggtttatggaagagatgcgcgagttacggcgaaaaattcgcgaactgcaactgcggtacagcctgaggatcttgatcggcgatccacctcaccatgaccaccatgatgagttttgtttgatgccatag

SEQ ID NO: 27034 - DNA, 2478 bp, Artificial Sequence
  Description of Artificial Sequence: Synthetic coding sequence
atggctgcaggcaaattcgcatcactcccccgcaatatgcctgtgaatcaccagttccctcttgctagctctatggaccttctgtcttcccgaagccccttggccgaacaccgcccagacgcttatcaagatgtttccattcacggtacacttccgcgcaagaagaagggacctcctcccatccgctcatgcgatgacttttcgcacatggggaccctgcctcacagcaagagcccacggcagaacagtcccgtgacccaggacggcatccaggaatccccatggcaggaccggcacggagagacattcacgttcagggatccacacttattggatccaacggtcgagtacgtgaaattctccaaagagcgccatatcatggaccggaccccagagaagctcaagaaggaattagaggaagagctactgcttagtagcgaagatctgcgcagtcacgcatggtaccacgggagaatcccaagacaagtcagcgaaaatttggtacagagggatggcgacttcctcgtgagagattcactctcaagcccgggaaatttcgttctcacttgtcagtggaagaatctcgctcaacactttaagatcaatagaaccgtgctcagactgagtgaggcctacagcagagttcagtaccagttcgagatggagagcttcgactcaatcccaggactcgtcaggtgttacgttggtaaccggagacctatatcccagcagagcggggcgatcatcttccaacccatcaatagaaccgtgccacttcggtgtctggaggagcactatggcacgtctcccggccaagctagggagggcagcctgaccaaaggcaggccagacgtcgctaagcggctgtccctcactatgggcggcgtccaggcgagagaacagaacctgcccagagggaatctgctccggaacaaagagaaaagcggatctcagcccgcttgccttgatcacatgcaggaccgtcgcgcattgtccctcaaagcacaccagtcggaaagttatttacctattggttgtaaactccccccccagtcatcaggggtggatacctctccatgtcctaattcccctgtgttcagaaccggaagcgaaccggccctctcgcccgccgtggtaagaagagtgagttctgatgcgagggctggggaagctctacgcggctcagacagtcaattgtgtcccaaaccgcctcctaaaccttgtaaagtaccttttctgaaggtgccatcctccccctccgcatggctgaattccgaggccaactactgcgaactcaaccctgccttcgcaactggatgcggccgtggggccaagctgccttcatgtgcccagggctcccacaccgagctcttaactgctaaacagaatgaagccccagggccccggaatagcggggtgaattaccttatcctagacgacgacgatagagaacgcccttgggagcccgcggccgctcaaatggagaagggccagtgggacaagggcgagttcgttactcctctgctcgagaccgtgtcttcttttagacctaacgaatttgagagcaaatttttgccccccgagaacaagcccctagagaccgcaatgctgaagcgcgccaaggagctctttacgaataacgatcccaaagttatcgcccagcacgtcctatctatggactgcagagtggctcgcattttgggagtaagtgaagaaatgagacggaacatgggtgtcagctccggccttgagctgataacactgccccacggacaccagctgagactggacataatcgaacgacataacaccatggccataggtattgccgtggatattcttggttgtaccggaaccctggaggatcgcgcggccactctgtccaagataattcaagtggccgtcgaactcaaagattccatgggtgacttgtactcgttttctgcgttaatgaaggccctagaaatgccgcagatcactagattggaaaaaacttggactgccctgagacatcaatatacacagacagctatcctgtacgagaagcagctgaaaccattttccaagctcctacacgaaggcagagagtccacatgcgtgcccccaaataatgtttctgttcccctgctaatgcctctggtaactctgatggaaaggcaggcagtgacctttgaaggtacggacatgtgggagaaaaacgatcagagttgtgaaataatgctgaaccatctggccacagctagattcatggcggaggccgccgattcctacaggatgaatgcagaaaggatccttgctgggttccaaccagatgaggagatgaatgagatttgtaagaccgagtttcagatgcggctcctttggggatctaaaggggcccaggtgaaccagactgagcgctatgagaagtttaaccagatattaactgccctttcgcgcaagcttgaacccccaccagttaaacaggccgaactctag

SEQ ID NO: 27035 - DNA, 2478 bp, Artificial Sequence
  Description of Artificial Sequence: Synthetic coding sequence
atggctgcaggaaaattcgcgagtttaccgcgtaacatgcccgtgaatcaccagtttcctctcgctagcagcatggatctgcttagttccaggtcccccttggccgagcacagaccggatgcctaccaggacgttagcatccatggaaccctgccacgcaaaaagaaagggcccccaccgatccgttcgtgtgacgatttctcccatatgggcactctgcctcattccaaaagcccgcgccagaatagtccagtgacacaagacgggatccaagaaagtccgtggcaggaccgccatggcgaaaccttcacttttcgcgatccacatttactggaccctacagtggagtacgttaagttctcaaaggagcgacatattatggacaggactcctgaaaagctgaagaaggagctggaggaagagttattactctcctcagaggatctgcggtctcatgcttggtaccatggcaggatcccgaggcaagtgagtgagaacctagtacagcgagacggggattttctagtacgggatagcctgtcttcccccggtaacttcgtattgacatgccagtggaagaatcttgctcagcattttaaaattaaccggacagttctgagactttccgaggcatatagcagggtgcagtaccagtttgaaatggaaagtttcgactccatccccggattggtgcgttgctacgtgggaaaccgacggcctatctcacagcagagtggcgctatcatttttcaaccaattaacaggaccgtgccactccggtgtttggaggagcactacggcaccagccctggacaggccagggagggaagccttacaaaggggagacccgacgtggccaagcggctgagtctgaccatgggcggtgtccaggctagggaacagaatctaccgcgcgggaacctccttaggaacaaggaaaaatctggatctcaacctgcatgcttagaccacatgcaggaccggcgggctttgtctttgaaagcccatcagagcgagtcttatctgccaatcggctgtaagcttccccctcagagtagcggtgttgatacatccccatgccccaatagtcctgtatttcgcacagggtcagaacccgccctttcgcccgctgtcgtacgccgggtgtcaagcgatgctcgtgccggggaggcgctgcgaggctcagattcccagctgtgtccgaagcccccaccgaagccgtgtaaagtgcccttcctcaaggtaccttctagtccaagcgcgtggctcaattctgaggcaaactactgtgagttgaatcccgcctttgccacaggatgcgggcgcggcgcaaagctgccttcttgcgcacagggctcgcatacagagttgctgactgccaaacagaacgaagccccaggaccgaggaactctggagtgaattatttgatcctggacgatgatgacagagagcgtccatgggaacccgcagcagctcagatggaaaagggccagtgggacaaaggagaattcgtgacgccactcctggaaactgtgtctagcttccggcctaacgaattcgagtcaaaattcctccctccagaaaacaagcccttggagaccgccatgctcaagcgggccaaggagctgttcacaaacaacgaccctaaggtgatcgctcagcatgtgctaagcatggactgccgcgtcgcacggattctcggagtctcagaggagatgaggcgtaacatgggggtgagctctggtctggagctaatcactcttcctcatggccaccagctgcgtctcgatatcattgagaggcacaacacaatggcaattggaatagccgtcgacattctggggtgcaccggaactctcgaagaccgggcagctaccctcagcaagatcattcaagtggccgtagagctgaaggactccatgggagacctatattcgttctcagctctcatgaaagcgctggagatgccccaaatcaccaggctggagaaaacctggaccgccctgcggcatcagtacacacagacagcgatactatatgagaagcagctgaaaccttttagcaagctgctccatgaggggagggagtcaacttgcgtgccccccaataatgtgagcgttccgctactaatgcccctcgtaactctcatggagcgacaagctgtcacgttcgaaggtacagacatgtgggaaaagaatgaccaaagttgtgagatcatgctcaaccacctcgccactgccagattcatggccgaggcagccgacagctaccggatgaacgctgaacgtatccttgccggcttccagcccgacgaagagatgaatgagatttgtaaaactgagtttcagatgaggctgctctggggttctaagggggcccaggtgaaccagactgaacggtacgaaaaattcaaccaaattctgaccgcattgtcacgaaagctagagccaccccccgtcaagcaagccgaattgtag

SEQ ID NO: 27036 - DNA, 2478 bp, Artificial Sequence
  Description of Artificial Sequence: Synthetic coding sequence
atggctgccggcaagtttgccagcttacccaggaatatgcccgtgaatcaccagttccccttagcatctagcatggatctgctgagtagccgatcaccacttgcagagcaccggcccgacgcttatcaggacgtatccatccacggcaccctgccccggaaaaaaaaaggcccgccccctatccggagttgtgatgattttagccacatgggaacccttccccactccaagtctcctcggcagaatagccccgtaacacaggacggcattcaggagtcaccctggcaggaccggcacggcgaaaccttcacatttagagatccccatctgttggatccaaccgtagagtacgttaagttctcgaaagagaggcatattatggatcgaacacctgagaaactcaaaaaagagctcgaagaggaattgctgttaagcagcgaggatttacggagccacgcttggtatcatggccggattccccggcaagtgagcgagaacctggtgcagcgagatggggatttcttggttagagacagcctcagctcccccggcaactttgttcttacttgtcaatggaaaaatctggcccagcatttcaagatcaaccggactgtacttcgactttcagaagcctatagtcgtgtgcagtatcaattcgagatggaatctttcgactccattccaggactggtgcggtgctatgttggtaatcgccggcctattagccagcagtctggcgcaattattttccagccaatcaatagaaccgtacccctgaggtgcctggaagagcactacgggacttcgcccggtcaggcccgggaaggaagtctgactaagggtagaccagacgttgccaaaaggctttcattaacaatgggcggcgttcaagccagagaacagaatttgccaaggggcaatcttctgagaaacaaggagaaatcaggttcccagcctgcttgcttggaccacatgcaagatcgacgggccctgagtctgaaagcccatcaaagcgagtcctacctgcccatcgggtgtaagctcccgccacaatcttccggggttgataccagtccatgcccaaattctccagttttcagaacaggaagtgagccagcattaagtcccgcagtggtgagacgggtaagcagtgatgctagagccggagaagccttacggggcagtgactcgcagctttgcccgaagccgcctccgaagccgtgcaaggtccccttcttgaaagtgccctcctcaccgtctgcgtggctgaacagcgaggcaaattactgtgagctcaacccagcctttgctacggggtgcgggagaggtgcaaagcttccttcctgcgcccaaggctcacatactgaactgctaactgcaaagcagaatgaggcccctggcccccgcaactccggagtcaactatttaatccttgatgatgacgatcgggagcgtccctgggagcccgccgctgctcagatggaaaagggacagtgggacaagggagagtttgtgacgcctctcctggaaactgtctcaagctttcggcccaatgagttcgagtctaagttcctgccacccgaaaacaagccactcgaaaccgccatgctgaagagagcaaaagagctgttcacaaacaacgatccaaaagtcattgcccagcacgtgttaagcatggattgtcgcgtcgctaggatactcggcgtcagcgaggagatgcgacgcaatatgggggtgagcagtgggctcgagttgattacactgccacacggccatcagttgcgtcttgatatcattgagcgtcacaacacaatggccatcggcatcgctgtagatatcctaggatgtacaggcactttggaagacagagccgcaaccttgagcaagataattcaagtggccgtggagctgaaggattcaatgggagatctgtatagctttagcgcacttatgaaggctttggaaatgccccaaataaccaggcttgagaagacctggacagccctgcggcatcagtatacccagactgcaatcttatatgagaagcagcttaagcctttcagcaaactgctgcatgagggccgcgagagtacatgcgtgccgccaaataacgtgagcgttccgctgctgatgcctctagtgactttgatggaaaggcaggccgtaacctttgaaggaacggatatgtgggagaagaacgaccagtcctgtgagattatgcttaaccatctggccacagcccggttcatggctgaggccgccgactcgtaccggatgaatgctgaaaggattttggctggattccaacctgatgaggaaatgaacgaaatctgtaaaaccgaatttcagatgcggctgctgtgggggagcaaaggagcccaggttaaccaaacagaacgttacgagaaatttaatcaaatattaaccgccttaagtcgcaaattggagccacccccggtgaaacaggccgaactgtag

SEQ ID NO: 27037 - DNA, 2205 bp, Artificial Sequence
  Description of Artificial Sequence: Synthetic coding sequence
atgccaaaagagtgttctgcctttcacgctttgagcgccgctctgtgctgtttttatcatcggaagagtttcatcggtgttaagttctctaaggagagacacattatggataggacccccgagaagcttaaaaaagagctggaggaagagttgcttttaagttccgaggaccttcggagccacgcctggtaccatggccggattcctagacaggtgtcggaaaacctcgtacagcgcgacggagacttcctggtccgggattctctgtcaagtcccggtaactttgttttgacgtgccagtggaaaaatttagctcaacacttcaagatcaatagaaccgtcctccgtttaagcgaagcctattcaagggtgcagtatcaattcgagatggagtcttttgacagcattcctgggcttgtccgctgctacgtgggtaaccgccgcccaattagccagcaaagtggcgctatcatctttcagcccattaatcggaccgtgcccctccggtgtctggaggagcattacgggacttccccaggacaggcccgcgagggctctctgacaaaaggtaggccagacgtggctaaacggctcagccttactatgggcggggtacaggcccgagaacagaatctccccaggggtaacctgttgaggaataaggagaaatccggttctcaacccgcgtgccttgaccatatgcaggatcgcagggcactcagcctgaaggcccatcaatcagagtcctatttgcctataggttgtaagctgcctccccaatcaagcggcgtggacacgtctccttgcccaaacagtcccgtttttcggactggtagtgagcccgccctttctcccgccgtggtcagacgcgtttcctccgatgcccgcgctggcgaagcactgcggggcagcgattctcagctgtgtcccaagcctcccccgaagccctgcaaagtgcccttcctgaaggtgcccagctctccttccgcttggttaaactcggaggcaaactactgtgagctgaaccccgcatttgctaccgggtgcgggcgcggcgccaagttgccatcatgcgcacagggtagccacaccgaactcttgacagcgaagcaaaacgaggcccccggcccaagaaactctggggtgaactatctgattctcgacgacgatgacagggagagaccatgggagccggcagcggcgcagatggagaaaggccagtgggataagggggagtttgtgaccccactgctggagactgtctcaagcttccgtcctaacgagtttgaatcaaagttcctgccccccgagaacaaacctctggagactgccatgttgaagagggctaaggagttgtttacaaacaacgatcccaaagtaatcgcacagcatgttctgtccatggactgccgcgtcgcgaggatcctgggagtgtccgaggagatgcgacggaacatgggcgtcagctcaggactagaactgattaccttgcctcacggccaccaactccggttagacatcatcgaaagacacaacaccatggccataggcatagccgtggatattcttggctgtacggggaccttggaggatcgagcggcaactctgagcaaaattatccaggtggccgtggaactaaaagattctatgggcgatctgtattccttttctgccctgatgaaggccctggaaatgccacaaatcactcggcttgagaagacttggacggcattgcgccatcagtacacacagaccgcaattctgtatgaaaagcagcttaagcccttcagtaaactgctccacgaggggcgcgaatcaacatgcgtaccacccaataacgtctccgttcccctgctcatgccccttgtcactctgatggagcggcaagccgtcactttcgagggtaccgatatgtgggaaaagaatgaccagtcttgcgaaatcatgttgaaccatctggccactgctaggttcatggctgaggccgctgattcataccgtatgaacgcagagaggatcttagcaggctttcagcccgacgaagaaatgaatgagatctgcaagaccgaatttcaaatgcgtctcctctgggggagcaagggggcgcaggtgaatcagacggaacgatacgagaagttcaatcagatcctgacggcattgagtaggaagcttgaacccccacctgttaagcaggccgagctctag

SEQ ID NO: 27038 - DNA, 1506 bp, Artificial Sequence
  Description of Artificial Sequence: Synthetic coding sequence
atgcaggatcggcgggctctgagtctgaaagcgcaccagtctgagagctatctccccatcggctgcaaacttcctcctcagtccagcggcgtggataccagcccttgcccgaattctcccgtcttcagaactggctcggagccagctctcagccccgctgtggtgagacgggtcagctccgacgcccgggccggcgaggccctgcgcgggagcgattcccagctgtgcccaaagcctccaccaaagccatgcaaagtgccctttctaaaagtgccttcaagtccgtcagcttggttgaacagcgaggcaaactactgcgagttgaacccagcgtttgccactggttgtggccgcggagctaagctcccgtcttgcgctcagggaagtcatacggagctgctaacagccaagcagaatgaggcccctggccctagaaacagcggggtgaactatcttatattggacgacgacgatcgcgaacggccttgggagccagcagccgcacaaatggagaaaggccagtgggataagggcgaatttgtgaccccccttctggagactgtttcttcctttcggcctaatgagttcgaatccaagttcttgccccccgagaataaacccctcgagacggctatgctgaagagggccaaggaactgttcaccaataatgacccaaaggtgatcgcacagcacgtgctgagcatggactgccgcgttgctcggatcctcggagtgtcggaggaaatgagacgaaatatgggcgtctcatcaggcttagaactaataactctccctcatggtcaccaactgaggctagatatcatcgagaggcataacaccatggccatcggcatcgcagtggacatactgggttgtacagggaccctcgaggatagagctgcaacactctctaagattattcaggtcgccgttgagttaaaagattctatgggcgacctttacagcttttcggccttgatgaaggcactcgagatgccacagattacccgcctggaaaaaacctggacagctttgaggcatcagtatacccagaccgcgatcctgtacgagaaacaactgaagcctttctccaagttattacacgagggtcgagaatccacatgcgttcctccaaacaatgtgagcgtgccgctgttaatgcctctggtgaccctcatggagaggcaggccgttacctttgagggaacagatatgtgggaaaaaaacgatcaaagctgcgagatcatgttgaatcacctggcaacagccaggttcatggcagaagcagccgattcttaccgcatgaacgccgagcggatactggcgggcttccaaccagacgaggagatgaatgagatctgcaaaacagaatttcaaatgagattattatggggttcaaaaggcgcgcaggtaaaccaaacagaaaggtacgaaaaatttaatcaaattcttactgcactttcccgaaagttggagccccctcccgtgaaacaggccgaactctag

SEQ ID NO: 27039 - DNA, 4452 bp, Artificial Sequence
  Description of Artificial Sequence: Synthetic coding sequence
atggcaccactgctgggtaggaaaccgtttccactggttaagcccctgcccggcgaagagcctttatttactattcctcacactcaggaagcctttcgtaccagagaggaatatgaggcccgacttgagagatacagcgaaagaatatggacttgcaagagtacaggatcctcccaactgacgcacaaggaggcctgggaggaggaacaggaggtagccgagctcctgaaagaagaatttccggcatggtacgagaaacttgtccttgagatggtgcaccacaacaccgctagcctggagaaactggtggacaccgcgtggctggaaattatgacgaaatatgctgtcggcgaagaatgtgattttgaagtgggtaaggagaaaatgttaaaagtgaagatcgtgaagatccatcccctcgagaaagttgacgaggaggccacagaaaagaaatctgacggcgcttgtgattctcccagctcggataaagagaacagttctcagatcgcccaggatcatcagaaaaaagagactgtggtcaaagaggacgaaggaaggagggaatccataaacgaccgcgcgcggcgcagccctaggaagctgcccacgtctcttaagaagggggagcgcaagtgggccccccctaaattcctcccacataagtacgatgttaagctgcagaatgaggacaaaatcattagtaatgtccctgctgatagcctgatccgaactgagcgaccaccaaataaggagattgttcgctactttattcgacataatgctttaagggcaggtaccggcgaaaatgctccttgggtcgttgaagatgagttagtcaagaaatatagcctcccttcaaaattctctgacttcctactggatccgtataagtacatgacgttaaatccttcgaccaagcggaaaaatactggctcccctgaccggaaaccgagtaagaaaagcaagaccgataactctagtttgtcaagccctctaaatccaaaactctggtgtcacgtccacttgaaaaaatctttgagtggcagtcccttaaaagttaagaattctaagaatagcaaaagccccgaagaacacttagaggaaatgatgaaaatgatgtctccgaataagctccataccaacttccatatacctaagaagggtcctccggcgaaaaagccagggaaacacagtgacaaaccattaaaggcgaaaggaaggtccaagggtatcctcaatgggcagaagtctacagggaacagtaaaagccccaaaaagggtcttaagacgcccaaaaccaagatgaagcaaatgacacttctagacatggctaaaggcacacaaaagatgacacgggccccaaggaactccggcgggacccctaggacttctagtaagcctcacaagcatttacctccagccgctctccacctcattgcctactacaaggagaataaagatagggaggataaacggtccgcactttcatgtgtcatcagtaagacagcccgcctgctctcttcagaggatcgggctaggctgcctgaagaactcagaagtcttgtgcagaagagatacgaactgctggaacacaagaaacgctgggcatctatgagtgaagaacagaggaaagagtatctgaaaaaaaaaagagaggaattgaaaaaaaagctaaaggagaaggccaaagagcgccgagagaaggagatgctggaacgattggagaagcagaaacgttacgaagaccaggagctcacagggaaaaaccttcctgcatttcgactggtggacacgcctgaaggactccccaataccctctttggggacgtggctatggttgtcgagtttttgtcatgctattccggacttctactgccagacgcacagtatccaatcacagctgtgtctctgatggaagcactgagcgcagacaaggggggctttctgtacctcaaccgggtgcttgtcattttgttacagacattgttgcaggacgagatagcagaagactacggtgaactggggatgaaattgagtgaaatcccattaaccctgcacagcgttagcgagttggtaagactgtgcctacgtaggtcagatgtccaggaggagtccgaggggtctgatactgacgacaacaaagacagcgcggcctttgaggacaatgaagtgcaggacgagtttctggagaagcttgaaacctcggaattctttgaactgacctcagaggaaaagctgcagattttgacggctctgtgccacagaatcctgatgacttatagcgtccaggaccacatggaaactaggcagcaaatgagtgccgagctttggaaggagagattggcagtgctgaaagaggagaatgacaagaaaagggcagagaagcagaagaggaaggaaatggaggccaaaaacaaagagaacggaaaagtggagaacgggttaggcaagaccgacaggaagaaagagattgtgaaattcgaaccacaagtagacacagaagccgaagacatgatttcagccgtcaagagtaggaggcttctggccattcaggctaaaaaagagcgcgaaattcaagagcgagagatgaaggtgaaattggaacggcaggcggaagaggaacgaattagaaaacataaagctgcagcagaaaaggccttccaagaaggaattgccaaggcgaaactcgtgatgaggcggactcccatagggactgaccgcaaccacaatagatattggctgttttcagacgaggtcccaggactgttcatagaaaaagggtgggtgcatgattcaatcgattatcggttcaatcaccactgcaaagatcacacggtgtctggcgacgaggattactgtcctcgctcgaaaaaggctaaccttgggaaaaacgcgtcaatgaacacacagcacggcactgccactgaagtagctgtagagacaacgacccccaaacagggacagaacctctggtttttatgcgactctcagaaggaactggatgaattactcaattgccttcacccacagggaatccgcgagtcccagcttaaagaaaggctcgaaaagagataccaggacattatccactccatacatctggccaggaagcccaatctgggactgaagagttgtgacgggaatcaggaactgttgaattttttaaggtccgacttgatagaggtggccactcgcttgcagaagggcggccttggctatgtagaggagaccagcgaatttgaagctcgagtaatttctcttgaaaaactgaaggacttcggcgaatgcgtcattgctctgcaggcgtctgtgataaagaaatttctgcagggtttcatggcccctaaacagaagcgaagaaagctacagtcagaggacagtgcaaaaaccgaagaagtagacgaggaaaaaaagatggttgaagaagcgaaagtcgctagtgccttagagaagtggaagacagcaatccgggaagcccagactttttccagaatgcatgtgctgctggggatgttggacgcctgtattaaatgggacatgtctgccgaaaatgcacgttgtaaagtgtgccggaaaaagggcgaggatgacaagctcatattgtgtgatgagtgcaataaagcctttcacctgttctgcttgcggccagctctgtacgaagtgcctgatggagagtggcagtgcccggcttgccagccagctaccgcccggcgcaactcccgcggcagaaactatactgaagagtcagctagcgaggacagcgaggatgacgagagcgacgaggaggaagaggaggaagaagaagaagaggaggaagaggattacgaggtggctggactaaggttgcgaccaagaaaaactatccgtggaaaacactccgtgattccacctgccgccaggagcggcagaagaccgggcaagaaaccacattctacaagaaggtcacagcctaaagcgcctccagtagacgatgccgaggtcgacgaattggtgctgcagaccaagcgttcttcgaggcgacagtccctcgaattgcagaaatgcgaagagattctccacaaaatcgtaaagtaccggttctcttggcctttccgggagcccgtgacaagggacgaagcagaggactattacgacgtgattacacaccctatggattttcagacagtccagaacaaatgctcttgcgggagttatcggtctgttcaggagtttctgactgatatgaagcaggtctttacgaatgccgaagtgtataattgtagagggagtcatgtgctcagctgtatggtgaaaactgaacagtgtctggtggcgctgctgcataagcacctaccaggccatccatacgtgagacgaaaaagaaaaaaattccccgatagactcgccgaggatgagggagatagtgaaccagaggcggtcggacagtctaggggaagaagacagaagaagtag

SEQ ID NO: 27040 - DNA, 1506 bp, Artificial Sequence
  Description of Artificial Sequence: Synthetic coding sequence
atgaagggataccagagccttgttttcaacttcttctttctgaaattgagtgccgagaacgaaagcacgcccatccagcaactgcttgagcactttttaagacagctgcagagaaaagacccgcatgggttcttcgccttcccagtcaccgatgccatcgcacctggatacagtatgataatcaaacaccccatggactttggaacgatgaaagataagatcgtagcgaacgaatataagagtgtgaccgagtttaaggcggacttcaaactgatgtgcgacaacgccatgacctacaaccggcctgacacggtgtactacaagttggcgaaaaaaattcttcatgcggggttcaagatgatgtccaaggagcggctgctcgctttgaagcggtcaatgagcttcatgcaggacatggatttcagccagcaggctgccctgctggggaacgaggacacggccgtggaagaacctgtgcctgaggtggtacctgtacaggtggaaaccgccaagaagtcaaaaaagcccagccgcgaagtgatatcctgtatgtttgagcctgagggcaacgcctgttcactgaccgacagcaccgccgaggaacatgtactggcactggtggaacacgccgccgatgaagcgcgagacaggatcaaccgcttcctgccaggaggaaagatgggatatctgaaacggaatggagacggctcactgctgtatagcgtggttaacactgccgaacctgacgcagacgaggaagagacccaccccgtggatctctctagcctctcttcaaagctgctccctggcttcacgaccctgggtttcaaagacgaaaggcgcaacaaggtgaccttcctgtctagcgctacgaccgctttgtccatgcagaataattctgtgttcggggatcttaagtcagatgagatggagctcctgtatagtgcatacggggatgagacgggggtgcagtgtgccctgtcactccaggaatttgtaaaagatgctgggagctactccaagaaggtggtcgatgacctgctggaccagatcacaggaggtgaccacagtcgtaccctgttccagctcaaacagaggcggaatgtgcccatgaagccccctgatgaggctaaagtgggtgacacgttgggggactcttcaagttccgtcctagagttcatgagcatgaagtcgtaccccgatgtttcagtggacatctccatgttgagctcattaggtaaagtaaagaaggagttggatcccgacgattcccaccttaatttggacgagaccacaaagctcctgcaggacttacacgaggcccaagcagaacgaggcgggtcaaggccaagtagcaatttatcgtctttgagcaacgcttccgagagagaccagcaccacctcggctcaccttctaggctgtccgttggcgagcagccagacgttacgcatgacccttatgagtttttgcagagtcctgagccagctgcttccgcaaagacctag

SEQ ID NO: 27041 - DNA, 561 bp, Artificial Sequence
  Description of Artificial Sequence: Synthetic coding sequence
gctgtttgcagtttacggctaccatcatcacccgataaaagatcccgcgccatgcaggtgaccctgatcctcgctgaggaggaaactcacccagtcgatttgtcctccctctcatcaaagttgttgcccggctttaccacattggggttcaaggacgagaggcgcaataaagtgactttcctctcgagcgcaactaccgctctttccatgcagaataacagtgtatttggtgacctcaaatccgatgagatggagctcttgtatagtgcttatggtgacgaaactggtgttcagtgtgctctttcgttgcaggaattcgtgaaggatgccggctcttatagcaaaaaagttgtagacgacctgctcgatcagatcactggaggcgaccattcacgtacactcttccaactcaagcagcgtaggaatgtgccaatgaaaccgccggacgaggctaaggtgggtgacaccttaggcgatagctcatcctctgtgctggagtttatgtccatgaagtcatacccagacgtgtcagtcgatatctcaatgctgagtagtctttag

SEQ ID NO: 27042 - DNA, 1446 bp, Artificial Sequence
  Description of Artificial Sequence: Synthetic coding sequence
atgaaagggtaccagtctctggtgttcaatttcttcttcctcaagttgagtgctgagaatgagagcacccccatccaacagttgctagagcatttcttgagacagctgcagaggaaggacccccacggcttctttgcctttcctgtaactgacgccattgcacctggttacagcatgattataaaacatcctatggacttcgggactatgaaagacaagatcgttgccaacgagtacaagagtgtcactgagtttaaggccgattttaaattgatgtgcgataatgccatgacatacaatcggcctgataccgtatattataagctggcaaagaaaatcctgcacgccggttttaagatgatgtctaagcaagcagccctgctcggcaacgaggataccgctgtggaagagccggttcctgaggtcgtccctgtccaggtggagacggcgaagaagagtaagaagccatcaagagaggtgatctcctgcatgttcgaaccggagggaaatgcttgctccctaaccgattctactgccgaagagcatgtcctggccctggtggaacatgcagcagatgaggcaagagatagaatcaacaggtttcttccgggcggcaaaatggggtatctgaaaagaaatggagacgggtcattgctttatagtgttgtcaacaccgccgagcccgatgccgatgaggaagagactcatccagttgacctgtcctcgctctcatcaaagctcttgcccgggttcaccaccctagggttcaaggacgaaagacgcaataaagtcacttttctgtccagcgccacaacagccttgtccatgcaaaacaactctgtgttcggtgatctcaagtctgacgaaatggaactgttgtactctgcatacggcgatgagacaggcgtgcagtgtgccctgtccctgcaggaatttgtgaaggatgcaggtagctactccaagaaagtggtggacgatctcctggaccaaatcactggaggcgaccacagccggactctctttcagctgaaacagaggaggaatgtccctatgaagccacccgacgaggcaaaggtcggcgacacactaggtgacagctcttcaagcgtgctggagttcatgtcaatgaaatcctatccggatgtaagcgtggacatctctatgctgagcagtttgggaaaagtgaagaaagaattagaccccgacgacagtcacctcaaccttgacgagacaacgaagctcctgcaggacctgcatgaagctcaagcagagaggggcgggtcccggccttccagcaatctcagcagcctctctaatgccagtgagcgcgatcagcaccacctgggttccccatctcgcctcagcgtgggagagcaacctgatgtaactcacgacccctacgaattcctgcagagtccagaacctgctgcttcggcaaagacctag

SEQ ID NO: 27043 - DNA, 645 bp, Artificial Sequence
  Description of Artificial Sequence: Synthetic coding sequence
atgaaaggatatcaatctctggtgtttaacttttttttcctcaagctgtcagcagaaaatgagtctactcccattcaacaacttctggaacatttcttacggcagctgcagcggaaagatccacacggctttttcgcatttcctgttaccgacgcaatagcccccggatacagcatgattatcaaacacccgatggacttcgggaccatgaaggacaaaattgtggccaatgaatacaagtctgtgaccgagttcaaagcggacttcaagctgatgtgtgataacgccatgacttataaccggcccgacaccgtttattacaaattggcaaagaagattctgcatgccggcttcaaaatgatgagtaagcaggccgcgctgctgggcaacgaagacacagccgtggaggagccagtgccagaagtggtgccagtgcaagtggagactgccaagaagtctaagaagccatcacgcgaggtgatctcatgtatgttcgagcccgaaggcaacgcttgctccctgacagattccaccgccgaggaacatgtgctcgctcttgtggaacatgccgccgatgaggctcgagacaggattaacaggttcttgcctggcgggaagcgcagacggcccaccagatggacatag

SEQ ID NO: 27044 - DNA, 1794 bp, Artificial Sequence
  Description of Artificial Sequence: Synthetic coding sequence
atggggaaaaagcataagaaacataaagctgagtggaggagcagttacgaggattacgcagacaagccactggaaaagcccctgaagctggtcctgaaggtgggaggctctgaggtgacggagctgtcaggatccggccatgatagttcatactacgatgaccgcagcgaccatgagagagaacgtcacaaggagaagaagaagaaaaagaaaaagaagagtgagaaagaaaagcacttagacgatgaggagcgacgcaagcggaaagaagagaagaaaaggaaaagagagagagagcactgtgatactgaaggagaggccgacgacttcgacccaggtaaaaaggtcgaggtggagcccccgccagatagacctgtgagggcttgccgtacacaaccagcagaaaatgagagcacacccatccagcaacttctcgagcattttttgagacagcttcaacgcaaggaccctcatgggttcttcgcctttcctgttaccgatgctatcgcacctgggtacagcatgattattaagcaccctatggacttcggcacaatgaaagacaagattgttgcaaacgagtacaaaagtgtcaccgaatttaaagctgacttcaagctgatgtgcgacaacgctatgacctacaatcgacccgataccgtttattacaagctggcaaaaaagatcctgcacgcgggctttaagatgatgtctaagcaggctgccctcctgggaaacgaagatactgccgtggaggagcctgtgccagaggtcgtcccagttcaagtggagactgcgaaaaaaagcaaaaagccctctcgcgaagttatcagctgcatgttcgagcccgaggggaacgcttgttcgctgacagattctacggccgaggaacatgtgctggcacttgtagagcatgctgccgacgaagcacgtgatagaattaatcgtttcctaccgggagggaagatgggctatctcaagcgtaacggcgacgggtcattgctatattctgtagtgaacacggctgagcctgatgccgatgaggaagaaacacatcccgtcgacctgtcttctcttagctcaaagcttctgcccggctttaccactctcgggtttaaagatgaacggagaaataaggttacttttctgagcagcgccaccactgccttgtctatgcagaacaatagcgtgtttggagatcttaagtccgacgaaatggagttattgtactccgcctacggagatgagacaggtgtacaatgcgctctgagcctgcaggagtttgtgaaagacgccgggtcctattcgaagaaggtggtggatgatcttctggaccagattacaggcggcgaccattctaggacattattccagttgaaacagcgcagaaacgtgcccatgaaaccacccgatgaggcaaaagtgggggacactctgggtgatagctcgtcatcagttctcgaatttatgagcatgaaatcatacccagatgtgtcggtggatataagtatgctgagtagcctggggaaggtgaaaaaggagctggatccagacgacagtcatttaaacctggacgaaacgacaaaactgctccaagacctgcacgaggcccaggcggagcgcggcgggagtcgcccatcgagtaatctgtccagtctgagcaatgcaagcgagagagaccaacaccacctcggtagtccttcacggttgtcggtgggcgagcagccagatgttactcatgatccttacgagtttctgcagtccccagagcctgctgcctctgccaagacttag

SEQ ID NO: 27045 - DNA, 1635 bp, Artificial Sequence
  Description of Artificial Sequence: Synthetic coding sequence
atgatgaccgggcagacaatgtccgagagaggcaccaaaaagcgcaaaagacgcagaaggcgctcgccacgcaggaggtccatatggaccatgcggaaggagggttccgaacggaagagaagaagcggtagcgaaagaggctcaaccgtaacccggagagaacggttgacaaccctgattctgggccggagatggaggtggtcccggcctcagatcggccaatcggagcgggcaggacacagtcaacctaagatgcgtgcccacctgttctccaactcatggaatacctccagtgcaagcttcagagacccccatggattctttgcatttcctgtcaccgatgccattgcaccgggatacagtatgatcattaagcacccaatggactttggaaccatgaaagacaaaatcgttgcgaacgaatataaaagtgtgacagaattcaaagcagattttaagctcatgtgcgacaacgcaatgacatataacaggccggacacagtctactacaagctggccaaaaaaatcctgcatgctggatttaaaatgatgagcaaacaggccgcccttctcggaaacgaggacaccgcagtagaagagccggttcctgaagtcgtccccgtccaagttgagacagctaagaagagtaagaagcccagccgggaggtgatctcatgcatgtttgagcctgaaggaaacgcatgcagtttgactgactccaccgctgaggagcatgtgctcgctcttgtcgagcatgcagccgatgaagcaagggaccgtattaatcgcttcctaccgggagggaaaatgggctatcttaagcggaatggtgacggatcactgctctactcagtggtgaacacggctgagcccgatgccgatgaagaagagacacaccccgtggacctgagttccctaagtagcaaactcctgcctggctttactactttgggttttaaggacgaaagacgcaacaaagtcacttttctctcatccgccacgactgctttgagcatgcagaacaacagcgtgttcggcgatttgaagtcagacgagatggagctgctgtactctgcatacggagacgaaacaggtgtgcaatgcgcccttagcttgcaggagtttgtaaaggatgccgggagttactccaagaaagtcgtggacgatcttttggaccagattaccggtggagatcactcacgaactctcttccaacttaagcaaagaaggaatgtgccgatgaagcctcccgacgaggcaaaggtgggcgacacactgggcgactctagctcttcggtcctggagtttatgtcaatgaagtcataccccgatgtctccgtggacatctcaatgttgagttcactcggtaaggtgaagaaggaactagaccccgatgactcccacctgaatctggacgaaactactaagctgcttcaggatctgcacgaggcacaagcagaacggggcgggtctcgcccatctagtaacctgagctccttgtctaacgcctcagagcgcgaccagcaccatctgggcagtccaagtaggttgtcagttggcgagcagcccgacgtgacgcacgacccctacgagttcctccaaagtccagagcctgccgcaagtgcaaagacttag

SEQ ID NO: 27046 - DNA, 438 bp, Artificial Sequence
  Description of Artificial Sequence: Synthetic coding sequence
atgctcgggtggatacagccttccagacagcctcagctacgtgccgcccccccgactcgtacaccctccgccaagaggtgcattctgtgcaactttctgcccggatgctggttggtgggcgatgtagcaggcagcaggcagcctagcgccccgcagacactcaggcagaggcagcatactaggcctcccccacaagaacgtgggtccggcaggaggtctcccctcagagaggcccggcgggccaacccgcacttcaaatccttccccgtcctcgaagccagggggttgccttgtggcgcgaggcgtacgggcccgaggcggcccgtacgagagatgacgctcccatctgacccggagcgggcaaccctgccaaacccccggctgggagcacctgcagtcccgagacggggacccaggtctcatggcgggcgtcgctag

SEQ ID NO: 27047 - DNA, 522 bp, Artificial Sequence
  Description of Artificial Sequence: Synthetic coding sequence
atggccgagggcgaagatgtgggctggtggcgctcctggctgcagcagtcctatcaggctgtaaaagagaaatccagcgaagcgctagagtttatgaagcgagaccttacagaattcacccaagttgtgcaacatgataccgcatgtaccatagcggccaccgcttcggtggttaaagaaaaactcgcaaccgagggaagttccggtgccacggagaaaatgaaaaagggcttgtccgacttcctgggagttatatctgatacatttgctccgtctccagataaaactattgactgcgatgtcattacgcttatgggtacgccatcaggcacagctgaaccttacgacggtaccaaagcccgcctgtactctcttcagagcgaccccgcgacctattgtaacgagccggatggccccccggagctgttcgatgcgtgtcagccagagttatgggcccaaatcctggtggcgccctgctggccctcttgggcatcggcccacacctgggagggcgccctgtag

SEQ ID NO: 27048 - DNA, 1425 bp, Artificial Sequence
  Description of Artificial Sequence: Synthetic coding sequence
atggctgaaggggaagatgtgggctggtggcggtcttggttgcaacagagttatcaagcggtgaaggaaaaaagttccgaagcgctggagtttatgaaacgcgacttaactgaatttacacaagtcgtgcagcatgacacggcgtgcacaatagcagccactgcctctgtcgtgaaagagaagttggcgatcgccgcgtgctcccgtggagcatgcttcctgtgtccgttcagtattcaaaccgaaggtagcagtggagccaccgaaaagatgaaaaaggggctgagcgacttccttggagttatcagtgatacctttgcaccaagcccagataagaccatagattgcgacgtaattactctgatgggcaccccttcaggaacagctgagccttacgatggtacgaaggcaaggctttacagcctccagagtgatcctgcaacctactgtaacgagccggacggccctccagagctctttgacgcatggctgagccagttctgcctggaagaaaaaaagggggagatttccgaattactggtgggcagtcccagcatcagggcactatataccaagatggtgccagccgccgtttcacatagtgagttctggcaccgctacttctataaagtccaccaactggaacaggagcaggcgagaagagatgccctcaagcagcgagccgaacagtcgatttctgaagaacctgggtgggaggaggaagaggaggagctcatgggtattagcccgatttctccaaaggaggcgaaagtcccagtggcaaagatatctaccttccccgagggcgagccagggccacaatcgccatgtgaggagaatctcgttacgtccgtcgagccccccgctgaggtgactccttcagagtcttcagagtctatatcattggtcacgcagatcgcgaatcctgctacagcccccgaagctcgtgttctgccaaaggatcttagtcagaagctgctggaggcctccctcgaggagcaaggactggccgtggacgtcggggaaacaggcccttcaccaccaatccattctaagcccctgactccagccggacataccggtggtcccgagccccggccccctgcgagggtggagaccctcagagaggaagctcctaccgatttgagggtgttcgaactcaactccgactcggggaagtctaccccttccaacaatggaaagaagggctccagtactgatatttctgaagattgggagaaggattttgaccttgatatgactgaagaggaagtacagatggccctgagcaaagtcgatgcgtccggagaagtgagcggaccaggggggtccgaaggtagcgagccaaatggcccgggctgtgagagcagtccccaaccagcacagctgtctccacaagagggaccctgctcgtgcctgaggtag

SEQ ID NO: 27049 - DNA, 1110 bp, Artificial Sequence
  Description of Artificial Sequence: Synthetic coding sequence
atggctgagggagaggacgtgggctggtggcgatcatggttgcagcaatcataccaggcggtgaaggaaaaatcgagcgaggccctagaattcatgaagagagacctgaccgagtttactcaggtcgtgcagcatgataccgcctgcacgatcgccgctacggcttccgtggtaaaagaaaagttagcaacagaggggtcctctggagcaacggagaagatgaagaaggggcttagcgacttcttgggtgtcatcagtgacactttcgctccaagccccgacaaaaccattgattgcgacgtaattactctcatggggacacctagcggtacggcagagccatatgatggtactaaagcgagactgtattctctgcagagcgatccagctacttattgtaacgagcctgacggcccgccagagctgtttgatgccttgaagcagcgcgctgagcagagcatatcggaagagccaggctgggaagaggaggaggaagagctgatgggtatcagtccaatctctcccaaggaggcaaaggtgccagttgctaaaatatccaccttcccagagggtgagccggggccccaaagcccctgcgaggagaacctggtgacaagtgtggaacctcccgccgaagtgactccgtccgagagttctgaatctattagcttggttacccagatcgccaatccagctaccgcgccagaagcccgggttctaccaaaggacctttctcagaagctattggaagcttccttggaggaacagggactagccgtggacgtgggggagaccggcccttccccgccgatacattccaaacccttaacccccgccggacatactggaggccccgaaccgcgcccccccgcccgtgtagaaacactgagggaggaggcacctaccgacctcagggtgttcgaacttaatagcgactcgggcaaaagtacacccagcaataatgggaagaagggttcttctaccgacatcagtgaggattgggaaaaagactttgacctggacatgacggaggaggaagtgcagatggccctatccaaagtcgatgcgtccggggagctggaggatgtggagtgggaggattgggagtag

SEQ ID NO: 27050 - DNA, 1125 bp, Artificial Sequence
  Description of Artificial Sequence: Synthetic coding sequence
atggccgaaggcgaggacgtgggatggtggcgtagttggttgcagcagtcatatcaggcagttaaagagaaatcctcggaggcccttgagtttatgaaacgagacctgaccgagttcacccaggtggtccagcacgataccgcttgcaccattgctgccactgctagcgtggtgaaagagaagctcgcagcccgattatatagccttcagagtgacccggcaacatattgtaacgaaccagatggcccccccgagttgtttgacgcctggctgtcacagttctgcctcgaggagaagaagggtgagatatctgagctgctcgtcggatcaccgagcattcgcgccctttacacgaagatggtccccgccgcagtttctcattctgaattctggcataggtatttttacaaagtgcaccagcttgaacaagagcaggctcggcgagacgctctaaaacaacgtgccgagcaatctattagtgaggagccgggatgggaggaagaggaagaggagctgatgggaattagcccaatttcccccaaggaggccaaggttcccgtggcaaagattagtacattccctgagggagagccgggaccccagtccccgtgtgaggagaaccttgtgacttccgtcgagccacccgccgaagttacgccttcagagtccagcgaatccattagcctggtgactcagatcgctaaccccgccacagccccagaggcaagagtcttgccgaaggacctgtcgcagaaattgttagaggcttccttggaagaacaggggctagccgtggatgtcggggagacgggcccctctcccccaatccatagtaagcccttaactccagctggccacactggaggtcctgagccccggccacctgctcgagttgagactttaagggaagaggctcccactgaccttcgtgtgtttgaactcaattccgactcaggaaaatctacccccagcaataacggcaagaaaggatcttccaccgatatttctgaggactgggagaaagacttcgatcttgatatgaccgaggaggaagtgcaaatggcactgagtaaggtggacgctagcggggaattggaggacgtggaatgggaggattgggaatag

SEQ ID NO: 27051 - DNA, 1344 bp, Artificial Sequence
  Description of Artificial Sequence: Synthetic coding sequence
atggcagagggcgaagacgtcggttggtggaggagctggcttcagcagagctaccaggccgtcaaagagaagagcagcgaagccctggagtttatgaagagagacttaacagagttcacccaggtggttcaacacgacactgcatgcacaatcgcagctaccgcatccgtggtaaaggagaagctggccatcgccgcctgcagcagaggggcttgcttcctgtgtccattctcaattcagactgagggtagcagcggtgctacggagaagatgaaaaaaggtctgagcgacttcctgggggtaatctcggacaccttcgcgcccagccccgacaaaaccatcgactgtgatgtgataaccttgatgggaacccccagtggaacggctgagccctatgatgggaccaaagccaggctttactcactccagtctgacccggctacctactgtaacgaacctgacggcccccctgagttgtttgatgcttggctctcacagttttgcttggaagaaaaaaagggcgaaatttctgagctgctggtgggtagtccgtctatacgcgcgctgtacactaagatggtgcccgctgccgttagtcacagtgaattctggcaccgctacttctataaggttcaccaattggaacaggagcaagcacgcagagatgcactcaagcaaagggctgagcagtccatttctgaagaacctggttgggaagaggaagaagaggagcttatgggcatctcacccatctctcccaaagaagctaaggtgcccgttgcgaaaataagtacgtttcccgagggggagccggggccccagagcccgtgcgaggaaaacctggttacaagcgtggagcctcctgcagaagttacccccagcgaaagctctgagtcaatctcactcgtcacacagatcgcaaaccctgctaccgctccagaggccagggttcttccaaaagacctctcccagaaactgctagaagcttcactggaggaacagggactagccgtggacgtcggcgagacgggcccatccccgcccattcactccaaaccacttacgccagccggtcacactggagggcctgagccgagaccgcctgcaagggtggagactttaagggaagaggccccgacggatttgcgagtgttcgaactgaattccgattccggaaagtcgacaccaagcaacaacggcaagaagggatcttctaccgatatctctgaagactgggagaaagatttcgaccttgacatgactgaggaggaggtccaaatggctctgtcaaaagttgatgcctccggcgagctcgaggatgtcgagtgggaggattgggaatag

SEQ ID NO: 27052 - DNA, 1269 bp, Artificial Sequence
  Description of Artificial Sequence: Synthetic coding sequence
atggcagagggtgaggacgtcggttggtggcgaagctggttgcaacagagctatcaggctgtaaaggagaagtctagcgaggccctggaatttatgaagcgtgatctgacggagttcacacaggttgtgcagcacgataccgcgtgcacaatcgctgctacagccagcgtggtgaaagaaaagcttgctaccgaaggaagtagcggtgcgaccgaaaagatgaaaaagggcttgtcggacttcctgggcgtgatcagcgataccttcgcgccatccccagataaaacaatcgattgtgacgttatcaccctgatgggaacacccagtgggacagccgagccatatgatggcaccaaggcacgactctacagtctgcaatctgatcctgcaacttattgtaatgagccagatggccccccagagttgtttgacgcctggctgagccagttctgcctggaagaaaagaagggcgagatttcggagctgctggtggggagccccagcattagagcattatacaccaaaatggtcccagcggctgtgagccattccgagttctggcatcggtatttctataaggttcatcagctggaacaggagcaagctagacgggacgccctgaaacagagagccgaacagtctatcagtgaagagcccggatgggaggaggaagaggaggagttgatggggatctcccctatctctcccaaagaggcaaaggtgcctgtggcaaaaatctccaccttccctgaaggcgagccgggaccccagtctccatgcgaggagaatttggtgacatccgtggaaccccccgcagaggtgactccctcagagtcgtccgaatccatctcattggtgacacagatagctaaccctgctaccgcacctgaagcccgcgtgctgcctaaggacctatctcaaaaactgctcgaagcctctctggaagagcaggggctcgccgtggatgtgggtgagacgggcccttctcctccaattcacagtaaacccctgacccccgctggacataccggaggcccggagcctagaccaccggccagagttgagactctacgagaagaagctcccaccgacctaagggtgttcgagttgaactcagatagtggtaaatctacaccttccaacaatggaaagaaggagacgcgctctcagttcactgtggacttcctatggaagattagtgtgactctgctggagcccctgggtcagagtgcctcccccttatttagcaacctcccgttcccaaggtag

SEQ ID NO: 27053 - DNA, 1293 bp, Artificial Sequence
  Description of Artificial Sequence: Synthetic coding sequence
atggcagaaggagaagatgtggggtggtggcggagttggttgcaacagtcttatcaggctgtaaaagagaagtcctcagaggccctggagtttatgaagcgggatctgaccgagtttacacaggtcgtacaacacgatacggcatgcacgattgcggccaccgcgagtgtggtcaaggaaaaacttgctacagagggatcgagcggcgctacagaaaagatgaaaaaaggactcagcgattttttaggcgtcataagtgacacatttgccccttctcctgacaaaacgattgactgcgacgtgatcactctgatgggaactccctcaggaacggctgaaccgtatgacggcaccaaggcaaggctgtactctctgcagagcgatccagcaacatactgcaacgagccagatgggccaccagagttattcgatgcctggctctcccagttttgtctggaggaaaaaaagggagaaatttcggaacttctcgtcggaagccctagcatccgggcgctgtacacgaagatggttcccgccgcggtctcccattccgagttttggcatcgatacttctataaagtccaccagctcgagcaggaacaggctcgaagagacgcactgaagcagagggccgagcaatcaataagcgaggagccaggatgggaggaggaagaagaggaactgatgggcataagcccaatttcgcccaaggaggctaaggtgcccgtggccaagatttcaacttttcctgaaggtgagccagggcctcaatctccctgtgaggagaatttggtgacctctgtggaaccacctgccgaggtgaccccttcagaaagttcagagtccatctcgcttgtaactcagattgccaatcctgcaacagccccagaggctagagtactgcctaaggacctctctcagaagctcctggaagcttctctggaagaacagggtctggctgttgacgttggcgagaccgggccaagtccccccattcatagcaagcccctgacacccgcaggccatactggggggcctgaacctagacctcccgctcgtgtagagacattgcgcgaagaggcccccacagaccttcgagtctttgagcttaactcggactctggtaagtctaccccttcaaataacgggaagaaggggagtagcaccgatatatcagaggattgggagaaggacttcgatctggatatgaccgaggaggaggtacagatggctctgtccaaagtagatgcttccggcgagctggaggacgtggagtgggaagactgggaatag

SEQ ID NO: 27054 - DNA, 1008 bp, Artificial Sequence
  Description of Artificial Sequence: Synthetic coding sequence
atggctgagggagaggacgtcggctggtggcggagctggctgcaacagagctatcaggccgtgaaggagaaagctaggctgtacagcctgcaatcagaccccgcaacctattgtaatgagcctgatggtcctccggagctcttcgacgcctggcttagccaattctgtctggaggagaagaagggcgagattagcgaattactcgttgggagccctagtatccgagcgctctacacaaagatggtgccagctgctgtttctcacagtgagttctggcaccgctacttctacaaagtccaccagctggagcaggaacaagcacgacgggacgcactgaaacaacgtgccgaacaatccatttccgaggagcccgggtgggaggaggaggaagaggagttaatgggcatttcaccaatctcgccgaaagaggctaaagtgcccgtggccaagatctcaacctttcccgaaggagagcctggcccccagtcaccctgtgaggaaaatctggtgacgagtgtcgagccccccgccgaggtgacaccatctgagtcatctgagagtatctctcttgttacccaaatagcaaaccccgcaacagctccagaagccagagttctccctaaggatctgagtcagaaattgctcgaggccagccttgaggaacagggactggcggtggacgtcggggagaccggcccgtctcctcccattcacagcaagcctctcacacctgccggacacaccggtgggccagaacctcggccacccgctcgggtggaaactctgagagaagaagccccaacagatctgagagtgtttgagttaaactctgattcgggcaaaagcactcctagcaataacgggaagaaaggctcctcaaccgatatttccgaagactgggaaaaggatttcgatttggacatgacagaggaggaggtgcaaatggcactatcaaaagtggatgccagcggggaactggaagatgtggaatgggaggactgggagtag

SEQ ID NO: 27055 - DNA, 1158 bp, Artificial Sequence
  Description of Artificial Sequence: Synthetic coding sequence
atggcttcactgggtcccgctgctgccggcgagcaggcaagcggcgccgaggccgagcctggccccgccgggcccccccctccaccttcgccaagctccctcggccctctgttaccgctgcaacgggagcctctatacaattggcaggccacaaaggccagcctgaaagagaggtttgctttcctctttaattccgagttgttatccgatgtgcgcttcgttctgggcaaggggaggggcgccgctgcggctggcggaccacagagaattcccgcccatagattcgtgctcgccgcggggagcgctgtcttcgatgccatgttcaatggtggaatggctacaacgtccgccgagatcgaattacccgacgtggagcccgccgccttcctggccctgctgagattcctgtactcagacgaggtccaaataggtcccgagactgttatgaccactctctataccgcaaagaaatacgcggttccggcgctggaagcacactgtgtcgagtttcttacaaaacacctcagagctgataatgcttttatgctgctgacacaagccagactctttgatgagccccagctggcaagtctgtgtctggatacaatcgacaaaagtacaatggacgctattagtgctgaaggctttacagacattgatattgacacactttgcgctgtgctagagcgagatactcttagtatcagggaatcgcggctatttggcgctgtcgtgcgctgggccgaggcagagtgccagcgacagcagcttcccgtcaccttcggcaacaagcagaaagtgctgggtaaggcattgagtctgatacggttccccctgatgaccatcgaagaatttgcagccggtccagctcagtcgggaattctgagtgaccgagaagtcgtgaacctgttcctgcatttcacagtcaaccccaagcctcgagtggagtacattgatcgaccccgttgctgtctgcgtggcaaagagtgctgtatcaacaggttccagcaggttgagtcccgatggggatactcaggcacgtccgaccgcattcggagcctgaatatgaggaagagcaaaccgtgggatcgcatgattccagcccttgtcgtaatgggacaactaacccacagtgggagttgttcaagaaacccgtag

SEQ ID NO: 27056 - DNA, 1521 bp, Artificial Sequence
  Description of Artificial Sequence: Synthetic coding sequence
atgataatgagcaacacccataaggcccgcttggaacggagagttacaggcagcactaacagatggaggctgcccaaacaaccctttagcggcgacttgctttctctctcccagatgtgtaaggcactcagcatcgatttcgaggaggccctccggaaccctgaccgcctctgtatctcacagatccaaaagtttttcttcgaaaatttcaaaaacaaagatatccagtccggcgaggctgatgtgatcttggagtgtctgggctttaagtgggaacttcatcagcctcagctttttcagtctgaaacccttgcaaagctgtatctcaaggcattagcccaggggacaacacatcccctgagagaactagaagagctgctgcgagctcaatcacctaaaaagaccaaggagaaatccccagcaaaaaggattattatttcgttaaagattaacgatcccctcgtgaccaaggtggccttcgctactgcccttaaaaatctctacatgagcgaggttgagatcaacctggaagacctgctcggggtcctggcctccgcccacattctgcaattctctgggctgtttcagcgttgcgttgatgtgatgattgccaggcttaagcccagcactatcaaaaaattttacgaagccggatgcaaatacaaagaagagcagttaacgactggatgcgagaagtggctcgagatgaatttggttcctctcggaggcacacagattcatctccacaaaattccgcaagatcttttgcacaaggtgttgaaaagcccacgcctcttcaccttttccgagtttcatctcttaaagacaatgctcttgtgggtatttctacagctcaattacaagattcaggcaattccaacgtatgagactgtgatgactttctttaaatcatttccagaaaattgttgtttcctcgatagggacataggccggtcgctgcggcctctgtttttgtgcctccgcctgcacggcatcactaaaggcaaagatctggaagtgttgagacatttaaatttcttcccggaaagctggttggaccaggtgactgtcaaccactaccacgccttggagaacggcggtgacatggtgcatctgaaagacctcaatacacaggccgtccggttcggcctgctgtttaatcaggagaacacgacatatagcaagaccatcgcactgtatggcttttttttcaagattaagggtttgaaacacgacactacctcttacagtttctacatgcagcggattaaacacaccgatctggaatccccctccgctgtgtatgagcacaatcacgtctctctccgtgccgccaggttagtgaagtatgaaataagagcagaggccctagttgacgggaaatggcaagagtttcgtaccaaccagattaagcagaagtttggactgaccacctcatcttgtaagtcacacactctgaagatccagaccgtcggcattccaatctacgtgagtttcgcatttatatttccggcatcttag

SEQ ID NO: 27057 - DNA, 1524 bp, Artificial Sequence
  Description of Artificial Sequence: Synthetic coding sequence
atgatcatgagtaatacccagcataaagcaaggctggaacgccgcgtgactggttctactaacagatggagactcccgaagcagccattcagcggggacctgctgagcttgtcccaaatgtgcaaggcactgagcatcgactttgaagaagccttgaggaatccggacaggctttgtatttctcagattcagaaattttttttcgagaacttcaagaacaaggacatccagtcaggcgaagcggatgtgattctggaatgtctgggatttaaatgggaactccatcagccacagctattccagagcgagacactagccaagttgtacttaaaagctctcgcacaggggactactcaccccctgcgagagctcgaagagcttcttcgcgcccagtcacctaagaaaacgaaagagaaaagcccggcaaaacgtatcattatttccctgaaaataaatgaccctttagttactaaggtggcattcgcaaccgcgctgaagaacctttacatgtctgaggtcgaaataaacctcgaggatcttcttggcgtgctggcttctgcccatatcttacagttctccggtctgttccagcggtgcgtggatgtgatgatagcacggctgaagccatccacaattaaaaaattttatgaggccggttgtaaatacaaagaagagcaattgacaacaggttgcgagaagtggctcgaaatgaacttagtgcccctaggcggcacccagattcacctccacaagattcctcaggacctgctgcacaaagtactaaaatccccccgtctcttcaccttttctgaatttcacctgcttaaaaccatgctgttgtgggtgtttctacagctgaactacaaaatccaggccatccccacatacgagacagtgatgacattcttcaaatcttttccagaaaactgttgctttttggacagggatatcgggcgcagccttcggccactcttcctctgcttgcggcttcatggaatcacgaaggggaaagatctagaagtcctgcgacaccttaacttcttccccgagtcgtggttggaccaggtgactgttaaccactatcatgccctggaaaatggcggagatatggtgcacttaaaggacctgaacacccaggccgtcaggttcggcctcctcttcaaccaggaaaatactacatactcaaaaacaattgccctctatggtttcttttttaagataaaggggctcaaacacgacaccactagttattccttttatatgcagagaatcaagcacactgacctggaatctcccagcgcggtctacgaacacaatcacgtaagccttcgggccgcacgcctggtaaagtatgagattcgagccgaggcccttgtggatggcaaatggcaggaattcaggactaatcagattaaacagaaattcggcttaaccactagctcctgcaagagccataccctgaaaattcagacagtgggcatcccgatttacgttagtttcgcatttatcttcccagcctcatag

SEQ ID NO: 27058 - DNA, 2139 bp, Artificial Sequence
  Description of Artificial Sequence: Synthetic coding sequence
atgtgttcgcctgcttccccgaagattttatataggaatccacggttccttcgcctggcatttttacagctgcaccaccaacaacagtctgacgtgttttgtgacgtcctactgcaggccgaaggagaagccgtccctgcgcattgttgtattttaagcgcatgtagtccctttttcaccgagcgactggagcgagagagaccagcccagggaggtaaggtagttttggaacttgggggcctgaagatcagcacgctgcgcaagctcgtggatttcctctatacttccgagatggaagtgagtcaagaagaggcacaagacgtgctgagcgcagcgaggcaacttagggtttccgagctggaatctcttcagcttgagggcggtaaacttgtgaaagctccccagggcagaaggttgaacagagaatgtctgcagcctaccagcgcagctccaatatccgctcgagtggtgactcccagtcaccacccgcatacgcctctgcccactaatcagaccccttgcccattgggtgcaatccggctgaagtccttgggcaaagaggagggtccacaggaaaataatcgacagaatgccgacaaccttagcggtactcttctccttaagcggaaggccagggcctgccccactccacaggaaaagaactcaagtccttcttcccactctcaggagccccgtgaaaacaagaatgatactgccttagatccaacggtcctgtcacctccctcactctacccctctgtggataagcacttgctcccaagaaagattcggctgtcacggagcaagccttccccaggaatttgcacttcaaaaccttcgtcaatccttagcgggagttcctcagttcccgcaaccccgggcaggcgcctttggagacagaggtcggtcaataaagaaacccctgaggataaacctaaacctggccgtgcctctccactgcagtccacaccgaatccctctggcctagggaagactgggggaagccggaaaaggtcccctgaagttcgagctccgaactctgattctgcagaggaggggcaagtcggccgggtgaagctgagaaaaatcgtgaacggcacctgctgggaagtcgttcaggagactccgctgaagaatacccaggacagcccccagattccagatcccggcggcgatttccaggaaccttctggtactcagcccttctcctccaacgagcaggagatgtctcccacaaggacagaactttgccaggatagtcccatgtgtacaaagctgcaggacattctggtttcggctagccactcccctgatcatccggtggtaaaatcggagtttgagagtagccctgagctggtggaaaaggaaccaatgctggctattgactgtcgtgagccatatgcctttgacactgcccttctggaacagccatgcgaggccgaggagtaccgcatcacgtctgcagcagcaacatcggagctggaggagattctcgacttcatgctatgtggttccgacatcgagccccctatcggatccctggagtcacctggtgcagaagggtgtcgaacccctacttaccatttgacagagaccggcaagaattggattgaaggtgaggaatggtgtctgcccgacatggagctgtggccccgcgagctgaccgagctggaaaaggagccagccggcgagaaccggggtcccaccgaactcttaagccctctcgttatgcctagcgaggtatccgaagtgttatccgtaggcgggcgatggactcctgacttggagattacgtcaagccagcccttagacgggcaagaggacaagctactgcacgtgtcctcactggacacccctcaacggtcctacggagacctttcgccaccttgcagcaattgggtggaaactggactggaggtttccctgaccaccgatgagctgttgtatccgtcccccaaggcgggtaaggaagtgtcaggccattctgagctgctcggctcactccctgctagcagcgaggaagaagagatcgatgtggtggactggacagccgagggcaggctcgtaccgaccactgtgccgtcagtttggccagaccccagctcagagagtgagaccgaagtggatatcctgacttag

SEQ ID NO: 27059 - DNA, 2139 bp, Artificial Sequence
  Description of Artificial Sequence: Synthetic coding sequence
atgtgctctcctgcttctcctaagatcctataccgcaatccacgattcttacggctggcttttctgcaactgcaccaccagcagcagtctgacgttttttgcgatgtgctcctgcaagctgagggcgaggcagttccagcccactgctgcatcctttctgcctgttccccttttttcacagagagactagaacgagagcgaccagcacaagggggtaaagttgttttagaattgggcggcctcaagattagcactctgcgcaagctcgttgacttcctatacacctcagagatggaagtttcacaggaagaagcacaggatgtgctgtcggccgccaggcaactgcgggtgtccgagctcgagagtctgcagcttgagggcggcaaattggtcaaggctccgcagggccgccggctcaacagagagtgcttacaaccaacgtccgccgcccctatttctgctcgcgtggttaccccaagccaccatccacacactcccttaccaaccaatcaaaccccttgcccactcggagcaattcggctgaagagcttaggtaaggaggaaggcccgcaagagaacaaccgacagaacgcagacaatttgagcggtaccctgcttttaaaacgcaaagcccgcgcctgccctacacctcaggagaagaatagttctccttcaagccattcacaggagccgcgcgagaacaagaacgacacggccctggatccaacagtactctctcccccatcattgtacccaagtgtggataagcatctccttccgcggaaaatccggctttctaggtcaaaacctagccctggaatctgtactagcaaaccaagctcgatcttatcaggcagcagtagtgtcccggccacccccggccggaggttgtggcgacagagaagcgtcaacaaggagactcccgaagacaagcctaagccaggtagggcctcccctctgcagagcaccccgaacccttccggccttggaaaaacagggggaagtcgcaaacgctctccagaggtgcgggctcctaactctgacagtgcggaagaagggcaggtgggccgggtcaagctccgcaaaattgttaacggaacttgttgggaggtggtgcaggaaacccccctgaaaaacactcaggactctccgcaaattccagacccaggcggagactttcaggagccgagcggcacccaacctttcagctccaatgagcaggagatgtcccctacacgaactgagctatgtcaggacagccccatgtgtactaagctgcaggacatactagtatctgccagccacagcccggaccaccccgtggttaaaagcgagttcgaaagttcaccggaactcgttgagaaagaaccaatgctggctattgattgtcgagagccttacgcctttgacactgctctgctcgaacagccctgcgaagccgaagagtatcgaattaccagcgcggccgcaacgtcagagctggaggagattttggacttcatgttatgtggcagcgatattgaaccccctatcgggtcattggagtcgcctggcgcggaggggtgtcggacccctacataccacttgacagagactgggaagaattggatcgagggggaagaatggtgtctgccggacatggagctctggcctagggagctcaccgagttggagaaagagcctgccggagaaaatagggggcccactgaattactgagtccactcgtaatgccatctgaggtatccgaggtgctctctgttggcggaaggtggactcctgatctcgaaatcacttcatcccagcccctcgacgggcaggaagacaagctgttgcatgtgtcctctctggatacgcctcagcgatcctacggagacctgagccccccgtgtagtaactgggtagaaactggacttgaggtctctttgaccaccgatgagcttctgtatccttcgcccaaggctggaaaagaagtgagcggccacagcgagctgctgggatctctgccagctagctctgaagaggaggagatcgacgtggtggactggacagcagagggtcggctcgtcccaactaccgtgccatcggtctggccagatcctagcagtgagtccgagaccgaggttgacatcctgacatag

SEQ ID NO: 27060 - DNA, 270 bp, Artificial Sequence
  Description of Artificial Sequence: Synthetic coding sequence
atgtgtagcccggcatccccaaagatcctctacaggaacccacggtttctgcgattagccttcttgcaactccaccaccaacagcagtcggacgtcttctgtgatgtgctgctccaagcggagggcgaggctgtgcccgctcattgctgcattctgagcgcctgcagcccgttcttcaccgagagactggagcgcgaacggccagcacaaggcggcaaagtggtgcttgaactgggaggcttaaagatctctactcttcgcaagctctag

SEQ ID NO: 27061 - DNA, 876 bp, Artificial Sequence
  Description of Artificial Sequence: Synthetic coding sequence
atggaacccctgggcctagtagttcacgggaaggccgagcctttctccgcggccctcagatcactggtgaacaacccacggtactcggatgtgtgctttgtcgtgggacaagaacggcaggaggtttttgctcaccggtgtctgctcgcttgcagatgcaatttcttccagcgcctgctcggcacagaaccgggcccgggcgtgccgtccccagtggtgctgtccaccgtacctactgaggccttcctggccgttctggagtttctctacacgaactcagtgaagctgtatcggcactctgtgctggaagttctgacagcagccgtagagtacggattggaggaactgcgggagttgtgtctgcagttcgtggtgaaggtccttgatgtggatctcgtgtgtgaggccctccaggtggccgttacctttggcctgggtcagctccaggagcgctgtgtagctttcatagaggcacacagtcaggaggctttgcgtacgcggggcttcttggaactcagcgcagccgcactcctgcccctgctaagaagcgacaaattgtgcgtggatgaggccgaactggtccgagccgctagatcatgggcccgtgttggagcagccgtcctggagcgacccgtcgccgaagtcgccgcacccgtagtcaaggagttgcgccttgctctgcttgcacctgctgagctatctgctctggaagaacagaaccgccaggaaccgctaataccggtggagcagatcgtggaggcctggaagtgccacgccctgagaaggggagatgaggccaggggagccccctgccgtcgtcgccgggggacgctccctagagaacatcatcgtttccttgacctgtccttcaagtag

SEQ ID NO: 27062 - DNA, 489 bp, Artificial Sequence
  Description of Artificial Sequence: Synthetic coding sequence
atggagccgctgggtctggtagtgcatggtaaagctgagccgttcagcgcagcgcttcggtccctggtcaataatcctcgttatagcgacgtgtgctttgtggtggggcaggagaggcaggaggtgttcgcccacagatgtctattggcatgccgttgtaatttctttcaacgactgttgggcactgagcccggccctggcgtcccatcgcctgtggtgctgagtacagtgcctacagaggcgttcctcgctgttctggaattcctgtacaccaactcggtgaaactgtacagacatagcgtgttggaggtgctgacagctgctgttgaatacggccttgaagagctccgagaactgtgcctgcagtttgtggtgaaagtcctagatgtggatctggtatgcgaagctctccagcatttctggaggccccggagagccgatcaggaggtgcgcaggtcacggccatcctggttaaccagatggccctag

SEQ ID NO: 27063 - DNA, 1386 bp, Artificial Sequence
  Description of Artificial Sequence: Synthetic coding sequence
atggcggctgacattttcccacgcaaaaaacccgcaaactcttcgtcaacctctgtgcagcaataccatcagcagaacctgagtaacaataacctcatccctgcccctaactggcagggcctgtacccaacaattagagaaaggaatgcaatgatgtttaataatgatctcatggcggatgtccatttcgtggtgggacctccgggcggaacccagagacttccgggacacaaatacgtgctggccgtcgggtcaagtgttttccacgcgatgttttacggagagctcgcggaagataaagacgaaattaggatacccgacgtagaacccgccgcctttctcgccatgctaaagtacatttattgcgacgaaattgacctggcagctgataccgttctggctaccctatatgctgctaagaaatacatcgtgccacatcttgcacgagcctgtgtgaactttctcgagacctccttaagcgctaagaacgcatgtgtactactttcacagtcatgcctatttgaggagccagatttgacccaacgttgctgggaggtgatcgatgcacaggccgagctagcactaaagtcagaaggcttttgtgacatcgatttccagactcttgagtccatcctgaggcgagaaacactgaacgccaaggagatcgtcgtgtttgaggccgctctgaactgggcagaggtggagtgccagaggcaagatttggcgctctccatagaaaataaaaggaaagtgctgggaaaggcactttatctaattcgcatcccaacaatggctctggatgacttcgcgaatggcgccgctcagtctggagtcctgacattaaacgagacaaacgatatattcctctggtatacggccgccaagaaaccagagctacagttcgtgagcaaagctagaaagggcttggtgccccaaaggtgccatcggtttcagtcttgtgcttatcgatctaaccaatggcgctaccgagggagatgcgatagcatccagttcgcggtggataagagggtttttatcgctggcttcggactttacggctcatcttgcggtagtgctgaatattcggctaaaattgagcttaagcgccagggagtggtccttggacagaacctgagtaaatatttttctgacgggtcttctaatacatttccggtgtggttcgagtatcccgtgcagatcgagcctgacacattttatacagcctcagtgattctggacggcaacgaactgtcttatttcggccaagaaggcatgaccgaagtgcagtgtggcaaagtcactgttcagttccagtgctcctccgacagcactaacggcaccggagtccaggggggacaaatccccgagctcattttctatgcatag

SEQ ID NO: 27064 - DNA, 1569 bp, Artificial Sequence
  Description of Artificial Sequence: Synthetic coding sequence
atggtcgatgacaaggaaaagaatatgaaatgcttgacgtttttcctcatgctccctgagacagtcaaaaacaggtccaagaagtccagtaagaaagccaataccagttctagctctagtaattcgtctaaactcccgcccgtgtgttacgaaattatcactttgaagactaagaagaaaaagatggccgcagatattttccccaggaagaagccagccaattccagctctacaagcgtacagcagtaccaccagcagaacctgagtaacaacaatctgattcctgcacctaattggcagggcctgtatcctactatccgcgagcgcaacgctatgatgtttaataacgaccttatggcggatgtgcacttcgtggttggaccccctggtggcacacaacggctccccggccacaagtacgtcctggccgttggctcaagtgtttttcacgcaatgttctacggagagctcgctgaagacaaggacgaaataagaatccctgacgttgaacctgcggcgtttttggctatgctgaaatatatttactgcgacgaaatcgaccttgccgcggatactgtgcttgcaactctgtacgccgccaagaaatacatagtgccccacctggcgcgtgcatgcgtcaacttcctggagacctccctgtcggcaaagaatgcttgcgttttgttgtctcaatcctgtctgttcgaggagcctgacctgactcagcgctgttgggaggtcattgacgctcaggcggagctggccctcaaatctgaggggttctgtgacattgatttccagacgttggaaagcatcttgcggcgggagacactgaacgctaaagaaattgtggtgtttgaggccgctctcaattgggctgaggtcgaatgccagcgtcaggacctggctttaagcattgagaacaagaggaaagtgttaggaaaagcgctttatttaattcgcatcccaactatggctctggatgatttcgcgaacggcgccgcccagtctggagtgctgacccttaacgaaacaaatgacatctttttatggtatacagctgctaaaaagcctgaactgcagttcgtcagcaaggcaaggaaagggctcgtacctcaaaggtgccatagatttcagtcatgcgcatatcgtagcaaccaatggaggtatcggggccgctgcgactcgattcagttcgcagtggacaaacgggtgttcatagcgggctttggactctacggatcatcttgtggatcggccgagtactctgcaaagattgaactcaaacggcagggcgtggttttagggcaaaatctaagtaaatatttctctgatggctccagcaatacattccctgtatggtttgaataccctgttcagattgagcctgacaccttctacaccgcatccgtaattcttgacggaaacgagttgtcatacttcggacaggaaggaatgacggaggtccagtgcggtaaggtaaccgtgcagttccagtgcagcagcgactccacaaatggaacaggagtgcaggggggtcaaattccagaattgattttctacgcctag

SEQ ID NO: 27065 - DNA, 1386 bp, Artificial Sequence
  Description of Artificial Sequence: Synthetic coding sequence
atggccgctgacatatttcccaggaaaaaaccagcaaactcttcttccactagcgtccaacagtatcatcagcaaaacctctctaataataacttaattccagccccgaattggcagggactttacccaaccatcagagagaggaatgctatgatgtttaacaatgatctcatggccgacgtccacttcgtagtggggcccccgggcggcacacagcggcttcccggacacaaatacgtgctcgccgtgggaagttcggtgttccacgcaatgttttatggcgagctggcggaggataaggacgaaataagaatcccggatgtagaacccgcggccttcctggccatgcttaaatatatctactgtgacgagatcgacctcgctgcagacactgtccttgccaccctctacgccgccaaaaaatacattgtgccacatctcgctcgagcctgtgtgaattttctcgagacctcattgtctgccaagaatgcctgtgtgctgctgagccagtcgtgtctgtttgaagagcccgacctgacccagagatgctgggaggtcatcgatgcgcaggctgagctggctctcaaatcagagggcttctgtgacattgatttccagacactggaatccattctgcggcgtgaaacgttaaatgccaaggagatcgttgtattcgaggctgctctgaactgggccgaagtggagtgccagcggcaggacttagcactcagcatagagaacaagaggaaagtcctgggcaaagcgctgtatttgatcagaattcccaccatggccctggacgactttgcgaatggcgctgcacagtcaggggtcctgaccctgaacgagaccaacgacatctttttgtggtatactgccgccaagaagccagaattgcaattcgtctcaaaagcccggaagggactggtaccccagcgttgtcaccgcttccaatcatgtgcatatcgatccaaccagtggagatatcggggccggtgcgattccatccaatttgccgtggataagcgggtgtttatcgccggctttggcctgtacggctcctcttgtggctcggccgaatactccgccaaaattgaactgaagcgacagggagtcgttttgggccaaaacctaagtaagtattttagcgacggatcttcgaatacattccccgtttggtttgaataccccgttcagattgagcctgataccttctacacagcgagtgtcatcttagatggaaacgaattatcatatttcgggcaagagggcatgaccgaggttcaatgtggcaaggtcactgtgcagtttcaatgctcatcagactcaacaaacggcacaggggtacaaggaggccagatccccgaacttatcttctatgcatag

SEQ ID NO: 27066 - DNA, 1569 bp, Artificial Sequence
  Description of Artificial Sequence: Synthetic coding sequence
atggtcgatgataaagagaagaacatgaagtgtctgacgttcttccttatgttgccagagaccgtcaaaaaccggagcaagaaatcgagcaagaaagctaataccagttcaagcagctcaaacagcagtaaattgcctccagtgtgttatgagattatcacattaaagaccaagaaaaagaagatggccgccgatatcttcccgagaaaaaaacccgcaaattcctctagtacctctgtccagcagtatcaccagcagaaccttagtaataataatctcatcccagcacccaactggcaggggctctatcctacaataagggaacgtaatgccatgatgtttaataacgatctaatggctgatgtccacttcgtggttgggccaccaggtggtacacaaagattacctggacacaagtacgtgctggccgttggatcttcagtgtttcacgcaatgttttatggggagctggcggaggacaaggatgagatcaggattccggatgttgagcctgccgcttttctggctatgttgaagtatatatattgtgatgagatagatctggcggcggacaccgtccttgccaccctgtacgccgctaagaaatatatagtcccccatctagctagagcatgcgtgaacttccttgagactagcctctccgccaaaaacgcttgtgtcctcctaagccagtcctgtttatttgaggaacccgaccttacacagcgatgctgggaagttattgatgctcaagcagagctcgccctgaaatcggaggggttttgcgacattgattttcagacattggagtctatcctgcgccgggaaacgcttaatgccaaggaaatcgtagtgttcgaggcagcgctcaattgggctgaagtggagtgtcagaggcaggatcttgcgctgagcatcgaaaacaagaggaaggtgctgggtaaagccctctatctgattcggattcccactatggccctggacgacttcgcaaatggagccgcccagagtggcgttcttacacttaacgagacaaacgacatcttcctgtggtacactgctgccaagaaaccggagttacagtttgtgtccaaggctcggaaggggttagtgccacagcgatgccaccgatttcagtcgtgcgcctatcgatcaaatcagtggaggtatcgcggcaggtgtgattctattcagtttgccgtggacaagagggtattcatcgccggatttgggttgtacggctcgagttgcgggtccgctgagtattcagcgaagattgagctgaagcggcagggagtagttctcggtcagaacctaagtaaatatttctccgatggctcttcaaacacatttcctgtgtggtttgagtatcctgttcagatcgagcccgacaccttttatacagcgtccgtgatcctcgacggtaatgagctgtcatactttgggcaggagggaatgacagaggtccagtgcggtaaagttactgtacaatttcagtgttcctcggactctactaacggtacaggtgtccaaggaggccagataccagagctgatcttttatgcctag

SEQ ID NO: 27067 - DNA, 411 bp, Artificial Sequence
  Description of Artificial Sequence: Synthetic coding sequence
atggccgctgacatctttcccaggaaaaaacccgccaactccagctccacctccgttcagcagtaccatcaacaaaatctcagtaacaacaacctcatccccgctccaaattggcagggtctgtatccgaccattagggagcgaaacgcgatgatgttcaacaatgacctcatggcagacgtccatttcgttgtgggcccgccgggcggaacacagcggctccctggccacaagtatgtactcgcagtcggctcctccgtcttccatgctatgttctatggcgaattggccgaggacaaagacgagatccgcatccccgacgtggaacccgccgcgtttctcgctatgctgaaatacatttattgcgacgagattgacctggccgctgacactgttttggccactctctag

SEQ ID NO: 27068 - DNA, 9 bp, Artificial Sequence
  Description of Artificial Sequence: Synthetic coding sequence
atggcctag

SEQ ID NO: 27069 - DNA, 1860 bp, Artificial Sequence
  Description of Artificial Sequence: Synthetic coding sequence
atggccgctgcgcctcccctgtccaaggccgaatacctcaaacgctatctgtcaggagctgacgccggcgtggaccggggttctgagagtggcagaaaaaggaggaaaaagcgacccaaaccaggcggggcagggggtaaagggatgcgtattgtggatgatgatgtttcctggactgccatctccactaccaagctggaaaaagaagaagaggaagacgacggggatctgccagtggtggccgaatttgtggacgagagacctgaagaggtcaaacagatggaggcttttcgcagctccgccaagtggaaactcctgggcgggcacaacgaagatctacccagcaaccggcacttccgccacgacaccccggacagctccccccgtagggtgagacacgggactccggacccatctccccgtaaggatcgccatgatacaccagaccctagccccaggcgggccagacatgacactccagaccctagtcccctgagaggcgctagacacgatagcgacacgtccccccctaggcgaatcaggcatgatagcagtgatacctccccacccagacgggccaggcacgactctcctgacccgagccccccacggcggccccagcataatagtagcggagcctccccacgacgggtgcgccacgactccccggaccccagcccaccccggagagcccgccacgggagttccgacattagttctccaagacgcgtacataataacagcccagacacgtcaagacgcacgctcggaagtagtgatacccagcaactccgccgggcccgccatgatagccctgatctcgcgcccaacgttacctactccttgccaagaaccaaatccggaaaggctcccgaaagggcgagcagtaagacgagcccccactggaaagaaagcggagccagtcacctgtctttccctaaaaattcaaaatacgagtacgaccccgatatcagccccccgcggaagaagcaagccaaatcccatttcggggacaagaagcagcttgacagtaagggcgattgccagaaagccacagacagtgacttatcctcaccgaggcacaaacagagtcccggacaccaggacagcgactccgacttgtctcccccgcggaaccgaccgcgacatcgctcttcagacagcgacctctcaccacctcggaggagacagaggacaaaaagtagcgatagtgacttgtcaccacctaggagaagccagccgccagggaagaaagccgcacacatgtattccggagctaagaccggcctggttttaactgacatccagagggagcagcaggagttgaaggaacaggaccaggagaccatggcgttcgaagctgaattccagtatgccgaaactgtttttagagacaagtccggccggaagagaaatctgaaactggaaaggctggagcaacgccggaaggctgagaaggattctgaacgagacgaactctatgctcaatggggaaagggcttggcccagagccgccagcagcagcagaatgtggaggatgccatgaaagaaatgcagaagccactggcaagatacatagacgacgaagatcttgacagaatgctgcgggagcaggagcgagagggggatccaatggctaattttatcaagaagaataaggctaaggaaaacaaaaacaagaaagtacgccctcgctactccggcccagcgccacctccaaatcgatttaatatatggccaggataccgttgggacggagtagatagatcgaacggattcgagcaaaagcgctttgcccggttagcttccaaaaaagctgtggaggaattggcctataaatggtccgtggaagacatgtag

SEQ ID NO: 27070 - DNA, 1458 bp, Artificial Sequence
  Description of Artificial Sequence: Synthetic coding sequence
atggcggctgctcctccgctgtcaaaagcagagtacctaaagaggtatttgtcgggcgccgacgctggtgttgaccgcgggtcagaatcaggcaggaaacggagaaagaagcggccgaagcccggtggggccggcggcaagggtatgagaattgtggatgatgatgtgtcgtggacagccatctccaccaccaaacttgagaaggaagaggaggaggacgacggcgacttacctgtcgtggccgaattcgtagatgagcggccagaggaagtcaagcaaatggaagcgtttaggtcctccgcaaaatggaaactgctcggtggtcacaatgaagaccttccttcaaaccgccacttccgtcatgataccccagatagctcgccaaggagggttcgacacggtacgcctgacccctctccaaggaaagacagacatgatactccggatcctagccctcgccgtgccagacatgacacgcccgaccccagcccgttgaggggagcgcggcatgattctgatacttctccaccaaggcgcatccgccatgatagttcagacaccagcccacctaggcgggcccggcatgatagccctgacccgtccccccctaggaggccccagcataactcctccggagactgtcagaaggccaccgattccgacctgtccagccctcggcacaagcagtctcctggacatcaggactccgactccgacttgtctccccctcggaatagaccaaggcataggagctccgacagcgatctgagccctcccaggaggagacaaagaaccaaatctagtgactcagatctgtcgccacctaggcgatctcagccaccaggcaagaaggcagcccatatgtacagcggggccaaaaccggtctcgtactgaccgatatccagagggagcaacaggagctcaaggaacaagaccaggaaaccatggcatttgaagcagaatttcagtacgccgaaaccgtgtttcgagataaaagcggccgcaaacggaatctcaaactcgaaaggttggagcaacggcggaaggccgagaaggactcggagcgcgatgagctttatgcccagtggggaaaaggccttgcacagtcacgtcaacagcaacagaatgtggaagatgcaatgaaagaaatgcagaaaccactagcccggtacatcgatgacgaggacctggaccgaatgctccgcgagcaagagcgagagggggacccaatggccaattttatcaagaagaataaggccaaggagaacaaaaataaaaaggtgagacccaggtactccggcccagcaccccctcccaatcggtttaacatttggcccggctacaggtgggatggggtggacagatcaaatggctttgaacagaaaagattcgccaggctggcttctaaaaaagcggtggaggaactggcatacaagtggagcgtcgaagacatgtag

SEQ ID NO: 27071 - DNA, 600 bp, Artificial Sequence
  Description of Artificial Sequence: Synthetic coding sequence
gccccaggacgcttggcatccagaccgcctccaccaccagcacggaggtggaggttggctgcccctcggtatagcagtgcatctggccctagcgggcccgctgctcgtctgtgcgccgagacgcagggcgaggcacccagaggcccacgtgcagtggggggttccggcggtgctggcgaaccccggtggtcgcggggccctgcacaacgcgaacgcttgcttgggtgctcctgctgtttccctagttttttcacagggacctgctcattccggacttcatggagcgcattcactttagagctgacttcttccatccccgcccctctacctccgcctcccgctgctctgtcattgtcacaacagcagggaaaaagcagacgcaaggaagcgtcaactccactgacccccgcggaggcccccgcttactcccgtgcaaggccaaggagacagggcagcccgtctgcgggcccagaggcccctctggcaacggacgaaccaccgcctcaacgacggtctggaatccgtggtggaagcgcaaatattagatctctccaaccaagttcattgcggccttccgcacacagaggaagtgcgttgtag

SEQ ID NO: 27072 - DNA, 1185 bp, Artificial Sequence
  Description of Artificial Sequence: Synthetic coding sequence
atgtctagaatttaccatgacggtgctctccgcaacaaggccgtgcagagtgtgcggcttcctggagcctgggaccctgccgcacatcaagggggaaacggcgtgcttctggaaggcgaattgatagatgtgtctcgccactcaattctcgacacccatggcaggaaggagaggtactacgttctatatatccgtccttcccatatacatagacggaagttcgatgccaaaggcaatgagattgagcctaacttctccgccacccggaaagtcaacactggatttcttatgtcctcctataaggtagaggcaaaaggcgataccgacaggctaaccccagaggctttgaagggactcgtcaacaaacccgaactgctggcactcacagagtccctgacacccgaccatacagtggccttttggatgcccgaatccgagatggaagtgatggagctggagctgggtgcaggcgtgcggctcaaaaccagaggggacggacccttcctcgacagcctggccaaactggaggctggaacagtgactaaatgcaattttacaggagacggcaaaacaggtgcttcctggacagataacatcatggcacagaagtgctccaagggcgctgcggccgaaatacgggagcaaggtgacggcgctgaggatgaggagtggcctgaagaaattcagcagcagatcgtacgggaaacttttcatctggtattgaagcgcgacgataacatttgtaactttctcgaaggtggctctctaatcggcggatccgattacaaattaatctaccgccactacgctactctgtattttgtgttttgtgttgacagttcagagtccgagttaggcatattggatttgatccaggttttcgtggagactctcgacaagtgcttcgaaaacgtgtgtgagcttgatctgatctttcacatggataaagtgcattatattctgcaggaggtggtcatgggtgggatggtactggaaacaaacatgaacgagattgtagcccagatcgaggctcagaatagactggaaaaatcggaggggggcctgagcgcagcgcccgcccgcgcggtctcggccgtgaagaatattaacctccccgaaattcctagaaatattaacatcggcgatctcaacatcaaggtcccaaacctctcccagtttgtctag

SEQ ID NO: 27073 - DNA, 1176 bp, Artificial Sequence
  Description of Artificial Sequence: Synthetic coding sequence
atggccggttctatggttaccccgctgctgtataggcgcaagcttcggcccggcgaaagaaagatgcgccctgaggtaggcagggagcccgctgcactccagcccagacaaagacctcgctccgatcaccagctgcatcgatcccccttcacggtaccacccagaacaccagcctgccgttcccctggcccgtcccccccaattgccgtagcattggaagtgaaaccccagcttgaggacgctgtcggcaagctggccgcagaggccgtggctgtacgggtgttcccattggcagttgatgatctcgaatcagatgtgctggtcggcagacctcgggtggaggcccaagacggagaaattttagtggtaggagctggactccaggaagttctgggtcgaggagctttagtcgatgaggtcggagtggaagatgttgagctcgtatcactgcacgatcttggacgctgggtggtcaaggtggtggtacgcctcgttgttcttgtgcctctggaagctcgcgtgcacgccgtcgaagaggctagattggcgtggcccgtcttagtgggcccacaggtcgggctggctggcgaatggcatctccatgctgaactccgactggttttagctcacgccctgctcggacccccagaagaagacgtgttaggcgcactcgcaggggtctccagggacctggaattacttgcccgcgagctgcaggcgctccaagtgttgattaggtttcaacacgttcgggtccagtggcagctcgtgcgcagggaacagccgcgcgccgtaccggccggtgtcgtggtggtgcaggcacttttagaccaggttctcttgcatgagcaccgcctggcactggctctcgccctgaccgtaccagtggcagtggcactttgccggggtcgggcagtacacctcggtctgcgtggcgcagccctgcgaggaggtcccgggcggggtgggcgccgcgtgttaaggcttcaagcggcggctggcgggctcggcctgctgctagaggacggtgaacagagattggcgctccatgcactgttacttctgcagttcgttcaactgttacctcagcacgtgttagtggccttgactcagccatcagctcaccgcgcaagagccatgtgggccaggagttgctgtcggcgcctgtctcaatag

SEQ ID NO: 27074 - DNA, 1062 bp, Artificial Sequence
  Description of Artificial Sequence: Synthetic coding sequence
atgtggctgctcgaaaaagctggctataaagtcggcgcggctgagccagctgcacgctgggctccttctggactattctcaaagcgtcgagctcccgggccacctacgtcagcctgtccgaatgtcctgacacctgataggataccgcagttttttattccgccgaggctaccggatcctggcggcgcggtacccgccgcccggcgacacgtggcaggtcgagggctgccggctacctgcagcctgccacacctagctgggcgggaagggtgggcctttctccctgaatcccctcacacaaggagaagagagagcctgttccacggccccccacctgcccccgcgggaggactccctgctgcccagtctcgtttacatgtgtcagctcctgaccttaggctatgtcgggctcccgattccgacaccgcgagttccccagacagctcgccgtttgggtcacctcggcctggactgggcaggcgcagggtgagtcgtccccactcactttccccagaaaaagcatcgagcgcggacacatcacctcattcaccgagacgagccgggccaccaacccccccactgttccatctggactttctctgttgccaactcagacccaccagggagtccgtactgcgtctcggacctaggggtggccagctaagactctctactgaataccaagccggccctgggagactccggttgcggctcgtctcggccgagggtctgccgcgtcccaggagtcgcccggggtccggggggggcgggtgctgcgtcgttctccggctgaggcctagagtaagacctagggaacagcaatctagagtggttaaatgtagtgccaacccaatctttaacgaggacttcttctttgacggactgggtccccccgatcttgcagcccgttccttgcgtgcgaaggtgctcgataggggagccggtctacgccgcgatgtgctgctgggagagtgcgagactccgctgatagccctgcttccacctttgggggggggccttggccccggaagtagcctggctcccacacatctctctctctag

SEQ ID NO: 27075 - DNA, 2124 bp, Artificial Sequence
  Description of Artificial Sequence: Synthetic coding sequence
atggaccccggctggggacaacgagatgtgggatgggccgctctgctgatcctattcgcagctagtctcttgaccgtattcgcttggttgctgcagtacgcacgagggctttggctggccagagctcgtggtgatcgaggaccggggccagccttggccggggagccagccggcagtctgcgagaacttggagtgtggcggtctctgctgagactgcgtgccacccgggccggagccgcagaggagccaggtgtccggggtctgctcgcatccctatttgcatttaaatcatttcgcgagaactggcagcgagcctgggtgcgggcccttaacgaacaggcctgccgaaacggatcaagcatccagatagccttcgaagaagtgccccagctgcctccacgggcttccatatcacacgtgacatgcgtggatcaatcagaacacaccatggtgctgcgctgtcagctgtctgccgaggaagtccgcttccctgtcagcgtgacacaacagtctcctgcagctgtttcaatggaaacttatcatgttaccctgaccttgcctcccactcaactggaagtgaacctggaagagatacccggggagggcctgcttatctcctgggcatttacagataggcctgatttaagtttgaccgtgctcccgaaactgcaggccagagaaaggggagaagaacaggttgagctttccaccattgaggagttgattaaagacgccattgtgtcaacgcagcccgcgatgatggtcaatctgcgagcctgttcagcccctggcggcctggtacctagtgagaaacctcctatgatgccccaggctcagcccgccattcccagaccaaacaggctctttctgcgacagctgagggcgtcccatctcggcaacgagctggagggaacagaggagctttgctgcgtcgcggagttggacaacccgatgcagcaaaagtggactaaaccagcacgggcaggtagtgaggttgaatggacggaggacctcgcgctggatctaggcccacagtctcgagagttgacattaaaggtgctccggagctcatcctgtggagatactgaacttttagggcaagcaaccctgcctgtcgggtcccctagtcggccactttctaggaggcaactgtgtcccctgacaccaggcccgggcaaggcactcgggcctgccgccacaatggccgtggagttgcactacgaagagggctcaccacggaacctcggaacacccacctccagtacccctcggcccagtatcacccccacaaaaaaaatcgagctggaccgaaccatcatgcctgacgggaccatcgtgactacggttacaacagtgcagagtaggccacggattgatggcaagctcgatagcccttcaaggtccccatcgaaggtagaagttacagagaaaaccaccactgtcctctcagagagtagtggccccagcaacaccagccactcctccagccccggggatagccacctgtctaacgggttagatcccgttgcggaaaccgccattagacagctgacagaaccatcaggaagggtcgccaagaagactcccaccaagcgcagcaccctcatcataagcggagtgtcaaaagttcctatagctcaggacgaacttgctctttccttgggttatgcagccagtcttgaagccagcgtgcaagatgacgccggcacttccggaggaccgtcctcccccccttccgaccctcccgccatgagtcccggcccccttgatgctcttagttcacctacaagcgttcaggaggccgacgaaactacacgcagcgacatttcggaaagaccctccgtggatgacattgaatctgagacaggctcaacaggcgccctggaaactcgtagtctgaaggaccataaggtttcattcttgcggtccggcactaaacttatcttcaggcggagacctaggcagaaggaggccggtctgtcacagagccatgacgatttatctaacgctactgctaccccgtctgtccgcaagaaggccggtagttttagccgccgactgatcaagcgctttagctttaagagcaagcctaaggcaaatggtaatcccagtccgcagctgtag

SEQ ID NO: 27076 - DNA, 840 bp, Artificial Sequence
  Description of Artificial Sequence: Synthetic coding sequence
atgatcaatcagctgacgggcactatccaggtggcacagcgcatcgatagggatgccggcgagctccgccagaatccgacgataagtctggaagtgctagttaaggaccggccttacgggggccaggagaaccggatacaaataacctttattgtcgaagatgtgaatgataatcccgcaacttgccagaaatttacttttagtatcatggtgcctgagcggacagctaagggcactctgctgctggacctgaacaaattttgctttgatgatgattctgaggccccgaacaatcgatttaactttaccatgccaagcggggtggggtccggctccaggttcctacaagaccccgcaggcagcggtaaaattgtcttgatcggggacttggattatgaaaaccctagcaatctggctgcgggcaacaaatatacagtgatcattcaagttcaggatgtggctccaccatactataaatccaaatacaatgtgtacgtgtatattctcacctctccagagaatgaatttcctctgatttttgaccggccttcatacgtttttgacgtgtccgagcgaagaccagcccagggccacttgagcggtcctgaagagaaacggctcctttctatttgcatggtgagggccgtttgtcaccactttggattacatattgcaagtggcagcccccgcgtgccaggcagaccgattggacagagtcacccacaaacgctccccctgcaggattgggaggaacagggtacctcagttagagagatccctaacgaagactgtcgggaacgtcggcggggggggaactatcccgacgagcattatctctag

SEQ ID NO: 27077 - DNA, 957 bp, Artificial Sequence
  Description of Artificial Sequence: Synthetic coding sequence
tatacagttctcgaggagttatctccaggcaccatcgtggctaacataacagccgaggacccagacgatgaaggcttcccaagccacctcttatactcaatcactaccgtgagcaaatacttcatgatcaaccagttgacaggcaccattcaagtggctcagcgaattgacagagatgcaggggaacttcggcagaaccctacaatcagtctggaggtgctcgtcaaggatcgcccatatggcggccaagagaacagaatccaaataacctttattgtcgaggacgtgaacgacaatcccgctacgtgccaaaaattcacattttcaataatggtgcctgagcgaacagcgaaaggtaccctgcttttggatctcaacaagttctgttttgatgacgacagtgaagccccaaataaccggtttaattttacaatgccctcgggggttggcagtggttcgaggtttttgcaggatcccgctgggagcgggaagatcgtgctgattggtgacctggattatgagaacccatccaatctcgcagcgggtaataaatatacggtgatcatccaggtccaggacgtggctcccccttactacaagaataatgtttacgtgtatatccttacttcacctgagaatgagttcccactgatattcgacagaccgtcctatgttttcgatgtgtccgagcgcaggccagcgcagggacacctgagtggtcctgaagagaagcgacttctgagtatctgtatggtccgtgccgtttgccatcatttcggcctacacatagccagcgggtccccgagagtcccaggtcggccaatcggtcagtcgcacccccaaactctgccactccaggattgggaggagcagggcactagtgacaaggagagaagaaacgaggattgcagggagcgcaggcgcgggggaaactacccggatgagcattacctctag

SEQ ID NO: 27078 - DNA, 450 bp, Artificial Sequence
  Description of Artificial Sequence: Synthetic coding sequence
atgcaggaggcgataattctgctggcattattgggtgccatgagcggaggggaagctctgcacctgattctgctgccagccactggcaacgtcgctgagaacagtccacctggaacctccgttcataagttctcggtgaagttgtctgcctctctgtctcccgttatccctggcttcccacagatcgtaaacagcaatccactgaccgaggctttcagggtgaactggctttcaggtacctacttcgaagtcgtgactactgggatggagcagcttgactttgagaccggacctaacatctttgatttgcagatttatgtgaaagatgaggtgggtgtaaccgatcttcaggtattaacagttcaggtgacagacgtgaacgaaccccctcagttccaaggtaacctggccgaggcacgccatgaatgtacacagtcttggaggaattag

SEQ ID NO: 27079 - DNA, 2658 bp, Artificial Sequence
  Description of Artificial Sequence: Synthetic coding sequence
atgcaggaagcaatcatcctactggcattgctgggcgccatgtcaggtggcgaggcccttcatcttatcttacttccggccaccggcaacgtggctgaaaattcacctcctggaacctcagtgcataaattttctgtgaaactgagcgcctcattatctcccgtgatccctggcttccctcagatcgtcaatagtaatccgctgaccgaggcatttcgcgttaactggctgagcggcacctacttcgaggtcgtcaccaccggaatggaacagttggattttgaaaccggccccaatatttttgacctccaaatctatgtgaaagatgaagtgggcgtcacagacctacaggtcctgacggttcaagtcactgacgttaatgagcctccacagttccagggaaatctagcggagggcctgcacctgtatatcgtggagagagcaaaccccgggttcatctaccaggtagaggcatttgatcccgaggatacctctcgtaacatccctctgagctatttcctcatcagccctcctaagagcttcagaatgtcggctaatgggaccctcttttccacgactgagttggatttcgaggctggccacagaagtttccatctcatagttgaagtccgcgacagcggaggactcaaagcatctaccgagctccaggtgaatatcgtcaacctcaatgacgaagtccctcgtttcacgagtccgaccagggtgtacaccgtactcgaagagctatccccgggaaccatcgtggctaacataaccgccgaggacccagacgacgaagggtttccctcccacctgttgtatagcattaccaccgtgagcaaatactttatgatcaatcaactgactggcaccattcaagttgcccagagaatagatcgcgacgccggggaattgcgccaaaaccctacgatatcacttgaggtactggtgaaggatcgaccatatggcggacaggaaaatcgcatacagataacctttatcgtggaggatgtaaatgacaaccccgctacctgccaaaagttcactttttcaatcatggtacccgaacgcaccgctaaaggcaccctgctgctcgatctgaataagttttgcttcgatgacgacagcgaagcaccaaacaataggttcaatttcacaatgccttccggcgtgggtagcggctccaggtttctgcaggatcccgcagggtctggcaagatagtgctgataggtgacctcgattacgagaaccccagtaacctggctgctgggaataaatacaccgtcattattcaggtgcaggacgtcgcacctccatattataagaacaatgtctatgtctatattcttacttcccctgagaatgagtttccgttgatttttgacaggcccagctatgtattcgacgttagtgagcggcgtcccgcgcgcacaagggtcgggcaggtgcgtgccactgataaggatctgcctcaatctagtctcttgtactctatcagcactggcggcgcgtccctccaatatccaaatgttttctggattaatccgaagaccggtgagctacagttagttacgaaggtagattgtgagacaacccctatttatattctgcgaattcaggccactaacaatgaggacacttccagtgtgacagtcacggtgaacatcctggaggagaatgatgagaagcctatctgtacaccaaattcatactttctggcactacctgtagacctaaaagtaggcaccaacattcagaactttaagttgacctgtactgatcttgacagttcccccagatcattcagatactcaatcgggcctggcaacgtaaataaccatttcactttttcccctaacgcaggttctaatgtgaccagattactgctgactagtcgcttcgactacgcaggcggcttcgataagatttgggactataagctgctggtgtacgtgactgatgataatctcatgagtgaccgcaaaaaggccgaggctctggtggagactggaactgtgaccctgagcatcaaggtaattccccatcccacgacaataatcacaacaacacctcgtccacgggtgacctaccaggtgctgcgaaaaaacgtctacagcccaagcgcctggtacgtgccgttcgtgataaccttaggttcaatcctcctccttggactgctggtgtacctggtggtcttgttagctaaagccatccaccgccattgcccatgcaagactgggaaaaacaaggaaccactgaaaaagaagacagaaacaaaaaccgccgagcgcgacgtcgtggtcgaaacaatccagatgaatacaatctttgacggtgaagctattgaccctgtaacaggcgaaacctacgaattcaattcaaagaccggcgcccgaaagtggaaggatcctctgactcaaatgcctaaatggaaggagtctagccaccaaggggcggccccacgcagggtaactgcgggcgaaggaatggggagcctgcggagcgccaattgggaagaggacgaactgtcgggtaaagcctgggccgaagacgcaggcctggggtcccgtaatgagggaggaaagctgggaaatcctaagaatagaaatcctgctttcatgaatagggcatacccgaagccacatcccgggaagtag

SEQ ID NO: 27080 - DNA, 945 bp, Artificial Sequence
  Description of Artificial Sequence: Synthetic coding sequence
atgtctgccgcggaggcaggcggtgttttccacagggctcgggggcgtactctggcagcattcccagcagaaaaggagtctgagtggaagggccctttttacttcatactaggagctgatcctcagttcggtcttattaaggcatggtcaacgggcgattgtgacaatgggggagacgagtgggaacaggaaattcggctcactgagcaggcagtgcaggcaatcaacaagctgaatcctaaacctaaatttttcgtgctatgcggggacctgatccatgccatgccggggaaaccttggagaacagagcagaccgaggatttaaagcgggtgctgcgggcagtggaccgcgctatcccactagtcctcgtgtctggcaatcacgatatagggaacacgcctactgcagagaccgtcgaagagttctgtaggacatggggcgacgactacttctcgttttgggtgggaggagtgctcttcctggtgctgaatagccagttctacgaaaacccttccaaatgtccctctctcaagcaggcccaggaccagtggctggatgagcagctgtctatagcaagacagaggcactgccagcatgctatcgtttttcagcatatacctttattcctggagtctatcgatgaagacgatgactattatttcaacttatcgaaatctactagaaaaaaacttgccgataagtttattcacgctggcgtaaaagtggtgttcagtggtcactaccacagaaacgcgggaggaacataccagaacctggacatggtcgtgtcctcagccattggatgccagcttggccgtgacccacacggcctgcgcgtggtcgttgtgactgctgagaagattgtacaccgctactactcactggacgagctgtccgagaagggaatcgaagacgacctgatggacctgatcaaaaagaagtag

SEQ ID NO: 27081 - DNA, 519 bp, Artificial Sequence
  Description of Artificial Sequence: Synthetic coding sequence
atgagtgctgcggaagcaggaggagtgtttcaccgcgccaggggaaggacactcgcagcctttcctgcggaaaaagagtcagagtggaagggcccgttttattttatcctaggtgcagatccccaattcgggctcattaaggcgtggtctacaggcgactgcgacaacgggggagacgagtgggagcaggagatcaggctcactgaacaggccgtgcaagccattaataagctgaatcccaaacccaaattttttgtgttgtgtggggacttgatccacgcaatgcctggggtgaaggtggttttctccggtcattatcatcgcaatgcggggggcacgtatcaaaatctcgacatggttgtcagttccgccataggctgtcagttggggagagatcctcatggcttgcgcgtggtggtggtgacagccgaaaagatcgttcaccggtactactctctggacgagctgtctgagaaggggattgaggacgatttaatggatcttattaagaaaaagtag

SEQ ID NO: 27082 - DNA, 426 bp, Artificial Sequence
  Description of Artificial Sequence: Synthetic coding sequence
atgggctttcagaagtttagtcccttcctcgcactgagtatattggtcctattgcaggcagggtccttacacgcagcacccttcagatcagccctggaatcttcgcccgccgacccagcaacactaagcgaggatgaagcccggttacttctagcagctcttgtccaagactatgtacagatgaaggcatccgagctggagcaagagcaggagagggaaggaagcagcctcgactccccccgatctaagaggtgtggtaatcttagcacatgcatgcttggcacctacacccaggacttcaacaaattccatacatttccacagactgccattggcgtgggagctcctggaaagaagcgtgatatgtccagcgaccttgagagggaccatcggccacatgtgagtatgccccagaatgccaattag

SEQ ID NO: 27083 - DNA, 564 bp, Artificial Sequence
  Description of Artificial Sequence: Synthetic coding sequence
atgggaaataagcaaacaatttttacagaagaacaactcgacaactaccaggattgcacattcttcaataaaaaggacatcctgaaacttcactctcggttttacgagctggcaccaaatttggtgccaatggattacaggaaaagccctatcgtgcacgtgccaatgtccctcattatccagatgcccgagctaagagagaatcctttcaaggagcgcatagtagctgcatttagcgaggacggggaggggaaccttacattcaatgatttcgtggacatgttctcagttctgtgtgagtcggccccacgcgagctcaaggccaactatgcttttaagatctatgactttaataccgacaactttatctgcaaagaagacctggaacttacccttgcacgcctgactaagagcgagctggacgaagaggaggtggttctcgtctgcgacaaagttatcgaagaggcagacctggacggagacggtaagctgggttttgcagactttgaggatatgatcgccaaagcccctgattttctgtccacgttccatatacggatttag

SEQ ID NO: 27084 - DNA, 564 bp, Artificial Sequence
  Description of Artificial Sequence: Synthetic coding sequence
atggggaacaaacagactgtctttacccatgaacaactggaggcgtaccaggactgtacctttttcacaagaaaagaaataatgaggctgttctaccgttaccaagatctcgcacctcagcttgtccccttagactacaccacctgcccggatgtgaaggtgccatacgagctaatcggtagtatgcctgagcttaaggacaatcccttccgtcaaaggattgcccaggttttctctgaagatggcgacggccacatgacgctggacaacttcctggacatgttcagtgtgatgtccgaaatggcccccagagacctgaaagcatactatgcctttaaaatctatgacttcaacaatgacgactacatctgtgcctgggatctggaacagaccgtaacaaaacttacacgcggcgggttgagtgctgaagaagtgagtttggtttgcgaaaaggtgctggacgaagccgacggcgatcacgacggccggctgtctctggaggactttcaaaacatgatcctgcgggccccagactttctaagtacctttcacatccggatatag

SEQ ID NO: 27085 - DNA, 417 bp, Artificial Sequence
  Description of Artificial Sequence: Synthetic coding sequence
atgggcaataaacagacggtctttacccacgagcagctcgaggcataccaggataatcccttccgtcaacgtatcgcccaggtcttctcggaggatggggatggccatatgacactcgacaactttctcgatatgtttagcgtgatgtcagaaatggcccctagagaccttaaggcttactacgcattcaagatttacgacttcaataacgacgactatatttgcgcctgggacttggagcagacggtaactaagttgactagaggcggtctgtctgcagaagaggtaagtctcgtctgtgagaaggtgctggatgaggcagacggcgaccacgacggccggctgagcttggaggactttcaaaatatgatcctcagggcccctgattttctgtcgacatttcatattcggatttag

SEQ ID NO: 27086 - DNA, 93 bp, Artificial Sequence
  Description of Artificial Sequence: Synthetic coding sequence
atggggaataagcagaccgtctttactcatgagcagttggaagcctatcaggactgtaccttttttactaggaaggagataatgcgcttttag

SEQ ID NO: 27087 - DNA, 558 bp, Artificial Sequence
  Description of Artificial Sequence: Synthetic coding sequence
atgggacagtgcctacgctaccagatgcactgggaggatcttgaagagtaccaggctctgacgtttctaaccagaaatgaaatactttgcatccatgacacgtttttgaagctgtgccctccaggaaagtactacaaggaagccaccctcaccatggaccaagtgtcttcgctgccggcgctgcgagtgaaccctttccgcgatcgaatctgtcgggtcttttctcacaaaggaatgttcagcttcgaagatgttctggggatggcctccgtcttctccgagcaggcctgtcccagtctgaagattgaatatgcctttcgaatctacgattttaatgagaacggatttatcgatgaggaggacctccagcgcatcattctgcgcttgctgaatagtgacgacatgagtgaagatttgcttatggacttaaccaatcacgtgttatccgagagcgacctggacaacgacaacatgctgagcttttctgagttcgaacacgccatggccaagtccccggacttcatgaatagtttccgtattcacttttggggctgctag

SEQ ID NO: 27088 - DNA, 450 bp, Artificial Sequence
  Description of Artificial Sequence: Synthetic coding sequence
atggcagcagaacacctgcttccgggcccccctcctagtctggccgacttccgacttgaagctggcggaaaaggtaccgagcgaggttctggcagctcaaaaccaactggctcctccaggggcccccgaatggccaaattcctgtctcaggaccagattaacgacggtaatggagagctggatttctccacctttctcaccatcatgcacatgcagattaagcaagaggatcctaaaaaggagattcttctggccatgctgatggtggataaagaaaaaaaaggatatgtcatggcaagcgatctcagaagtaaactgacgagcctcggagaaaaactgacgcacaaagaggtggatgacctgttccgcgaagccgacattgagcccaatggcaaggtcaagtatgatgaattcatccataagattacccttcctggccgagattactag

SEQ ID NO: 27089 - DNA, 591 bp, Artificial Sequence
  Description of Artificial Sequence: Synthetic coding sequence
atggccgctgaacacttgctccccggccctcccccttcccttgccgactttagacttgaggccggcgggaagggcaccgagcgaggaagcggcagcagtaaaccgaccggcagtagccgtggacccaggatggccaagttcctatctcaggatcagatcaatgagtacaaggaatgtttcagcttatatgataagcagcagaggggcaaaattaaggctacggacttgatggtcgcaatgcggtgtctcggcgcctctcccacacccggggaggtgcagagacatttacagacccacggcattgatgggaatggggaactcgatttcagcacattcctgaccattatgcacatgcagattaagcaagaagaccctaagaaagaaatcctgttagccatgctgatggtggacaaagaaaaaaagggctatgttatggccagcgatctgaggtctaaactgaccagtctgggggagaagctgacccacaaagaagtggatgatctctttagggaggccgatatcgagcccaacggaaaagtcaaatacgatgagtttatccacaagataacactccccggccgtgactattag

SEQ ID NO: 27090 - DNA, 363 bp, Artificial Sequence
  Description of Artificial Sequence: Synthetic coding sequence
atggtggcaatgaggtgtctgggcgccagtcctacacctggagaggtccagcggcatctgcaaacacatggaattgatggaaacggagaacttgacttcagcacattccttactattatgcacatgcagatcaagcaagaagatccaaaaaaggaaattttgctggcgatgctgatggtggataaagaaaagaaggggtatgtcatggctagcgatctacgatcaaagctgacttcattgggcgagaaactgactcacaaggaagtggatgacctcttccgtgaggcagatattgagcccaatggtaaagttaagtatgatgagttcattcataaaatcaccctccccggaagggattactag

SEQ ID NO: 27091 - DNA, 441 bp, Artificial Sequence
  Description of Artificial Sequence: Synthetic coding sequence
atggcgggcgagctaacccctgaagaagaggcccagtacaaaaaggccttttcggccgtcgataccgatggaaacggaactataaacgcacaggagttgggcgccgcattgaaggctactggaaaaaatcttagcgaggcccagctccgcaaactgatctcagaagtagactctgacggcgatggggaaatttcatttcaggagtttctcaccgcagccaagaaggccagagccggtctcgaagaccttcaggtcgccttccgggctttcgaccaggatggcgacggtcacatcactgtggacgaactcaggcgggcaatggcagggctcggccagccactccctcaggaggaacttgatgcaatgattagagaagctgacgtagatcaggatggccgcgtcaactatgaagaatttgcccgcatgctcgctcaggaatag

SEQ ID NO: 27092 - DNA, 2010 bp, Artificial Sequence
  Description of Artificial Sequence: Synthetic coding sequence
atggcctactaccaggagccatccgtggagacgtcaattataaagttcaaggaccaggatttcactactctgagggatcactgtctgtctatggggcgcacattcaaagatgagaccttcccggctgcagattcttccatcggtcagaaacttctgcaggagaaacgcctgagcaacgtaatctggaagcggccccaggacctgcccggagggcctccacatttcatactggacgacatttcccggttcgacatccagcaagggggggccgcagactgctggttccttgcagctctcggttcccttacgcagaatccgcagtataggcaaaaaattctcatggtacaaagcttcagccaccagtacgcaggtatcttccggttccggttttggcagtgtgggcagtgggtcgaggtggtgatcgacgaccgcttaccagtccagggcgataaatgcctattcgtgaggccacggcaccaaaaccaggagttttggccctgcctgctggagaaggcctacgccaaattgttggggtcttattccgacctccactatgggtttttagaggatgccctagtcgatttaaccggtggggtgatcaccaatatccatttgcactcctctccagtggatctggtgaaggctgtgaaaaccgcgaccaaggctgggagcttgatcacatgcgcaacaccctccggacctaccgatacagcacaggccatggagaacggactcgtgtccctgcacgcttacaccgtgacaggggccgaacagatccagtacaggcgcgggtgggaagagatcatatcgttatggaacccctggggttggggagaggccgagtggcgagggagatggagtgacggttctcaggagtgggaggaaacctgcgatccccgcaagtcccagctgcataagaaacgcgaggacggcgagttttggatgtcttgccaagattttcagcaaaaatttattgccatgtttatctgcagcgagattcctataaccctggatcacggcaatactcttcacgaaggatggagccaaattatgttccgcaagcaagtaatactggggaacacagcagggggaccaagaaatgacgcccagttcaatttctccgtacaagagcctatggaaggcactaatgtcgtggtgtgtgtcacagtcgctgtgacccctagtaacctgaaggccgaagacgccaaattcccattagattttcaggttattctagctggatcccaaagatttcgcgagaagttcccacctgtgttcttttcaagttttcggaataccgtccagtcttccaacaacaagtttaggagaaacttcacaatgacctatcatcttagcccaggaaactacgtcgtcgtggcgcagacacgtcgcaagtcggccgagtttctgttgagaatcttcttgaagatgcctgactctgatcgccacctaagcagtcacttcaatttgcgaatgaagggatctcctagtgaacacggatcacaacaatccatttttaatcggtatgcgcagcagcgtctagatattgacgcaactcagctgcagggcctgctcaatcaagaactgctcacaggcccccctggcgatatgttttctctcgacgaatgcaggagcttagtggccttgatggagctgaaagtgaatggtaggctggatcaggaagagtttgccaggctgtggaaacgactggtgcactaccagcacgtcttccagaaggttcagacatcccccggtgtcctgctgtccagcgacttatggaaggcgatcgagaacacagatttcctccgcgggatcttcataagtagagagctgctgcacctggtgacacttcgctactctgattcagtcgggagagtttccttcccatccctggtgtgtttcctgatgaggctggaagctatggcaaagaccttccgaaacctatcaaaagacgggaagggtctgtacctgaccgaaatggagtggatgtctttggtgatgtataactag

SEQ ID NO: 27093 - DNA, 2010 bp, Artificial Sequence
  Description of Artificial Sequence: Synthetic coding sequence
atggcctactaccaggaaccttcagtcgaaacttcaattatcaagttcaaggatcaagactttaccacactgcgggaccactgcctctcgatgggtaggactttcaaagacgagacctttccggctgcggacagctccataggccaaaagctacttcaggagaaacgcttgagtaatgtgatctggaaacgcccacaggatctgcctggggggccaccccatttcattctcgacgatattagtcgcttcgatattcagcaagggggagccgcagattgttggttcctggcagccctgggcagcctgacccagaacccacagtatcggcagaaaatactgatggtgcagtctttctcacaccagtacgccggaatctttcgtttccgtttttggcagtgtgggcaatgggtggaggttgtgattgatgaccgtcttcccgtgcagggagataagtgtctgttcgtccggccccgtcaccagaatcaggagttctggccctgcctccttgagaaagcatatgctaaactcctgggctcttactctgacttacattatggcttccttgaggacgccttggtcgacctgaccggaggcgtaattaccaacatacatcttcactcttcccctgtcgacttggtcaaggctgtgaagaccgcgaccaaagctgggtctcttatcacatgtgcaactccctccggccctaccgataccgctcaggccatggagaacggcctggtgtccttgcatgcgtataccgtcacgggggccgagcagatccagtataggcgcgggtgggaagagattatttctttgtggaatccgtggggttggggagaagctgagtggaggggacgttggtctgacggctcacaagagtgggaagagacctgcgaccctaggaaatcccagctgcataagaagagagaagacggggaattttggatgagttgccaggatttccaacagaagtttattgcaatgtttatctgctctgaaatcccaattacactggaccatggcaacacacttcatgaagggtggtcacagataatgttccggaagcaagttattttgggcaatacggcgggcggccccagaaatgacgcacagtttaattttagcgttcaagagcccatggagggtacgaacgttgttgtttgcgtcacggtagcagtcacccccagcaacttaaaggcagaagatgccaaattcccgcttgattttcaggtaatactaacctcggtccagaggttccgggaaaaattcccgcccgtcttttttagctcctttagaaatacagtccagagttcaaataataaatttcgcagaaattttaccatgacttaccacctatccccgggaaactatgtcgttgtcgcacagacacgcagaaaaagcgcggagtttctcctgcgtatttttctcaagatgccggactctgatagacatctctcctcgcactttaacctccgcatgaagggttcacccagtgaacacggatcccaacagagtattttcaatcggtacgcccagcagcggttagatattgacgccacacagctgcaggggcttttaaatcaagaactgttgaccggaccgccgggtgatatgttttccctagacgagtgtcgaagcctggtcgctctcatggaattgaaagtgaacggccggctggaccaggaggaatttgctcggctttggaagcggttagtgcactaccaacacgtgttccaaaaagttcagacatcacctggcgtgctcctgtctagtgatctctggaaagccatagagaacactgattttcttcgcggcatctttatcagtcgggagctgctgcacctggtcaccttgaggtactccgacagtgtgggaagggtgtcatttcccagtctggtttgtttcctcatgcgcttggaagccatggcgaagacgtttcgaaacttatcaaaagatggtaaaggactttacctcaccgaaatggagtggatgtcattggtcatgtacaattag

SEQ ID NO: 27094 - DNA, 2055 bp, Artificial Sequence
  Description of Artificial Sequence: Synthetic coding sequence
atgtccctctggccaccttttagatgccggtggaagctggccccgcgctactcacgaagggccagtccccaacagccccaacaggatttcgaggccttgctggccgagtgtctgaggaacggttgcctgtttgaggatacctccttccctgcaacgctgagcagcatcggatccgggtccctgcttcagaagttgcccccgaggttacagtggaagaggccccccgaactccactcgaacccacagttttacttcgctaaagccaaacgtttagacctgtgccagggcatcgtcggggattgttggttcttagctgcactccaggctctggccttgcaccaggatatccttagcagggtggttcctctaaaccagagctttaccgagaaatacgctggtatctttcgcttttggttttggcactatggcaattgggtacccgtggtgattgatgaccggttaccggtaaacgaagcaggccagctagtgtttgtctccagtacttacaaaaacctgttctggggcgccctgctcgagaaggcttatgctaaattatcaggcagttatgaggacctccagtccgggcaggtgagcgaggcccttgtagacttcactgggggagtcaccatgactataaatctagcagaggcccacggaaatctctgggacatcctgatcgaagctacttataatcgaaccctgatagggtgccagacgcatagcggggagaaaatcctggagaatggcctggtggagggacacgcctacacactgactgggattcggaaagtgacctgcaagcaccgcccagagtaccttgtcaaactccgcaatccctgggggaaggttgaatggaaaggagactggtccgatagctcgtcaaagtgggaacttttaagtccaaaggagaaaattctgcttttacgtaaggacaacgacggggagttttggatgactctgcaggactttaaaacgcattttgtgctgcttgtgatttgtaaattgaccccgggactactgagccaggaagccgcccaaaagtggacctacacaatgagggaagggcgttgggaaaagcgctcgacggcaggaggccagcggcagctccttcaggatacattctggaagaacccccagtttctcctcagcgtttggcgacctgaagaggggaggagatcgcttcgcccctgcagcgttctggtgagcctcttgcaaaagccacgccacagatgtaggaaacggaagccgctcctcgcaattggcttttacctctacagaatgaacaaataccacgacgatcagaggagactgccgccagagtttttccagagaaatactcctttgagccagcccgatagattcctgaaagagaaagaggtgtcccaggaactttgcctggaaccgggaacctatctgattgtgccttgcattttagaggcccatcaaaaaagcgaattcgtgctgcgggtgttcagccggaaacatatattttatgaaatcgggtcgaatagtggagtcgtgttcagcaaagagattgaagaccagaatgaaagacaggatgagttctttaccaaatttttcgaaaaacacccggaaatcaacgctgtgcagttacagaacctgcttaaccaaatgacctggtccagtctgggatcaagacagcccttcttctccctggaggcttgtcagggtatcctggcattgctggacttgaatgcctcagggactatgagcattcaggaatttagagatctctggaaacagctgaagctgtcacagaaagtttttcacaagcaagaccgcggaagcggatacctgaactgggaacagttgcacgctgccatgcgcgaggcgggaataatgctgtccgatgatgtctgccaattaatgctcattagatacggtggcccccgcctccagatggattttgtatcattcattcacttgatgctcagggtggagaatatggaggacgtgttccagaatttgacacaggatggcaagggtatttatctgcagaaaccagagtggatgatgatggctctctattcctag

SEQ ID NO: 27095 - DNA, 2055 bp, Artificial Sequence
  Description of Artificial Sequence: Synthetic coding sequence
atgtctctctggccaccctttagatgtagatggaagctagcccctaggtactcccgccgcgctagcccccagcagcctcaacaggacttcgaagctctgctggctgaatgtctgcgcaacggatgcctctttgaagatacctctttccccgctactttgtcatcaattggatctggatctctgttgcagaagttaccgcctcgactccaatggaaacgtccaccagagcttcatagcaacccccaattctattttgccaaggctaaacgcctagacctctgccagggtattgtcggcgattgttggtttctagctgccctccaggcattggccttgcatcaggacattctgtcccgtgtggtgccacttaaccagagctttaccgagaaatatgcagggatcttccgattctggttttggcactatggtaattgggtgccagtggtgatagacgacaggctgccggtgaatgaagcgggtcaactagtcttcgtgtctagcacctataagaatctgttttggggtgccctgctcgaaaaggcgtacgctaagctgagcggatcctatgaggacctgcagagcgggcaagtttccgaggctcttgtagatttcacaggtggagtgaccatgaccatcaaccttgccgaggcacacggaaatctctgggatatccttatcgaagcaacgtataatagaacgctaatcggctgccagacccattccggggaaaagatcctcgagaacggcctggtcgagggacacgcctatacactgaccggaataaggaaggtaacgtgtaagcatcggcccgaatatctggtgaaattgaggaatccctgggggaaggtcgaatggaagggggattggtccgattcctcttccaaatgggagttgttgtcccctaaggagaagatcctgcttttacggaaggataacgacggtgagttctggatgaccctccaagatttcaaaactcactttgtgctccttgtgatctgtaaactgactcccgggctgcttagtcaggaggccgcccagaagtggacgtatactatgcgagagggtcgttgggaaaagcgtagcacagctgggggccagcgtcagctgttgcaggacactttctggaaaaatccacagtttctgctttctgtgtggagaccagaagaggggcggagaagcttgagaccctgtagcgtgctcgtgagcctgttgcagaagccaaggcaccggtgccgaaagcggaaacctctgctggcaatcggcttttatttgtaccgggtcgcaaaatatcacgatgatcagcggcgactgccacccgagttcttccaacgaaacacccccctttcccaacccgacaggtttctgaaagaaaaggaggtgtcacaggaactgtgcctggaacccggcacttatctgatcgtgccgtgcattctggaagcccatcagaagagcgagttcgtgctgcgcgtgttttcacgcaagcacattttttatgagattggttctaattccggggtcgtgttttctaaggaaatcgaggaccagaacgagaggcaggacgagttcttcacaaaattttttgaaaagcatcctgaaattaacgccgtccaattgcagaacctcctgaatcagatgacttggtccagccttggctcccgccagccttttttttctttagaggcgtgtcaaggtatcctggcgctactcgacctcaacgcaagcggcacaatgtctatccaggagttcagagacctttggaagcagctgaaattatcccagaaggtcttccataaacaagatcgaggaagtgggtatctgaattgggaacagcttcatgccgcaatgagagaggcagggatcatgctgagtgacgacgtgtgtcagttaatgctgatcaggtacggcggcccgaggctacagatggactttgtaagcttcattcacttaatgctgcgagtggaaaacatggaggacgtttttcaaaatttgacccaggatgggaaggggatctacttgcagaagccggagtggatgatgatggccctgtacagttag

SEQ ID NO: 27096 - DNA, 2046 bp, Artificial Sequence
  Description of Artificial Sequence: Synthetic coding sequence
atggcggctcaggccgcgggagtcagcagacagcgggcagcaacacagggactggggtccaaccagaatgcgttaaagtacctagggcaggacttcaagacccttagacaacagtgcctggacagcggcgttctgtttaaggaccctgaatttcccgcatgcccctctgccctcggatacaaagatctgggccccggatcgccacagacacaggggataatctggaagaggcccacagaactgtgtccatccccacagttcattgtgggtggtgcaactcgcacagatatctgtcagggcggcctcggagattgctggttgcttgctgctatcgcgtctctgacattgaacgaggagctcctctaccgggtggtgccccgggatcaagattttcaagaaaactatgccggcatctttcactttcagttttggcagtatggcgaatgggtcgaagtggtgatagatgacaggctcccaaccaagaatggtcagctgctcttcctccactctgaacagggaaacgagttttggagcgccttactggagaaggcttacgcaaaactgaatggctgctacgaggccctggcgggcggatctactgtcgaaggatttgaggactttaccggtggcataagtgagttctatgatctgaagaagcccccggccaatttataccagatcatccgtaaggccctgtgtgccgggtcgctcttgggctgcagcatagacgtgtcaagcgcggcagaggcagaagctatcacctcccagaaactcgtgaaaagtcacgcctattcagtaaccggagtggaggaggtcaatttccaggggcacccagaaaagctcatcagattaagaaacccttggggcgaagtagaatggagcggagcctggtcggacgacgcctcaccagtcataagccccagcgccgagggatgtcgggtcaaacacacaacgatgcgcagcatgagccaaatgagtttgtccgacttcgtgagacaattttctcggcttgaaatatgtaacctaagccctgattccttgtcctccgaagaggtacataaatggaatctggtactgtttaatgggcattggacccgcggctctacagccgggggctgccagaattaccccgctacctattggacgaatcctcagttcaaaatccgactcgacgaagtcgacgaggatcaggaggaaagcattggcgagccctgctgtaccgttttacttgggctaatgcagaagaaccggcgttggcgcaaacggattgggcaaggcatgttgagtataggatacgctgtgtaccaggtcctcctctgttggtacacccttgacgtacttgggttaaatattctggcgagccattgttccacttcatttctgctcctggaggaggcttctctcttactctacatcccactgcctgttgcactgctaaggttccgcgatagcttcctgtggctcaatacccggcgcctccgccgtatctgcccccaggcctgtcatgatgctcttccgttttggcaacgcccttctagcgttccccatccatggatggtgagcctggaagtcttttaccgtggcggctcttttccccacctccagatgatacgtttcccgctgcctttttcgagaactgatataaaattcgacggcttcaacattaacacctgccgcgaaatgatcagcctcctggactccaacgggacagggactctgggggcagttgagttcaaaactctctggctcaagattcagaaatacctagagatctattgggagacagattacaatcatagcggcaccatagacgctcacgagatgaggactgcactacggaaggccggatttaccttaaacagtcaagtccagcagacgatcgccctgcggtacgcctgctccaagcttggaattaacttcgactcctttgtggcttgtatgatccgactggaaactctgtttaaactgttcagcctgctggacgaagataaagatggcatggtgcagctcagcctcgctgaatggttatgttgtgttttggtgtag

SEQ ID NO: 27097 - DNA, 1146 bp, Artificial Sequence
  Description of Artificial Sequence: Synthetic coding sequence
atggccgcacaggctgcgggagtcagccgccagcgcgcagctacacagggcctgggctctaatcaaaatgctttgaaatacctcgggcaggattttaagacactgcggcagcagtgccttgactccggcgtgctttttaaagaccctgagtttcccgcttgtccctctgccctagggtacaaggacctgggccccggaagtccacaaacacagggcattatctggaagaggcctacggagttgtgcccttcaccacagttcatcgtgggcggcgcaacaagaaccgatatttgtcagggcgggctgggggactgttggcttttggcggcgatcgcctcactaacgttgaatgaggaattgttgtacagggtagtgccgcgcgaccaggactttcaggaaaattatgctggcatcttccactttcagttctggcagtatggcgaatgggtcgaggtggtcattgatgacaggctccctaccaagaacggacagcttctctttctgcacagcgagcaggggaacgagttctggtccgcccttctggaaaaggcctacgccaaactgaacggctgctacgaggcactcgccggggggtcgaccgtggaaggattcgaggacttcaccggtggtatctcagagttctacgacctgaagaagccgcccgcgaatctgtatcagattatccggaaggcactgtgtgcaggaagtctcctggggtgtagcatagacgtaagctctgctgccgaagcagaggcaattacctcgcagaagctggttaagagccacgcatattctgttactggcgtggaagaggtcaattttcaaggccacccagagaagctcatcaggctgagaaatccctggggggaagtggagtggagcggagcctggtctgacgacgccccggagtggaaccacatcgaccccagacgtaaagaagagctggataagaaggttgaggacggcgaattctggatgtctctgagtgactttgttaggcagttcagccgtctagagatttgcaaccttagcccagacagcttaagtagcgaggaagtgcataagtggaatctggtgctatttaacgggcattggactcgtggtagtaccgctggaggttgtcaaaattatccagggtctagctag

SEQ ID NO: 27098 - DNA, 1314 bp, Artificial Sequence
  Description of Artificial Sequence: Synthetic coding sequence
atggctgctcaggctgctggcgtttccagacagcgtgccgcgacacagggcctcggttccaatcaaaatgctctcaaatatctcggccaggattttaagacactgcggcagcaatgtctggactccggtgtcctctttaaagaccccgagttccccgcctgtccatctgccctcggctataaagacctcggtccaggctcccctcagacccagggtataatctggaagcgtccaacagagctctgccccagcccacagttcatcgtgggtggcgctacccggacagacatatgtcaaggtggactcggcgactgctggttgctcgccgccattgcctctctgacccttaacgaagagctgttgtacagggtggttccccgcgaccaagacttccaggagaactacgcaggcatcttccacttccagttttggcaatatggcgagtgggtggaagtggtgattgacgatcggctgccgaccaagaacggacagcttctgtttcttcacagcgaacagggcaatgaattctggtcggctcttctcgagaaagcctacgccaagctcaatggttgctatgaggctctggccggcggcagtaccgtggagggcttcgaggactttacaggtggcatcagcgaattttacgacttgaaaaaacctcctgccaatctgtaccaaatcatcagaaaggccctttgtgcagggagtctattgggttgttcgatcgacgtctcttccgcagctgaagcagaggctattacaagccaaaagttggtaaaaagccacgcctatagtgtgacgggagtcgaagaggttaactttcaaggacaccctgaaaagctgattaggctccgcaacccgtggggggaggtggagtggtccggtgcctggagcgatgacgcgcccgagtggaatcatattgatccgcgccgcaaggaagaactcgataaaaaagtcgaggatggagaattctggatgtctctgtcagacttcgtgagacagttcagccgtttggagatttgtaacttgtcaccagattcattatcttccgaagaggttcataagtggaatttggtgctgttcaacggccattggacaaggggctccaccgcaggcggttgccaaaattaccccgctacttactggactaacccccaatttaagattcggctcgatgaggttgatgaagaccaggaggagagcataggcgaaccatgttgtaccgtcctactggggttgatgcagaagaatagacgttggcggaaacgaataggccagggcatgctttccattggctacgctgtgtatcaatag

SEQ ID NO: 27099 - DNA, 2151 bp, Artificial Sequence
  Description of Artificial Sequence: Synthetic coding sequence
atgtcggggagcaagaagaagaaagtcacaaaagcagagaggctgaaactgctgcaggaggaggaggagcgccgtctgaaggaagaggaagaggcgcgtttaaagtacgagaaggaggaaatggagcggctagaaatacagcggattgaaaaagagaaatggcacaggctagaagcaaaggatctggaaaggaggaacgaggagctcgaagaattgtacttactagaacgatgttttccagaagctgagaaactgaagcaggaaacaaagctgctgagtcagtggaagcactacatccagtgtgatgggtcacctgacccgtcagtcgcacaggaaatgaatacattcatctctttatggaaagaaaaaaccaacgagacttttgaagaggtaattgagaagtccaaggtggttctcaatcttatcgaaaagctgaaattcatcctgcttgagacacccccctgcgacctacaggataaaaacattatccaatatcaggaatctatccttcagctccaggaattgctgcatctcaaatttggggtggctaccgagatcttgctgaaacaggcttctactctggcagatctagattcaggtaacatggagaaggtgatcaaggacgagaatgtgactctgtacgtatgggcaaatctcaagaaaaatccaagacaccgctcagtcaggttttccgagacccaaattggttttgaaatccccagaatcttggccacgtctgacatagccgtgagactcctgcacacccactatgaccacgtgtccgctctgcatcccgtttccactcccagtaaggagtatacttccgcggtaactgaactggtcaaggatgatgtaaagaatgtcgaaaaggcgattagcaaagaagtcgaggaggagtctaagcagcaggagcgcggcagccacttgatccaggaggaggaaattaaggtcgaggaggagcaaggggacatcgaagtgaaaatgagctccgctgaggaggagtcagaagccatcaagtgcgagagagagatgaaggtcttatccgagactgtctccgcggcccaactcttgctcgtcgagaacagctcagaaaagccagacttctttgaggataatgtggtcgacctctgtcaattcactactctggggggagtttatcacctcgatattctagagctacccccgcagtgtaaaccagtcaagggctggatgatcgtggaaattttgaaggaaggtctccaaaaatatacgtatcctcccgaaaccaccgaggaattcgaaactgagaacgctttcccaccaatcgaagtgacgttggaagtccacgaaaatgtgatcttcttcgaggaccccgtggtggtgaggtgggatgccgaaggtaaacactggcgaactgacggcattagcaacgtatcatacaaacccaaagagagattggtcaccttctcgcttgacaccttcggacctgttacgctgatccaggacgctcacattaacatgccttaccaatcttgggaactgcggcccctcgacgttaataaggtgttattaacagtaaccaccgttttcacagaaatacagattcaaatcaaagagaatctctgtatgctttcaagcattaagctaaaggataagaagcatatctcaattctggagggtacatggatgacaccgattcctttcatcatagctctgaaggaagccgggctgaatatcttcccaacccggcacagtcacttttatgtgataatcaataataaagtccctcttgttgaagtgaaagcctaccgccagatggcactcctcagtagcgcctttgcctttggctggagcaaatggaatctcctttgtaatagcacaaaggtggtctttaaggtgagagagcatctgactgaagcctgcaccgaaaaccctaactgggccctgttaatgttctcaggagaccgcgcacagcggctgaaaattaaggaagagagcgaggctttttcagaggccctgaaggaagaaactgagttccattccactttatatcacatggtgaaggattttgcgtccgaagaagccatggagaaggtgaggagcagtaattgtcagttcgtcaacagcgtgtgccacatgctcctcagcaccaggctcctgagctatagctag

SEQ ID NO: 27100 - DNA, 2073 bp, Artificial Sequence
  Description of Artificial Sequence: Synthetic coding sequence
atgagacagacaggaggcggcgctacaacagatagtgcatcacccgtgttgaataatgtgatcaagtcacagtcatactttaccgccaaacgcgtgggactggggaacaactcctatctgggagtcggcagaccaagcagtcagcagtggctgagtctgccaggcccaggcggccaggggccaaaggcaaagaagtcaggctctaaaaagaagaaagtgacaaaggccgaacgactgaagctgctgcaggaagaggaggagcgtcggcttaaggaagaggaggaggctcgactgaaatatgagaaggaagagatggagaggctcgagatccaacgcatcgagaaagagaagtggcatcgcctggaggccaaagatctggaacgccggaatgaagaactggaggagctctatttgttggagcgttgttttcccgaggccgaaaaactgaagcaggaaaccaagctattgagccagtggaaacattacatccagtgtgatggttcgcccgatcccagtgttgctcaggagatgaacacttttatttccctgtggaaagagaagacaaacgagacttttgaggaggtgatcgagaagagtaaggtggtactcaatctgatcgagaagctgaagttcatcctgcttgagacccccccgtgcgatcttcaggacaaaaatatcatacagtatcaggagagcatcctacaactacaggaactgctacacctcaagttcggcgtcgctacagaaattctgctgaagcaggcgagcacactcgcagacttggacagtggaaatatggagaaggtcattaaggacgagaacgtgacactgtatgtgtgggctaacctgaagaagaatcctagacaccggtccgtccgcttctcagagactcagatcggctttgaaattccccggatcctggccacatctgatattgccgtgcggctgctgcacacccactatgatcatgtgtccgccctccatccagtgagtacaccatcgaaggaatacaccagcgctgtgacagaacttgtgaaagatgatgtaaaaaatgtggagaaggccatcagcaaagaagtggaggaggagagcaaacagcaggagcgcggcagccatctgattcaggaggaggagattaaggtagaggaggagcagggggacatcgaagtgaagatgtcgagtgccgaggaggagtcggaggcaatcaaatgtgagagagagatgaaggtgctatcagagaccgtaagtgccgcacagctcctactggtcgaaaactcctcagaaaaaccagatttctttgaagataatgtggttgacctgtgtcagtttactacattaggcggagtgtatcatctcgatatattggaacttcctccacagtgtaagcccgtaaagggatggatgattgtggaaatacttaaagagggactgcaaaagtatacgtacccaccggaaaccacagaggaatttgaaaccgaaaatgcattcccacctattgaggtcacactagaggtgcacgaaaacgtgatatttttcgaagacccggtggtggttagatgggacgcagaggggaaacactggaggaccgatggaattagcaatgtatcttacaagccaaaagagcgactggtgactttctccctggatacgttcgggccagtcacactgattcaagatgcccatataaatatgccctaccaatcctgggaactcagaccgctggacgtgaataaggttctcctaaccgttacaactgtttttacggagattcagattcagatcaaggaaaacctctgcatgttaagtagcatcaagctgaaagacaagaagcacatttcaatactcgagggaacttggatgactccaatcccctttatcattgcacttaaggaagctggtctcaatatattccccacccggcactcccacttctacgtaatcattaacaataaagtccctctggtcgaagttaaggcataccggcagatggcgctcctgtcctccgcttttgcttttggctggtcaaaatggaacctactgtgtaacagcaccaaagttgttttcaagtggtag

SEQ ID NO: 27101 - DNA, 1311 bp, Artificial Sequence
  Description of Artificial Sequence: Synthetic coding sequence
atggaacggctggaaatccagagaattgagaaagagaaatggcatagactggaagcaaaagacctggagagaaggaacgaagaactcgaggaactctatctgctggagaggtgttttcctgaggcagagaaacttaagcaggagactaagctcttgagccaatggaaacattacatccaatgcgacggatcccctgatccctcagtggctcaggagatgaatacctttatctctttatggaaggagtatacatccgctgtgacagagttagttaaagacgatgtcaagaacgttgagaaagcaatctctaaagaggtagaggaagagagcaagcagcaagagagaggtagtcatctgattcaggaggaagaaattaaggtggaggaggaacaaggcgacatcgaggtcaaaatgtctagcgctgaagaggagtccgaggcaatcaagtgcgagcgggagatgaaggtgctatccgaaaccgtgtccgcggcacagttactgttagttgagaatagctccgagaaaccggacttttttgaggataatgtggtggacctctgccagttcacaacccttggaggggtctaccatcttgatattcttgagctcccaccccagtgcaagcctgtgaaggggtggatgattgtggagatcctgaaggagggattgcagaaatatacttaccctccggagactactgaggaattcgagacagaaaacgcgtttccccctatcgaagtaactctggaggtgcacgagaacgtcatattttttgaggaccccgtcgtggttcgatgggacgccgagggcaaacattggaggaccgacggaattagcaacgtgtcgtataagcctaaggagcgcctggtgacattcagcttggacacttttggcccagtaacgctgattcaggatgctcacattaatatgccctaccaaagttgggaattgcggccgctggatgtcaataaggtgttgctgacagtgactaccgtcttcactgaaattcagatccagattaaagaaaatctgtgtatgctttcctctataaaattgaaggataaaaaacacatctcaattctggagggtacatggatgacccccattccctttattattgcgcttaaggaggcaggactcaatatcttccccaccaggcatagccatttttacgtgatcattaacaacaaagtcccactggtggaggtgaaagcatatcgtcaaatggccctgctttctagtgccttcgctttcgggtggagcaagtggaatctgctctgcaatagtactaaggtcgtgttcaaatggtag

SEQ ID NO: 27102 - DNA, 2169 bp, Artificial Sequence
  Description of Artificial Sequence: Synthetic coding sequence
atgggcccaaaggcgaagaagagtggaagtaagaaaaagaaggttaccaaggccgaacgcttgaaattactccaggaagaagaagagcggcggctcaaagaggaggaagaagcccgtctgaagtacgaaaaggaggagatggaacgcctggaaatccaaaggatcgagaaagagaagtggcatcggttggaggcaaaagaccttgaacgacgaaatgaggagctggaggagctttacctgctggagcggtgctttcccgaggcagagaaattgaaacaagagaccaagttgttgagccagtggaagcattatattcagtgtgacgggagcccagacccatctgtagctcaagaaatgaacacgtttatctcattatggaaggagaagacaaacgaaactttcgaagaggtcattgaaaagagtaaggtggtattaaatttgatcgagaagctgaaattcatactccttgaaactccgccttgtgatctgcaagacaagaatatcatccagtatcaggagtctatcctgcagctgcaagagctgcttcatctcaagtttggcgtggccaccgaaatactgctcaaacaagcaagtaccctggccgacctggatagcggtaacatggagaaagtcataaaagatgaaaacgtgactctatatgtgtgggcaaaccttaaaaagaacccgcggcatcgaagcgtgcgtttttccgaaacccaaatcggatttgaaataccccgcattttggcaacatccgacatcgcggtgaggctactgcatactcactacgaccacgtctcggctctccaccccgtgtcgactccctcgaaagaatatacctccgctgttacagagctggtcaaggatgacgtgaagaatgtggagaaggccatttccaaagaggtggaggaagaaagcaaacagcaggagcgtggctcccatctgattcaggaggaggaaataaaggtggaggaggagcagggcgacatcgaggtgaagatgagctcagctgaagaagagtccgaagccatcaagtgcgaaagggaaatgaaggtactttccgagacagtctccgctgcccagctcctgctggtggaaaactccagtgaaaaaccggacttcttcgaagacaacgtggtggatctgtgtcagtttaccacccttgggggtgtgtatcacctcgacattttagagttacccccacaatgcaagccggtaaaaggttggatgatcgttgagatcttgaaagagggattgcagaagtatacctaccctcccgagactactgaagagttcgagacagaaaacgcttttccccccatagaagttacattagaggttcacgaaaatgtcattttctttgaggatcctgtggttgtgcgttgggacgccgagggtaaacactggcggactgacggaatctctaacgtgagttacaaaccaaaagagcggctggtgacattctcgctcgacacctttggcccggtgacacttatccaggatgcacatattaacatgccctatcaaagctgggaattgaggcccctagacgtgaataaggtgctcctgaccgtaaccaccgtctttaccgagattcagatacagatcaaggaaaacttatgtatgctctcctctataaagctgaaagacaagaaacacatctctatccttgaaggcacatggatgacacccattccctttattatagctctgaaagaggccggcctgaacattttccccacccgacatagccacttctacgtgatcattaataataaggttcccctggtggaagtgaaggcctaccggcagatggcactgctgagctccgctttcgctttcggctggagcaaatggaacctgttgtgcaattcaactaaggtggtttttaaagtcagggagcatctcaccgaggcatgcacagagaaccctaactgggccttattaatgttcagtggggaccgcgcccaaaggctgaaaattaaggaggagagtgaggccttttccgaggcactgaaggaagagacagaatttcattctacgctgtatcacatggtgaaggatttcgccagcgaggaggctatggaaaaggtgcgctcgtcaaattgtcagtttgtgaatagtgtgtgtcacatgttactctcgacaagattgctttcgtatagctag

SEQ ID NO: 27103 - DNA, 2031 bp, Artificial Sequence
  Description of Artificial Sequence: Synthetic coding sequence
atggagcgactggagatccagcggattgaaaaggaaaagtggcaccggctggaagccaaggatctggagcggcgtaatgaagagttggaagagttgtacctgctggagcgctgcttccctgaggctgagaaactgaagcaagaaacaaaactcttatcacagtggaagcactatatccagtgcgatggctcacctgatcctagcgtggctcaagagatgaacacatttatttcactttggaaggaaaaaaccaatgagacatttgaggaggttatcgagaaaagtaaggtggttctcaatttgattgagaagttgaaattcattttactggaaacacctccatgtgatctccaggacaagaatataatccagtatcaagaatccatcctacaactgcaggaactcttacatcttaagttcggagttgcaacggaaatcctgctgaaacaggcgtccacactggcagacctcgactctgggaatatggaaaaagttataaaagatgaaaatgtgacactatacgtctgggcgaacctgaagaaaaaccccagacacaggtccgtcagattctctgagacacagatcgggttcgagattccaaggattctggccacatcagacattgctgtgcggttgctgcacacccattacgaccatgtgtccgcactgcaccccgtaagcactccctctaaggaatatacttccgcagttactgagctcgttaaagatgatgtgaaaaacgtagaaaaagccatttccaaagaagtggaagaggagagcaaacagcaagagagagggtcccacctgatacaagaggaagagataaaggtagaggaggagcagggcgatatcgaggtgaagatgtcctccgctgaggaggaaagtgaggctattaaatgtgagcgggaaatgaaggtgctctctgagactgtctctgcagctcaactgctccttgttgagaactctagcgaaaaacctgatttttttgaggacaacgtagttgacttgtgccagttcaccaccctcggcggtgtgtatcatctcgatatacttgaactcccgccgcagtgcaaacccgtcaaggggtggatgattgtggagattctgaaggagggactgcaaaaatacacttatccccctgagactacagaagaattcgagaccgaaaacgcctttccaccaattgaggtcactctggaagtgcacgagaatgtaattttctttgaagatcccgtcgtagtccggtgggacgccgagggaaagcattggcggaccgatggaatttccaacgtttcctacaagcccaaagagcgcctcgttaccttttccctcgacacatttggacctgtcactctcatccaagacgcgcacatcaacatgccctaccaatcttgggaactgcgacccctggatgtcaacaaagtgctcctgacagtgactactgtattcactgagatacagattcagatcaaggaaaatctttgcatgctgtcctcaatcaaattgaaagacaaaaagcacatcagtatcctcgaaggtacctggatgacccctattccattcattattgctctgaaagaggcagggctgaatatatttccaacacgacatagtcacttctacgtgatcattaacaataaggtgccactcgtggaggtgaaggcatacaggcagatggccctcctgagtagtgcctttgccttcgggtggtctaaatggaacctcctctgtaatagcacaaaagttgtgtttaaggtcagggagcatttgacggaagcgtgtacagaaaaccctaactgggcccttctaatgttctctggtgacagagcccagcgactgaaaattaaggaagaaagtgaagccttctctgaagcattaaaggaagaaaccgagtttcacagcacattgtaccatatggtgaaggatttcgcttcagaggaagccatggagaaggttaggtcttccaactgtcaattcgttaattcagtgtgccacatgcttctgtccacaagattactcagctattcatag

SEQ ID NO: 27104 - DNA, 1458 bp, Artificial Sequence
  Description of Artificial Sequence: Synthetic coding sequence
atggggcccaaggccaagaagagcggttccaagaaaaagaaggttactaaggctgagcgcttgaaactgctgcaggaagaggaggagagacgcctaaaagaagaggaagaggccaggctgaagtatgaaaaggaagagatggaaagactggagattcagaggatcgaaaaagagaaatggcaccgcctggaagctaaagacctggaacggcgcaacgaggagctggaagagctgtatctgctcgagcgctgtttccccgaagctgagaaactcaaacaagaaacaaagttgctgtctcagtggaaacactatatccagtgcgacggcagtcccgatccctcagtagcccaagaaatgaatactttcatcagcctttggaaggagaagactaacgaaactttcgaggaggttattgaaaaatccaaggtggtactgaaccttatagagaagcttaaattcattctgcttgagactcccccttgcgacctccaagacaagaatatcattcaatatcaggagtcgattctgcaactgcaagagctgctccacctgaaatttggggtcgcgacagagatccttttgaaacaagctagcactttggccgacctggattccggcaacatggagaaagtgatcaaagacgaaaacgtgacgctgtacgtctgggccaacctcaagaagaacccccgtcacagatcagtccgattttccgagacacagattggcttcgagattcccagaatactggctactagcgatatcgctgttcgacttctccatacccactatgatcacgtcagtgccttgcaccctgtgtcaaccccttcgaaagagtatacctccgccgtcacagagctggtgaaggacgatgttaaaaacgtggagaaggcgatcagcaaggaggtcgaggaggaatccaagcagcaagaacggggcagccacctgatccaagaggaagaaattaaggtagaggaagagcagggagatatagaggtgaaaatgtcatccgctgaagaggaaagcgaggccattaagtgtgagcgcgaaatgaaggtccttagcgagactgtctctgccgcccagctccttctggtggagaacagctcagaaaagccagacttctttgaagacaatgttgtggatttgtgtcaatttactaccctggggggcgtctatcacctggacattctggagctgccgcctcagtgtaaacctgtcaagggatggatgattgtcgagatcctcaaagagggtcttcaaaagtacacctatccaccagaaaccacggaggagttcgagactgagaatgcatttccacctatagaggtgactctcgaagtccacgaaaatgtgatcttcttcgaagaccccgtagttgttagatggatgctgaaagtcaacatcggcgagctcatggcctcagctatgtatcccaccaatcagaaaaaagatctctag

SEQ ID NO: 27105 - DNA, 1545 bp, Artificial Sequence
  Description of Artificial Sequence: Synthetic coding sequence
atgaacacctttatatcactgtggaaggaaaagactaatgaaacctttgaggaagtcatcgagaagtcaaaggttgtgctaaatctgattgagaagttaaagttcattttgctagaaaccccaccctgtgacctccaagacaagaacattattcagtatcaggaaagcatattacagcttcaagaattgctgcacctcaagtttggtgtcgctacagaaatcctgctcaaacaggctagcaccctagccgacttagacagcgggaatatggaaaaggtgattaaggatgaaaatgtaacactctacgtatgggcaaacctcaaaaaaaacccacggcaccgatcagtgcggttctcggagacccaaattgggttcgagatacccagaatcctcgcgacatctgacattgcagtccggctcctccatactcactacgaccacgtctccgctttgcaccccgtgtccacaccttctaaggagtatacttctgccgtgacagaattggtcaaagatgatgtgaaaaatgtcgaaaaagccatctccaaggaggtggaagaggagtcaaagcagcaggagagaggatcccacctaatccaggaggaagaaattaaagtcgaagaggagcaaggagatattgaggtaaagatgtcgagcgccgaggaagaaagtgaagccatcaaatgcgagcgggagatgaaagtgttgagtgaaacagtgtctgccgcccagctgctcctggtagagaacagttcagagaagcccgatttttttgaagacaacgtggtcgatctctgtcaatttaccacactgggcggcgtataccatcttgatatcctggaactgcctccccagtgtaagccagtgaaaggctggatgattgttgagatactcaaggaagggctacaaaagtatacctatccacccgaaactactgaagaattcgagacagagaacgcattcccccccattgaagtcactctcgaggttcacgagaacgttattttctttgaagatccagttgtcgtccgctgggacgccgaaggaaagcactggagaacagatgggatctcaaatgtgtcctataaaccgaaagagcggctggtcactttttccctggacacattcggacctgtcacactgatccaggatgcgcatattaatatgccatatcaatcctgggagctgcgtccgctggacgtgaacaaagttctattaacagtgacaactgtttttaccgaaattcagatacaaataaaagagaatctctgcatgctcagttccattaagcttaaagacaagaagcacattagtatcttggagggaacctggatgacccccattccattcatcatcgccctgaaggaggcagggttgaatatctttccaacccgccactctcatttttacgtgatcatcaataataaggtccccttggtagaagtgaaagcctatcgccaaatggctctgctcagttccgcctttgcctttggctggtcaaaatggaatctgctgtgcaatagtaccaaagtggtctttaaatggtag

SEQ ID NO: 27106 - DNA, 279 bp, Artificial Sequence
  Description of Artificial Sequence: Synthetic coding sequence
atggagcggctcgagatccagcggatcgaaaaagaaaaatggcaccgcctggaagcaaaggatctcgagagaagaaacgaggagcttgaggagctgtatttgcttgagaggtgtttccctgaggctgaaaaactcaagcaggagacaaaacttctctcccagtggaaacactatattcaatgcgatgggtcgccagatccgagtgtggcccaggaaatgaatacttttatctccctctggaaggaaaagactaatgagactttcgaggaggtgatctag

SEQ ID NO: 27107 - DNA, 1974 bp, Artificial Sequence
  Description of Artificial Sequence: Synthetic coding sequence
atggatctggaacgtagaaacgaggaattagaggagctgtatctcttagagaggtgcttccccgaggccgaaaaattaaagcaagaaactaaactgcttagccagtggaaacattatatccaatgcgacgggtcccccgatccttctgttgcccaagagatgaacacatttatttccctgtggaaagagaaaaccaatgaaacctttgaggaggtcatcgaaaagtcaaaggtggtcttgaaccttatagaaaaattaaaattcatactacttgaaacccctccctgcgaccttcaggacaaaaacataattcagtaccaggagtctatattgcaactccaagaactactccatctcaaatttggagtggctacggagatactcttgaaacaggcttcaacccttgcggatctggatagcggcaatatggaaaaggttatcaaggacgaaaatgtgacactatacgtttgggcgaacctcaaaaagaatccccgccataggagcgtgcggttttctgagacccagattggcttcgaaatccccagaattctcgccacttccgatatcgccgttagacttctccacacccactacgaccacgtgtctgcactgcacccagtgagcactccaagcaaggagtacacctctgccgtgacagaactcgtgaaagatgatgtgaaaaacgtggagaaagccattagtaaggaagtggaggaagagagcaagcagcaagagcgcggttcccatttgatacaggaggaggagataaaggtggaggaagaacagggagatatcgaagtgaagatgtccagcgctgaggaggagagcgaggctatcaagtgcgaacgggaaatgaaagtgctaagtgagactgtatccgcagcccaactgctcctcgttgaaaattcttccgagaagcctgatttcttcgaagacaacgtggtcgatctctgtcaatttactacactgggaggagtttatcaccttgacatcctggaactgcctcctcaatgtaagcctgtcaagggttggatgatcgtagaaattctgaaggaagggctacaaaaatacacctacccacctgaaacaactgaggaattcgagacggaaaacgcttttccgcccattgaggttacgctggaggttcacgagaatgtgatcttcttcgaagatccagttgtagttagatgggatgccgaagggaaacactggcggactgacgggatctcaaacgttagttataaaccaaaggaaaggctcgtcacattcagcctcgacacattcggacctgtgacactgattcaagatgcgcatatcaatatgccataccaaagttgggaactgcggccactcgatgtcaataaagtgctgcttactgtcactacagtatttacggagatccagattcagatcaaggaaaacctctgtatgttgtcatcaatcaaactcaaggataaaaaacacatcagcattctggagggcacatggatgacccctattccgttcataattgcactgaaggaggccggactgaacatatttcccacccggcactctcacttctacgttatcattaacaataaagttccgctggtggaagtgaaggcctaccgccagatggccttgctgtcttccgcttttgctttcggttggtctaaatggaatctgctgtgcaacagtaccaaagtcgttttcaaggtcagggagcacctgaccgaggcctgcacagagaacccaaattgggctcttttgatgttcagtggcgatagagcccaaaggctgaagattaaggaggaaagcgaagcatttagtgaggccctcaaggaagaaactgaatttcactctactctttaccatatggtcaaagattttgcatccgaggaagctatggagaaggtgaggtctagtaattgtcaattcgttaattctgtatgccacatgctgctgtccactcgtcttttgtcttattcgtag

SEQ ID NO: 27108 - DNA, 411 bp, Artificial Sequence
  Description of Artificial Sequence: Synthetic coding sequence
atgatgcatacaacttcctacagacgcctctcccccccccacctgacggatcagccaagcgcttatagccacactcaccggacatttagccatttcagctgcggttcccagcccgctgcacagcggctgcacgtggagctctggaatgctgaccttcagtctgaattcttgtgtccctgtcttggattgacactttacttgacttgtaacccccaactcgggaagcggaagttttgctcccactcatccgaggacatgagtaagatggtcagccgcaggaacgtgaaggatagccatgaggtgtcaggctctctgcaggcgacccttcaagtgatttctttcagctttccctttctactgcacacgtgcagtcatccactgagccatcctacatctggacagcgccgatag

SEQ ID NO: 27109 - DNA, 570 bp, Artificial Sequence
  Description of Artificial Sequence: Synthetic coding sequence
atgaccgacaaaaccgaaaaagtggccgtggacccagagactgtgttcaaacggccgcgggaatgcgattccccttcgtatcaaaagcgccagagaatggcactactcgcacggaaacagggagccggagattctctgatcgctgggtctgccatgtccaaggagaaaaaactgatgacaggacacgccattcccccctcacagcttgactcacagatcgacgacttcacaggcttctccaaagacaggatgatgcagaaaccgggcagcaacgcgccagtaggagggaacgtgacatcttccttctcgggtgatgatcttgaatgtagagaaaccgccagtagtcctaaatctcagagggagatcaacgccgatattaagcggaagctcgtgaaagagcttagatgcgtgggccaaaagtatgaaaagatcttcgagatgctggaaggcgtgcagggacccaccgctgtgagaaaacgtttctttgaaagtatcattaaggaagccgccaggtgtatgaggagagactttgttaagcacctgaagaagaagctgaaaaggatgatatag

SEQ ID NO: 27110 - DNA, 867 bp, Artificial Sequence
  Description of Artificial Sequence: Synthetic coding sequence
atgagcgcaaccggcgatcgccaccccacacaaggagaccaagaggctccagtttctcaggagggggcccaggctgaggctgcaggtgcggggaatcaagaaggaggggattccggacctgatagctctgatgtcgtgcccgccgccgaagttgtcggtgtcgcaggtccagttgagggcctgggcgaggaggagggagaacaagccgccggacttgcagccgtccctcgggggggatctgcagaagaggactctgatatcggacccgccactgaagaagaggaggaagaagagggaaatgaagccgcgaactttgacctggctgtggtggccagacgctaccctgctagtggaatacactttgtactgcttgatatggttcacagccttctgcatagactgagccacaacgaccacatcctgatcgaaaacaggcagctgagccgtctcatggtcggaccccacgctgctgccaggaacctgtggggtaacttacctcctttgctcctgccccagcgtcttggagcgggtgcagccgcacgtgccggagaaggcctggggttgatccaggaagccgcttcggtccctgagccagctgtgcccgcagacctcgcagaaatggcacgggagcccgccgaagaagcggcagaggagaaattgtccgaagaggccactgaggaaccggacgccgaggaacctgcaacagaagaaccgactgctcaggaggctaccgcccccgaggaagtgacgaagtctcaacctgagaagtgggatgaagaagctcaggacgcagctggagaagaagagaaggagcaggaaaaagaaaaggacgctgaaaacaaggtgaagaattcaaaggggacctag

SEQ ID NO: 27111 - DNA, 867 bp, Artificial Sequence
  Description of Artificial Sequence: Synthetic coding sequence
atgagcgctaccggggatcgacacccaactcagggggatcaagaggccccagtcagccaggagggtgctcaggccgaagccgccggggctggaaaccaggaggggggagacagcggccccgactcttccgatgtcgtgcccgctgcagaagtcgtgggggtcgctggccccgttgaagggctcggagaggaggagggcgaacaggccgcggggctggccgcagtgccccggggagggagtgctgaggaggacagcgatattggacctgccaccgaggaggaagaagaagaagaaggcaacgaggcggccaacttcgacctagccgtggtggccaggcggtaccccgctagcggcatccacttcgttttactggacatggtgcacagtctcctgcacagacttagccataacgatcacattctgatagagaaccgacagctgtccagactcatggttggcccacatgcggcagcacgcaatctctggggaaacctgcctccactactgctaccacagagactgggcgcgggggccgcagcaagagccggagagggcttggggctgatccaagaggccgccagcgtgcctgagccagctgttcctgcagaccttgccgaaatggcaagggaacccgccgaggaggcagccgaagaaaaactgtctgaggaggccaccgaagaacccgatgccgaagaacctgctacagaagagccaaccgcccaagaggccacagctcctgaagaggtgacaaagtcccagcctgagaagtgggatgaggaggctcaagacgccgccggtgaagaggaaaaagagcaggagaaggagaaagacgccgagaacaaggttaagaatagcaagggaacttag

SEQ ID NO: 27112 - DNA, 495 bp, Artificial Sequence
  Description of Artificial Sequence: Synthetic coding sequence
atgggagatctccccggcttggtgaggctgtcaattgcgctcaggattcagccgaacgacggtccagtattctacaaagtggatgggcagcgattcggccaaaatcgcacgatcaaactccttacgggctcgtcttacaaagttgaggtgaaaattaaaccatctactctgcaagtcgagaatatctcaattggcggagttctcgtgccgctcgaactgaaatccaaagagcccgatggagatagagtagtgtacacgggcacctacgacacggaaggcgtcactcccactaagtcaggcgaacgacaaccaatacagattacaatgccctttactgatattgggacgttcgagaccgtgtggcaggtaaaattctacaactatcacaagagggaccactgccagtggggatcacctttcagcgtaattgaatacgagtgcaagccgaacgaaaccagatctctgatgtgggtcaacaaggaatcatttctctag

SEQ ID NO: 27113 - DNA, 387 bp, Artificial Sequence
  Description of Artificial Sequence: Synthetic coding sequence
atgggagacctccctgggttagtaagattatctatcgcgctgcggatacagccgaatgacgggcccgtcttctataaggtggacggacagcgtttcggccagaaccgcaccattaagctgctgactggctcatcatataaggtcgaggttaagatcaagccctctactttacaggtcgagaacataagcatcgggggcgtgctggtgccactggagttgaaatctaaggaacctgacggtgatcgcgttgtgtacaccggcacttacgatacagagggagtgaccccaacgaagagtggggagaggcaacctatacaaatcaccatgccagagtgcctcgagcagcgcccccaagagatcagtctcacatacgaatgcgaagaatag

SEQ ID NO: 27114 - DNA, 279 bp, Artificial Sequence
  Description of Artificial Sequence: Synthetic coding sequence
atgaatgattataagttagaggaagaccctgtgacgaaagagagaacatttaagcgctttgcccctcggaagggcgataagatctaccaggagtttaagaaattatacttctactcagacgcctatagacccttgaagttcgcttgtgagacaatcatcgaggagtatgaagacgaaataagttctctaatcgcccaggaaacccactacctcgcagacaagctgtgtagcgaaaagagcgacttatgtgaaactagtgctaaccacactgagctctag

SEQ ID NO: 27115 - DNA, 3141 bp, Artificial Sequence
  Description of Artificial Sequence: Synthetic coding sequence
atgcagaaaccttccggactgaagccaccaggtagaggaggaaaacacagctcccccatgggtcgtacttctacagggagtgcctcgtcatcagcagcggtggctgcatctagtaaagaaggatcccctttgcacaagcagtcatccgggcccagttcgtcccctgccgccgcagccgctcccgagaaacctgggcctaaagccgcagaagtcggagacgactttttaggggattttgtggtgggtgaaagagtatgggtgaacggtgtgaagccaggagttgttcagtatctgggcgagacacagttcgccccaggtcagtgggcaggtgtcgttctagatgatcctgtcggcaagaatgacggcgctgtgggaggcgtgcgatactttgagtgccctgccctgcagggcatctttaccagaccatctaagctgacaaggcaacccaccgccgagggcagtggctctgacgcacactccgtagagtccctaaccgctcagaatctgtctctgcactccgggactgcaacacctcccctgacctcccgggttatcccactccgagagtccgttttgaatagcagcgtgaaaactgggaatgagtcaggcagtaatctcagcgattccggaagtgttaagcggggggaaaaggatctgaggttgggggaccgtgtcctagtcgggggaacaaagaccggggtggtgaggtatgtgggggagacagacttcgccaaaggcgagtggtgtggcgtggaattggatgagccattgggaaagaacgacggcgccgtggccgggacccggtactttcagtgtcccccaaagtttggcctcttcgcccccatccataaggtgattcggattgggttccctagtactagcccggctaaggcaaagaaaaccaaaaggatggccatgggagtgtctgctttaacacatagccctagctccagtagcatttcgagcgtgagctccgttgcctcaagtgtcggtggaagaccatcccgctcgggcctgcttactgagaccagctctaggtacgctcgaaagatttcaggtactactgccctgcaggaggcccttaaagagaaacagcaacacatcgagcagcttttggctgagagagaccttgaacgcgcagaagtggcaaaggccacatcccatatatgtgaggtcgaaaaggagattgccctgctgaaggcccagcatgagcagtacgtggcagaagccgaggaaaaactgcagcgggctcggctactggtggaaagtgtgcgaaaagagaaagttgatttgtccaaccagcttgaggaggagaggcgtaaggtggaggacttgcaatttcgagtcgaggaagaaagcatcacaaagggtgatcttgagacccagacccagcttgagcatgcacggataggggaattagaacagtcgctcctacttgagaaggcacaggcagagcgtctcttacgggagctggcagacaataggctgaccacagtcgccgaaaaaagcagagtgctgcagttagaagaagagctgacgctccggcgcggagagattgaagaattgcagcaatgccttttacactctggcccacctccgcccgatcaccctgatgcggctgaaatcctcaggctgcgtgagaggctattgagcgcctcaaaagagcatcaaagagaatccggcgtactacgggacaagtatgagaaagccctgaaggcataccaagcagaagtggataaactccgggctgcgaacgaaaaatatgcacaggaagttgccgggctgaaggataaggttcagcaggcgacctccgaaaatatgggcttgatggacaactggaagagtaagctggactcgcttgcctccgatcatcagaagagcctcgaggatcttaaagctactctgaactctggaccgggcgcacagcagaaagaaatcggagagctgaaggcggtgatggaaggaatcaagatggagcaccagctggaactggggaatctccaagccaagcatgacttggagaccgctatgcatgtaaaggagaaagaagctctgcgggagaaattgcaggaggcacaggaggaattggcaggactgcagcggcattggagagctcagcttgaggtgcaggcctcccagcaccgcctcgaactacaagaggcccaggaccagcgcagagacgctgaactccgagttcacgaactggagaaactcgacgtggaataccgaggacaggcccaggctatcgagtttctgaaagagcagataagcctggccgaaaagaagatgttggactacgagcggcttcagagggctgaggctcaagggaagcaagaggtggaaagccttagagaaaagctgttggtagctgaaaacaggctgcaggcagtcgaggcgctgtgcagcagccagcatacccatatgatagagtctaacgacatttctgaggagaccatcagaactaaagagacggtggagggtttgcaagataagctgaacaagagggacaaagaagttaccgctctgacatctcagactgagatgctccgggcccaggtcagtgccctggaatctaagtgcaagagcggcgagaaaaaagtcgacgccctgctgaaggaaaaaagaagacttgaggccgaactagaaacggtgagccgtaagacacatgacgcctccggtcagctcgtcctgatctctcaagagctgctgcggaaggagcgtagtctcaatgagttgcgtgtgctcctgctggaggccaaccggcattcacctggccccgagcgagacctgtcacgggaggtgcataaagcagagtggaggattaaggaacagaaattgaaggacgacatcaggggtttgcgtgagaaactgaccggcctagataaggagaaaagcctgtctgaccagaggcgatatagcctgattgaccgctctagcgcgccagagctcttacggctacagcaccaattgatgagcactgaggacgccctgagagatgccttagaccaggcgcagcaggtggaaaaactgatggaggctatgcgtagctgcccagacaaagcgcagactattggtaattcagggagcgccaacggcatacaccagcaggataaagcccaaaaacaggaggataagcactag

SEQ ID NO: 27116 - DNA, 2118 bp, Artificial Sequence
  Description of Artificial Sequence: Synthetic coding sequence
atgacaattgaggatctgcctgacttcccactcgaaggtaatcccctcttcgggcgttatccttttatcttctcagccagcgatactcccgtgatcttctctatatctgcggcgcccatgccctcggattgtgaattcagcttttttgatcctaacgatgcatcttgccaggagatcttattcgaccctaagacttcagtgagtgaactgtttgctatactccggcaatgggtgcctcaagtgcagcagaatatcgacatcattggtaacgaaattctgaaaagggggtgcaatgtgaatgaccgtgatggactaaccgatatgactctcttgcattacacatgtaaatcgggtgcccacggcatcggcgatgtggagactgctgtcaagtttgcaacgcagttaattgatttaggggcagatatctcattacgctcccgctggaccaacatgaacgccttgcattatgccgcctattttgatgtccctgaattgatcagggtgatcctcaagacctcaaaacccaaagacgtggacgccacttgttcggacttcaattttggaacagctctccatattgcagcctacaatctttgcgccggtgccgtaaaatgcctcctcgaacagggggctaatccagcatttaggaatgataaggggcagatacctgcggacgtagttcccgatccagtggacatgcctctggagatggccgacgctgctgccactgctaaggagataaaacagatgcttctggacgcggtcccattgagttgtaatatctccaaagcaatgctgccaaattacgaccacgtcactgggaaggccatgttaacctcgttgggactcaaactcggtgatagagtcgttatcgccgggcagaaagttgggacattaagattctgcggcacgactgaattcgccagtggacaatgggccgggatcgagctggacgagccggaaggtaaaaataatggcagcgtgggtaaagtgcagtactttaagtgtgcgccaaaatacgggattttcgccccactttccaagatatcaaaggccaaaggacgtaggaaaaatattacgcacactccttcaacgaaagccgctgtgcctcttatacggagtcagaaaatagacgttgctcacgttactagtaaggtgaacacgggacttatgacatcaaagaaggactcagcttcagagtctaccttgtccttaccacctggagaggagctcaaaaccgtgactgagaaggacgtcgccctgttagggtccgtatcgagctgtagcagtacgagctctctggaacaccgtcaaagctatccgaaaaagcagaatgccatctccagtaacaagaaaacaatgtctaagagccctagcttaagctcacgagcgtctgccggccttaactcaagcgctacatctacggccaataatagtaggtgcgaaggcgagctgcggctgggcgagagggtgctcgtcgttggccagcgtctgggaactatacgctttttcggtactactaactttgctcctgggtactggtatggcatcgaactggaaaaacctcacggcaagaacgatggaagtgtgggaggagtgcagtacttctcttgctcaccccgttacgggatttttgctcctccctcacgcgtgcagagggtgacagacagccttgacacactgtcggagatctcatctaataaacaaaatcatagctacccagggttcaggaggtcgtttagcactacgagtgcgtcgtcacagaaagaaatcaaccgtagaaatgcattctctaagtctaaagctgccctgagacgctcctggagcagtaccccaacggccggcgggatagagggctccgtcaagttacatgaggggagccaggtgttactcacaagtagtaacgaaatgggcactgtgcggtacgttggtcccacagactttgccagtggcatttggcttgggctcgagctgcgcagcgcaaagggcaaaaacgacgggagcgtgggggacaaaaggtatttcacatgtaaacccaatcacggcgtcctcgtgcggccgagcagagtgacttatagagggatcaatggttctaaactcgtggatgagaactgctag

SEQ ID NO: 27117 - DNA, 2172 bp, Artificial Sequence
  Description of Artificial Sequence: Synthetic coding sequence
aagatgacgatcgaggacctcccagacttcccattagagggaaatcccctgtttggaaggtacccctttatcttcagtgccagtgacactcccgtgatcttcagtatctcagccgcccccatgccatctgactgtgagttctcctttttcgaccccaacgacgctagctgccaggaaatcttatttgaccctaaaacttctgtaagtgaactgtttgctatcttgcgtcagtgggttccacaggttcaacagaatattgacattataggaaacgagattcttaagaggggttgcaacgtcaacgatagagatggcctgactgatatgaccctgttacactacacatgtaagtcaggggcacacggaatcggagacgtggaaacagctgtcaaattcgctactcagctgatagacctcggtgccgacatatccctgaggtccagatggactaatatgaacgctttgcactacgccgcctattttgatgtaccagagctcatacgcgtcatcttgaagacctccaagcccaaagatgttgacgccacttgttctgacttcaatttcggcaccgccctgcacatcgctgcctacaatctttgcgctggcgctgtgaagtgccttcttgagcaaggcgcgaatcccgcctttagaaatgacaagggacaaatccccgccgatgtggtgcccgacccagtcgacatgccccttgaaatggccgacgcagccgcaaccgctaaggagataaaacagatgctgctggacgccgttcctttaagctgcaatatttctaaggccatgcttccaaattacgaccacgtgaccggcaaagcaatgctgacaagcttaggactgaagctaggagacagggtggtcattgcagggcaaaaagtggggacactgagattctgtgggacaactgaattcgcctccgggcagtgggctgggatcgagctcgacgagcctgagggaaaaaataatggatcagtgggcaaggtccaatacttcaagtgcgcccctaaatacggtatcttcgcccccttatccaagatctcaaaggcgaaaggtcggagaaagaatatcactcatacgccctcaaccaaagccgccgtaccactgatccggtcccagaagattgatgtggcacacgttacaagtaaagtaaacacagggctcatgacgagcaagaaggacagtgctagcgagtccaccctctctctccctcctggggaggagctcaagacagtcaccgagaaagatgtagccctgttgggctccgtgtcatcctgcagcagtacctcgagcctcgaacacaggcagtcatatcccaagaagcagaatgcgataagcagcaataaaaaaactatgagcaagtcgccctctctctctagccgggctagtgcaggaatttacggcttctttaaccaggcgtttctcgtattctttatcctcgtttgtctgtttgaattcctcagtaatatttatagcaactccaggtgtgagggggagctacggttaggggagcgagtgctggtggtcggccagaggctcggcacaatcagattttttggaacaactaatttcgctccagggtactggtacggcatcgagttggagaagccccacggtaaaaacgacggcagcgtgggcggggttcagtacttctcatgctcccccagatatggaatttttgcaccacccagcagagtgcagcgggtcaccgactccttggacaccttatccgagatttcctccaacaaacagaaccacagttatcccggattcagacgaagctttagcactacatccgcgtcttcccaaaaggagattaataggcggaatgccttctcgaagagcaaagctgccctgcggagaagttggagcagcaccccaacggccggagggatcgaggggagcgtgaagctgcatgaggggagtcaggtgttacttacctccagcaacgagatggggacagtgcggtatgtcggccccacggacttcgcctccggaatttggctcggcctagaacttcgctccgccaaagggaaaaacgacggatcggttggtgataagagatatttcacctgtaaaccaaaccacggcgtgttggtcaggcctagtagggtgacctacaggggcattaatggtagtaaattggtggacgaaaactgttag

SEQ ID NO: 27118 - DNA, 2124 bp, Artificial Sequence
  Description of Artificial Sequence: Synthetic coding sequence
atgacgattgaagacctgccagacttccctctggagggcaatcctttattcggacgatacccgttcatcttttccgccagtgatacccccgtgatcttctccatcagcgctgcccctatgccatccgattgcgagtttagctttttcgaccccaacgacgcttcttgccaggagattttgttcgacccaaagacctctgtttccgagctgttcgcaatactacgacagtgggtgccccaggtgcaacagaacattgatataattgggaacgagattttgaaacgcgggtgcaatgtaaacgatcgcgatgggctcactgacatgaccctcctccattacacctgcaagtcaggggcacatggcattggagatgtagagaccgccgtcaagttcgcaacacagctgattgatcttggggcggatatttccctacgttcacgttggactaatatgaatgccctccactacgctgcctacttcgatgtgcctgagctcattagggtgatcctgaagacttctaaacccaaagacgtagacgctacttgcagtgacttcaattttggcacggctctccatatcgcagcctacaatctctgtgcaggtgccgtcaagtgcctgttggagcagggagctaaccccgcattccgtaatgataaaggtcaaattcctgccgacgtcgtgccggaccccgttgacatgccccttgagatggccgacgccgctgcgaccgcaaaagagataaagcagatgctcctggatgccgtgccactctcctgcaacatctctaaggctatgttgccaaactacgaccatgtcaccggcaaggccatgctcaccagtcttgggttgaaactcggagacagagttgtgatcgccggccagaaagtcggcactctgaggttttgtgggacaaccgagtttgccagcggccagtgggcaggtatcgaacttgatgaaccagaaggtaagaacaacgggtccgtgggcaaggtacaatatttcaagtgtgcacctaaatacggcattttcgcaccactttcaaagatcagtaaagctaaggggaggcgaaagaatattacacacaccccatccaccaaggctgcggttcccctgattcgcagtcagaagatagatgtggctcatgtgacctctaaggttaatacgggactcatgacttcaaaaaaagacagcgcaagcgagtctacactcagtctgccacctggggaggaattgaagactgtgactgagaaagatgttgctctgcttgggtccgtgagctcgtgctcttccacatcatctctggagcaccggcagtcctacccaaagaagcagaacgcaattagcagcaataagaagactatgtctaagtcccccagtctgtcttcaagggcctctgccggactcaactctagcgcaacaagtaccgcgaacaactcgcgttgcgagggagaactgaggctgggggaacgtgtgctcgtagtaggccagagactcggcactattagattctttggcactaccaatttcgcaccagttttaggttactggtacgggatcgagcttgaaaagccgcacggcaagaatgacggttctgtgggtggcgtgcagtatttctcttgcagcccaagatacggaattttcgcacctccatccagggtgcagagagttaccgattccttggataccctgagcgagatctcatccaacaagcagaaccacagttatcctgggttcagacgcagcttctctacgacatctgcgtcctctcaaaaggaaatcaacaggcgaaacgccttttctaagagcaaagcggcactcagacgctcctggtcaagtaccccaaccgcaggcggtatcgaagggagcgtcaaattgcacgaaggttcccaggtactcctgacctcaagcaatgagatgggcactgtacgttatgtaggccccacggatttcgccagtgggatatggctgggtctggagctccggtctgcaaaaggaaagaatgacggaagtgtcggcgacaagcggtactttacctgcaaacccaatcacggtgttctcgtgcggcctagccgagtcacttaccggggaattaatggctccaagctggtggacgagaactgctag

SEQ ID NO: 27119 - DNA, 2118 bp, Artificial Sequence
  Description of Artificial Sequence: Synthetic coding sequence
atgactatagaggacctccctgattttccactggaaggaaacccactctttggacgataccctttcattttttccgctagcgatactcccgtcatctttagtatatccgctgcccccatgccgtcagactgtgagttcagcttctttgacccaaatgacgcctcgtgtcaggagatactgttcgatcccaaaacgagcgtctcagagctgttcgcaattctgcggcaatgggttccccaagttcagcagaacattgatatcatcgggaatgaaattctcaagaggggatgcaacgtgaatgaccgtgacggcctgaccgacatgacactgcttcactacacgtgtaaatccggagcgcacggcatcggggatgtggagacagctgtgaaattcgcaactcagctgatcgacttgggagccgatatcagtttgcggagccgctggaccaatatgaacgcactgcactatgcagcctactttgacgtgcctgagctgatccgggtgatattgaaaacatcaaaacccaaggatgttgatgcgacatgtagtgactttaacttcggcaccgcgctgcacattgccgcatacaacctgtgtgcaggcgcagtgaaatgcctgcttgagcagggcgccaaccccgcctttcggaacgacaagggacagatccctgctgatgtggtgcccgacccagttgatatgcctctcgaaatggcagatgccgctgccaccgcaaaagagataaaacagatgctgctggatgctgtccctttgagttgtaacatctccaaagcaatgctcccgaactacgatcacgtgacaggcaaagctatgctgacatctctaggcctgaaactcggcgaccgagtggtgatcgcagggcagaaggtgggcacactgaggttctgcggaaccacagaattcgctagcggccagtgggctggcattgagctcgatgaaccagaagggaagaataacggctccgtcggcaaggtacagtatttcaaatgtgcccccaagtatggaatattcgctcccctgagtaaaattagcaaggccaaaggacgccggaagaatatcacccatacgccctctaccaaggctgcagtgcctctgatccgcagccagaaaattgacgtggcacatgtgacaagcaaagtaaacaccggcttaatgacctccaagaaggactcagctagtgagagtaccctctccctgccacccggcgaagaactgaagacagtgactgaaaaagatgttgcccttctcggttccgtgtcttcgtgttcctctactagctccctggagcatagacagtcataccccaaaaaacagaatgctatttcctctaacaagaaaacaatgtcgaaatcccctagtcttagcagtagagcttccgcaggcttgaattcttcagcaacttcaactgctaacaatagccggtgtgagggggagctcaggctgggagaaagggtgctggtggttggccagaggctgggtaccatcagattttttggcacaactaatttcgccccaggctactggtacggcattgagcttgaaaaacctcatggcaagaacgatggttctgtagggggagtgcaatatttttcctgttccccacgctacggcatttttgctcctccgtcacgggtacaacgcgtgacagactccctcgatactctgagtgagatatcatccaataagcaaaaccattcttaccccggatttcggcgaagcttctctaccacgagtgcaagctcacagaaggagatcaaccgacggaacgcgttctcaaagagtaaggctgcactacggcggagctggtcatcaaccccaactgccggaggaatcgaggggtcagtgaagctgcacgagggtagccaggtgctcctgacttcttccaacgaaatgggaaccgtccggtacgtgggaccaaccgatttcgctagcggcatctggttggggctcgagttacggtctgcgaagggtaaaaacgacgggtcagtgggcgataagcggtactttacctgtaagcccaaccatggggtgctggttcgtcccagccgcgttacataccggggtataaatggaagtaagttggtggacgaaaactgttag

SEQ ID NO: 27120 - DNA, 645 bp, Artificial Sequence
  Description of Artificial Sequence: Synthetic coding sequence
atgactattgaggacttgccagacttcccactggaggggaaccccctgttcggacgctacccctttatattctcagcctctgatacacctgtgatattttctatctccgctgccccaatgccgtccgattgcgaattttccttttttgatcctaacgacgcttcatgtcaggaaattctgttcgatccaaaaaccagcgtctccgagctctttgcaatactaaggcaatgggtccctcaggtccagcagaacattgacattataggcaatgagatcctgaaacgggggtgcaatgtgaacgatagagacggcctcaccgatatgacattgctgcattatacctgtaaatccggcgcccacgggattggcgacgtggaaacagctgtcaaatttgctactcagctcattgatctcggagcagacattagtctgaggtctcgatggacaaacatgaatgctcttcactacgcagcctatttcgatgtacccgaactgatccgggtgatcttgaagacctcgaagcctaaggacgtggacgctacatgtagtgactttaatttcgggactgcattgcacatcgccgcctataacctgtgcgctggcgccgttaaatgcctactagaacaaggagctaacccggcatag

SEQ ID NO: 27121 - DNA, 1998 bp, Artificial Sequence
  Description of Artificial Sequence: Synthetic coding sequence
atgcaacgcaggaagcagaaacagaagaacctcaacgaaagccactatctgtgcatgctgcttcagtccgagctatcagaattctctttcttcgatcccaacgatgcgtcatgccaggaaattttgtttgaccccaaaacatctgtgtctgaactgttcgccatcctgaggcaatgggttcctcaggtccagcagaacatcgacatcatcgggaatgagattctcaagagaggatgcaacgtaaatgatagagacggactcactgatatgacactgctccattacacgtgcaagagcggcgctcatggaattggagatgttgagaccgccgttaagtttgccacccaacttatcgacctgggagcggatatatcactacgaagcaggtggacaaatatgaatgctctgcactatgcggcatactttgacgtgccagagcttatcagagtcattctcaaaacatctaaaccaaaggatgtggacgcaacctgctccgacttcaacttcgggaccgcactacacatcgctgcttataatctctgcgccggagccgtaaagtgtctgctggaacagggagctaatcccgcctttcgaaatgacaaagggcagatcccagcagatgtggtacccgaccctgttgacatgccgctggaaatggctgatgctgcggctacagcgaaggagattaagcaaatgctcctcgacgccgtgccactgagctgcaacatttctaaggccatgttgcctaactatgatcacgtcactggcaaggcgatgctgacttcgttaggactgaagctcggggaccgggttgtgattgccggtcagaaagtaggtactctgcggttctgcggtacgactgagttcgcaagcgggcagtgggcggggatagaattggacgagcccgaaggtaagaataatgggagcgtcggtaaggtccagtatttcaaatgcgctcccaagtacggaatcttcgctcctctgtcaaaaatctctaaggctaaggggcggaggaagaacatcacacatactccttctactaaggctgcagtgcccctgatccgctctcagaaaattgacgtggcacacgttaccagcaaagttaatacgggactcatgacgtcaaagaaggattcagcatctgaaagtaccctgagtcttcccccgggtgaggaattgaagacagttactgaaaaggacgtggcgctgttaggcagcgtctcttcaaataagaagacaatgtctaaatctcctagcctttcttcaagagcaagtgcaggcctcaactcaagtgcaacatcaactgccaacaattcccgctgtgaaggagagctgagactcggtgaaagagtgttggtggtcgggcaacgacttggcacaattcgtttctttgggacaactaactttgctcctgggtactggtacggcatcgagctggaaaaaccacacggaaaaaacgacgggtcagtgggcggcgtgcaatacttctcctgctcacctaggtatggcatatttgccccaccatcacgggtgcagagagtaaccgatagtctagatactttgagcgagatctcatcaaataaacagaaccatagctaccccgggtttcgtaggagcttctcgaccacatctgcttcttcccagaaagagattaatcggcgcaacgccttttctaaatccaaggcggctctccggcggagctggtcctccacccctaccgccggagggatcgaggggagcgtaaaactgcacgagggctctcaggtgctcctgacctcaagcaatgaaatgggtaccgtgaggtacgtcgggccgacagattttgcctctggaatttggctcggcctcgaactgcgatccgccaagggaaagaatgatggtagtgtaggtgataagcgctacttcacctgtaagcccaaccatggggttctggtgcgtccgtctcgcgttacatatcgtgggattaacggatcaaaacttgtggacgagaattgctag

SEQ ID NO: 27122 - DNA, 1173 bp, Artificial Sequence
  Description of Artificial Sequence: Synthetic coding sequence
atggtcacacgggcgggcgctgggaccgccgtcgccggagcagtggtagtggccctgctgtccgccgcccttgctctttacggacccccattggacgccgtactcgagcgcgctttcagcctgcgaaaggcccacagcataaaagatatggagaataccctgcagctggtgaggaatatcattcccccattgagtagcaccaagcataaaggacaggatggccgtataggggtggtcggcggatgtcaggaatatactggggctccttattttgcagcgatctccgctctgaaggtgggggctgacttgagccatgtgttctgtgcttcagccgcagcaccggttattaaggcctacagtcccgaactgatcgttcatcctgtcctcgatagcccaaatgcagtccacgaagtagagaagtggctgccacgcctccacgccctggttgtgggccccggcctaggcagggacgacgctttactgagaaacgtgcagggcatcctggaggtctccaaagcacgagacatccctgtcgttatcgacgcagacggcctgtggctggtagcacagcagcccgctttaatccacggatatcggaaagccgtgctgacccctaaccacgtcgaattttcccgcctgtatgatgcagtgctccgaggccccatggattctgacgactctcacgggagcgtgctgcggttgtctcaggccctggggaatgtcacagtggttcagaagggcgaacgggacattctgtccaatgggcagcaggtgcttgtgtgcagccaagagggctcaagcagaaggtgtggtgggcagggtgacctgctgagcggctcattgggagtgctagtccactgggccttgctcgccgggccacagaaaacaaacggcggcataagcgacttgaagttgacgatctgggggcctgagatcgagacgggcgttaagactcgagctcagggctcttgtggtcctaggacaacgacacccaccagcccacacctgctgctttccccttcaccccaggtgcagcccagtcctgggggcagagtgtggcgtcttctgagccaccaggcggtgcagccgccttccctcccagaggctaggtcgttgcaccatcacctacggcacgatcgcaggggtggaggccggttgcagcaagccctgtag

SEQ ID NO: 27123 - DNA, 366 bp, Artificial Sequence
  Description of Artificial Sequence: Synthetic coding sequence
atggccctgggacctcgctgtggggcaatcagagcttgcaggagagtgctggagcgcgcattttccctgcgcaaagcccactccattaaggacatggagaacacccttcagctggtgagaaatatcattcccccactatcaagcacaaagcataagggtcaggacggccgcatcggggtcgtgggcggttgccaggatgactccccaaatgcggtgcacgaagtggagaagtggctcccaaggctccacgccctggtcgtgggtccaggactgggtagggacgatgcccttcttaggaatgtccagggcattttggaggtgtcgaaggctcgcgatatacctgtggtgatagatgcggtgtcatag

SEQ ID NO: 27124 - DNA, 714 bp, Artificial Sequence
  Description of Artificial Sequence: Synthetic coding sequence
atgctcccagacggcccaggttcctctctctggggcaacccaggactgcagacttctgactcacccaacgcagtgcacgaggtcgagaagtggctgccccgacttcatgcacttgttgttggcccaggcttgggacgtgacgacgctttgctgcgcaatgtacagggtatcctggaagtcagtaaggctagggacatccccgttgttattgatgccgacggcctctggctggtcgcccagcagcccgctctcatacacggatataggaaagccgtgctgacgccgaaccacgttgaatttagtcggctttacgacgccgtgttgcggggacccatggacagcgacgatagtcatgggagcgttctgcgcctgtcacaggctctggggaatgtgacggtggtccaaaagggcgagcgtgatattctgtccaacgggcaacaggttctcgtctgctcacaggagggcagtagcaggagatgtggtggacaaggggatctgctcagtggctccctcggggtactggtgcattgggcccttctcgccggacctcagaaaactaatggttcctcacccctcctcgtagccgcattcggtgcttgtagccttacccgccagtgcaatcatcaagcattccaaaaacacggccgctctactacaacgagcgacatgatagcggaggtgggagccgcattcagtaaactatttgagacgtag

SEQ ID NO: 27125 - DNA, 972 bp, Artificial Sequence
  Description of Artificial Sequence: Synthetic coding sequence
atggctctgggtcccagatgtggcgcaataagggcatgcaggagagttctggagagagccttcagcctgcggaaagctcattctatcaaagatatggaaaacaccctgcagctggtacgtaacataattccaccactgagttccacgaaacacaaggggcaggatgggcggattggagtggttggaggatgtcaggaatacacaggagctccttacttcgctgcaatatccgccttaaaagtcggcgctgatctttctcacgtattttgcgcctccgcagcagcacctgtgattaaggcttattccccggagttaatcgttcacccagtgctggactctcctaacgccgtgcacgaagtagaaaaatggttaccgagactgcacgccctggtggtaggtcctggtctgggtcgcgacgatgccttactgaggaacgtgcaggggatcctcgaagtctctaaggctcgggacatacctgtagtgatcgacgctgatggtctctggttggtcgcccagcagcctgctctcattcatgggtaccggaaggcagttctcactccgaaccacgtcgagttcagtagactgtatgatgccgtgctaagagggcccatggattccgatgattcacacggttctgtgttacgtctgtcccaggcactgggcaatgtaacagtggtgcaaaaaggcgagcgagatattcttagtaatgggcagcaggtgttggtgtgttcacaagaggggagctctcgtcgatgtgggggccagggcgacctgctgtctggttcgctgggcgtgcttgtacattgggccctgttagccggcccacagaaaacaaatggaagctcacctttgctggtggccgccttcggggcgtgttccttgactagacagtgtaaccaccaggcatttcagaagcatggcgcatgccaaatcttcaacctctctattaattggttgccactgcgcatctag

SEQ ID NO: 27126 - DNA, 651 bp, Artificial Sequence
  Description of Artificial Sequence: Synthetic coding sequence
atggccgtttttcctgctacagcaaggggacagcttggcattagaaacgctgcgagatggccctgggtgctggctgtcggacaatccggactggcagacgaaggcatcctggaagtctccaaagcccgtgacattcccgtagtgatcgacgctgacggcctgtggctcgtggctcaacagcccgctctgattcacggatatcggaaggcagtgctgaccccgaatcacgtagagttctctaggctgtacgacgccgtcctccgcggtcccatggacagcgacgattcccatggaagtgtgctgcgcctttcgcaggcgctcgggaatgttacagtggtacagaaaggtgagcgggacatcctctccaacggacagcaggtactggtttgctctcaggaaggcagcagccggaggtgcggcggccagggagacttgctatcaggcagcctaggggtccttgtccattgggcgctcctggccggaccccaaaagacaaacgggtcaagtccccttctcgtggccgcattcggagcctgttcgctgacgaggcagtgtaatcaccaagcatttcaaaagcacgggaggtctaccacaacctctgacatgatcgctgaggtgggagctgctttttctaaactgttcgagacatag

SEQ ID NO: 27127 - DNA, 789 bp, Artificial Sequence
  Description of Artificial Sequence: Synthetic coding sequence
atgtcccggctctcttggggctaccgcgagcataacggtcccatccattggaaagagttcttcccgatcgctgacggtgatcaacaatctccaatcgaaatcaaaacgaaggaggtgaagtatgattccagtcttagacccctttccattaaatacgatcccagctccgctaagattatctctaatagcggacacagctttaatgtggatttcgacgataccgaaaataagtcagtgctaaggggaggcccattaacgggatcataccgtctgagacaggttcacctgcactgggggagcgctgatgaccacgggagtgagcatatcgtcgacggcgtcagttatgccgccgagctgcacgtggttcactggaacagcgataagtacccaagtttcgtggaggctgcccatgaacctgatgggctggccgttctcggcgtgtttcttcaaataggcgaaccaaattcacaactgcagaagatcaccgacacattggatagtattaaggagaaaggcaaacagacccgattcacaaatttcgatctcctgtcactcctgccaccctcttgggattattggacatatccaggatctttaacagtgcccccactgctcgagagcgtcacgtggatcgtcctgaagcagcctatcaatatctcgtcccagcagttagcaaaatttcgctccctgttgtgcaccgccgagggggaggccgctgcatttctggtctcaaaccataggcccccccagcctctaaaaggtagaaaggttcgcgcaagcttccactag

SEQ ID NO: 27128 - DNA, 1311 bp, Artificial Sequence
  Description of Artificial Sequence: Synthetic coding sequence
atgcagggcactcccggcggaggcaccaggccgggtccttcacccgtggacagaaggacactgctcgtgttctccttcattctggccgccgcactgggacaaatgaatttcacaggcgatcaggtcctcagagtcttagcaaaggacgagaaacagctttccttactcggtgatctggaagggctaaaacctcaaaaagtcgacttttggcgcggccctgcccggccatctcttcctgtcgacatgcgagtcccattttctgaattaaaagatatcaaggcctaccttgaatcccacggtctggcatattccattatgatcaaagatattcaggtgctcctggatgaagaacggcaggcaatggccaagtctcgaaggcttgagcgatccactaattccttctcctattcgtcatatcatacactggaagagatttactcgtggattgacaatttcgtcatggaacatagtgacatagtcagcaagattcagatcggaaatagcttcgaaaaccagagcatcctcgtcttgaagtttagcactgggggatcgcggcaccctgctatctggattgatacaggtattcactctcgtgagtggattacccacgctactggcatctggacagctaataagatagtatccgattatggcaaggatagggtgttgacagacatcctgaacgcaatggatatctttattgagctggtgactaaccctgacggctttgcctttacgcactctatgaaccgtctgtggcggaagaacaagtctatccggccaggaatcttctgcatcggcgtggacctgaataggaactggaagtcagggtttggcggcaacggtagtaatagcaacccatgttctgaaacatatcatggtccttctccacagagcgaacccgaagtcgccgccatagtcaacttcattactgcacacggtaattttaaggccctcatctccattcactcttattctcagatgctaatgtatccctatggaagactgttagagccagtgtccaaccagcgcgagctgtatgatctggccaaggacgcagttgaagcattgtacaaggtccacgggattgagtacatttttggctccattagtacgaccttgtatgttgcctctgggatcactgtcgattgggcatatgactccgggatcaaatacgcattcagcttcgagctaagggacaccgggcagtacgggttcttgctgcctgctacccagattatccccactgcccaggaaacttggatggcactgcgaacaattatggaacacactctcaatcacccctactag

SEQ ID NO: 27129 - DNA, 1311 bp, Artificial Sequence
  Description of Artificial Sequence: Synthetic coding sequence
atgcagggcacccccggaggaggcaccaggccaggcccttctccagtggataggagaacactgctcgtgttttctttcattctcgccgccgccctgggccaaatgaactttaccggcgatcaggtgctgagagtcctggctaaagacgagaagcagcttagccttcttggtgatctcgaggggttaaaaccccagaaggttgacttttggagagggcctgcaaggccgtcccttccagtggatatgagagtgcccttcagtgagctgaaggacattaaagcttatcttgaaagtcatggcctggcctactctataatgatcaaggacatccaggtgctactcgacgaggagcgccaggcaatggccaagtccaggaggctcgagcgcagcaccaactcttttagctattcgagctaccacaccctcgaggagatttattcttggatcgacaattttgtaatggaacattcagacattgtgtctaagattcagatcggaaattcgttcgagaaccaaagtatcctcgtcctgaaattctccacgggtgggtctaggcaccctgccatttggattgacacaggcatccattctagggagtggatcacccacgcgaccgggatttggacagccaataagatcgtctccgattacggcaaagacagggtgttgactgatattctgaacgcaatggatatattcatcgagctggttaccaatcccgatggctttgcttttacacactccatgaataggctttggaggaaaaacaaatcaatcaggcctgggattttttgcatcggtgttgacctgaaccgaaactggaagtctggctttggaggaaatgggtccaattctaatccctgctcagagacgtaccatggcccctccccccagagtgaaccagaggtagctgccattgtgaatttcatcaccgcccacggcaattttaaggccttgatatccatccacagttattctcagatgctgatgtacccgtacgggcgactcctggagcccgtgtctaatcaacgcgagctgtacgatttggcaaaagatgcggttgaggcactctacaaagtgcacgggatagagtacatatttggtagcatttccaccacactttacgtcgcatcggggataacggtcgactgggcatacgacagcggcataaagtatgctttcagctttgagctgcgggacactggacagtatggattcctccttccagccacccagatcatacctactgcccaggaaacttggatggctcttcgtaccatcatggaacatactctgaatcatccctactag

SEQ ID NO: 27130 - DNA, 2196 bp, Artificial Sequence
  Description of Artificial Sequence: Synthetic coding sequence
atgtcaagaccgggcacagccacgccggctctggccttagtgctcttagcggttacgctggcaggggttggggcacagggagcagcactggaggaccccgattattacgggcaggagatctggtccagagaaccctactacgctagaccggagcccgagctcgagacattttcccctccgctcccggccggccctggggaagagtgggaacgccgaccccaggagccccgacccccaaagcgcgcgacaaaaccaaagaaggccccaaagcgtgaaaaatctgcgcctgagcccccgccgccaggaaaacacagtaataagaaggtgatgcgtaccaaatcaagtgaaaaagcagccaacgatgatcactccgttcgggtagctagggaggatgtaagggaaagttgcccacctctgggccttgagacgcttaaaataactgatttccagctgcacgcttcaaccgtgaagagatatggcctgggggctcacaggggacggctaaatatccaggccggcatcaatgaaaatgatttctacgatggcgcttggtgtgccggcagaaacgacttgcagcagtggatcgaggttgatgccaggcgcctaacacgcttcaccggcgttatcacacagggccgcaattctctttggctatctgattgggttactagctataaggttatggtttcgaacgattcccatacttgggtgacagtcaaaaacggatcaggtgacatgattttcgaaggaaactccgagaaagagatccccgtcctgaacgaacttcccgtgcctatggtggccagatacatccgcatcaatccccaaagttggtttgataacggcagcatctgtatgcggatggagattctgggatgccctctgcctgatcccaacaactactatcatcgtcggaacgaaatgaccaccaccgacgacctggactttaagcaccacaactataaagagatgcggcagcttatgaaagttgttaacgaaatgtgccccaatatcacacggatttataatatcggcaaatctcaccaggggctgaaactttacgccgtggaaatcagtgatcatcctggcgaacatgaggtgggagaaccagaattccattacatcgccggcgctcacggtaacgaggtcctcggccgggagctcctgctgctgctggtccagtttgtttgccaggagtacctggcgagaaacgcccggattgtccacctggtcgaagaaactcggatccacgtcctcccatccctgaatcccgacggatatgagaaggcttacgaaggcggcagcgagctgggcggctggtccctggggcgttggacccacgatggaatcgatatcaacaacaatttccctgacctcaatacccttctgtctgagaacgccaccgtggccgcagagacccgcgctgttatcgcctggatggaaaagatcccatttgtgctcggaggcaatcttcagggcggggagttagtggtggcctatccttacgacctcgtccggtcgccttggaagacccaagagcatacacccactcctgatgatcacgtgttccgctggttagcctatagctatgcctctactcatcggctgatgactgacgcaagaagaagagtatgccatactgaggattttcagaaagaagaaggtacagtcaatggtgcttcctggcatactgtagctggcagcttgaatgatttttcctacctccataccaactgtttcgaactctcaatttacgtgggctgtgataagtaccctcacgagtcacaactgcccgaagaatgggagaataacagggagtctctaatagtgttcatggagcaggtgcaccgcgggatcaagggactggtccgagattcccatggaaaaggtatacccaatgccattatcagcgttgagggaatcaaccatgatattcgaactgcgaatgacggcgattattggcgcctgctgaacccaggggagtatgtagtaacagccaaagctgagggtttcaccgcctctacaaagaactgcatggtgggatacgacatgggggccactcgatgcgacttcacccttagcaaaactaatatggctcgtatccgagagatcatggagaagttcggcaaacagccagtcagtctgccagcaagacgcctcaaacttcgaggacaaaagagaagacaaagaggctag

SEQ ID NO: 27131 - DNA, 1770 bp, Artificial Sequence
  Description of Artificial Sequence: Synthetic coding sequence
ctggagatacaggcaggcattaatgagaacgacttctacgacggcgcatggtgtgccgggcggaatgatttgcaacagtggattgaggtggacgctcggcggctaacccgcttcaccggggtgataactcaggggagaaattccctgtggctgagcgattgggtcacttcatacaaggtaatggtgtcaaacgactcccatacctgggtgacggtcaaaaacggatctggcgatatgatcttcgaaggtaatagcgaaaaggaaataccagttctgaatgagctgccagtgccaatggtcgctcggtacatccggattaacccccaatcttggtttgataacggctccatttgcatgagaatggagatcctcggttgcccacttcctgatccaaataattattatcacagacgtaacgagatgactactactgacgatctggattttaagcatcacaattacaaggagatgaggcaactcatgaaagtggtgaacgagatgtgccctaacatcaccagaatttataacatcggaaaatcccaccaaggtttgaagctctacgctgttgagataagtgatcaccctggggaacacgaggtgggggaacccgaatttcactacattgcaggagcacacggtaatgaagtgttaggcagggaactcctactgctactcgtgcagtttgtctgccaagagtatttagcgcgcaatgctaggatcgtgcacctggtggaggaaacccggattcacgtgttgccttcccttaacccggatggctatgagaaagcttatgagggaggctctgagctggggggatggtcactcggtcgatggacacacgacggaatcgacattaataacaacttcccggacttgaatacgctcctatgggaggctgaggaccgccagaacgtcccacggaaagtgccaaaccactatatcgccattcctgaatggttcctgagcgagaatgccacagtggcagcagagacgcgtgccgtcatagcttggatggaaaaaatacctttcgttcttggaggcaacctccagggaggtgagctggtggtcgcctatccatatgatctagttcgttcaccatggaaaactcaagagcatactccgaccccagacgaccacgtgttccgttggctggcatattcatacgcttccacccacaggctgatgaccgatgctcgcagacgagtgtgtcacaccgaagattttcagaaagaggagggtacagtgaatggagcaagttggcatactgtggccggcagtttaaatgacttcagctacctccacacaaattgtttcgagctgtcaatatatgtcggatgtgataagtaccctcatgaatcccaacttcctgaggaatgggagaataatcgggaaagcttgattgtgttcatggaacaggtccacaggggcatcaagggcctggttcgggacagccatggtaagggcatccctaatgccattatttctgtggaagggataaaccacgacatacggaccgccaatgacggagattactggcgtttgctcaatcctggggagtatgtggtaaccgccaaggcagaaggcttcaccgcatctaccaagaattgcatggtgggctatgatatgggagcaacacggtgtgatttcacactgtctaaaacgaatatggcccggatccgcgagatcatggaaaaatttggcaagcagcccgtgtcactgcctgctagacgcctgaagttgagaggacaaaagagaaggcagcgagggtag

SEQ ID NO: 27132 - DNA, 1464 bp, Artificial Sequence
  Description of Artificial Sequence: Synthetic coding sequence
atgagcgatcttcttagcatctactccgcccctgtggtcgtcagcacagtactgcacatcactattgtgtttccaattctgcagatacgcaaactgcgtctgggtagggtgcataagcttccccgagtgctggaggtgggcaattctggaacgatgtccagggcctatactttcttctttctaaggtggaattctatggccctgactgggtattcttggctgctgcttagtgcgactttcctgaatgtaggagcagagatctctattacgctcgagccagcgcagccctccgaaggcgacaacgtcacccttgtcgtgcacgggctctcgggcgagcttctggcctactcgtggtatgctgggccgacattaagcgtgagctatcttgtggccagttacattgtgtctactggcgacgagaccccaggccccgctcacacgggtagggaagcagtgcgccccgacggcagcctggatatccagggtatcttgcctagacattctgggacctatatcttacagaccttcaatcgacagctccagacagaggtcggatacggccacgtgcaggttcatgagattctggcccagcctacggttctggcaaatagtaccgcactggtggagcggcgcgacacccttcggctgatgtgttccagcccgtcacctactgccgaggtacgttggttcttcaacggaggtgccttaccggtagcattgagactgggcctgtccccagatggccgcgtgctcgcgcgccatggcatcaggagggaagaagccggggcctatcaatgcgaagtttggaaccctgtttcagtttccaggtccgagcctatcaacctcaccgtctatttcggtccagaacgagtggccattctgcaggacagtaccacccgaacaggctgtacaatcaaggttgatttcaacacttcactgacactgtggtgcgtctcacgctcttgccccgagcctgagtatgtgtggacattcaacggacaggcccttaagaacggccaggaccatctgaatatttcctcaatgaccgcagcacaggagggaacttatacatgcatcgccaaaaatactaagacactcctttccgggtctgcgagtgtcgtggtcaaattaagcgctgccgccgttgccaccatgatcgttccagttcctactaagccaaccgaaggtcaggacgtgaccttgactgtacaagggtatccgaaggatcttttggtgtacgcgtggtacaggggccctgcttctgagccgaatcggcttctgtcacaacttcctagtggaacttggatcgctggacccgcacacactgggcgggaggtagggtttcccaattgcagcctgctcgtgcaaaagctgaatcttacagacacaggccgctacactctgaagacagtgactgttcagggcaaaaccgagacattagaggtggaactgcaggtggcttag

SEQ ID NO: 27133 - DNA, 1278 bp, Artificial Sequence
  Description of Artificial Sequence: Synthetic coding sequence
atggcgctgaccgggtacagctggttgctgttatcggccacttttctcaacgtgggagcggagatctctatcactctcgagcctgcccaacctagcgagggagataacgtcactctagtggtgcacgggttgagtggagagctcttggcttacagttggtatgccggacccactctgtccgtgtcgtaccttgtcgcttcgtacattgttagcactggtgatgagacaccgggtcccgcacatacaggacgggaggcggttagacctgacggctccctggatattcaggggattttgcctcggcattctggtacttacattctgcagactttcaatagacagctgcagacggaggtaggctacgggcatgtgcaagtgcacgagattctggctcaacctaccgtacttgcaaattcaacagccttggtggagagaagggataccctgaggctgatgtgcagtagtccatcccctactgcagaagtccgttggttcttcaatggaggcgccttaccagtcgcactacgcttgggactgtctccggacgggcgcgttctggccaggcacggcatccggagggaggaggccggcgcctaccagtgcgaagtgtggaaccctgtgtcagtcagtcgctctgagccaataaatttgaccgtttacttcggccctgaacgggtcgctatccttcaggactcgacaacgagaacaggttgtacgataaaggtggatttcaacacgtctttgacactctggtgcgtctcccggtcttgtcccgaacctgagtacgtttggaccttcaacgggcaggctcttaaaaacggccaagaccatctcaacataagttccatgacagcagctcaggagggaacctacacatgcattgctaagaataccaagactttgctgtctggctccgcgtctgttgtggtgaaactaagtgcggcggccgttgctacaatgattgtacccgtgcccactaagcctaccgaggggcaggatgtcacgctgaccgtgcaagggtatcccaaagatttgcttgtgtatgcctggtataggggccccgccagcgagccgaataggctgctttcccagctaccctccgggacttggatagccggtcccgcgcatacagggagggaggtcggctttccaaattgttccctcctggttcaaaagctcaacctcactgatacaggacgatataccctaaagacagttaccgtgcaaggcaagaccgaaaccctggaggtcgagctgcaggtcgcgccgctcggctag

SEQ ID NO: 27134 - DNA, 1092 bp, Artificial Sequence
  Description of Artificial Sequence: Synthetic coding sequence
atggacctcagccggcctaggtggtcactgtggcgcagggtcttccttatggcctccctcctggcatgtggtatttgccaagctagcgggcagatcttcattacacagacgctgggaatcaagggctaccgcacagtcgtcgcactagacaaggtacctgaagatgtccaagagtatagttggtactggggggccaacgattccgcaggtaacatgattatttcccataagccacctagtgctcagcagccaggtcccatgtatacaggccgggaacgggtgaaccgcgagggtagtttgctcattcgcccaactgccttaaatgacactggaaactacacggtgcgagtggtggccggcaacgaaacccaaagggccaccggctggctggaggtcttggaattgggcagcaacttgggaatctcggtgaacgcatcaagcctcgtcgagaatatggacagcgtggcagccgattgcctgactaacgtgactaacatcacctggtacgttaacgacgtgcctacaagctcgagcgatcgcatgaccatttcaccagatgggaaaactttggtgatcctccgcgtaagtcgctatgatcgaaccatccagtgcatgatagaatcgtttcctgaaatattccagaggtctgaacgcatttcactcaccgtcgcgtatggaccagattacgttctgctgcgctctaacccggacgactttaacggtatcgttacggccgagatcggatctcaggtggagatggagtgcatttgttacagttttcttgatctcaaataccactggattcacaacgggtctctgctgaactttagcgacgctaagatgaatctgagcagccttgcctgggagcagatggggcgctacagatgtacagtggagaatccggtcacacagttaatcatgtatatggacgtgaggatccaggctccacatgagtgcccattgcccagcggcatcctgcccgtcgttcacagagatttttccatatctggctctatggtgatgttcctgattatgttgaccgtcctgggaggcgtttatatttgtggtgtactgatccatgctctgatttag

SEQ ID NO: 27135 - DNA, 1197 bp, Artificial Sequence
  Description of Artificial Sequence: Synthetic coding sequence
atggaggtctccggatgtccaacccctgcaggccagagcgccccatggggcggaaaggcggcactcaaggccgggagaagggatcgtcaaccactctgccaggaaacgcaagtgcttgagggtgccgaagaagtggctgtgtccctcgaagggcccttgctgctcgaggacccccgccaactgatggacctgagccgccccaggtggagcctgtggcgccgagtcttcctcatggcatcacttctcgcttgtggaatctgccaggcaagcggtcaaatatttatcacccagactctgggaataaagggctacaggaccgttgtagccctggataaagtgcccgaggatgtccaggagtattcctggtattggggggccaacgactccgcggggaatatgatcatctctcataagcccccttccgcgcagcaacccggtcccatgtataccggccgcgagcgcgtgaatagagaaggcagtctgctgatcaggcccacggctctaaacgacactgggaactatacggtccgcgtagtagcagggaacgagacccagcgcgctactggatggctggaagtgctggagctcggatccaacctggggatttccgtcaacgcctccagccttgtcgaaaacatggacagcgtagccgctgattgtcttaccaatgttaccaatataacttggtacgttaacgacgtgccaacttcctcttctgaccgtatgacgatctcacctgatggcaaaacacttgtgattcttcgggttagccgatacgaccgcaccatccagtgcatgatagaaagtttccccgagatctttcagaggtctgagagaatcagtctcacagtggcttacggtcccgactatgttctcttgaggagcaaccctgacgatttcaatgggatcgtgaccgccgaaattggaagccaagtggaaatggagtgtatttgttacagtttcctggatctaaagtaccactggattcacaacggcagtctgctgaatttcagtgatgctaaaatgaatttgagctccctagcttgggaacaaatgggccgataccggtgcaccgttgagaacccagtaactcaattgattatgtatatggatgtcaggattcaggcaccgcacgagtgtagttcatccccccctggcagttgttttgcacatcttcctgcaagcatgccgtgttag

SEQ ID NO: 27136 - DNA, 705 bp, Artificial Sequence
  Description of Artificial Sequence: Synthetic coding sequence
atggaaaagtgcaagggaacatctcgcatggccggtactacgtctgcagacgtgaagatgagctctagcgaggaagtaagttggatctcttggttttgcgggcttcggggcaacgaatttttttgcgaggtcgacgaggattatattcaggacaagtttaatctgactggcctcaacgaacaggtacctcattaccgacaggcgttggacatgatcttggacttagaaccagatgaggagctggaggataatcctaatcagagcgacctcatcgagcaggctgccgagatgctttatgggctgatccatgctcgatatatcctcaccaatagagggattgctcagatgctggaaaagtaccagcagggagatttcggctactgcccgcgagtttattgtgaaaaccagccaatgctcccaattggactgagcgacataccaggcgaggcgatggtcaaactgtattgtcccaaatgcatggacgtatatactcccaaaagtagccgccatcaccacacagatggagcatactttggcaccggcttccctcacatgttgttcatggtgcacccagagtacaggccaaagcggcctgccaatcagttcgtgcctaggttatatggtttcaaaattcatcctatggcttaccagttacaactgcaagcggcctctaactttaaaagcccagtgaaaaccatccggtag

SEQ ID NO: 27137 - DNA, 294 bp, Artificial Sequence
  Description of Artificial Sequence: Synthetic coding sequence
atggctgacaaagtgctgaaagagaagcgtaagctttttatccattccatgggcgagggaaccatcaacgggcttttagatgaactgttgcagaccagagtgctgaatcaggaagaaatggaaaaggtgaaacgggagaatgccacagtcatggataaaactcgcgccctcatcgactcagtgatcccaaaaggagcgcaggcatgccaaatttgtataacctatatctgcgaagaggactcctacttggccgaaaccctgggcctatcagccggcccgatacccggcaactag

SEQ ID NO: 27138 - DNA, 594 bp, Artificial Sequence
  Description of Artificial Sequence: Synthetic coding sequence
atggctgataaggtactgaaggagaagaggaagctgtttattcactcaatgggcgagggtacaatcaacgggctgctggatgaactactccaaaccagggtgctcaaccaggaagagatggagaaggtgaagagagagaacgcgaccgttatggacaagacaagggctcttatagatagcgtcatcccaaagggcgcacaggcatgccagatttgcatcacctacatatgcgaggaggatagctatttagcggagaccctggggctgagcgccgccctgcaggccgtccaggataatcctgcgatgcccacatgcagtagccccgaaggtcgtataaagctgtgcttccttgaggacgcccaaaggatatggaaacagaaactgcagaggtgtcatgtacagaatacaatcatcaagtggtctgagaggtacacctctgggagtttcgaaatgcaatggctcttcctcaggactaattttatcgagcggttctggaggaacatcttgctgctgcccctgcataagggttcattatatcctcggatcccaggacttggaaaagaactgcagacaggaacccacaagttatcgtag

SEQ ID NO: 27139 - DNA, 294 bp, Artificial Sequence
  Description of Artificial Sequence: Synthetic coding sequence
atggctgataaggtgctgaaggaaaagcgtaaacttttcattcacagcatgggcgagggaactataaatggtctgctcgacgaactgctccagacacgggtgctgaatcaggaagagatggagaaggtgaagcgcgaaaacgcaactgtcatggacaaaacgagagctctgatcgatagcgtcattcccaaaggcgcacaggcgtgtcaaatatgcatcacatatatatgcgaggaggatagctaccttgccgaaaccctcggcctcagtgctggtcccatcccagggaattag

SEQ ID NO: 27140 - DNA, 273 bp, Artificial Sequence
  Description of Artificial Sequence: Synthetic coding sequence
atggctgatcagcttctgcgcaaaaaaaggagaattttcattcatagcgtgggagcaggtacaattaacgccctcttagattgtcttctggaagacgaggtgatcagtcaggaagacatgaataaggttcgggatgagaatgatacagtgatggataaagcccgagtgctgatcgaccttgtgaccggaaagggaccaaaatcctgttgtaagttcatcaagcacctatgcgaagaggaccctcagctggcctctaaaatgggactgcactag

SEQ ID NO: 27141 - DNA, 672 bp, Artificial Sequence
  Description of Artificial Sequence: Synthetic coding sequence
atggccctgtcggtccctctgctttatagtttagtgagagcgatatctgaagccggagcaccacccggatctgccggtccactcctgctgcaaccccagaggcaccgagccgcaggatgctttcttggcacctgtctggacttacttgacagctttaccctcgtcgagttgatgctggagggaagggtacccctccccgcccacctccggtatttacttattgccgtgtacttccttaccctggccagccccgtattgtggctgtatgaactgaatgcggcagctgcagctgctgcctcgtggggccaggcctccgggccaggaagctgctcacgcctgctccgcctgctaggggggtgcctagtcgacgtgcctttactagctcttcgctgtctgctggtcgtttcctaccagcagcctctgtcgatttttatgctcaagaacctctttttcctcggttgtcgaggattggaagcactggaagggtgctgggacaggggaaatagggccagcccttcacgggctaggggcgggtacggcgctccgccctccgccccgccacctcccccacccccaccccagggaggcagccagctgggccactgcatatcagagaatgaaggcggagcacacggctatgttaatactctggctgtggcctcacaaaattag

SEQ ID NO: 27142 - DNA, 1737 bp, Artificial Sequence
  Description of Artificial Sequence: Synthetic coding sequence
atgcgaccggcgcttggccacccccggtccgtgagcagtgcctcagggtcctttccaccgcctccagccgcggcccgcctccaaccattgttcctgcgaggcgggtccttccgaggcagacggggcagtggcgactcttctactagcacatccactagcagaggtggcggcggcggccgtcggggggggggggggggtagcccctcatcttctaccggggctgagagagaggacgacgacgaatcacttagcgtcagtaagcctctggtaccgaacgccgccctcctgggcccacctgcccaggtgggcgcccccgcgggaccagctccggtggcgttttcttcctcagccgctaccagctcatctaccagcacccctacatctagctgttcgatgacagctgcggatttcgggggcggagcagcggctggcgccgtgggggggccaggcagtaggtctgcaggaggcgcaggcgggacaggtacgggcagcggcgcctcatgctgcccgtgctgttgctgttgcggatgtcctgaccggcccggccgcagaggtagacggagagggtgtgccccctccccacgctgccgttgggggtaccaggcactgtctgtggtgctgctcttggctcaaggcgggttactggacctttacctgattgctgtcactgacctttattggtgcagctggatcgctaccgatctggttgtggtggtaggctgggcgatattctttgctaaaaatagccgggggaggagaggtggcgctgcttcgggagctcataatcatcaccttcaccatcaccacgctgctccacccttgcacctcccagccccttccgcagctacagctggggccaaggccaggggcgcccgaggaggggcgggaggagccggcggaggcctgggggcagccgctgccgcgggcgaatttgcattcgcctacctggcttggctgatctatagcattgcctttaccccaaaggtggtgttgatcctaggtacaagcatccttgatctgatcgagctgcgcgcaccatttgggacaaccggtttcagactgactatggcgctgtcggtgcctctgctttactctctcgttcgggcaatctccgaggctggggcaccccccggtagcgctgggccactgctgctgcagccccagcgccatcgggccgccgggtgctttctgggaacttgtctggacctgctggactcctttacactggtcgagctgatgttggagggaagagtgccactccctgctcatcttcgctacctgctgattgcggtttattttcttacactggcatctcccgtcctttggttatacgaactgaacgccgcagccgccgccgcagcttcatggggtcaggcctctgggccgggtagctgctcccggctcctgcggctgttggggggatgtctggtcgacgttccacttttggcactcagatgcctgcttgtggtctcttaccagcaacctctcagtatatttatgctgaagaatctgttttttctgggttgtagaggactcgaggcactcgaaggctgctgggataggggaaaccgcgcctccccgagtcgggcgcgaggaggttatggagctcccccatcagccccaccgccaccgccgccaccccctcagggcggaagccagcttgggcactgtatctccgagaacgaaggcggggcccatggctacgttaataccctggccgtcgcctcacagaattag

SEQ ID NO: 27143 - DNA, 2262 bp, Artificial Sequence
  Description of Artificial Sequence: Synthetic coding sequence
atggctgataaaagaaaattgcagggtgagatagatcggtgcctcaagaaagtgtccgagggagtggagcagttcgaagacatatggcagaagctgcataacgccgccaatgcaaaccaaaaggaaaaatacgaggccgacttgaagaaagagatcaagaagctgcagcggttacgggatcagattaaaacctgggtggcatcaaacgagatcaaagataagcgccaattgatagataataggaagctgattgagacgcagatggagaggttcaaggtagtggagcgtgaaaccaagacgaaggcctattcaaaggaggggctgggtttggctcagaaagtggaccccgctcagaaagagaaagaggaagttgggcagtggttaacaaataccattgataccttaaacatgcaggtagaccagttcgagtccgaggtcgagtcactctcagtgcagacgagaaaaaagaagggggataaagacaagcaagaccggattgaaggactcaagcggcacatagaaaagcatcgttatcatgtgcggatgctggagacaatactgcgaatgctcgacaacgacagtatccttgtggatgcaattaggaaaatcaaagacgatgtagaatactacgtggacagtagccaggaccccgatttcgaggagaacgaatttctctatgacgaccttgatctggaggacattcctcaggccctggtggctacatctcccccgtcccattcccacatggaggacgagatttttaatcagtcatcatccacccctacaagtacaacttctagcagccccatcccgccctcccccgctaattgcacaactgagaattctgaggacgacaagaaacgcgggcggtcaacagactccgaagtgtcgcagtccccagctaaaaatgggtcaaaacctgttcattctaaccagcacccacaatccccggcggtacccccgacctatccatccggcccaccccctgccgcaagcgcattgagcacaacacccgggaacaatggagtgccagcaccggccgcaccaccctccgccctcggtccgaaagccagccccgccccttcccacaatagcggcactccggctccttatgctcaggcggtcgctcctcctgcgccttctgggcctagtaccacgcaacctcgccccccttctgtgcagccttcaggaggcgggggaggggggagtggtggtgggggctcaagctcttcttccaactccagtgcgggcgggggggctgggaaacagaatggcgctacatcttacagttctgtcgtggccgactcccctgctgaagtggcactatcctcctccggaggcaacaatgcttctagtcaggccttaggtccaccctccggcccacacaatcctccaccaagcacgagcaaagagccaagtgccgccgcccctactggggccggtggagtggctcccgggagtggtaacaattcaggaggtcccagtctgttggtcccactcccagtgaacccgccttcttctccgaccccgtctttcagtgatgcgaaagcagccggcgctttgctgaacggacccccacagttctcaactgcgccggagatcaaggcaccagaacccttgtcctccctgaagtctatggccgagcgagccgccatctcctctgggatcgaggatcccgtccccacgctccacctgaccgaacgagacattattcttagctctacgagtgctccccctgcttccgcccagcctcctctgcagctgagcgaagtgaacatccctctgtctttgggtgtatgccctctcggccctgtacctttaacgaaagagcagctgtaccagcaagccatggaagaggcagcctggcatcacatgccacaccccagcgactccgagaggattaggcagtatcttccaaggaacccttgcccaacgcctccctaccaccaccagatgccaccaccgcacagcgataccgtagagttctaccaacgattgtcgactgagacactgttttttattttctattacttggagggcactaaggcccagtaccttgcagcaaaggcactcaaaaaacagagttggaggttccacacaaagtacatgatgtggttccaacgccacgaggaacccaagacaataacagacgagtttgagcaggggacgtacatctactttgactatgagaagtgggggcagcgcaaaaaggaaggttttacatttgaatatcgctacctcgaggatcgggacttgcagtag

SEQ ID NO: 27144 - DNA, 2262 bp, Artificial Sequence
  Description of Artificial Sequence: Synthetic coding sequence
atggccgataaacgcaagctacaaggcgagatcgatcgatgtctcaaaaaagtgtccgaaggcgtggagcagttcgaggacatttggcaaaagctgcacaatgcagcgaacgcaaaccagaaggagaagtacgaagcggacctgaaaaaggaaatcaagaagctgcagagattgagggaccagattaaaacgtgggtagccagtaatgaaatcaaggacaaacgccagttaatcgacaatcgcaaattaattgagacccagatggaaaggtttaaggtggtagaacgggagaccaagactaaggcctacagcaaggagggcctgggactcgcccaaaaagtggatcccgcccaaaaggagaaggaggaggtggggcagtggctcactaacacaatcgacaccctgaacatgcaggtggatcagttcgagtccgaggtggaatcgctctccgttcagacccggaaaaaaaaaggggataaggataaacaggacagaatagaaggtctcaaacgccatatagagaaacacagataccatgtccgcatgctggagaccatcctgaggatgctagataacgacagcattctcgtggatgcaatacgcaagatcaaggacgacgtggaatactatgtggactcctcgcaggaccctgattttgaagagaacgagttcttgtacgacgatttagatctggaagacattcctcaggcactggttgcgacatcacctccttcacactcgcatatggaggacgagattttcaaccaatcaagcagtactcctactagcacaaccagttcatccccgattccgccctcccctgctaattgcacaactgaaaactctgaggacgacaaaaagcgtggccgatcaaccgattcggaagtcagccaatctccagccaaaaacggatctaagccagtacacagcaatcagcatccgcaatctccagccgtcccgcctacctacccaagcggccctcctcctgcggccagcgccttatctacaacccctgggaataatggggttccagctcccgccgccccccctagtgcgctgggcccaaaggcgtccccagccccttcccataacagcggcacacctgccccttatgctcaagccgtggccccacctgcaccatctggccctagcactacccaaccaaggccgccctccgtccagccgtctggaggggggggaggtggttccggagggggcgggtcttcttcctcttcgaacagcagcgccggtggcggggcaggcaagcagaacggcgctacatcatattcttccgtagtggccgattctcctgccgaggtggccctgtcttctagtggcggaaataatgcatcctcccaggcccttggacccccgtcgggccctcacaatccacctccctccacgtctaaagagcctagcgcagcggcacctacaggggccgggggcgtggcacccggctctggcaacaacagcgggggtccctcactgctcgtccccctgccagtgaaccctccctccagccctactcccagcttctctgatgctaaagctgctggagccctgctgaatggcccgccacaatttagcaccgctcccgagattaaagcacctgagcccctgtcctctctgaagagcatggcagagagggctgccattagcagcggcatcgaggaccccgtacccactctccatttgacagagagagacattattttgagctctactagcgcaccacccgctagtgcccagccaccgctgcagctctctgaagtgaacattcccctgagccttggcgtttgcccactcggccctgtccccctgacaaaggagcagctttatcagcaagcaatggaggaggcagcatggcatcacatgccacatccttccgattcggagcggatcaggcagtatctgcctcgcaatccctgtcctactcccccttaccaccaccagatgccaccaccacattcagataccgttgaattttaccagagactttcaaccgagactctcttcttcatcttctattaccttgaggggaccaaggcccagtacctagcagccaaggctctcaagaagcagtcctggcgattccataccaagtatatgatgtggttccagcggcatgaagagccaaaaaccataacagacgagtttgagcaaggcacttacatctattttgattatgagaagtggggacagcggaagaaggagggctttacctttgagtaccgttacctggaggatcgcgacctgcagtag

SEQ ID NO: 27145 - DNA, 2262 bp, Artificial Sequence
  Description of Artificial Sequence: Synthetic coding sequence
atggcagataaaagaaaactccagggggaaattgacagatgtttgaagaaggttagtgagggggttgagcaattcgaagatatctggcagaaactgcataatgcagctaacgcgaaccagaaggagaaatacgaagccgatcttaaaaaagagatcaaaaaactgcaacgcctcagagaccagattaagacctgggtggctagtaacgagattaaagataaacgtcagctcatcgacaatagaaaactaatcgagacccagatggaaagattcaaggtagtggaacgggaaacgaagaccaaagcatattccaaagaagggctcggtctggcgcagaaggtagatcccgcccagaaggaaaaggaggaggtgggccagtggctgaccaataccatcgatactctgaatatgcaagtggatcagtttgagtccgaggtggagagcctcagcgtgcagactcgtaagaaaaagggagataaagacaaacaggatcggattgagggattgaagagacacatcgaaaaacataggtaccacgtgcgtatgctggagactatcctcaggatgctggacaacgacagtattcttgtagacgcaatacgtaagattaaagatgatgtggagtactacgttgactccagtcaagaccctgatttcgaagaaaatgaatttctatacgacgatctagatctggaagacataccccaggcactagtcgctaccagccccccctcacatagccatatggaggacgagatctttaaccagagcagcagcaccccaacttccaccacatcttcctcccccattccgccttctccagcaaattgtactacggaaaatagcgaggacgataaaaagagggggcgaagcactgacagcgaagtcagtcaatcacccgcaaagaacggcagtaaacctgtgcacagcaaccagcacccacagagcccagccgtgcctcctacctaccctagtggaccacctcccgccgcatcggctctgtcaacaacccccggcaacaatggagtaccagcacctgctgcgccaccaagcgcccttggccccaaggccagccccgccccgagtcacaactccggaacaccagcgccctatgcacaggcagtggcgccccccgcccctagtgggcccagcaccactcaaccaagaccaccctctgtgcagccttccggcggcggcggtggaggatccggaggcggtggctcatcaagctcctccaatagcagcgccggcggcggcgccggtaaacaaaatggagcaacaagttattcaagcgtggtggctgactcacctgccgaggtggccctatcctccagcggcggtaacaacgcctcatcacaggccctgggtcctccgagcggtcctcacaatccaccaccttccactagcaaggaaccttcagccgctgctcctaccggggcaggcggagtcgcgcctgggtctgggaataactcaggagggccttccctgctggtgcctctgcccgtcaatccaccttcgagccctaccccatctttctccgacgccaaggctgccggcgcactccttaatggcccccctcaattcagcacagcacccgaaatcaaagctcctgagccactgtcctcccttaaaagcatggctgagcgcgctgcaattagtagcggtattgaagatcccgtccccacactccacctcacagaaagagacatcatcctgagctcaacctccgccccacccgcatcagctcagccaccattgcagcttagcgaggtcaatatccctctgtcactgggagtgtgtcctcttgggccagtcccactcaccaaagagcagctgtaccaacaggccatggaagaagccgcttggcaccacatgcctcatccctccgacagtgaaaggatccggcagtacctcccccgcaatccatgtccaacccctccttaccaccaccagatgccaccacctcactcagacaccgtagaattctatcagcgtctgtccaccgagaccctattcttcatcttctattatctggagggaacaaaggcacaatacctcgccgccaaggccctcaaaaagcagtcctggaggttccatacaaagtacatgatgtggtttcagcggcatgaggaacctaagaccataactgatgaattcgagcaaggcacctatatttactttgactatgagaagtggggtcagcgtaagaaggaagggttcaccttcgagtatagatacctggaagacagagacttacagtag

SEQ ID NO: 27146 - DNA, 2262 bp, Artificial Sequence
  Description of Artificial Sequence: Synthetic coding sequence
atggctgacaagaggaagctacaaggagagatcgatcgctgtctaaagaaggtatccgagggggtcgaacagttcgaggacatatggcagaaactgcataatgccgcgaacgcaaaccagaaagagaaatacgaagcggatctgaagaaagagattaaaaagctgcagcgcttacgggaccagatcaagacatgggtagcgtcgaatgaaataaaagacaagaggcagctaatcgacaatagaaaactcatcgaaacacagatggagcgttttaaggtggtggaaagagagaccaaaactaaggcctattccaaggaaggcctagggcttgcacagaaggtggatcccgcccagaaggaaaaggaggaagtaggacaatggctgactaataccattgacactctcaatatgcaggtcgaccagtttgagtctgaggtggagagtctgagcgtccagacccggaagaagaaaggggacaaagacaagcaggaccgaatcgaggggttgaagcggcatatagagaagcacaggtaccacgtgcgcatgcttgagaccatcctgagaatgttggataacgatagtatcttggtggatgccataaggaaaatcaaggatgatgtggaatactatgtggacagttctcaggaccccgattttgaagaaaatgagtttctatacgatgacctggacctggaggacataccacaagcactggtagcaaccagccctccatctcactcccacatggaggacgaaatctttaaccagagttcttctacacccacttcaacaacatccagctcaccgatccctccgagtcccgccaactgtacaaccgaaaatagtgaggacgataagaagagaggacgtagtacagattcggaagtgtcccagtctcccgccaagaatggcagtaaaccagtccattcaaaccagcacccacagtcccccgccgtcccccccacttacccaagcggcccgccccccgctgcctctgccctgagcactacacccggcaacaacggggttcctgcacctgcagctccaccctccgccctcgggccaaaagcgtcaccagcaccgagccataattcaggtaccccagctccctacgcccaagccgtggcaccccctgcgccaagcggtccttctactactcaaccccgcccgccctccgtgcagccatccggcggcggcgggggcggatcaggcggtggcgggagctccagttcctcgaattccagtgcgggggggggggcaggaaagcagaatggcgccacttcctattctagcgtcgtggcagactcgccagctgaagtggccctttcgtccagtggaggcaacaacgcgtcatctcaggcactggggccccctagtggtccccacaatccaccgccaagtacttccaaagaaccaagcgctgctgctcccactggagcgggcggggttgctcccggatcaggaaacaacagcggcggcccgtctctcttagtgccattgcccgtgaatccgccaagttctcccacgccatccttttccgacgctaaggcagcgggggccctgttgaacggccccccccagttcagcaccgcccctgagattaaggcacctgagccactgtccagcttgaagtcaatggctgaaagagccgccatctctagtggcatcgaggacccggtgccaactctgcacctgaccgagcgggacattattctcagctctaccagtgcccctccggccagcgcccaaccaccactgcagctgtctgaggtcaatatacctttgagcctgggggtatgcccattaggccccgtacctctcactaaggagcaactgtatcaacaggctatggaagaggctgcctggcaccacatgcctcatccgagcgattcagagagaatcaggcagtatctgccgcgtaatccttgtcccaccccaccttatcaccatcagatgccacctcctcattcggatacagtagagttctaccagaggttaagcacagagaccttattttttatcttttactatttagagggcaccaaggcccagtacttggccgcgaaggcactaaaaaagcagtcctggagatttcacactaagtacatgatgtggttccaaaggcacgaagagcccaaaacaatcaccgacgaatttgaacaggggacttatatatattttgactatgaaaagtggggacaacgcaaaaaggagggatttacatttgaataccgctatctcgaagatcgggatctccagtag

SEQ ID NO: 27147 - DNA, 2262 bp, Artificial Sequence
  Description of Artificial Sequence: Synthetic coding sequence
atggctgacaagcgcaagctgcaaggagagattgaccgatgcctcaaaaaggtctccgaaggagttgaacagttcgaggacatatggcagaagctccataacgcagcgaacgctaatcagaaggagaagtacgaggccgatctaaagaaagagatcaagaagctgcagcggctcagggaccaaatcaagacatgggtggcctcaaacgagattaaggacaaaaggcaacttatcgataatagaaaactcatagagactcagatggagagatttaaggtggtcgaaagggagaccaagaccaaagcctactccaaagagggacttgggctcgcgcagaaagttgacccggctcaaaaggaaaaagaagaggtgggccagtggctgaccaacaccatcgataccctgaacatgcaggtggaccaattcgagagcgaggtcgagtccctgagcgtccagacgcggaagaagaaaggggataaagacaagcaggacaggatagagggcctgaagcggcacatagagaagcatcgctaccacgtcaggatgctggaaaccattctgcgcatgttagacaacgacagtattcttgtggacgccatcaggaagatcaaagacgatgtagaatactacgtcgacagtagtcaggatccggactttgaggaaaatgagtttttgtacgatgacctggacctcgaagacatccctcaagcgctggtggcgacttcgcccccaagccattcccacatggaagacgagatttttaatcagagttcatccactccgactagtacgacctcatcaagcccgatccctcccagtccagctaattgcacgactgagaactccgaggatgacaagaaacgcggccggagcaccgactcagaagtatcacagagtccggccaaaaacggatcgaaaccagtacacagtaatcagcaccctcagtcgcccgcagtacctccgacttatccgagtggcccaccacctgccgcatccgctctgagtaccactcctgggaacaatggtgtcccggctcctgctgccccaccgagcgccctgggccccaaagcttccccggctccctctcataactcagggactcccgctccttacgcccaagctgttgcaccacctgcacctagcggtccgtccacaactcagccaagaccccctagtgtccagcctagtggaggtggaggggggggaagcggagggggcggctcctctagttcctctaattccagcgccgggggtggcgccggcaaacagaatggcgctacatcttacagctctgtggtcgccgacagtccagccgaggtggccctctcctctagtggcggaaacaatgcatccagccaggccctgggcccaccatctggcccacacaatcccccacctagtacatcaaaagaaccatctgctgcggccccgaccggagccggaggagtggcacctggttcagggaacaattctggggggccttccttgctcgttccccttccagtgaaccccccaagtagccctactcctagcttcagtgatgccaaggctgccggcgccctgctcaatggaccccctcagttttctactgcccctgaaatcaaggcgccagagcctctcagctctctgaaaagtatggcagaaagagccgcgatcagctccggcatcgaagatccggtaccaacactgcatctcactgagcgtgatatcatcctgtccagcacatcagctcctcccgccagtgcgcagcctcctttacaactcagtgaagtcaatatacctctttccctcggagtgtgtccactcggccccgtgcctctgacgaaagagcaactgtatcagcaggcgatggaagaagccgcttggcaccacatgccgcaccctagcgactctgaacgaatcagacagtacctgccccgcaacccatgccccactcctccctaccatcaccagatgccccccccacattccgacacagtggaattttaccagcgtctttctacggaaaccctattcttcattttttactatctggagggcacaaaggcccagtatctcgcagccaaggccttgaagaaacagtcttggcgatttcatacaaaatacatgatgtggttccagaggcacgaagagccgaaaactatcacagacgagtttgaacagggcacttacatctacttcgactatgagaaatggggccagagaaagaaggagggttttactttcgaataccgttatctagaggatcgcgatttgcagtag

SEQ ID NO: 27148 - DNA, 2262 bp, Artificial Sequence
  Description of Artificial Sequence: Synthetic coding sequence
atggcagataaacgcaagctccagggagagattgatagatgccttaagaaggtgagcgagggggttgagcaatttgaagacatatggcagaagctgcacaatgccgcaaacgctaaccagaaggaaaagtatgaagccgaccttaaaaaagagatcaaaaagttgcaacgtctacgggaccagataaagacctgggttgctagcaatgaaatcaaggacaaaagacagcttattgacaataggaaacttatcgagacccaaatggagcgctttaaagtcgtcgagagagagacaaagacaaaagcatattccaaagaaggactcggactggcccagaaagtcgacccagctcagaaggagaaggaagaagtggggcaatggctgaccaatacgattgacacattaaacatgcaagtagatcagttcgagagcgaggttgagtccctcagcgtgcaaacccgcaaaaagaagggagacaaggacaagcaagataggatcgaggggctaaaaagacatattgagaaacacaggtatcacgtgcgaatgttggagaccatcctccggatgctggacaatgactcaatcctggttgatgcaattcggaagattaaagacgacgtagagtattatgttgacagctcccaggaccccgactttgaggaaaatgagtttctgtacgatgatttggacctggaagacatccctcaggcgctggtggctacatcacccccttctcactcacatatggaggatgagatctttaatcaatcaagtagcactcctacttcaactaccagctcgtcccccattccaccatcgcctgccaattgtactactgagaacagcgaggatgataagaaaagaggacggtcgactgacagcgaagtgagtcaatcccctgctaagaatggctcaaagcccgtgcatagtaatcagcacccacagagtccggcagtgcctcctacctatcctagtggcccaccccctgctgcgtcagctttgagcacaacacctggaaataatggcgttcccgcccccgcagctcctccgtccgcccttggacctaaagccagtcctgcacccagccacaactcaggcactcccgccccttacgctcaggcggtggcaccacctgcaccaagcgggcccagtacaacacaacctagaccccctagcgtccagccatctggcgggggcggaggcggatccggtgggggcgggtccagctcatcttcgaactctagcgctggcgggggggcaggaaagcaaaatggcgcaactagttattctagtgtcgttgctgatagccctgccgaggtggccttatcaagctctgggggcaataacgcgtcctcacaggccctaggccccccgagcgggcctcacaatcctcccccatccacaagcaaagagccttccgctgccgcccccacaggtgctgggggagtggctccggggtccggaaacaattctgggggaccttcgctgctagtgcccctgcctgttaacccgcctagtagtccgacaccatcgttctctgatgcaaaggcagccggcgccttactgaacggccccccgcagtttagcacagcgcccgaaatcaaggcccctgagcccctgtccagtctgaaatcgatggccgagcgggcagcaatctcaagcgggatagaagatcctgtgcctaccctccatcttacggaacgggacataatcctgtcgagtacttctgcaccaccggcgtctgcccagcctccgctccaactgtccgaagtcaatatccccttgtccctgggcgtgtgcccgttggggcctgttcctctgaccaaagagcagctatatcagcaggcaatggaggaggccgcatggcatcacatgccacacccgtctgactcagagagaatccgccagtacctgccacgaaatccttgtccaacgcccccttaccatcaccagatgcctccaccacatagtgacactgtagagttttaccaaaggctgtcaacagagacgctgttctttatcttttactatctcgaagggactaaggcacaatatctggccgcgaaagccctcaaaaagcagtcatggaggttccacaccaagtatatgatgtggttccaacggcatgaggaacccaagacgattacagacgagttcgagcagggtacatatatttacttcgattacgagaaatgggggcagaggaagaaagagggttttacattcgagtatagatatctggaagatagagacttacaatag

SEQ ID NO: 27149 - DNA, 2262 bp, Artificial Sequence
  Description of Artificial Sequence: Synthetic coding sequence
atggccgacaagcggaagctccaaggcgaaatcgacagatgtttaaagaaagttagcgaaggggttgagcagtttgaagacatatggcagaagctgcataacgctgccaatgctaaccaaaaagagaagtatgaagccgatctgaagaaagagattaagaaactccagagactccgagaccagattaagacgtgggtggcttctaacgaaattaaggataaaagacagctcatcgataaccgcaagctcatcgagactcagatggagcggtttaaagtcgttgagcgtgagacaaagacaaaagcctattccaaggagggcctgggcctcgcccaaaaggtcgacccagctcaaaaagaaaaagaggaggtaggtcagtggctgaccaacacgatcgatactctgaatatgcaggtggaccagttcgaatcggaggtagagagcctctcagtccagacgaggaagaagaagggtgataaagataaacaagataggattgaaggcttaaaacgccacatagagaagcaccgctaccacgttcgaatgctggagactattctcagaatgctggataacgacagcattctggtggatgccatcaggaagattaaagatgatgttgagtattatgtggactccagccaagaccccgacttcgaagagaacgaatttctgtacgacgacctggatcttgaagatatcccacaagctctggtcgcaactagtccaccatctcattcacacatggaagacgagatctttaaccaaagcagctcaacccctacctctaccacgtcatctagtccaattcctccgtcacccgctaattgcacgacagaaaactctgaggacgataagaaacgcggcaggagcacagactccgaagtgagccagtctcctgccaaaaacggatccaaaccggttcattcaaatcagcacccgcaaagccctgctgtgcctccaacttatccctcaggacctccacccgctgctagtgcactctccactaccccagggaacaacggcgttccagcgccggccgctcctccaagcgcgctgggccctaaggcctcgcctgctcctagccacaattctgggacaccggctccatatgcacaggctgtggcacctccagccccctccgggccgagcaccactcagccccggccaccatccgtgcagccaagcggcggaggtggagggggctccgggggtggtgggtctagtagttcaagcaactcatccgccggcggaggtgcagggaagcaaaacggtgcaaccagttactcaagtgttgtcgccgatagtcctgcggaggtagctctctcttcatcgggagggaataacgcatcctctcaagctctcgggcccccttcaggccctcacaatcccccgccatctacctccaaggagccatcagctgctgcgccgacaggtgcagggggggtcgctcccggctccggcaataactccggcggtcccagtctcctggttccactaccggtgaaccccccatcttctcccacacccagttttagtgacgccaaggctgcgggcgctcttctgaacggccctccccaattttctaccgcacctgaaattaaggcccccgaacccctgtcatcactgaaatccatggccgagcgcgcggccatttcctctggtatcgaagatcctgtgcccacactgcacctgaccgagcgggatatcatcctctcttctacttccgcccctccggctagcgctcaacctcctctgcagctgtcagaggtgaatatccccctgagcctaggcgtttgtcctctcgggccagttcccttaacgaaggagcagctttaccaacaagctatggaagaagcggcatggcaccacatgcctcatcccagcgatagcgaaagaataaggcaatacctgccacgtaatccctgtcctacacccccataccatcatcagatgcctcccccccactcagatacagtcgagttttatcagaggctgagcacggaaacactatttttcattttctattatctggaaggcaccaaggcacagtatttagcagcaaaagctctgaagaagcagtcctggcgctttcatactaagtatatgatgtggtttcagcgccacgaggaaccaaaaacaatcaccgatgagttcgaacagggtacttacatttatttcgactacgagaaatggggccaacgtaagaaggaggggtttacatttgagtaccgatacctggaggatcgggatctgcagtag

SEQ ID NO: 27150 - DNA, 810 bp, Artificial Sequence
  Description of Artificial Sequence: Synthetic coding sequence
atggaaaggctggtcatcagaatgcctttctcccacctgagtacctactccctggtgtgggtcatggccgcagtggtactatgcacagcacaggtgcaggtagtcactcaagacgagcgggagcagttgtacaccccagcttctcttaagtgcagcctgcagaacgcccaggaagcgctgatcgtgacatggcagaagaagaaggccgttagccccgagaacatggttaccttttctgaaaaccatggcgtggttatacaaccagcatataaggataaaatcaacataacccagctgggcctacagaactcaaccatcaccttctggaatattactctggaggatgagggatgctatatgtgcctattcaatacctttgggttcggtaagatttccgggacagcctgtctcaccgtctatgtgcaacccattgtgagcctccattacaaattttctgaggatcatctgaacattacatgctcagcgaccgcccgccctgcacccatggttttctggaaggtgccccggtccggtatagagaatagcaccgtgaccctttcacacccaaatggaacaacatcagtaacctctatcctacatattaaggatcccaagaatcaggttgggaaagaagtgatctgtcaggtcttgcacctgggcacagtcactgactttaaacagaccgttaataagggctattggttttcagttccgctgttactcagtatcgtttcccttgtgatcctgttagtcctgatttcaatactgctctactggaagagacacaggaaccaggatagagagccttag

SEQ ID NO: 27151 - DNA, 885 bp, Artificial Sequence
  Description of Artificial Sequence: Synthetic coding sequence
atggagcgcctgacccttacaaggacaatcggcggcccactacttacagcgacactgttggggaaaacgacaatcaatgactaccaggtcatccggatgccattttctcatctcagcacctactcactcgtctgggtgatggctgctgttgtgttgtgtacggcgcaggtacaggtggtgacccaggatgagagagagcagctctatacgcctgcctcgctgaaatgtagtcttcagaatgcacaggaggccctcattgtgacatggcagaaaaaaaaagccgtctcccccgagaacatggtgacttttagcgagaaccatggcgtcgtgatccaaccagcctataaggataaaatcaacattacacagctcggcctgcaaaattccacaatcacattctggaacatcacgttagaagacgaaggctgttacatgtgcttattcaatacctttggatttggcaaaatatctggaacggcgtgcttgacggtttacgtgcaacccattgtaagtcttcactataaatttagcgaagatcacctcaacattacctgtagtgcaactgctcgtccagcaccaatggtcttttggaaagttcccaggtccggtatcgagaatagcaccgtcaccctgtcgcaccccaacgggacaacttctgtcacaagcatcttacacatcaaagaccccaaaaaccaggttgggaaagaggttatctgtcaagttctgcacctagggaccgttaccgactttaagcaaacagtcaacaaagggtactggttctccgtgcctttactcctgtcaatcgtttctttggttattttgctggtactgattagtatcttactttattggaagaggcatagaaatcaggatagagagccatag

SEQ ID NO: 27152 - DNA, 1377 bp, Artificial Sequence
  Description of Artificial Sequence: Synthetic coding sequence
atgaaccgaggcgtgccattcagacatctgctcttggttctacagctggcgctgctcccggcagctacccagggcaagaaggtcgtgctgggaaagaagggggacacggtggagctgacatgcacagcgtcgcaaaagaaatctatacagtttcattggaagaattctaatcagatcaagatactaggaaaccagggctccttcctgacaaaaggtccatcaaagctaaatgaccgtgctgattcccgcagatctctctgggatcagggcaatttccctctcattatcaagaatctgaaaatcgaagattccgatacctacatctgcgaggtagaagaccagaaagaggaggtgcagctcttagtgttcgggctgactgccaatagtgacacccaccttctccaggggcaaagtcttactctgacactagagtcgcccccaggcagtagtccaagcgttcagtgcagatcccctcggggcaaaaatatccaggggggcaaaactctctcggtgtcccagcttgagctgcaggactcaggtacctggacatgcacggtcctgcagaaccagaagaaagtggaatttaaaatagacatcgtcgtgctggctttccagaaggccagctcaatcgtctacaagaaagaaggggaacaggttgagttcagttttcccctggcctttacagtcgagaagcttaccggttctggcgaattatggtggcaagctgagagggcctcttccagcaaaagttggatcacttttgacctaaagaataaagaggtcagtgttaagcgggtgacccaggaccccaagttgcagatgggcaaaaaattgccactgcacttgacccttcctcaggctttacctcagtacgccggaagcggaaatctaacactcgcactggaagctaaaacaggaaagttacatcaggaggtgaaccttgttgtgatgcgagctacgcaattacagaagaatctgacttgcgaagtgtggggccccaccagtccaaagctgatgttatcccttaaactggagaataaagaagcaaaggtgagcaagagggagaaggcagtttgggttctcaaccccgaagccggaatgtggcagtgtctgctgtccgattccgggcaggttctgctcgaatctaatatcaaagtcctccccacctggtcaacaccagtgcagcctatggccctgatagtcctggggggggtcgctggtctgctgctcttcattggtctgggcattttcttttgcgtaaggtgccggcacaggcggcgccaggcagagagaatgagtcagatcaaaaggctcctatcggagaagaaaacttgtcaatgtccccacagattccagaagacttgttcccctatctag

SEQ ID NO: 27153 - DNA, 789 bp, Artificial Sequence
  Description of Artificial Sequence: Synthetic coding sequence
atggtggcctggcgctccgcttttctggtttgcctggctttctccctggcaaccctggtgcaacgtggctcaggggactttgatgactttaatttagaagatgcggttaaggagacctcctctgtcaagcagccctgggaccacaccacgactaccacgaccaatcggcctggaaccacccgcgcacctgccaagcccccaggctccggattggatctggcagacgccctggatgatcaggatgatgggcgcagaaaacctggaatcggggggcgggagagatggaaccacgtgaccacaactacaaaacgcccagtcacaacaagagcgcctgccaacactttgggtaatgattttgatcttgctgacgctctggatgatcggaatgaccgggacgacggtcgccggaagccaatagccggcggcggcggctttagcgacaaagatctagaagacatcgtcggagggggagaatacaaacctgacaagggcaagggcgacggcaggtacggctcgaatgatgaccctggttcaggaatggtggctgaaccaggcacgatcgctggtgttgcctccgccttagcaatggcactgatcggagccgtgtctagttacatcagctaccaacaaaaaaagttctgcttttctatacagcaggggctgaatgctgactacgtaaagggagagaacctagaagcggtcgtctgcgaggagccgcaggttaagtactcaactctccacactcaaagcgctgagccgcccccgcctcctgagccggcaagaatatag

SEQ ID NO: 27154 - DNA, 1437 bp, Artificial Sequence
  Description of Artificial Sequence: Synthetic coding sequence
atggccgcggcagccgccggaggagcccccgggccggcaccgggtccagcaggtcctccaccacccgccgctcctacttctgccgcccgggccccccctcaagcacttaggaggcggggagactcccgccgacgccaggctgccctgttctttcttaataacataagcctggacggtcggccacctagcttagggcctggcggcgagaaaccccctcctcctcccgctgaggcaagagaaccaccggcaccgccacctcctgaaccacccaccggtctcccagcccgtacccctgccccacaggggctactgtcccctactcaggtgcctacaggcctcgggttggacggacagcggcaaagaaagagagtgacaagtcagcggtgttctctcgaatttttggaagatgcagttggctgtgccccggctcagaggacaaagcatacttctggctccccccgtcataagggattgaagaaaactcacttcatcaagaacatgcgtcagtacgatactaggaacagccgaattgtgttaatatgcgccaagaggtccctatgtgcagccttctccgtcctaccctatggtgaaggcctgcgcatcagcgacctgcgggtggacagccagaaacaaaggcacccttcagggggggtgtcagtgagctctgagatggtgttcgagctcgagggtgttgagctgggggcggacggcaaagtagtgtcttatgcgaaatttctgtacccaacaaatgcactggtaacccacaagtcggactctcatggcctgctgcccacccctcggccctcagtcccaagaacactcccagggtcaaggcacaagcccgcgcctaccaaatctgccccggcaagtacggaactaggatctgacgtcggggacaccctagaatacaaccccaacctgctcgacgacccccaatggccatgcggaaaacataagagagtgctcattttcgcctcctacatgaccacagtgatcgagtacgtaaagccatccgatcttaagaaggacatgaacgaaaccttccgcgagaagtttccccacgtcaagctcaccctgagcaaaatccgatccctcaaacgcgagatgcggagcttgtctgaagaatgttctcttgagcccgtgaccgttgctatggcgtacgtttactttgaaaagttggtgctgcagggaaaactcagtaaacagaaccgaaaactttgtgcaggtgcttgcgtgctcctggcggccaaaatttccagtgaccttagaaagtctggcgtcactcaactgatagataagttggaggaacgatttaggttcaataggcgcgatctcattggatttgaatttactgtacttgtcgcattggaactggccctgtacctgcccgaaaaccaggttctgccccactatagacggctcacacagcagttttag

SEQ ID NO: 27155 - DNA, 801 bp, Artificial Sequence
  Description of Artificial Sequence: Synthetic coding sequence
gacagggcgcacctgtgccaggcagttccagtgagagggctgctggggcctgctctatggggacgacccgctgaccaggtcgtctcttatgccaaattcttgtacccaaccaatgcactggttacacacaagtcagattctcatggcttgctccccacaccgagacctagcgtgcctcggaccctacctggctcaagacataagcctgctccaaccaaaagtgcacctgcctcaacggaactggggtcagacgttggagataccctagagtacaatccaaatttactagacgatccacagtggccatgtggaaagcataaaagagttctcatattcgcctcatacatgactaccgtaattgaatacgtcaagccatccgatctgaaaaaagatatgaatgagacttttagagaaaagtttccacatgtgaaactcactttgtctaagatcagaagtctgaaacgggaaatgcgttccctctccgaggagtgctccctggagccagttactgtggccatggcctacgtctacttcgagaagctggttctgcagggaaagctaagcaagcagaatcgtaagctctgtgcaggggcttgtgtcctgttggcagccaaaatttcctcagacctgcgtaagagcggcgttacacagctgattgacaaactggaggaacggttccgttttaataggagagacttgatcggattcgagtttacggtcctcgttgccctggaattggcactataccttcccgaaaatcaggtcttaccgcactaccgacgcctgacccagcagttttag

SEQ ID NO: 27156 - DNA, 777 bp, Artificial Sequence
  Description of Artificial Sequence: Synthetic coding sequence
tgacaccaggaacaacaggatagagctcacctgtgtcaggctgtgcccgtgcgaggcctgctgggacctgcgctgtggggtcgcccggctgaccaagtggtgtcatatgccaagttcttataccccaccaatgccctggttactcataagagcgattctcacggcttgctcccaaccccgaggccctctgtcccgcgtacgcttcctgggagcagacataaacccgcccccaccaaaagcgcccctgctagcactgagctgggaagtgatgtcggcgatacactggagtataaccctaacctgctggatgacccacaatggccatgtggaaaacataagcgagttctgatctttgcaagctacatgacaaccgttattgagtatgtgaagccctccgatctcaagaaggatatgaacgagacctttcgcgaaaagttcccccacgttaaactcacactgtctaagataagatccctgaaacgcgagatgcgatcattgagcgaagagtgcagcctagaaccagtgacagtcgccatggcttacgtgtactttgaaaagctggtcctccaaggtaagctgtccaaacagaatagaaagctgtgtgcaggagcatgcgtgcttcttgcagctaagatctcttccgatcttcgtaagtcgggggtgactcagcttatcgataagctggaggagcgttttcgcttcaataggagggatctgataggcttcgaattcacggtcctggtggctctggaactggccctatacctgccagaatag

SEQ ID NO: 27157 - DNA, 258 bp, Artificial Sequence
  Description of Artificial Sequence: Synthetic coding sequence
atggtcggaggcgaagctgccgccgccgtggaggagctggtatccggcgtaaggcaagccgccgactttgctgaacagttcaggtcttattcagaaagtgagaagcaatggaaagccagaatggagttcatcctgagacatctgccagattatagagatccaccagatgggagcggaagactcgatcaattactttcgcttagtatggtctgggctaatcatctgtttcttggctgttccccacggggtcctaaatag

SEQ ID NO: 27158 - DNA, 351 bp, Artificial Sequence
  Description of Artificial Sequence: Synthetic coding sequence
atggttggcggggaggccgctgcggcggtggaggagctggtgagcggggtgcggcaggcagccgactttgcagaacagtttcgttcttacagtgagagcgaaaagcagtggaaggcacgaatggagttcatcctacgccatctgccagattaccgggacccccctgacggatccggacggctcgatcaactcctttctctgagtatggtgtgggcgaatcacctgttcctggggtgctcttataacaaagatcttctggacaaggtgatggaaatggcggacgggatagaagtcgaggacttaccgcagttcactactcggtctgagctgatgaagaagcatcaatcttag

SEQ ID NO: 27159 - DNA, 372 bp, Artificial Sequence
  Description of Artificial Sequence: Synthetic coding sequence
atgagttcaggcgggagccccggctgcctacgactcgctgaggggtgccctaaccatcgggcctgggtgcgctggaaccggcggcagccacactctgcattcctaatcgcttcacacctgttcctcagcgtgctcgtttggtttaacagctttcaagggcttgaattggagagtgaaaatcctcggcaccttttgtggaatgtctgtcttgtggtgctggtgtgtccatcctctagccttgcgtgcagattccaggtgtatcagaggactttctgcagtgtggagagccatcgaactaaaagaaaaattcttcagctgttcgccaacatcctgccctatctctataaacagccgtacacgaaaaaacattag

SEQ ID NO: 27160 - DNA, 396 bp, Artificial Sequence
  Description of Artificial Sequence: Synthetic coding sequence
atggggcctgccgctagacccagaaggttcgtgcccggtcctcctggcgacgccaccaccctagaactctacactaaagtgtgtctcccacgtaagagatggcgcctgccacttggtcgcctggcgaggtcgcctagactccaagctcctcgagtgcgggcaggatctagccattcgtgtaaagaggcggccaaatacgtcttccagactttccacggttccaaactgtccgccagcataaagcgttccggtgtgcgcggcaagagcatcctggggatttctatgcagatgaatggtcctggattccaactgcggagtggttttccccctttgcgtgcggagttagctcccagtcatgcacggccagaggcatctgggagatgtccagggggttag

SEQ ID NO: 27161 - DNA, 438 bp, Artificial Sequence
  Description of Artificial Sequence: Synthetic coding sequence
atgggtctgaagtcccatgtactaccagcccctaactctcagggacaaggcagcctttgtatcttcgtctacgtcacatcctacatggactacatccagttacagggcaaggaaaacctggattgttcagggctgaataaacagaaaatcgtcttcccccatagcatggactcgggagatggatggctcatggttcttgtgcagcagctgcatgagggccggggacatgtcctggatccatttgctctcatctccgtactcgtgacttcctggagtcaggacggttgctgcattcccaagaaccatgtgtgcgtgcaaggcaggcggggtgggggcagaggacgcgcaaaattagctgggcccgtaaccttctaccaaaaagtcaagcctcggcagaagtctgtttcatgcagcctaccactgcatattttcacttag

SEQ ID NO: 27162 - DNA, 387 bp, Artificial Sequence
  Description of Artificial Sequence: Synthetic coding sequence
atgctgcaggaagccctgactgaggccagttttctgaaacttgtaattttcttttttttcttcagtttcctgcggagatcactggccttgtccccgcgtctggaatgctccggagccataagcgctcactgcaaccttcgacttctcggcagttcctacagcctcgccagtgccagtagagtgagcggcatcaccgggtctaggcatcacgcgcaattgttcttcgtgttcctggtagaaacaggctttcatcacatcggccaggcaggactggaactcctgacatcaggcgaccctcccacatcagctagccagagcgtgggtattacaggcgtgagccaccgcgcccagcagatgcgcatcatcttcatcttcatcaaactgtag

SEQ ID NO: 27163 - DNA, 597 bp, Artificial Sequence
  Description of Artificial Sequence: Synthetic coding sequence
atgactctgaaggagcacgctgccttcaaacatctcttcaacaaagcgcacctagcacctccactgatccacttgactctgagtggacactccacttgcttccgggagcacagagtggggggcaaggtcatcgaccagcagcaccccaaagctgaagagagtttccttgtccagaataagatggagtccccaatgtcaacatttttctacagtaggcatggcaataatttaatttctttaagcttcccccatattagtcccttcagtatccctcagaacaggcactgccaccacggcttgtttagtatgtcgtgttgggtgaggctccccgatggtgtcgccgctggacagagaggcagtagccttccccggcgtggagggagggccgaggctccccctacgtcacgcacaggcaggcggcctggtggtggtgctccccacttcccggaccgggtcgccgccggtagacgcggctcttcactgttgcgccggggggggtgttgggctgaagggctcctcaccagtcagactggcagacctggcagagacgcccctcacttgcctgacggcgtcgccgccggtcaacgctgcagttag

SEQ ID NO: 27164 - DNA, 450 bp, Artificial Sequence
  Description of Artificial Sequence: Synthetic coding sequence
atgcaggaaatacacgaaaaagtgttgaatgaggtcgtaggcgccatgatgtatcatacattttctcttaccagggaggatcttgagaacttcaaggctctgcgcgtgatcgtccaggttggatccggttacgataacgttgcgataaaagcagccggcgaactggagatcgctgtttgcagcattccgagcgccgcggtggaagagactgccgactccacaactggccacatcctgaatctgtactggggaaataggagtctgtatcaggccctccgggagggcacaagggtgcaatcggtcgagcagatcggagaagtggcaagtgtaaaggcaaggatccgcggtgagatacttggcctaatcggctttgggcgaacacaacaggaagtggccgtacgtgccaaagccttcgccggctgggaccgggcagtgcccggatgcgcgtag

SEQ ID NO: 27165 - DNA, 381 bp, Artificial Sequence
  Description of Artificial Sequence: Synthetic coding sequence
atgggcctaccagctccgtctctacacgcaacgtccactcttaggcctgatcagttttctcctcacaccaacccctctctgagccttccctgtctcaaatcttttccagtgagtctttggccctggggtcgagcctcactcctctgccacttatctaggctgttcgtgtgtcatcgaccactcactcctacctctcaggctcctaatatgttctcatgcgtcagctcctcattgacgttagccgccagcagcgcctggccagccagtcacctgcccatttcacactccccattcctgccccctcatctgctgagatcccagctgtctgtaacctcctcgcgagaaccgcgcctgagcctgcctcttcagttggggcagtag

SEQ ID NO: 27166 - DNA, 1548 bp, Artificial Sequence
  Description of Artificial Sequence: Synthetic coding sequence
atggagtggaagttagaaaggacggcgcctaggcgggtacggacagaagaagaaatgctgtgggagagcataatgagggtcctaagtaaagaccttaaacagaagcggagtcaagactctgcaaatgtgttagattcagtcaatgctacatattctgatttcaagtctaactttgccaagcgactgagcgcagaagttcctgtcgcatccagtcctatcaccacccgatggcagcagagtcagacacgggctctgagctctgacagctttggcgaagagcagtctacaacctatttgcctgaggcctctggtagtgtcttgaagacaccacccgagaaagagaccctgacactgggtagtcgtaaagagcagctgaagacccctagcaaaggaatctctgagacgtctaactccgccttacatttttgcaaggccccacacgccatggacagagattggaaagagtccgtcgctagcaaaggtcagaagtgcctgaagcagctgttcgtcactcagaacgtggtacagcaggctaatggcaagatgcagctgtgcgagcaaagtgaatgcgtctggaagggttgtaaagatggtgtccgcgacgaatctttccacttaaagagcagcggggacatcaacgattctattttacagcctgaggtcaagatccatatcacaggcttgcggaatgattattatctgaatatccttgactggtccttccagaatctggtagcaatcgcccttggaagcgctgtgtacatctggaatggggagaatcataacggaatagagaacatcgatctgtcgctcacatgtaactacataagctccgtcagctggattaaggagggtacctgcctggctgtggggacaagtgaaggggaggtgcaactctgggacgtcgtgactaaaaaaagactccggaatatgttgggtcatctgagcgttgtgggagcgctgtcctggaaccacttcattctctcctcaggatcccgtctggggcgcgtgtaccaccacgacgtgagggtggctcaacatcacgtcgggacactgcggcataaacaggctgtgtgcgctcttaaatggtcccccgacggaagactattatctagtgggtgctctgatggactcctcacgatatggccacatgacccaggagccagtgcccagggacaaccattgaaggtgataacacaaagtactgccgttaaggccatggactggtgcccttggcagagcggagtcctcgcaataggaggcggcatgaaggacggtaggttacacatcctagatattaacgctggaaaatccattcaaacgccaagtacaaactctcagatttgcagtcttatttggttgcctaaaactaaggagatcgcgaccggtcaaggaacccctaagaacgacgtcacggtctggacctgtcctaccgtgagtagaagtggccataggggtagggtgctacacttatccctgtcccctgaccagaccagggtgttctcagcggcagctgatggtactgcttcagtctggaactgttactag

SEQ ID NO: 27167 - DNA, 1434 bp, Artificial Sequence
  Description of Artificial Sequence: Synthetic coding sequence
atggaatggaaactggagcgtacagcccctcggagagtcaggacagaagaggaaatgctttgggagtccattatgagggtcctttctaaggacttgaagcagaagcgctcccaagacagcgctaacgttttggattccgtgaacgcaacctacagtgactttaagtctaacttcgctaaacgcttatcagcggaggttccagtggcttcctcccccatcactactcgctggcagcagtctcagacaagggctctcagtagtgatagcttcggcgaagaacagagcacaacttacctgcctgaagctagcgggtctgtactaaaaaccccgcctgaaaaggaaacactgactctcggaagcagaaaggagcagttgaaaacgccttccaagggcatcagcgaaacctccaacagtgctctgcatttctgtaaagccccccacgctatggaccgcgattggaaggaatcagtggcatcaaaagggcagaaatgccttaagcagctgttcgtcacccagaatgtcgtccagcaggccaacggaaaaatgcagctgtgtgagcaatcagaatgtgtctggaaggggtgtaaagatggcgtgcgtgacgagagcttccatctgaaatccagcggtgatattaatgactccatccttcagcccgaagtcaagattcatattaccggtctgcgtaatgattattacctcaacatccttgactggtcctttcaaaacctggtggccatagccctcggctccgcggtctatatctggaacggagaaaatcataatggcattgagaacattgacttgagcctgacctgcaattatatatcttcagtatcatggatcaaagaagggacttgcttggcggtaggcacgtccgaaggcgaagtccagctctgggatgtagtgaccaaaaaacgactgcggaacatgctgggccacctgtcagtcgtgggggcactgagttggaaccactttatcctctcgtccggttcaagattggggcgggtctaccatcatgacgtgcgagtggctcagcaccatgtgggaactctccgccataagcaagccgtgtgcgctctgaaatggagcccggatggccgacttctgagttctggatgcagcgacgggctgcttactatttggccgcacgatccaggggcgtccgctcagggacagcctctcaaggtgattacacagagtaccgccgttaagatctgtagtttgatctggttgcccaagactaaggagatagcaacaggacagggtacacccaaaaatgatgtgacagtctggacctgccctacggtgagccggagcggtggtttcttcgggcatcggggtagagtccttcacttgagtctctctccagaccagaccagagtattttccgccgcggctgatggtactgcctctgtgtggaactgctactag

SEQ ID NO: 27168 - DNA, 579 bp, Artificial Sequence
  Description of Artificial Sequence: Synthetic coding sequence
atggaatggaagttggaacgcacagccccacggcgtgtccggactgaggaggaaatgttgtgggtcctcgacagcgttaatgctacttactctgactttaagtccaatttcgcaaaaagactgtctgccgaagtgcctgtcgctagtagtccaataacgacccgttggcagcagtcacagaccagagctttgagctccgactctttcggagaagagcagtctacgacctatttaccagaggccagcgggagcgtgcttaagacgcccccagagaaagagaccctgacgctcgggagccgcaaggaacaactgaaaaccccatcaaaaggaatctccgagactagcaacagcgccctgcatttctgcaaggcacctcacgccatggaccgcgactggaaagagtccgtcgccagcaaaggccagaaatgtctgaagcagctctttgtcacacagaatgtggtgcagcaagccaacggaaaaatgcagctctgcgagcagtccgagtgtgtttggaaggaccactttagcggcagtatgaaaaagagattcgagcaagaggatgtcggtggaaaagactag

SEQ ID NO: 27169 - DNA, 1119 bp, Artificial Sequence
  Description of Artificial Sequence: Synthetic coding sequence
atggagtggaaactggagagaacagctcccaggcgggtgagaacggaagaggagatgctatgggaatctatcatgagggtcctttctaaggatcttaagcagaaacggtcacaagattcagcaaatgtcctggattccgtcaacgcgacctacagcgatttcaaaagcaacttcgcaaaaaggctgagcgcagaggtgccggtcgcttctagtcccattaccacaagatggcagcagagccagactagagccctgagttccgatagcttcggcgaggagcagagcactacttacttgccggaagcatccggcagcgttctgaaaaccccgcccgaaaaggaaactctaaccctgggcagccgaaaggaacaactcaaaactccttcaaagggtatcagcgaaacttccaacagtgcactgcacttctgtaaagcccctcacgcgatggatcgagattggaaagagtcggtggcatctaaaggtcagaaatgtttgaagcaactctttgttacccaaaacgttgtccagcaagcaaacggaaagatgcagctttgtgagcagtccgagtgtgtatggaagggctgcaaagacggagtccgtgatgagtcgtttcacctcaaatctagtggagatattaatgattcgatcctgcagcccgaagtgaagatccacattacaggacttaggaatgattactatctaaacatcttggattggtcattccagaacctggtggctattgcgctgggcagcgctgtttacatctggaacggcgagaaccacaacggtatcgaaaatatcgatctgtccctgacctgcaactacatttcatcagtgtcctggataaaggagggtacgtgtctagcagtgggtacatccgaaggagaagtgcagttgtgggacgtagtgacgaagaagcggctcaggaatatgcttgggcatctgagcgtggtcggcgcccttagctggaatcacttcattcttagtcgactggagttctcgggagtcatatccgcccactgcaacctgcatctcccttcttcatgggattataggcgtccccccccgtgcctggttgggcaggactggggagtttttatcataacaatgtttgggtag

SEQ ID NO: 27170 - DNA, 1560 bp, Artificial Sequence
  Description of Artificial Sequence: Synthetic coding sequence
atggaatggaagctcgagcgcaccgctcctcggagggtgcgcactgaagaagaaatgctctgggagtccattatgagggtgctaagcaaagatctcaagcaaaaacgctctcaggattccgcaaacgtacttgatagcgtaaacgcgacctactcagatttcaagtcaaactttgctaagcggttatctgccgaagtacctgtggcaagctcccctatcaccacaagatggcagcagagtcaaacccgagccctcagttctgatagctttggggaggagcagagtactacttacctacccgaagcatctgggtccgtacttaaaaccccaccggagaaggagacgcttaccctggggagcaggaaggagcagttgaagacaccaagtaaagggattagcgaaacaagtaattctgccctgcacttttgtaaggcaccacatgcgatggacagggattggaaggaaagcgttgcctcaaagggacaaaagtgcctcaaacagctgttcgtcactcagaacgtggtgcagcaagccaacggcaaaatgcagctatgcgagcagtccgagtgtgtttggaaaggctgtaaggacggagtgagagatgagtcttttcatttgaagtctagtggagacatcaacgacagcatcttacagcccgaagtgaaaatccacatcactggcttgcgaaatgattattatctgaatattctggactggtcctttcagaatctcgtcgctatagccctcggcagcgccgtttacatctggaatggtgaaaatcataatggaatagagaacatcgatctgagcctgacatgcaattacatttccagcgtttcatggattaaggaggggacctgcctcgctgttggcacatcagagggcgaagtacagctatgggacgttgtcacaaaaaagcgcctgcgtaatatgctgggccacttatccgtagtcggcgccctgtcctggaatcacttcattctgagcagcggaagtagactgggacgggtttatcatcatgacgtgcgcgtagcccagcatcatgttggcaccctgcgacataagcaggcggtatgtgcccttaagtggagccctgacggccgccttttgtcttccggatgctcggacgggctacttactatatggccacacgatccaggagcaagcgcgcagggacagccactgaaggtaatcacccaatctactgccgtaaaggccatggactggtgtccttggcagagtggtgtcctagctataggtgggggaatgaaggacgggcgattacatatcttagacattaacgctgggaagtctattcagactccttccaccaactcacagatttgctccctgatctggttgcccaagaccaaagaaattgcaacaggccaaggtaccccgaagaacgacgtcacagtctggacttgtccgaccgtaagtagaagtggcggctttttcgggcaccgcgggcgagtgctgcatctgtctttgagccctgatcagacacgcgtcttcagcgccgctgctgatggcactgcatcagtctggaattgttactag

SEQ ID NO: 27171 - DNA, 807 bp, Artificial Sequence
  Description of Artificial Sequence: Synthetic coding sequence
atgggaagcgcgaagtccgtacctgttacccccgcacgccctcctccacacaataagcacctggcgagggtcgctgatcctagatctcctagcgcaggaatcttgagaacccctatccaggtggagtcatcccctcagccagggcttcctgcaggcgagcagctcgaggggttaaaacatgcccaggatagtgaccctcgttcccctacgttgggaatcgctaggacccccatgaaaacgtcctcaggagatcccccaagtccccttgtcaagcaactctctgaagtcttcgagaccgaggacagtaagtccaacctgccccctgagccagttcttcctcccgaggcccctctgtccagcgagcttgatctccccctggggacccagctctcagtcgaagaacaaatgcctccctggaaccagaccgaattcccgtccaagcaagtcttttccaaagaggaggcgcgacagccgacggaaacgcctgtggcatcacagtctagcgacaagccatcgagagaccccgagaccccccggagctccggatcaatgcggaataggtggaagccaaatagctcaaaggtcctgggccgtagtccattaaccattctgcaggatgataacagccctgggacgctgaccttgaggcagggcaaacgccctagccctctctccgagaatgtgtccgagttgaaggagggtgcaatcctcggaacgggaaggctcctcaagactgggggacgcgcgtgggaacaggggcaggatcatgataaagaaaatcaacactttccacttgtcgaaagctag

SEQ ID NO: 27172 - DNA, 435 bp, Artificial Sequence
  Description of Artificial Sequence: Synthetic coding sequence
atggcctttacctttgccgccttttgctacatgttggccctgctcttaactgctgctctgatctttttcgccatctggcatatcattgcttttgacgagctgaagacagattacaaaaatcccattgatcagtgcaatacccttaatccacttgtgctgccagaatacctaattcatgcctttttttgcgttatgttcctgtgtgctgcagagtggcttaccctgggcttgaacatgcctctgctggcgtaccatatttggcggtatatgtcccgacccgtcatgtccggacctggactgtacgaccctacaaccatcatgaatgctgatattctggcttattgccagaaggaaggttggtgtaaacttgcattttacctgctggccttcttttattatctttatggtatgatttacgttctggtgtcctcctag

SEQ ID NO: 27173 - DNA, 225 bp, Artificial Sequence
  Description of Artificial Sequence: Synthetic coding sequence
atgaaatttcaggaatgccatagcgaggtgatgcgtcatggacaaaaaatataccccagtcaccatcgtattgagatggctgtggaaattgctagcctgaagtgccagcacagcagcatcaatcaatctccaacaagaaagaattccaactctaccacaggatggcttctgtgggacctgctcatgggcatcggtaactccggatccaacgtggtcctgacctag

SEQ ID NO: 27174 - DNA, 750 bp, Artificial Sequence
  Description of Artificial Sequence: Synthetic coding sequence
atgaccacggcagtggagcgaaagtacattaacattagaaagaggctggatcagcttggttaccgacaaacacttaccgtcgagtgcttacccctggtagaaaagctgtttagtgatctggtccacacgaccgagagcctcaggcagtctaaactctccgcagtgaaggcagagaaggaatcagccaattttgattttgtgttggaaccttataaactggaaaacgctcgactgtcccgggagaacaatgagctgtatcttgaactgatgaaactgcgcgagcacagcgaccagcacgttaaagagctcaagacgagcctgaagaagtgcgccagggagacggcagaccttaagttcctcaacaatcaatatgcacataagctgaagctcctggaaaaggaatctaaggcaaaaaatgagcggatccagcaacttcaagagaagaatctgcacgcggtagtccaaactcctggaggcaagaaaagaagcatcgccttccggaggcagcggatgcagattgacgagccagtgccccccagcgaagtgagtagctaccctgtgccccaacccgatgatccttacatcgcggatttgcttcaggtggctgataatagaatacaagagctgcagcaggaagtgcatcagctgcaggaaaaactggccatgatggagtccggtgtcagagattattcgaagcaggtgggatttctgtttacctgtattgtgggcattgagataggaatgctgtag

SEQ ID NO: 27175 - DNA, 165 bp, Artificial Sequence
  Description of Artificial Sequence: Synthetic coding sequence
atgagcctcaggcgacacataggcaatccagagtacctcatgaagagaataccccagaacccaaggtaccagcacatcaaatccagactcgataccggagcttgcgtgtacctgactagttctcctgcgctgccagactgtgccatgaacggcctctgcttctag

SEQ ID NO: 27176 - DNA, 411 bp, Artificial Sequence
  Description of Artificial Sequence: Synthetic coding sequence
atgctttctagcttcaatgagtggttttggcaggatcgcttctggctcccaccgaatgtcacgtggaccgagctggaagatagagatggcagagtttaccctcacccacaggacttactagcagctctaccactggcacttgttctgctggccatgagactcgcattcgaacgctttattgggctgccgctgagcaggtggctgggagtgagagaccagacccgccgacaagttaagccgaacgcgacccttgagaaacattttctcaccgaaggtcaccgaccaaaagagccccaattgtccctgctcgccgcccagtgtggcctcaccctccagcagacacagagatggttcagaagacggaggaatcaggatagacctcagctgaccaagaagttttgcgaggcctag

SEQ ID NO: 27177 - DNA, 1398 bp, Artificial Sequence
  Description of Artificial Sequence: Synthetic coding sequence
atgcgccgtgccgcgggtatggaagacttcagcgcagaagaagaggaaagctggtatgatcagcaggatctcgagcaggacctccacctggcggccgagctcggcaaaaccttgttagagagaaacaaggagctggaaggatcactgcagcagatgtatagtacaaacgaggagcaagtgcaggagatcgaatacttgacaaagcaactggacacactgcgccacgtgaatgaacaacatgctaaggtgtacgagcagctcgaccttacagccagggatttagagttaacaaaccaccgtctggttttggagagtaaagctgctcaacaaaaaatccacggactgaccgagaccattgagcgactgcaggcccaagttgaggaactccaggcgcaagtggagcagctgcgcggactcgaacaacttagagtacttcgcgaaaaaagagaacgacgtcgtacaattcacacttttccttgcctcaaagaactgtgtaccagcccaaggtgcaaagatgcgtttcgcttgcactccagttcacttgaattaggcccaagaccgctggagcaggaaaatgaacgactacagactctggtgggagcactcagatctcaggtctctcaagagcggcagcgaaaggaaagagccgaacgcgaatataccgctgtgctgcaggagtattcagagctggagaggcagctgtgcgagatggaagcctgccgcttgcgagtccaggagctagaggctgaactcctagaattacagcagatgaaacaggcaaagacttacctgctggggccagacgatcacctggccgaggctttgcttgctccattgacccaggctcctgaggctgatgatccacaaccaggcagaggtgacgatctgggcgctcaggacggtgtctcaagccccgccgccagcccaggacacgtggtccgaaaaagctgctccgatacagccctgaacgcaattgtggccaaggacccggcctccagacacgctggaaacctgactctgcacgccaacagcgtgagaaaaagaggcatgtctatccttagggaagtggatgagcaatatcatgcactgttggagaagtacgaggaattactgtcaaagtgccgccagcacggggcaggtgtccggcatgctggggtgcagacctctagacccattagcagagacagttcatggcgggacttgagagggggcgaggagggccaaggtgaggtcaaagcaggtgaaaaatccctctcccagcacgtggaggctgtggataaacggcttgagcagagccagccagagtataaggcgttattcaaggagatcttttctcgaattcagaaaacaaaggctgatattaatgcaaccaaggtcaagacacactcatcaaaatag

SEQ ID NO: 27178 - DNA, 555 bp, Artificial Sequence
  Description of Artificial Sequence: Synthetic coding sequence
atgtgggtattcggctatgggagtctgatctggaaagtggatttcccataccaggacaaattagtaggttacatcaccaattatagtagacgcttttggcagggctcgacagatcacaggggggtgccaggaaaacccggcagagtggtgacattggtggaggaccctgccggctgtgtttggggtgttgcgtaccggctgcccgttggaaaagaggaggaggtgaaggcgtatctggattttagggagaagggagggtatcgcactacaaccgtgattttctacccgaaagaccccactactaagcctttcagcgtgctgctatatatcggcacctgtgacaatcctgactacttgggacccgccccgttggaagatatcgccgaacaaatctttaacgcagcagggccatccggcaggaacacagaatacctttttgagctagcaaactcaatcaggaatcttgtacccgaagaagctgacgaacacctgtttgccttggagaagttagtcaaagagagactagagggcaagcagaatctcaactgtatatag

SEQ ID NO: 27179 - DNA, 285 bp, Artificial Sequence
  Description of Artificial Sequence: Synthetic coding sequence
atgatgggcctcagcctcgcaagcgccgtgcttctcgccagcctattatcacttcacctgggtaccgccacgcgcggatctgatattagcaagacatgttgtttccagtattcccacaaaccccttccgtggacctgggtaaggtcttacgagtttactagtaatagttgctcacagcgcgccgtcatcttcactacgaaacgtggtaaaaaggtatgcactcatcctcggaagaagtgggttcagaagtacatcagcctcctcaagactccgaaacagttgtag

SEQ ID NO: 27180 - DNA, 729 bp, Artificial Sequence
  Description of Artificial Sequence: Synthetic coding sequence
atgtgggcgtcaagagatcatctgcctgagccggatctgggggatgcagccccacctgggtccccatctagtttttggacaagcggtttaccaaggcaggaaaggagtaccagcagacagcgatctcggggcagcccatcatccacctgcgtcccatataaggttcatgcacttgccacgttcgaatgctcagcaacctcccatgcaagccgcctgtggcagactctacaacaattctgggcagaccacatctcaagacccttcagcccacggagacctccccttcggcggatgccttcattgagcaccttttatctgctagatcataacacacggcaggcagagctgggtctagcctacggcgctccctgcatgcggctcagcaatcaggcatttgtattcagggggggacgctggactacagagagtcagctcgccagaacacggagccccctgttgtccaggactgcctggggctggaaagcccaggttcagagaagcaaaagtcaggttttactggaggagaacaactatcttaaactgcaacaagagctgttgatcgacatgttgaccgaaacaatggcgcggatgcaccttctggaaaagcaaagaaaccccgaggtcatccctactgccgcagctagggctgggcagaggaagatgcgcaaaagagccggagcctcagctggcgttcttatgattcagccgtgtgcactggattctcaatag

SEQ ID NO: 27181 - DNA, 237 bp, Artificial Sequence
  Description of Artificial Sequence: Synthetic coding sequence
atgagtgccacgacagcatgttggccagcatttaccgtgctaggcgaggctcggggagatcaggtcgattggtcccgactctatcgggacaccggactggtgaagatgtctagaaaaccaagggcatcttctcctttctccaacaatcacccatctacccctaagcgcttcccacgccaacctaaacgagagaagggacctgtgaaggaagtgccagggacaaaaggcagtccttag

SEQ ID NO: 27182 - DNA, 222 bp, Artificial Sequence
  Description of Artificial Sequence: Synthetic coding sequence
atgagtgcaaccactgcctgctggccagccttcaccgtactgggggaagcaagaggagatcaagtggactggagccgactctacagagataccgggttggttaaaatgtctcgcaagccccgggcctccagcccttttagtaacaaccacccatctacgcctaaacgtaggggcagaggtaaacacccccttatccccggtccagaagccttgtccaagtag

SEQ ID NO: 27183 - DNA, 237 bp, Artificial Sequence
  Description of Artificial Sequence: Synthetic coding sequence
atgagtgccacaaccgcatgctggccagctttcactgtgcttggcgaagccagaggcgaccaagtcgactggtcacgtctttatagagataccggcctggtgaaaatgtcaaggaagccacgggcctcttctcctttttccaacaatcatccttccacccccaaacgcttcccccgacagcctaagcgagagaagggacctgttaaggaggtcccgggaacaaagggcagcccctag

SEQ ID NO: 27184 - DNA, 333 bp, Artificial Sequence
  Description of Artificial Sequence: Synthetic coding sequence
atgtggatgggcctcatccagctggtcgaaggcgtaaagagaaaggatcaaggcttcttggaaaaggaattttatcacaagactaacataaagatgcgctgcgaattcctggcctgctggcctgctttcacagttctaggagaggcctggcgggatcaagtcgattggtcacggcttctccgagatgcgggcctcgtaaagatgagccgcaaacccagggcctcctcaccacttagtaataatcatccaccaacgccaaaacgcttcccaagacagcccggccgagaaaaggggcccatcaaagaagtgccaggaacaaaaggctcaccttag

SEQ ID NO: 27185 - DNA, 492 bp, Artificial Sequence
  Description of Artificial Sequence: Synthetic coding sequence
atgagcaagggcctgctccttttgctgcttctgtctatgggaggcacctgggcatccaaggaaccgctgagacccagatgcaggccaattaatgcgaccttggcagtcgaaaaagaaggctgccccgtgtgcattaccgtcaacacaacaatctgcgcaggttattgcccaacaatgacaagagttttgcagggagtgcttcctgctttgccacaagtagtgtgtaattatagggacgtccggtttgagagtataagactgcctggatgcccccggggggtcaaccctgttgtatcatacgccgtggctctcagttgtcaatgcgccctctgcagacggtccaccaccgattgtggcggacccaaggaccatcctttgacctgtgacgatccgcgcttccaggctagttcttctagcaaagcaccccccccgtcactgccttccccatcgaggctgcctggtcctagtgacacgcctatcctgccccagtag

SEQ ID NO: 27186 - DNA, 417 bp, Artificial Sequence
  Description of Artificial Sequence: Synthetic coding sequence
atgagtaagggcctactgctgctgctgctgttatccatggggggaacgtgggcctctaaggagcccttaagaccacgctgcagaccaatcaacgcaacgttagctgtcgaaaaggagggctgtccagtgtgcatcaccgttaacacaaccatctgcgctggttactgtcccactatgacgcgggttctccaaggagtgctccctgctctgccccaggtcgtgtgtaattatcgcgacgtccggtttgagagcatacgactgccaggatgcccacgaggcgtgaatcccgtggtttcctatgcggtggccttgagctgtcagtgcgcactgtgccggcgtagcaccactgattgcggcggaccaaaggatcatcctctaacatgtgaccctccactgcccggactgttgttcctttag

SEQ ID NO: 27187 - DNA, 492 bp, Artificial Sequence
  Description of Artificial Sequence: Synthetic coding sequence
atgttccaagggcttctgctgctgctgctcctctcgatgggggggacttgggcctcacgcgagatgttaaggcccagatgccgacctattaatgcgaccctggctgtggagaaggaggggtgtcctgtctgcatcaccgttaacactaccatctgtgcaggctattgtcctaccatgacgagagtgctgcaaggtgtactgcccgctcttcctcaagttgtgtgcaactacagggatgtcagatttgaatccattcggcttccaggatgcccacggggcgtgaacccagttgtgtcctatgcggtggcactgtcttgccagtgtgccctctgtagacgtagcaccaccgactgtggaggacctaaggaccatcccctgacatgtgatgacccacggttccaggcatcatcctcctctaaggccccacctcctagtcttcccagcccttctcggctccctgggccctctgatactcccatccttccccagtag

SEQ ID NO: 27188 - DNA, 498 bp, Artificial Sequence
  Description of Artificial Sequence: Synthetic coding sequence
atggaaatgtttcaggggctgttactgttgttgcttctgtctatgggagggacatgggctagtcgcgagatgcttaggcctcgctgtaggccaattaatgccacccttgcagtggagaaggaaggttgtcccgtgtgtattacagtgaacacaactatctgcgccggatattgcccgaccatgacccgcgttctccagggggtgctacccgccctcccgcaggtggtttgtaattatagggatgtgcgctttgaatcaatccgtttacctgggtgcccgcgcggtgtgaacccagtggtgtcctacgcagtcgctctttcatgccagtgcgcactctgccgacgctctacaactgattgcgggggcccaaaagaccaccccttgacctgtgatgatcccagatttcaggcttcatcctcttcaaaagcccctcctccaagcttacccagtccatctaggttgcctgggccctccgatacaccaatcttaccccagtag

SEQ ID NO: 27189 - DNA, 189 bp, Artificial Sequence
  Description of Artificial Sequence: Synthetic coding sequence
atggccagtaacaagaccactctgcagaagatgggcaagaagcagaatggcaagtccaagaaagtggaggaagccgaacccgaagagttcgtggtggagaaggtgctggacagacgggtagtgaatggcaaagtggaatatttcctgaagtggaagggatttacagacgctgacaatacttgggaatag

SEQ ID NO: 27190 - DNA, 2082 bp, Artificial Sequence
  Description of Artificial Sequence: Synthetic coding sequence
atggagcgggcaggtgcaacaagcagaggtggtcaggctccaggatttctgctcagattacatactgagggccgggctgaggctgcccgtgtgcaggagcaggacctgcggcaatgggggcttaccgccagcgagcttcataaacttctacaacctttcctgctgcgtcgtgtaaaagcggaagtagccactgagctccctaagaagaccgaagtggtgatctatcacggtatgtccgccctccagaaaaagtactataaggctatactcatgaaggatctcgacgctttcgagaatgagacggcaaaaaaagtcaaacttcagaacattctatcacaactcagaaaatgtgtggaccatccttatttgtttgacggagtcgagcccgaacctttcgaggtaggcgatcatctgaccgaagctagcgggaagctccacctgctcgacaagctgctcgctttcctgtatagtggcggacatcgggtcctgctgttcagccagatgacacagatgctggacatcctacaagattacatggattaccggggctatagctacgagagagtggatgggtcagtacgaggagaagaacgccatctagccattaaaaattttgggcagcagcccatttttgtgttcctgttgtcaacgcgcgcaggaggcgtgggaatgaatctcactgccgctgacaccgtcatattcgtagactcagacttcaatccccagaacgatctgcaggcggccgcacgagcccaccggattgggcagaacaagagcgtgaaggtgattcgcttgatcggcagggacacagtggaagagatcgtgtaccgcaaagctgcaagcaagctccagttgactaatatgatcatagaggggggccactttacactgggcgcccagaaacctgccgccgacgcagacttgcaactgtcggaaattctgaaattcggactagacaagctgctggcgagtgagggctccactatggatgaaatcgacctggagtctatcctgggcgagaccaaggacggtcagtgggtatccgacgcacttcccgctgcggaggggggttccagagatcaagaggaaggaaagaaccatatgtacctctttgaaggtaaagattactccaaggagcccagtaaggaggatcgaaaaagttttgagcagctagtcaaccttcaaaaaactctgctggagaaggcttcacaagagggcagaagtttgagaaataaaggctccgtgctcatcccaggcttggtggagggatctaccaagagaaaaagggttctgtccccagaggagctggaggacaggcagaagaaaagacaggaggctgcggcaaagagacggcgtctgattgaagagaaaaaacgtcagaaggaggaggcggaacacaaaaagaagatggcctggtgggaatcgaacaactaccagagcttctgcctgccaagtgaggaaagcgagcctgaggaccttgagaatggcgaagagagttcagccgagctggactatcaggatccagacgcgaccagtctgaaatacgtgtccggcgacgtgacacaccctcaggccggtgcagaagacgcgcttatagtgcactgcgtagatgacagcgggcactggggccgcggcgggcttttcacagcccttgaaaaacgttccgcagaaccccggaagatctacgaactggcaggaaaaatgaaagacctcagcctgggcggagtgctactgtttccggtggatgataaggaaagcaggaataagggccaggacttgctggccctgatcgtggctcagcatagggatcggtccaacgtcctgagcgggatcaagatggcagcactggaggagggactgaaaaaaatcttccttgccgccaagaagaagaaggccagcgtccatctgcctcggatcggtcacgccacaaaggggttcaactggtacgggacggagcgcctgatcagaaagcacttggccgccagaggcataccgacttacatctactactttcccaggagcaagagtgctgtgctgcatagccaatcttccagttcctccagtagacagctcgtgccctag

SEQ ID NO: 27191 - DNA, 1851 bp, Artificial Sequence
  Description of Artificial Sequence: Synthetic coding sequence
atgtcagctctccaaaagaagtattacaaggccatcctcatgaaagacttggatgcatttgaaaatgaaactgcgaaaaaagtgaagctgcagaacatcctctcccagctacggaaatgcgtggaccacccctatttgtttgacggcgtcgagcctgagcctttcgaagtgggcgatcacctgacagaagccagtggcaaacttcatcttctcgataagctgttggccttcctttactccggcgggcatagggtgctgttgttctcacagatgacccaaatgctcgatatcctgcaggattatatggattatagaggatacagctacgaaagagtggacgggtccgtgagaggagaagagcgtcaccttgccatcaaaaactttgggcagcagcctatatttgtgttcttgctcagcactagggccgggggagtaggcatgaatctcacggccgccgatactgttatcttcgtggatagcgactttaatcctcagaacgacctgcaggccgccgctagagctcaccgaattggccagaacaagagcgtcaaggtgatacgactgattggcagggacacagtcgaagaaatcgtgtaccgaaaggccgcttctaagctccagctgaccaatatgatcatagagggaggccacttcacactaggagcccagaaacccgccgccgacgcggatctgcagctgagcgaaattctgaaatttggtttagacaaactactggcttccgagggtagcacaatggatgaaatcgacctggagtccatcctgggcgaaacaaaggacggacagtgggtcagcgacgcactgcctgctgcagaaggaggcagccgcgatcaggaagaaggaaagaaccacatgtacctgttcgaaggaaaggactattctaaagaacccagcaaggaagacagaaaaagcttcgagcagttagtgaacctccagaaaactctccttgagaaagcctcacaggagggcaggagcctgagaaacaaagggtccgttctaatccctggacttgtcgaggggagtacaaaaaggaaacgggtgctttcaccggaggagttggaagatcgacagaaaaagagacaggaggctgcagctaagcggagaaggctcattgaggaaaagaagcgccagaaagaagaagctgaacacaaaaagaaaatggcttggtgggagagtaacaattaccaatccttttgcctgcccagtgaagagtctgaaccagaggacctcgaaaatggggaggaaagctccgctgagttggactatcaggacccagacgcaacttcacttaagtatgtgagcggtgacgtgactcaccctcaggccggggctgaagacgcactgatagtgcattgcgtggatgattcaggccactggggcaggggaggactgtttacagcactcgagaaaagaagtgcggagcctcgcaagatctatgagctggcaggcaagatgaaggatctctccctgggcggagtgctgctttttcccgttgatgataaagagtcaaggaataaaggacaagatttgctggcattgatcgtagcacaacatagggatcgttctaatgtactgtccgggatcaagatggctgcactcgaggaggggttgaaaaagatcttcctggcagctaagaaaaagaaggcctcggtgcatctgccccggattggtcatgccaccaagggtttcaactggtacggtacagaacgcttgattcgaaagcatctggccgcccgtgggattccgacatacatttactatttcccacggtcaaaatccgccgtgttacactctcagagttcctcttctagctctcgccagctcgtgccttag

SEQ ID NO: 27192 - DNA, 2694 bp, Artificial Sequence
  Description of Artificial Sequence: Synthetic coding sequence
atggagagggctggagcgacctcgcggggggggcaggcaccaggttttttactccggttgcatactgaagggagggccgaggccgctagagttcaggaacaggatctccgtcagtggggtcttaccggcatacaccttcgctcttaccagttggagggcgttaattggctggcacagagattccattgccaaaatggttgcattttgggggatgaaatgggtctgggtaagacatgccagaccatagcactttttatctacctggctggtcgactgaatgatgaaggaccattcctgattctgtgccctctgtccgtgctaagtaactggaaggaagagatgcagcgtttcgcccccggcctctcatgcgtaacatacgctggggacaaggaggagagggcctgcttacagcaagatctgaagcaggaaagcagattccacgttctgctgacgacctacgagatctgccttaaggacgccagctttctgaagtcattcccatggagtgttctggtggtggatgaggcccaccgccttaaaaaccagagtagcctgcttcataagaccctgtctgaatttagtgtggtattttctctcttgctaactggtactccaattcagaactcattacaggagctgtattcactgctgtccttcgtagagccagatcttttttcaaaagaggaagtgggcgatttcatacaacgctaccaggacatagagaaagagagcgaatctgcttctgagctccataaactgctgcagccatttctgctgaggagagtgaaggctgaagtcgccaccgagctccctaaaaagaccgaggtggtcatctaccacggaatgtccgcacttcagaaaaaatattacaaggccattttgatgaaagatttagacgcctttgaaaatgagaccgccaagaaggtgaaactgcagaatattttgtcccagcttagaaaatgtgttgaccatccctatttgttcgatggcgttgagcctgaacctttcgaggtcggcgatcacttgactgaagccagcgggaagctccacctactcgacaaactgcttgcctttctgtactcaggaggccaccgggtcctgctctttagtcaaatgacacagatgctcgacatccttcaggactatatggattacaggggatacagctatgagagagtggatggcagtgtcaggggagaggagcgacacctcgccatcaagaacttcgggcagcagccaatctttgtctttttattgagcacgagggcaggaggcgtgggaatgaatctcacagccgctgacactgtcatattcgtagatagcgacttcaaccctcaaaatgatctgcaggcggcagcaagggctcatcggatcgggcaaaacaagtccgtgaaagttatcagactgatcgggcgcgacacagtggaagagatcgtgtatcgaaaagcagcttctaaactgcagctcaccaacatgatcatcgaaggaggtcatttcacccttggggcccagaagccggccgcggatgctgatctccagttgtctgaaatcctgaaatttggcttagataaactactggcatcagagggctccacaatggacgaaattgatttggagtcaatccttggagaaactaaggatgggcagtgggtttccgacgctctgccagccgcagagggcggcagtcgcgatcaggaggaggggaagaatcacatgtacctatttgagggcaaagactattcaaaggagccatctaaagaagatcgtaaatccttcgaacaactggtgaacttgcagaagacactcctggagaaggcttcccaggaagggcgatcactcaggaataagggctccgttctgatccccggcctggttgaggggtctacgaaaaggaagcgggtgctctcccctgaggagcttgaggatcgacagaaaaaacggcaggaggcggccgcaaagagaaggcgcctgatagaagagaaaaaacgtcagaaggaggaggcagaacataagaagaaaatggcctggtgggaatctaacaactatcaatccttttgcttgccctccgaagagtcagaacctgaagacctggagaacggggaggagtctagcgccgaactggattaccaagatccagacgccacgtctctgaagtacgtgtcaggcgacgtcacccaccctcaagccggggcagaggatgctttaatcgtacactgtgtggacgactcaggccattgggggagaggcggactttttaccgctttagaaaaacggtccgctgagcctagaaaaatttatgagctagccggtaaaatgaaagacctctccctgggaggtgtcctcctgttccccgtggatgacaaggaatctcgcaataaaggacaggatctgctagcactaatagtggctcagcaccgcgacaggtcaaatgtactgtccgggattaaaatggccgccctcgaagaaggactcaagaagatttttctcgctgcaaaaaaaaagaaagccagcgtacacctgccaaggatcgggcatgccacgaagggatttaattggtacggtactgaacgactgatacgcaagcatttggccgcacgcggcattcctacttacatttactattttcctaggagcaagtctgccgtgctgcacagtcagagtagttcaagcagcagtcggcagctggtaccatag

SEQ ID NO: 27193 - DNA, 1983 bp, Artificial Sequence
  Description of Artificial Sequence: Synthetic coding sequence
atggaggcgctgatggcgcggggagcactcacaggcccgttgcgggccttatgtcttctgggatgcctcctgtcccacgccgctgcagctccctcaccaattatcaagtttcctggagacgtcgcccctaagacggataaggagttggcagtccagtacctgaataccttttatggatgtcctaaagagtcctgcaatctcttcgttctgaaggatacccttaagaagatgcagaaattcttcggcctgccacagacaggggatctggaccagaataccatagaaaccatgcgcaagcctagatgtggtaacccagacgtggctaattacaacttttttccccgaaagccaaaatgggataagaatcagattacataccgcatcatcggatatacccccgacctggaccctgagaccgttgatgatgcatttgcccgcgcgtttcaggtttggtcagacgttacacctctcagattctctaggatccacgacggagaagccgatattatgatcaacttcggcagatgggagcacggagatggttatccttttgacggtaaggatggccttctggcccacgccttcgcacctggtaccggagtgggcggggactctcacttcgatgatgatgagctctggacgctgggtgaggggcaggtggttcgggtgaagtacggcaacgccgatggtgaatactgtaaatttccattcctgtttaatggcaaggagtacaattcctgcaccgacacagggcgtagcgacggttttttatggtgctccactacatacaacttcgagaaggatggcaagtacgggttttgcccgcacgaagcccttttcacaatgggaggtaatgctgagggacaaccgtgcaaatttccttttcgcttccagggaacctcctacgatagctgtacaaccgagggcagaactgacggctaccggtggtgtggaaccactgaggactacgatagagataagaagtatggcttttgccccgagactgcgatgagcacagtggggggcaatagcgagggcgccccatgcgtgtttccttttacattcttggggaacaaatacgaaagctgtacatctgcaggccgaagtgatggcaagatgtggtgcgcaacgaccgctaactacgacgacgacagaaagtggggattttgtcccgaccaaggctattccttgttcctcgtcgctgctcatgaatttggacatgcgatgggactcgagcactcccaggaccctggtgctcttatggcacccatctatacatacaccaaaaatttccgactgtcgcaggacgacattaagggaattcaggagttgtacggtgcctccccggatatcgacctcggcacaggacccaccccaacactgggaccagtaaccccggagatctgtaaacaggacatcgtatttgacgggatcgcccagataaggggcgaaatcttcttcttcaaggacaggttcatttggcgaacagtcacacctcgggacaagcccatgggcccactcctcgtggccaccttctggccagagctccccgagaagattgatgccgtgtatgaggctccccaggaggaaaaagccgttttcttcgcaggtaacgagtactggatctatagtgcgtcaactcttgagcgtggataccctaagcctcttaccagtttaggcctcccccccgatgtgcagcgcgttgacgccgcgtttaattggagtaaaaacaaaaagacttatatatttgccggagacaaattctggagatataacgaagtaaagaaaaaaatggatcccggctttcccaaattgatcgccgacgcatggaatgcgataccggacaatctggacgccgtagttgatctccaaggaggaggtcactcttacttcttcaagggcgcctactatctgaaactcgagaatcaatcccttaaatctgtcaagttcggctctatcaaatccgattggctgggatgctag

SEQ ID NO: 27194 - DNA, 8646 bp, Artificial Sequence
  Description of Artificial Sequence: Synthetic coding sequence
atgaccgatcccatgatggacttcttcgacgacgccaatctttttggagagacccttgaaggactttccgacgatgctttcgtgcaacctggtccagtaagccttgttgacgagctaaaccttggggccgagtttgaaccactccatattgacagccttaatcatgtgcaaggcaccccaacacatcagaagatgaccgatttcgaacagttgaatcagttcgattccattaaattccatcacgtgaaccaatctttcgggtcaccggccgaacacgtgctatccccacatagtcagttcaactgcagtcccatccacccacaaaatcagccaaacggattatttcctgacgttagcgacggctcgccaatgtggggacatcagacggcaaccacgatttctaaccaaaacgggtccccatttcaccagcagggtcacagccatagcatgcaccagaacaaaagtttcgtagcacaccacgacttcgctctcttccaggccaatgaacaacagacccagtgtactagccttcggtcgcaacaaaatagaaacaatctgaacccaggccagaactctctgagccagtcgaagaactttatgaacgtgagcggtcctcatagggttaatgtgaatcaccccccccaaatgaccaacgcctccaatagtcagcagtccataagcatgcagcagttttcccaaacttctaacccttcagcccacttccacaagtgtagcagccatcaggaaggtaactttaatgggcctagtcctaacatgacatcctgttccgtgagcaattctcagcagttttcctcgcactatagtttttcatctaaccacatatcaccgaactctctgttgcagtcaagcgctgtcctggcctctaatcacacaaatcagactctctcagactttacagggtctaacagtttctcaccacaccgcggtattaagcaggagtctacccagcatatcctcaatcctaacacctctctgaatagcaataacttccaaatcttgcattcctctcatcctcagggaaactacagcaactcgaagttaagtccagtccacatgaattttccagacccagtggattctggaacccagatggggcactttaatgatcacgtggagaccaacgggtttagcagcctggaagagaacctcctacatcaggtggaaagtcaaacggagccttttacaggcttagaccctgaggacctactgcaggagggactcctgccccactttgacgagagtacctttggccaggataatagctctcatattttggaccacgacctggatcgacagtttacctcacatctggttactcggccttcagacatggcgcagacccagctccagtctcaggcaagaagctggcacagcagcttcagtaaccatcagcatctccacgaccgtaaccacctgtgtctgcagaggcagccccctagctctaaaaagtcagacgggagtggcacgtataccaagctccagaacactcaagtgagagtgatgtctgaaaaaaagcagcgcaagaaagtagagtccgagtctaagcaagaaaaggccaatagaatcatttccgaggctatcgcgaaggctaaggagcggggtgagaggaatattccacgggtgatgtcccccgagaacttcccaacggcttccgtcgagggcaaggaagaaaagaaagggcgccgaatgaaaagcaaaccaaaggataaagacagcaagaaaactaagacttgtagtaaactaaaagagaaaactaagatcggtaaactgattattacactgggcaagaaacagaagcgaaaaaacgagagcagcgatgagatctcggacgccgagcagatgccccagcacaccctgaaagaccaggactcccagaagcgcaggtccaatcgccaaattaagaggaagaagtacgccgaggatattgaaggcaagcagagcgaggaggaagtgaaaggcagcatgaagatcaagaagaattcggcacccctgcctggagagcagcccttgcaactttttgtcgaaaatccgtcagaagaagatgcagcgatagtggataagatcctgtctagccggaccgtaaagaaggaaatctcccccggggtcatgatagacactgaggagttctttgtcaagtataagaactattcatacctgcattgcgagtgggccactgaggagcaattgttgaaagacaagagaatccagcagaaaataaaacgatttaaactccggcaggctcagagagcacactttttcgcggacatggaggaggagcctttcaacccagactacgtcgaggttgatcgggtgttggaggtgagcttctgtgaagacaaagacacaggcgaacctgtgatatattatctcgtgaagtggtgcagtctgccttatgaagattctacatgggagctgaaagaggatgttgatctagctaaaatcgaggagtttgaacagttgcaggcatctcgccccgacacaagaaggctggacaggcccccttctaacatctggaagaagatcgaccaaagtagagactacaagaacggtaaccagcttcgagagtaccaattggagggtctgaattggctcctgttcaactggtacaacagaaggaattgtattttagctgacgagatggggttaggcaaaacaatccagtcgataacatttctctatgagatcctactgaccggaattcggggaccgtttctcatcatcgcgccgttgagcactattgctaactgggaacgcgagtttagaacctggacggacattaatgtcgtggtataccacggcagcctaatctcccgccagatgatacagcagtacgagatgtattttagagattcccagggccgaatcattaggggcgcatacagattccaggccataataacgaccttcgaaatgattttaggaggctgtggcgagctgaatgcaatcgaatggcgctgtgtgataatcgatgaagcccatagattaaaaaataaaaactgtaagctgctcgaggggctgaagctcatgaacctcgagcataaggtgttgctgaccggaacaccgctccaaaacactgttgaggaactcttctctttgctccattttctggagcccctgcgcttcccaagtgagtccacatttatgcaggaattcggggacctgaaaaccgaagaacaggtgcagaaactgcaagccatccttaagcccatgatgctccgtcggctaaaggaggacgtcgaaaaaaagctggcccctaaagaggagaccatcatcgaggtcgagttgacgaacattcagaaaaagtattatagagccatcctggagaagaatttctcattcctgagtaagggcgcgggccaaactaacgtgcccaatctggtgaacaccatgatggagctgcggaagtgctgcaatcatccctacctgattaagggcgctgaggaaaagatactcggggaatttcgcgacacctacaaccccgccgccagtgattttcatctgcaggctatgatccaatccgcggggaagctggtcctgattgacaaactgctcccaaaaatgaaggccggcggccacaaggtgttaatattctcacagatggtgaggtgcttagacattttagaggattacctgatccacaagcgatacctttatgagagaatcgacggcagagtgcgaggaaatctgaggcaggctgcaattgatcgatttagcaaacctgatagcgatcgcttcgtgtttctcctctgcacgagggctggggggctcggcatcaatctgactgccgccgatacatgcatcattttcgacagtgactggaacccccagaatgacctccaggcacaagctcgctgtcatcgcattgggcagaataaggcggtaaaggtgtaccgtctcgtgaccaggaatagctacgagagagagatgttcgatagggcctccctcaaactcgggctagataaggccgttctgcagtccatgtcggggagggaaagcaacgtgggcggcatacaacagctgtcgaaaaaggagatcgaggatcttcttcggcgcggagcgtacggggccattatggaagaggaagacgagggctctaagttttgtgaagaagacattgaccagattctactgcgccgcacaaaaactattaccattgaatcagagggaagagggtccacttttgcaaaggcttcattcgtggccagcggaaatcgtacggacatttcccttgacgacccaaatttctggcagaagtgggctaaaaaggccgaaattgacatcgaggccatcagtgggcgaaattcccttgtgattgataccccacggattcgaaagcagacacggccattcagcgcaactaaggatgagctcgccgagctgtccgaggctgagtccgaaggagatgagaagccaaagcttagacggccttgtgacaggtctaatggttacggccggacagagtgcttccgcgtagagaagaatctgttggtgtatgggtgggggcgctggcgtgagatcctctcccacggacgcttcaaaagacagctgaacgagcacgatgtcgaaatcatttgccgagccctcctggcttactgcctggttcactatcgaggtgatgagaagattaagggatttatttgggatctcatcacccccacagaggatggacagacgagagaactgcagaaccatctgggactgtctgcccctgttcctcgggggcgtaaggggaagaaagtgaaaacgcaaacatctagctttgacattcagaaggcagaatggctaagaaagtacaatcctgaacagctactacaggacgagggatataaaaagcatatcaagcaccactgtaataaagtgcttctccgagtgcggatgctgtattacctcaaacaggaagttatcggtaacgaatgccagaaagtgttcgatggtgtggatgcctccgatattgatgtgtgggtgcccgagccagaccacagcgaagtgccggccgaatggtgggactttgatgctgataaatcactcctcattggtgtatttaaacacggctatgagaagtacaacacaatcagagccgaccccgccttgtgttttctcgagcgagtaggcaaaccggatgagaaagcggtcgctgccgagcagagggcaaacgactacatggatggggatgtggaggacccagagtacaaacccgcccctgccatcttcaaagacgacattgaggatgacgtgagctcacctggtgatctggtcatcgccgatggagacggacagctcatggagggggacaaggtatattggcctactcagagtgccttgacgacaaggctacggagactcatcactgcctaccaacggacaaataagaaccgccagatccaacagattcaacccaccttcagcgtgcccacctcagtaatgcagccaatctatgaggaggctactctgaaccctaaaatggctgccaagatcgagagacagcagagatggactaggagagaggaagccgatttttacagggtggtgtcaaccttcggcgtggtctttgatccagatagagggcaattcgactggactaagtttcgggctatggctagactccacaagaaaacggatgatagccttgagaagtatttgtatgctttcatgtccatgtgccgacgcgtttgccgcctgccttcgaaagaagagctggttgaccctaatatattcattcaacctatcaccgaggaacgtgcctcacggaccctctatagaatcgagctccttcggaaggtcagagagcaagccctcagacacccacagctttttgaacggctgaaactgtgtcaccccaatcctgacctcccggtatggtgggaatgtggtccacatgatagagacctcctgataggtgctgcaaagcacggcgtcagtcggaccgattatcatattctgagagaccccgagctgagctttatggctgcgcagagaaactactctcaatccaagatggcccatagccgaacttcaacaccattgcttcagcagtaccaggtcgcactgagcgctagtcctctgacgtctttgccaagactgcttgacgcaaaagggataattcttgaagagatgaaggtcaaatctgagaacctgaaggaggagccgcagtcatctgaagaagagagcatgagtagtgtggaaacacgaaccctgataaagtcggaacctgttagtccaaagaacggcgtactgccccaggcaactggagaccagaagtctgggggcaaatgtgaaacagaccgtaggatggtagccgctcgtacagaacctctgactcctaacccagcatcaaagaagcccagggtgcataaacgcggctccgagtctagttccgactcagacagtgattccgaaaggtcctcatgttcctccaggagcagtagctcctcctcctcttcctcgtgctcccactccaggtccggctcgagctcctcctcctccagctcatgcagtagtgcctcttcctcttcctcttcttccacgtccagttcttcaagctcgtcttcctcaagctcagaggagtctgacagcgatgaagaagaggcccaaaagagagaaagcaccacgcacatgaaagcctatgacgaagaaagcgtggcttctttaagcaccacgcaggacgagacccaggactccttccagatgaataatggcacacctgaatcagcttacattctgcagggtgggtacatgctagcagcatcatattggcccaaggaccgggtcatgattaatcgacttgactcaatctgccagaccgtgttgaaggggaagtggccttccgctcgcaggtcttatgatgcgaacaccgttgcgtccttctacactacgaagttactcgattcacccggggctgctacagagtacagtgacccctccgttcctactccaccgggggcaggtgtgaaggaggagcatgaccagtcaactcaaatgagcaaagagggtggactcaaattaacctttcagaaacaaggcctggcacagaaacgcccgttcgatggggaggatggggctctcggccagcaacagtacttaacccgcctgcgggagcttcaatcagctagtgaaacctctctggtaaacttcccaaaaagtatccccgtgagcggaacgtcgatccaaccgacactgggagcgaatggcgtgatcctggacaaccagccaatcgtcaagaaaagaaggggcaggagaaaaaatgtggagggcgtagacatcttcttttttaatcggaataagccccctaaccacgtgagcctcggactcacctcatcccaaattagcaccggtatcaacccagcactttcttacactcaacctcaagggattccagataccgagtcccctgtgccagtaatcaatttaaaagacggaacccggcttgctggagatgatgcgccaaagcgtaaggacctcgaaaagtggctgaaagagcacccgggctacgtagaggacttaggagctttcatccctcggatgcagctgcatgaagggcggccgaagcaaaaacgtcacaggtgtaggaaccctaacaagttggatgttaactccttaactggggaggagagggttcagctcattaacagacggaacgctaggaaggtcggaggcgcgtttgcacccccactgaaggacctgtgtaggtttctcaaagagaacagcgaatacggggttgcaccagagtggggcgatgttgtgaaacaatcaggatttttgcccgaaagcatgtatgagcgcatactgacagggccagtggttcgcgaggaagtgtcccggcggggcagacgccctaagagtgggattgcaaaagccaccgccgccgccgctgccgcctcggctacctccgtgagcggcaacccacttcttgccaatgggttgcttcccggcgtcgacttaactaccttacaggctttgcagcagaacttgcagaaccttcagtctctgcaagtcacagcaggacttatgggcatgccaactggattgccttcagggggcgaagcaaagaacatggccgcaatgttccctatgttgctgtctggaatggccgggctccctaatcttctcgggatgggcggtctgcttactaaacctacggagtctggcactgaagataaaaagggcagcgactctaaggagtcggagggaaaaactgagcggaccgaatcacaaagttcagagaatgggggtgagaactccgttagctcctctcctagcacctccagcaccgccgccctaaacaccgctgctgccgctaatcccttggcactgaaccctctactgctctctaatattctttatccaggtatgctgctgacgcctggcctcaacctccacatccccaccctctctcagtctaatacctttgacgttcaaaataagaactctgacctcgggtcctccaagagcgtcgaggtgaaagaagaggattcacgtatcaaggatcaggaagataagggaggcactgagcccagtcctctgaacgagaatagcactgacgaggggagtgaaaaagctgatgcctcgagtgggtctgactctacatcatcatcctcagaggatagcgactcaagtaacgaggactag

SEQ ID NO: 27195 - DNA, 8649 bp, Artificial Sequence
  Description of Artificial Sequence: Synthetic coding sequence
atgactgaccctatgatggatttctttgatgatgccaacctgttcggggagactttggaaggactgtccgatgatgcctttgttcagcccgggcctgtgtcattagtggacgagctcaacctgggggcagagttcgaacccctacacattgattccctcaaccacgtgcagggaactccaacacaccagaagatgactgatttcgagcagcttaatcagtttgactctatcaagttccaccatgtgaatcaatccttcggctcccccgctgagcatgtcctcagtccacacagccagttcaattgctctcctatccacccccagaaccagccaaacggactgttcccagatgtgtctgatggcagccctatgtggggccaccagaccgccaccaccatctctaaccaaaacggcagcccattccaccaacaggggcactcgcacagcatgcaccagaacaaaagcttcgtggctcaccacgattttgcactgttccaagcgaatgagcagcagacccagtgtacttccctgcgaagtcagcagaatcgcaacaacctgaacccaggccagaatagcctgtcccagtcaaaaaattttatgaacgtgagcgggccccacagagtgaacgtcaaccacccacctcagatgaccaatgcaagcaactcgcagcagtctatctctatgcaacagttcagtcagacatccaacccctccgcgcattttcataagtgctccagccaccaagagggcaactttaacggaccctctccgaacatgacatcgtgctccgtctcaaattctcaacaattcagctcccactacagcttctcgagtaaccacatatctcctaactccctcctccaaagtagtgccgttcttgccagcaaccatacaaaccagaccctatccgacttcacaggatcaaattcattctccccccatcggggtattaagcaggagtctacgcagcacattctcaatcccaacacttcactcaatagtaacaatttccaaatcctgcacagctcacacccacagggaaattacagtaactccaagctcagtcctgtgcacatgaattttccggaccccgttgactcaggtactcaaatgggacacttcaacgatcacgtcgagaccaacggcttttcctctctggaggagaatctgctgcatcaggtggagtcacaaactgagcctttcactggcctggatcccgaggatctcttgcaggaaggacttttaccacattttgatgagagcacttttggacaggacaactcaagtcatatcctcgaccatgatttggaccgtcagttcacgagccatcttgtgacccgcccctctgacatggcccagacccaactccagtcccaggctcggtcctggcactcgtctttctcaaatcaccaacatctccatgatcggaaccacctgtgtctgcagcgacaaccaccaagcagcaagaagtccgacggaagcgggacatatactaagctccagaacacccaggtgcgggtgatgtccgaaaagaaacaaaggaagaaagtggaatccgagtccaagcaggaaaaggcaaatagaataatctcggaggctatagccaaggcaaaggagagaggcgagaggaacatcccacgagtgatgagccccgagaactttcctactgcaagcgtcgagggcaaagaggagaaaaaaggtagacgaatgaaatcgaaaccgaaagataaagactccaagaaaactaaaacctgtagcaaactcaaggaaaagactaagatcgggaagctaataatcacactcggaaaaaaacagaagcgcaaaaatgagagctccgacgaaatcagcgatgcagaacagatgccacagcatactcttaaagatcaggacagtcaaaagaggcgttctaatagacagatcaagcggaaaaaatacgctgaggacatcgagggcaaacagtccgaagaggaagtaaagggtagcatgaagataaagaagaactctgcccccctaccaggtgagcagcctctgcagcttttcgtcgaaaatccctctgaagaagatgccgctatagttgataaaatcctgtcttcaaggaccgtgaagaaggagatctctccaggagttatgatagatacagaagagttctttgtgaaatacaaaaattacagttatctccactgcgagtgggcaactgaggagcagttactcaaggataaacgaatccagcagaaaatcaaacgttttaaactaagacaggcacagagagcccacttctttgccgatatggaagaggagccttttaaccctgactacgtggaggttgatagagtcctagaagtgtcattctgtgaggacaaggataccggcgagcctgtgatttattatctggttaagtggtgctcccttccatatgaagacagtacgtgggagctgaaggaagacgtagacctggcgaagatagaagagttcgagcaactccaggcctccagaccggatacaagacggttagatcgccccccttctaatatctggaaaaaaatcgatcagagtcgggattacaaaaatgggaatcagctgcgcgagtaccagttagaaggacttaattggctgctgttcaattggtacaatcgacgaaattgtatcttagccgacgaaatgggattgggcaagactatccagtctataacttttctgtatgaaatcctactcactggtatcagggggcctttcctgatcattgccccactttcaaccattgccaactgggagagagagttcagaacatggacggacatcaatgtggtcgtttaccatggatcgttgatatctagacaaatgattcaacagtacgagatgtacttcagggactcccagggtcggatcatcagaggggcctatcggttccaggccattatcacaaccttcgaaatgatattgggaggttgcggcgagttgaatgcaatagaatggcgctgtgtgattattgatgaagcccatagactgaagaacaaaaattgcaaacttctcgaggggcttaagctgatgaatcttgaacacaaggtacttctgactggcacaccactgcagaacacagtcgaagagctgttctctctgctacacttccttgagccactcaggttccctagcgagtctacttttatgcaggagtttggtgacctcaaaactgaggagcaggtgcagaaactccaggctattcttaaacccatgatgctccgacgcctgaaggaggacgtggagaaaaaactcgccccaaaggaagagaccatcattgaggtggaactgacaaacatccaaaaaaaatattaccgcgcaatattggagaaaaatttctcctttctgagtaagggagccggacagacaaacgtccccaacctggtgaataccatgatggagctacgtaagtgctgcaatcacccttacttgatcaagggcgctgaggaaaagattctgggcgagtttcgcgacacttataaccctgctgcaagcgactttcatttacaggccatgatccagagtgccggcaaactggtgctgattgacaaattactgccaaaaatgaaggccggaggccacaaagttttaatattcagtcaaatggtaagatgtctcgacattctggaagactacctgatccataaaaggtacttatacgagcgtatcgatggtcgtgtgcgaggcaacttacgtcaggccgcaattgaccgcttctctaaacctgactcggacaggttcgtctttctgctgtgcacccgagcgggaggacttggcatcaacctcactgcagcggatacctgtatcatattcgacagtgactggaatccacagaatgacctgcaggcccaggccagatgccaccgaattggccagaacaaagccgtgaaagtgtatagacttgtgacccggaactcttacgagcgggaaatgtttgatagggcttcattgaaattaggcctagacaaggctgtgctacagtcaatgagcgggcgggagagcaatgtggggggaatccagcagttgtccaagaaagagatagaggacttactccgccggggcgcttatggggctattatggaagaggaggatgaagggtccaagttctgcgaagaagatatcgatcaaatccttctcagacggacaaaaaccatcactattgagtcagagggtcgaggctcaacttttgccaaagcatcgtttgttgcgtctggaaataggacagacattagcttggacgaccctaacttttggcaaaaatgggctaaaaaggctgagattgacatcgaggccatctcaggccgtaacagccttgttatagatacacctcgcatacggaaacagacccgcccgttttccgccacgaaagatgagttagctgagctgtctgaagctgagagtgagggtgacgagaagccaaaactgcgccggccgtgcgaccgaagtaacggttacgggaggacagagtgctttcgagtcgagaaaaacctgctcgtgtatggttggggtagatggagagaaattctgagccatggacgctttaagcggcagctgaatgagcatgacgtcgaaattatttgccgagccctgctagcctattgcttagtccattatcgcggggatgaaaagatcaaaggcttcatttgggacctgataacccccacagaggatggccaaacacgcgaactgcagaatcacctgggactcagcgcacctgtgccaagaggtagaaagggcaagaaagtaaagactcagacaagcagcttcgatatccagaaagctgaatggttacgaaagtataaccccgagcagctgctgcaggacgagggctataagaagcatattaaacaccactgtaacaaagtactgctgcgggtgcgaatgctgtattatctcaagcaggaggtgatcggcaacgagtgccagaaggtgttcgacggggtcgacgccagcgacattgatgtttgggttcccgaaccagatcatagtgaggtgccagccgagtggtgggatttcgatgccgacaaatctctgcttatcggtgtgtttaagcacggctatgaaaaatataacactatcagggcagacccagccttgtgcttcctggaaagagtgggaaagcctgatgaaaaggctgtcgcagcggagcagagagctaacgattacatggacggcgacgtggaagacccagagtataagcctgcccctgccatcttcaaagatgatattgaggacgacgttagttcgcccggtgacctggtgattgccgacggagacggacagctgatggaaggtgataaggtgtattggcccacacaaagcgcactgacaactaggctgcggaggttgattacagcgtaccaacgaactaataaaaatcggcagatccagcagatccagccaacattctctgtgcccacatccgtaatgcaacctatctatgaggaggctactctcaacccgaagatggccgcaaagatcgaacggcagcagagatggaccaggcgcgaggaagccgacttctacagagtggtgtcaactttcggagtggtgtttgatcccgaccgggggcaattcgactggaccaagtttcgagcaatggcgcggctccataaaaaaaccgatgactcgctggagaagtacttatacgccttcatgagtatgtgcagacgggtgtgccggctgccatcaaaggaagaactcgtcgacccgaacattttcatacagcccatcaccgaagaacgcgccagcagaactttgtatcggatcgaacttctgaggaaggtgcgagagcaggccctgcgacacccccaactcttcgagcggcttaaactttgccatccgaaccctgacctgcctgtatggtgggagtgcggaccacacgatagggacctcctgattggggccgcaaagcatggtgtgtctaggaccgattaccacatcttgagggaccctgagctcagttttatggcagcgcagagaaattattcccagtctaagatggctcatagccgcacatcgactccgctgctccagcagtatcaggtcgccctgagcgcgtcacctctgacctcgctgcctcggctgctagatgctaagggcattatcctggaggagatgaaagtgaagtccgagaacctgaaggaggaacctcagagtagtgaagaggagagtatgagctcggtcgaaactcggacactcataaagagtgaacccgtctctcccaagaatggagtgctgccccaagccacaggagaccaaaagtctggaggcaaatgcgagactgataggcgcatggtggctgcccggacggagccattgaccccgaacccagcctctaaaaagcctagagttcacaagcgagggagcgaatctagttctgattctgacagcgatagcgaacgtagcagctgttcctcccggagctcgagcagcagtagctcttcctcctgctctcattccagatctgggagctccagctcgagttcttcatcctgctcaagtgcatcttccagctcatctagctctacctcatcgagctcatccagctcaagttcctcgtcagaggaatccgattccgatgaagaggaagcacagaaaagagcggagtccacaacacacatgaaggcctacgacgaggagtctgtggcaagcctatccacaacccaggacgaaacgcaggatagctttcagatgaacaatggcaccccagaatccgcctatatcctacaaggcggttatatgcttgccgcctcatactggccaaaggatcgagtgatgatcaatcgactggactcaatttgccagacagtgcttaaaggcaaatggccatccgccaggcgatcatacgatgctaacaccgtcgcatcattttatactaccaaattgctggatagtcccggtgcagccaccgaatattctgacccctcagttcctactccccccggcgctggggtcaaggaagagcatgatcagtccacacaaatgtctaaggaagggggcctaaaattgactttccagaagcaaggactcgcccagaaaagacctttcgacggggaggacggggccctgggtcagcagcagtacctcacaaggctccgggagttgcaatccgcatcagagacatcattggtcaacttcccgaaatccattcctgtctccggcacttccattcagcccaccctgggcgctaacggtgtgatccttgataatcagcccatagtgaagaaacggcgtggaagaaggaaaaatgtcgaaggcgtagacatcttcttctttaaccgtaacaagccaccaaatcacgtttccctgggcctcacatcctctcagatcagcacaggtataaaccctgccctttcttacacacagccgcagggaatcccggataccgagagcccagtgccagtaatcaatctcaaagatgggacacggctggccggagacgacgctcctaaaagaaaagatctggaaaagtggttgaaggagcacccaggttacgttgaagatctgggcgcattcatacccagaatgcagctacacgaagggcgaccgaaacagaaaaggcatagatgtcgcaaccctaataagctggacgtgaactcgcttacaggagaagagcgagttcagttaattaaccgcagaaatgctaggaaagtgggcggggctttcgctccccctctgaaagacctgtgccgtttccttaaagaaaatagcgaatatggtgtggctcctgagtggggcgatgtggtaaaacagtctggatttctgccggagagtatgtatgagaggatcttgaccggacccgtggtccgtgaagaggtgtcacgacgcggaaggagaccaaagagcgggattgcaaaggccactgccgccgctgcagccgctagcgcgacaagcgtcagcgggaatccgctgctagctaacggcctcttacccggcgttgacctaaccacgctacaggccctgcagcagaacctgcagaatttacagtctttgcaagtgaccgctggcttaatggggatgcccactgggctgccctctgggggagaggccaagaacatggctgctatgttcccaatgctgctttcaggaatggccggcttacccaatttgttaggcatgggcggtctgctgaccaagcccactgagtctggaacggaagataaaaaagggtctgacagtaaggaatccgaaggtaagaccgagcgtactgaatcccagtcaagcgagaacggcggcgagaactctgtcagcagttccccctcaacctcctctactgctgccctgaacaccgctgcagcggctaacccattagcgctaaatcccctacttctgagtaatatactgtaccctggcatgctcttgactccaggcctgaacctccatatccctacactcagtcagtccaataccttcgatgtacagaataagaacagcgatctcgggagcagcaagagcgttgaggttaaggaagaggacagtaggataaaagaccaagaagacaagggcggcacggaaccgtctccgctgaatgaaaactctacggacgagggttctgagaaggcagacgcctcctcaggttccgactctactagctcgtcctccgaggactctgatagttctaatgaggattag

SEQ ID NO: 27196 - DNA, 2892 bp, Artificial Sequence
  Description of Artificial Sequence: Synthetic coding sequence
atgttatattacctcaagcaggaggtcataggcaatgagtgtcaaaaggtcttcgatggtgttgatgcctccgacatcgacgtatgggtccccgagcccgatcactccgaagtgccagctgagtggtgggattttgacgccgacaagagtctgctgatcggggtgttcaagcacgggtacgaaaagtacaataccatccgggccgatcctgcattatgtttcctcgagagggttggaaaacctgacgagaaggccgttgcggcggaacagagggctaacgactatatggatggcgacgtggaggaccctgaatataaaccagccccagctatctttaaagacgacattgaggatgatgtttccagtcctggtgacctcgttatcgccgacggtgatggccagttaatggagggggacaaagtctactggccgacgcaatccgcactgaccacaagactccgcaggctgattacagcctaccagaggaccaacaaaaatagacagatccagcagatccaacccaccttcagtgtgcctacctcagtcatgcagcctatttatgaagaagccacgttaaaccctaagatggccgccaaaattgaacgacaacaacgctggacacgtagggaagaggcagatttttatagggttgttagtacattcggcgtggtgttcgatccagaccgcgggcaattcgattggaccaagtttagagccatggccagactgcataaaaagactgatgatagtctggagaagtatctttacgccttcatgtcaatgtgtaggagggtttgcaggctgcccagtaaggaggagtccacgactcacatgaaagcgtacgacgaggagtctgttgcctccttaagcactacacaggacgagacccaggattctttccaaatgaacaatgggactccagaatcagcctacattcttcaaggtgggtacatgttggctgcaagttattggcctaaagacagagtcatgattaatcgtctggattcaatttgtcagactgtgctgaaggggaagtggccatctgctcgacgaagctatgacgcaaatacagtggccagcttctatacgaccaagctgctggattccccaggggccgctaccgagtattctgacccctctgtccccacgcccccaggagctggagttaaggaggagcacgaccagtccacccagatgtctaaggtcaagaagcacgtccgcgaaaaagagttcacagtcaaaataaaagatgaaggtggcctgaagctcacattccagaaacaaggcctcgctcagaagagaccattcgacggagaagacggcgctctcggacagcagcaatatttgaccaggctgcgtgaactgcagagcgcctcagagacgtcactagtgaattttcctaagtctataccggtgagcggtacttctatccagccgacgcttggggccaacggcgttatcctggacaaccagccaatcgtcaagaaacgacggggtcggcgtaagaatgtcgagggagtggacatcttcttctttaaccggaataaacccccaaatcacgtgagcctcgggttgacgtcttctcagataagtacagggattaatccagcccttagctacacacagccacagggcataccggacaccgagagtccagtgcccgtgatcaatttgaaagacggcacgcgcctcgccggcgatgatgcgcccaaaagaaaggacctggaaaagtggctcaaggaacatccgggttatgtggaagatctaggcgcgtttattccccgcatgcagctgcacgaagggaggcctaaacagaaaagacaccggtgcaggaacccaaataaactggatgttaacagtcttaccggggaagaacgtgtgcagctaatcaaccgacggaacgctcgcaaggttggcggggccttcgctcctcctttaaaagatttatgtaggtttttgaaagaaaatagtgagtatggcgtcgccccagaatggggcgatgtggtcaagcagtcaggatttctccccgaaagcatgtacgaacgaatcctcaccggtcccgtggttcgagaggaagtgagcaggaggggacggaggcctaaatcaggtattgcgaaagcaactgcagccgccgcagctgcaagtgcaacttccgtttcaggaaatcctcttttggccaatggacttctgccaggagtcgatctcaccacactgcaggctttgcaacaaaatctccaaaatctccagtcactgcaggttaccgcaggcttgatgggaatgcctacggggctgcccagcggcggagaagcaaaaaacatggccgcgatgttccctatgctgctgagtggaatggcagggctgcccaatcttctcggcatgggcggcctcctgacaaagccaaccgagtccggaactgaggataaaaaaggcagtgattctaaggaatccgagggcaaaaccgagcggaccgagtcccagagctctgagaatgggggggaaaacagcgtgtccagcagccccagtaccagtagcacagctgccctgaacaccgctgcggcggctaatcccctggctctgaacccattgctgcttagtaatatcttgtaccctggtatgcttctgacacccgggcttaatttacacatacctaccttatctcagagcaatacctttgatgtgcagaataaaaatagcgacctgggctcatctaaatcagttgaggtgaaagaagaagacagccgcattaaggatcaagaggacaaagggggtactgagccttctccgttaaatgaaaactctactgatgaaggatccgaaaaagcggacgcatctagcggcagcgatagcacctccagttcttcagaagacagcgattcatcaaacgaggactag

SEQ ID NO: 27197 - DNA, 8646 bp, Artificial Sequence
  Description of Artificial Sequence: Synthetic coding sequence
atgacagatccaatgatggatttttttgatgacgccaatctgtttggggagacgctggaaggccttagtgacgatgcctttgttcagccaggccctgtgtctctcgtagacgagctgaacctgggcgcagaattcgagcctctccatatagatagtttgaatcatgtacaggggacccctacacatcagaaaatgaccgacttcgaacaactcaatcaatttgattcaattaagttccaccacgtgaaccagagtttcggatcaccagccgagcatgtgctttccccacactcccagtttaattgctccccaattcatcctcagaaccaacccaacgggttgtttcctgatgttagcgatggctcccccatgtggggccaccagaccgcaacaaccatcagcaatcagaatggtagcccattccatcagcaggggcatagtcactcaatgcaccagaataagtccttcgttgcccaccacgatttcgctctctttcaagccaacgagcagcagactcagtgcactagtctgcgctcccaacaaaataggaacaacctgaatcctggccagaatagcctatctcagtctaaaaacttcatgaatgtgtctggaccacatagggtcaacgtgaatcacccccctcaaatgacaaatgcttctaatagtcagcagtctatttctatgcagcaatttagccagacctctaatccatcagcacactttcataagtgttcaagccaccaggagggcaacttcaacggaccaagtcctaacatgacaagctgttccgtatccaactctcagcagtttagtagccactacagctttagttcaaaccatatctctccgaacagcctgctgcagtccagtgcggttctggccagcaaccacaccaatcagactttatccgattttaccggttctaattctttttccccacaccgcggaattaagcaagaatccactcagcatatcttgaaccccaatacatcacttaatagtaacaattttcagattctgcactcctcacatccccagggcaattactccaacagcaagctatctcccgtgcacatgaattttccggaccccgtggactctgggacacagatgggccattttaatgaccatgtcgagacaaatggttttagcagtctggaagagaatctgttgcatcaagtggaatctcagacagaaccattcaccggcctggatcctgaagatctactgcaggaggggctgctccctcattttgacgagagtaccttcggacaggataatagcagccacatccttgaccacgacttagatcggcaattcaccagtcaccttgttacacggccatccgacatggcacagactcagcttcagagccaggcacggtcctggcattcttctttctcaaatcaccagcacctgcatgatagaaaccatttgtgcttgcagcgacagccgccgagctctaagaagtctgacgggtccgggacctacaccaagttgcagaatacccaagtccgcgttatgagtgaaaaaaagcaacgaaaaaaggtggagagtgagtctaaacaggaaaaggctaatcgtatcatctccgaagccatcgccaaggccaaggagcgcggtgagcggaatatcccccgcgttatgtcccccgaaaatttccccactgcctctgtggaggggaaggaggagaagaagggccgcaggatgaagagtaagcctaaagacaaagactcaaagaagaccaagacctgtagcaaacttaaagaaaagactaaaatcgggaagctcataattacgctaggtaaaaagcagaaaagaaagaacgaatcctctgatgagatctccgatgccgagcagatgccccagcacactcttaaggatcaggattcccagaagagacgcagcaatcgccaaattaagcggaagaaatacgccgaagatatcgaagggaaacagtccgaggaagaggtaaaagggtcgatgaaaataaaaaaaaactccgctcccctgccgggcgaacagcctttgcagctttttgtggaaaacccatctgaggaggacgctgcaatcgttgataaaatccttagttcaagaactgtcaaaaaggaaatttctcctggggttatgatcgatactgaggaattcttcgtgaagtacaagaactacagctacctccactgtgaatgggctactgaggaacagctgttgaaggacaaacgtattcagcaaaaaatcaaacgattcaaactgcggcaagctcaacgcgcacacttcttcgcagatatggaggaagagccttttaaccccgactacgtggaggttgaccgagtgcttgaagtgtccttttgtgaggacaaggacaccggcgaacccgtgatttactacctggtgaagtggtgctccctgccatacgaggacagcacctgggaactgaaggaggacgtcgatttggctaaaatcgaggaattcgagcaactgcaggcttctcgccccgatacacggaggctcgaccgcccaccgtccaacatctggaagaaaatcgaccagagcagagattataagaacggaaatcagctacgcgagtatcagttggaggggctgaactggctcctattcaattggtataacagacgaaattgtatcctggctgatgagatgggcctgggaaaaaccatccaatcaataacctttctctacgagatcctgctcaccggaatacggggcccctttcttataatcgcgcccctgtcaactattgccaactgggagagggagtttagaacatggacggatattaatgtcgtagtgtaccacggaagtcttatttcacgacaaatgatccagcagtatgagatgtacttccgggactctcagggaagaatcattagaggggcctaccgcttccaggccatcataactacattcgagatgatcctgggcggctgtggcgagttgaacgcaatagaatggcgctgtgttattattgacgaagcccacaggctgaaaaacaagaattgcaagcttttggagggactgaagctgatgaatctggagcataaggtcctgctcactgggacacctctgcagaataccgtggaagagctgtttagtcttctgcacttcttagagcctcttcgcttcccaagcgaatcaacctttatgcaggagtttggagacctgaaaacagaggaacaagtgcaaaagctgcaggccatcctgaaacctatgatgcttcgccgcctcaaagaagacgtcgagaagaagctggctcccaaagaggaaacgattatagaagtagagctcaccaatattcagaaaaagtactacagagccattctcgaaaagaacttttcctttctgagcaagggagcaggacagacgaacgtccctaacttagttaatacaatgatggagctgcggaagtgctgcaatcacccatacttgattaaaggtgcggaagagaagattctcggggagttcagagacacctataaccctgccgcttctgacttccatctccaagcaatgatccagagcgccggaaagctggttctcatcgataagctgctaccaaaaatgaaggcaggcggtcataaggttctcatcttttcacaaatggttagatgcttggacattcttgaagattacttgatccacaagcggtacttgtatgagagaatcgacggtcgagtgcgcggaaatctgagacaagccgcaatcgaccgcttctcaaagcccgactccgatcgcttcgtgttcctgctgtgcactagggcaggcggcctgggtatcaacctcaccgcggccgatacctgcattatctttgactcagactggaatccacaaaacgacctgcaggcccaggccagatgccataggattggccagaataaagcggtgaaagtgtatagactggttacaaggaactcgtacgagcgcgagatgttcgatcgtgcctcactgaagttaggattagataaggctgtgctgcagtctatgtctgggcgggaaagcaacgtggggggaatccagcagctcagcaaaaaggaaatcgaagacttgctgagaaggggtgcctacggcgccatcatggaagaggaagacgagggcagtaagttctgcgaggaagacattgaccagatcttactgcgaagaactaaaactattactatagagtcagaaggacgggggtccactttcgccaaggcctctttcgtcgccagcggcaacaggaccgatattagtctggacgatccgaatttctggcaaaaatgggctaagaaggcagaaatcgacatagaggcaatctcaggcaggaattctctggtaattgacacaccccggatccgaaaacaaaccaggccattcagcgccaccaaagacgaacttgctgaactaagcgaggctgaaagtgagggcgatgaaaagccgaaactgcggcgcccttgtgatcggtccaatggatatggacgcactgagtgcttccgcgtggaaaaaaatttgctggtttacgggtggggcaggtggagagagatcctgtcccacgggcgttttaagcggcagctaaatgaacacgatgttgagatcatctgtagagcactgctcgcctactgtctcgtgcactatcgcggcgatgaaaagattaagggtttcatttgggatctgatcacaccaaccgaggacggacagacccgcgagcttcagaaccaccttggactgtctgccccggtgccgcgaggtcggaaggggaaaaaggtgaagacacagacctccagcttcgatattcagaaggctgagtggttgcgcaagtacaaccctgaacagctcctccaagatgagggttacaagaagcacatcaaacaccactgcaacaaagtccttttgagggtcagaatgctttattatctgaagcaggaggttatagggaacgagtgtcagaaagtgttcgatggcgtggatgcctccgatattgatgtctgggttccggagccagatcactcggaagtacccgccgagtggtgggactttgacgctgacaaatctctgctgataggagtgtttaagcatggttacgaaaagtataacaccattcgcgccgacccagccttgtgcttcctggagagggtcgggaagcccgacgagaaggccgtggccgccgaacagagggcaaatgactacatggatggggatgtagaggatccagagtacaaacctgcacctgcaatattcaaagatgacattgaggacgacgtcagctcacctggtgacctggtcatcgccgacggggacggtcaattaatggagggagacaaggtgtactggcctacacagtcagcccttaccacaagactgcgacggctgattaccgcttaccagcgcactaataaaaaccgtcagattcagcagatccagcctaccttttccgtcccaactagcgtgatgcagccaatatatgaggaggccacgcttaaccctaaaatggcagcaaagatcgagcgtcagcagaggtggactcgacgcgaggaggctgatttttatcgcgtcgtgtccacgtttggagttgtctttgatcctgacagaggacagtttgactggaccaaattcagggcgatggctcgtctgcataagaagaccgacgattcgctcgagaaatacctgtacgccttcatgagtatgtgccggagagtttgtcgcctgccttccaaggaagagctagtggatcctaacatcttcatccagccaattaccgaagagagagcttcccgtaccctctatcgtatagagctgcttaggaaagtgcgagagcaggctttacgacatcctcagctgtttgaaaggttgaaattgtgtcaccctaaccccgacctccctgtgtggtgggaatgcggccctcatgatagggatttgctcataggggccgctaaacatggagtgtcacgaacggactaccacattctccgcgacccagaactctctttcatggccgcgcagcggaactacagccagtccaagatggctcacagccgcacatccacccctttactgcagcagtaccaggttgctctgtcagccagccccctgacatcactcccgcgactgttggacgccaagggcattatccttgaggaaatgaaagtaaaatctgagaacttaaaggaagaaccccagtcctctgaagaagagtccatgtctagtgttgaaactagaaccctgattaagtctgagcctgtgtctcctaagaacggtgtcctgccccaggcgacgggtgaccagaaaagtggtggaaagtgcgagaccgatagaaggatggttgcagccagaacagaaccactaactcctaatcctgcctcaaaaaagcctcgcgtccacaaaagaggaagcgaaagcagctcagattcggactctgactccgaacggtcatcttgctcatcaaggagctcgtcttccagcagttcatcttcttgcagtcactcacgatcaggctcctctagctcctcttcatccagctgctcaagcgcatcgtcttcctcttcctccagcacctcaagctcatccagctccagctcgtcatcctccgaagagtccgacagcgacgaggaggaagcccagaagcgggagagtaccacccatatgaaggcttatgatgaggaaagcgtcgcttcacttagcactacccaggatgagacccaagactcctttcagatgaataacgggacaccagaaagcgcatacatcctgcaaggaggttacatgctcgctgcgtcctattggcctaaagaccgcgtcatgattaacaggcttgacagcatttgtcagacagtgctgaaaggcaaatggccatcggcaagacgatcatacgatgcgaacaccgttgcatccttttatacgaccaaactccttgatagcccgggcgccgcgaccgagtatagtgatccctcagtgcccacgcctcctggggctggcgttaaagaagaacatgaccagtccacccagatgagcaaagaaggtggtctgaaactgacttttcagaaacagggactggcccagaagcggccattcgatggcgaagatggagctctgggtcaacagcaatatctgactcgtttaagagagcttcagagcgcttcagagacctccctggtgaacttccctaagtctatccccgtgtctggaactagtattcagccgacactcggggcgaatggagttattctggataatcagcccatcgtgaagaaacgacgaggaaggcgtaagaatgtcgagggcgtcgacatatttttcttcaacagaaataagccccctaatcacgtgtcactgggattaacttcaagccagatatccacagggatcaaccccgcactgtcttatacgcagccacagggaatccccgacactgagtctccagtgcctgtcatcaatctcaaggacggaactcggttggctggcgacgatgcaccgaagcgtaaggacctggagaaatggttaaaggagcacccgggctacgtggaggacctcggcgcatttataccacggatgcaattgcacgagggcagacctaagcagaaacgccaccgttgccgaaaccctaacaaactggatgtcaactctcttaccggcgaagagagggtgcagcttattaaccggaggaatgccaggaaggtgggcggcgcttttgcgccaccattgaaagacctgtgtaggtttctcaaagaaaattccgaatacggtgtcgcccctgaatggggtgatgttgtgaaacagtctggttttctcccggagagtatgtatgaacgcattcttacaggccccgtggtgagggaggaagtgtctagacggggccgtcgcccaaaaagcgggatcgcaaaggccacagctgccgcggccgcggcgtccgccacatcagtgtctggaaatcccctgcttgccaatggtctgcttccaggagtggaccttactacactacaggccttgcagcaaaatctgcagaacctgcagagccttcaggtgacagccggtttgatgggcatgccaacagggcttcctagcggtggagaagccaagaatatggctgctatgtttcctatgctcctgagcgggatggccgggctccctaatctgctgggcatggggggattgctgacaaaacccacagaatccggcacggaagataaaaagggtagcgactctaaggagagcgaggggaaaaccgaaagaaccgaatcacaatcatctgagaatgggggggagaatagcgtctcatcctcaccctcaaccagctccacagcggctctgaatactgcagctgccgccaatccactggcgctaaacccactcctgttatccaacatcctgtatcccggcatgcttttaactcccggcctcaaccttcacatccccacactatcacagtcaaacacgttcgatgtccagaacaagaattctgacctcggctcttctaagagcgtggaagtgaaggaggaggatagtagaataaaagatcaagaggacaagggtggcactgagccatctcccttgaacgagaattcgaccgatgaaggctctgagaaagctgacgcttccagtggttcagactcgacctcctctagctctgaggacagcgacagtagtaatgaagattag

SEQ ID NO: 27198 - DNA, 444 bp, Artificial Sequence
  Description of Artificial Sequence: Synthetic coding sequence
atgactgcaatccgcctacgggaattcatcgaacggagaccggttattcctccatctatatttatagctcaccagggccgtgatgtacagggctattaccccgggcagctcgcccggctgcatttcgaccactcagccaaaagagctccgaggccactgatcgacctgaccatccccccaaagacaaaataccactatcagcctcagctcgatcagcaaactctgatcagatacatctgcctgaggaggcattctaagccagccgaaccatggtataaggagactacatacagaagggactactctctgcctttttacgagattgactggaatcagaaacttgctaccgtctctttaaaccccagacctctgaattccttaccagaactctactgttgtgaggagcgctcctcattcgagcggaatgcctttaaattgaaatag

SEQ ID NO: 27199 - DNA, 348 bp, Artificial Sequence
  Description of Artificial Sequence: Synthetic coding sequence
atgactgccattagattgagggagttcatcgagcgacgaccagtaatcccacctagtattttcattgcacatcaaggccgcgacgtgcagggatactatccagggcagctggcccgcttgcattttgaccatagtgcaaagagagcgccaagacactctaagcccgcagagccctggtacaaggaaactacctaccgaagggattactccttacccttttatgagattgactggaaccagaaattggccaccgtttccctgaacccaagacccctgaactctcttcctgagctatactgttgtgaggagagatcgagcttcgagcgcaacgccttcaaactgaaatag

SEQ ID NO: 27200 - DNA, 552 bp, Artificial Sequence
  Description of Artificial Sequence: Synthetic coding sequence
atggagaagcgcgaactgaaggcctctgttcctaagtttgacaaaattccctggctgtcagaggcctctctcgtgaacaagccactggtcttatctctccctcgacgctaccctcatactagtgctaccttcttgacaagttctaaaaagaatatgaatctaccaatcctgtttcaggtgcccgatgtcctgtctaaggcaaggagaaatcagtgcgacagcatgcttcttcgcaatcagcagctttgctctacttgtcaagagatgaagatggtgcagcctcggactatgaagatccctgacgatcccaaggcatcatttgagaattgcatgagttatcggatgagtctgcaccagcctaaatttcagacgactcctgaaccgttccacgatgacatccctactgagtccattcactacagactgcctattctggggcccaggacggctgtgttccacggactgcttaccgaagcctataagactctcaaagagcggcagaggtcttctctgccccgtaaggaacctattggtaaaacaacccggcagtag

SEQ ID NO: 27201 - DNA, 1992 bp, Artificial Sequence
  Description of Artificial Sequence: Synthetic coding sequence
atgctgcagatgccgaagttaaatgagattcccccaggaagagccggtcgccgcgaagccagaggtgaagggaggtggcctggacaaaccggtcctgaggccgcccgactggagtggcgggcgcagggacaggcagggggcgccagagcaccctgggattcctggggaagtagcaggcttccgactcaacctggcccggggtggtctcgctgtcccccttcactcctatgcgcgctctcgttccagaaaagtacaatggaatcgaaagacgaagtcagcgatacagatagtggcatcatactccagagcggccctgattcccctgtaagccctatgaaagagctaactcacgctgttcacaaacagcagagagccctggaggctcggcttgaagcctgcctggaagaactgagaaggctgtgcctcagagaagctgagcttacgggtaccctgccagctgaataccctctgaaacctggggagaaggccccaaaagttagaagacgcatcggagccgcatataagcttgatgactgggcactgcacagagaagatccactgagcagtctcgaacgccagttggcactgcagttgcagattacggaagctgcccggcgtctctgcctagaagagaacttgtctcgacaagcccgacgacagcgtaaacattctatgttgcaggaagagaagaaactccaagagcttcagaggtgcctggtggagcgtagacggaattcagagccacctcccgccgccgcactaccgttggggcgcgaactgagcgccagcgacgatagtagtctgagtgacgggctgctgttggaggaagaggaaagtcaggtccccaagcctcctcctgaatctccagcaccccccagccggccactacccccacagacactggagggattgcaaccaactggaccggaagcgggttcccccgagagagctccagtgcagaactccccctggaaggagacatccctggaccatccatacgagaaacctcgtaagagttctgagccatggtccgaatcgtcctccccagccacaaccccacaagatggcccttctgcatcctccctgtggctgttggagcccgccagttatcatgttgtgccgattagaggcgtgcccgggcagtggcaggggcggacatcagcccccgccacaccggagatacaagggaggcggggacagtctcaaagtctgcgagtcgacagcttcagagctggtcccgaaggcagaggcaggagcgcttttcctagaagaaggcctacacactacactgtgaccgttcccgatagttgctttcctgctacaaaacctcctctgcctcacgccgcttgccacagctgcagtgaggattccggctcggatgtcagctccatctctcaccctactagccccggttccagctcaccagacatctctttcttgcagcctctgagtccccctaagacacaccggcaccggggggcctgggttccagccggatctcgtgaactagtggcacaccaccctaaactgcttctaccacccgggtacttccccgctggcagatacgtcgtggttgcagagtctcctcttcctccaggagaatgggagctgcgccgcgctgctcctggccccgcttatgaggaggagggtacaccactgaggtaccagcgcctggtgccaagtagaagtaggatcgtacggaccccatcactgaaagatagtccagccggaagaggcttatcgaaagctgcagtgtcagaggaattgaaatggtggcacgagcgtgcaaggcttcggagcacgaggccccatagcctggaccgccagggcgccttcagggtgaggtctcttcccctgggacgggagggcttcgggcgcgccctcggcccgagggcccaggtgcctacagtgtgcgtgttgcgtagatcccctgacggcgcccctgtacaagtgtttgtgcctgaaaagggggaaatcatttcacaggtctag

SEQ ID NO: 27202 - DNA, 1737 bp, Artificial Sequence
  Description of Artificial Sequence: Synthetic coding sequence
atggagtctaaagacgaggtctccgataccgattcaggcatcattctacaatctggtccagatagcccagtgtctcccatgaaagagctgactcacgccgtgcacaagcagcagcgagcattggaggctcgtcttgaagcctgtctcgaggagctgaggcgcctctgcttgcgagaggccgagttaacaggcacactgccagctgagtacccgctgaaacccggggagaaagctccaaaagtccgcagaaggataggagccgcctacaaactcgacgactgggcactgcatcgtgaagacccactcagcagtttggaacggcagctcgccctgcagctgcaaattaccgaagccgcacggcgactttgcctcgaggaaaacctgtctcgccaagccaggcggcagagaaagcattctatgcttcaggaggagaagaaacttcaggaactgcaaaggtgcttagtggagaggagacgcaattccgaacctcccccagcagccgcgctgcctctcgggagagagctctctgcatccgatgactcaagcctgtctgatgggttgctcctggaagaagaggaaagtcaggtccccaaaccaccaccagagtcccctgctcctccgtcaagacccctgcccccccagacccttgagggccttcagccaacaggcccagaagctggctctcccgagcgagctcccgtgcaaaatagcccatggaaggagacgtcactagaccacccatatgaaaagccccggaaatcatccgagccgtggtcagagagttctagccctgcgaccactcctcaggacggcccatcagcctcaagtctgtggctgcttgaacctgctagttaccatgtggtgccgatcaggggcgtgcccggtcagtggcaggggcgcacatcagcaccggccacccccgaaattcaggggcgacgtggccaatctcagagcctgagggtcgactctttccgcgctggtccagagggaaggggccggagcgccttcccacgccggagacctactcactacaccgtaaccgtccctgattcatgctttccggcaactaagccgccactaccccatgccgcatgccacagttgttccgaggattccggcagtgacgtgtcttctattagccatcctactagccctggaagctcctcccctgacatctcctttctgcaaccactgtcaccccccaagactcacagacataggggcgcatgggtgcctgccgggagtcgcgagctggttgcccaccatccaaagctgcttcttcctcccggctatttccctgccggaaggtatgtcgtggtggctgaatctccccttccaccgggggagtgggaactccgaagagcagctcctgggcccgcctatgaagaggaaggcacacctctcagataccaaaggctcgtgcccagtagatcacgcattgtcaggacccccagtctgaaggactctccagcaggcaggggcttgagcaaggctgccgtgtccgaagaattaaagtggtggcacgagagagcaagattacgctccacccgcccccacagtttggatagacagggcgcttttcgcgttcgctctcttccattgggccgggaaggctttggccgcgcgctcggtcccagagctcaggtcccaacagtctgcgtgctgagaaggtctcctgatggagctcccgtgcaggtgtttgtccccgagaagggggaaattatctcacaggtctag

SEQ ID NO: 27203 - DNA, 372 bp, Artificial Sequence
  Description of Artificial Sequence: Synthetic coding sequence
atggagtcaaaggacgaggtgagcgataccgattcagggatcatccttcagagcggccctgactcccccgtaagtccaatgaaggaacttacccatgcagttcataagcagcagcgtgcgctggaggctaggctggaggcctgccttgaagaactcaggcgactgtgtttgcgtgaggccgaactcaccgggacactgccagccgaatatcccctgaagccaggggagaaggctcccaaggtgagaagaagaattggcgcagcttataagctggacgattgggccctgcatagagaagatcctctgagtagtctggaaaggcagcttgccctccaacttcagattaccgaggccgcacgtcggttgtgctag

SEQ ID NO: 27204 - DNA, 123 bp, Artificial Sequence
  Description of Artificial Sequence: Synthetic coding sequence
atggaatccaaggatgaggtcagcgataccgactctggcattattctgcaaagcggaccagactcaccagtctccccaatgaaggaacttacacacgccgtccacaagcagcagcgcgcatag

SEQ ID NO: 27205 - DNA, 612 bp, Artificial Sequence
  Description of Artificial Sequence: Synthetic coding sequence
atgacccaggacagacctttattggcagtccaagaggccctcaaaaaatgctttccagtggtcgaggagcagcagggcctatggcagagcgcgctgcgtgattgtcagccgctgctgtcttccctgagcaatctcgccgaacagcttcaggctgcgcagaatcttaggttcgaggatgttcccgccctgcgggcttttcccgaccttaaggaacggctcagacggaaacaattggtagcaggcgacattgtgctggacaaacttggagaacggctcgccatactgctaaaggtgagagacatggtgagctcgcatgtggagcgggtcttccagatctatgagcagcatgccgataccgtaggaatcgacgctgtgctacaaccgagcgcggtgagcccatcagtcgctgatatgctagagtggttgcaggatatcgaaagacattaccgcaaatcatatctcaagcgcaaatacctactaagctccatccagtggggcgatctggccaatattcaagcccttcccaaggcttgggaccgtatttcaaaggatgagcaccaggatctggtgcaagatatcctgctgaatgtctcttttttcctcgaagagtag

SEQ ID NO: 27206 - DNA, 909 bp, Artificial Sequence
  Description of Artificial Sequence: Synthetic coding sequence
atggaaagacatatggtgcgcgggcagctctacaaacattttgatctggaaaggaaaaacgccaaacaggccgaggcacgattagaccagagactccagcggctgaaagtgatctgcctctaccatgtgaaactgctgacatgggaacagcgccaactccagaaggagctccagagactacagcaagcagagacaatgaagaagaaattttccagctatctcgggaatggctttcaaaagagaccagaggacgttcttgtgttctcaccgcaaggccgccagaagcacagagccccacaggctaagaaaatgcgggccctggcaacaagaatggcacaggacacatgcaaaagcaaatcccaggtgccccctagtcacgacgcgggtttgaaggacccaatgaagagtaaaaaacaaccgttgagccagaacaatcggacggcctgcttcatcaaggagcagcctcaagcgcaggaaaaggacagtgtgaacccctcgaaggacgtggacccatccaaaggaattagcgtgccgtgccagaaccaggaagtatcaaccaatacaatcgaacagggtcccagtagttctccggcctctgattccgggatggcctgcgccgacgagacccggtcgaaggacgtcgcgcttaagcccgacggaaacacaggtaagcaaattcctcctaaacacatggagtgtgcggggagctttgaaggagaattcacaaagcccacctttctggaacttctgtccaaggcccgcaatgcacattatttacgccaccgcgtacctccagaaagtgaacgcctcctttctatcggggaaatctttggacacggtgagtcctcttctagccgagccggaaaggaatgcgaaaatagggtgccgtctaagttcttaccgctgtag

SEQ ID NO: 27207 - DNA, 708 bp, Artificial Sequence
  Description of Artificial Sequence: Synthetic coding sequence
atggtccgagggcagctgtataagcacttcgacttggaacgcaagaacgcgaagcaggcggaggctaggctggaccagaggcttcagagactcaaagtgatatgcctctatcatgtaaagctgctgacttgggaacaacgacagcttcagaaagagctacagaggcttcagcaggaaactatgaagaagaagttttccagttatctgggcaacggctttcaaaagaggccagaggatgtgctagtgttctctccacagggaagacaaaaacatcgggcccctcaggccaagaagatgcgcgccctggccactcgcatggcacaggatacatgcaagagcaagagccaggtacccccgagtcatgatgcaggactcaaagaccccatgaaaagtaaaaagcagcctttgtcccaaaacaatcgcacggcttgttttattaaagagcagccgcaagctcaggagaaagatagcgtgaatcccagtaaggatgtggatcctagtaagggaatctcagtgccttgtcagaatcaggaggttagtaccaacaccattgaacaagggcccatctcttccgcgcagcctctcgcctttaacggcgaaacaattctgtatagtgagcggaatacgcggaatctgctgccaccaaccctctcctcaatgaagcagtcaaacaggggacgccaggccatctctgatcgcacggattag

SEQ ID NO: 27208 - DNA, 786 bp, Artificial Sequence
  Description of Artificial Sequence: Synthetic coding sequence
atggaaaacttcagtctcctatcaatatcaggaccccctatctccagttccgcactatccgccttcccagacatcatgttctctagggcaactagcctccccgatattgcaaaaaccgccgtacccactgaggcctcatctcccgcacaggccctgccacctcagtaccaatccattatcgtcaggcagggtatccaaaacacagcccttagcccagactgcagcctgggagacacccaacacggcgagaagttgagacgaaactgtacaatctataggccgtggttctctccgtattcttactttgtatgcgccgataaagaatcccagctggaggcctacgacttccctgaagtccagcaagatgagggaaagtgggataattgcctgtccgaggatatggctgagaacatatgttcatcctcttcctcccctgaaaacacctgtccaagagaggcaaccaaaaaatctcgccatgggctggactccattaccagccaggacatcctgatggcttccagatggcaccccgcgcagcagaacgggtacaagtgcgtcgcctgttgtcgcatgtatcccaccctggatttcctgaagagccatatcaaacgcggcttcagggagggtttcagttgcaaggtgtactacagaaagttgaaagctctgtggagtaaagagcagaaggctaggctgggtgaccggttaagtagtgggtcttgccaagcctttaactccccagccgaacaccttaggcagatcgggggcgaagcctacctctgcctctag

SEQ ID NO: 27209 - DNA, 1527 bp, Artificial Sequence
  Description of Artificial Sequence: Synthetic coding sequence
atgaacgaaaataaagatactgactccaaaaagtccgaggagtatgaggatgacttcgagaaagacctcgagtggctgatcaatgaaaatgagaaaagcgatgcttccataatcgagatggcttgcgagaaagaagaaaatattaaccaggatttgaaagagaacgaaaccgtcatggaacacaccaaacgtcacagcgatccagataaatccttacaggacgaggtgtcaccccggaggaacgatattatatccgtgcctgggatccaacccttagaccccattagcgactctgactccgagaacagctttcaggagtctaagctggaatcgcaaaaggacctggaggaggaggaggatgaggaagtaagacgatacattatggagaagatagtccaggccaacaagttgcttcagaatcaagaaccagtgaatgataaacgcgagcggaagcttaaattcaaagatcagcttgtggatctcgaagtcccaccactggaggacactacaactttcaaaaattacttcgaaaacgagagaaatatgtttggcaagctcagtcaactgtgtattagcaacgactttggtcaggaagatgtcctcttaagcctaacaaacggctcctgtgaggagaacaaagatcggactatattggtagaacgtgacgggaagtttgaactcttgaacttgcaagacattgcgagccaaggatttctgccgccaataaataatgcaaatagcacggagaacgatccccagcagctgctgcccagatccagtaattcttccgtgtctggcaccaaaaaggaggactccacagccaaaatccacgcggtcacacactcatccacaggggaacccttggcttatatcgctcagccccctttgaatagaaagacctgcccatctagtgccgtgaattctgacagaagcaaagggaacggcaaatccaaccataggacccagagcgcacatatatctcccgtgactagcacctactgtttgtcaccccgtcagaaggagttacagaaacagctagaggaaaagagggaaaagttgaaaagagaagaagagcgacgcaagattgaggaagagaaggaaaagaaacgcgaaaacgatatcgtgttcaaggcttggctgcaaaagaagcgggaacaagtgcttgagatgcggcggatccaaagagccaaagagattgaggatatgaatagccgcgaaaacagagacccacaacaagcttttcggctgtggctgaagaaaaaacatgaggagcagatgaaggagcgccaaacggaagagctgcgtaagcaagaggagtgcctgtttttcctaaaggggactgaaggccgagagcgcgccttcaagcagtggcttaggagaaagcgaatggaaaagatggctgaacaacaggccgtacgggagaggacccgtcagctgaggctggaggccaagaggagcaaacaactgcagcaccatttgtatatgtccgaggccaagcccttccggtttacggaccactataactag

SEQ ID NO: 27210 - DNA, 1530 bp, Artificial Sequence
  Description of Artificial Sequence: Synthetic coding sequence
atgaacgagaataaggacactgacagcaaaaagtctgaggagtatgaggatgattttgaaaaagatttagagtggctcattaacgaaaacgagaaatctgacgccagtatcattgaaatggcttgtgagaaagaggagaatatcaaccaggatctcaaagaaaatgaaaccgttatggaacataccaagaggcactcagaccctgacaagtctctccaggacgaagtgtctccacggagaaatgacatcatatccgtgcctggaattcaacccctcgatcccatctctgatagcgactcagaaaattcattccaggaaagtaaactggaatctcagaaagacctggaggaggaagaagacgaggaagtgcgacgctatatcatggaaaaaatcgttcaggccaataagctactccagaaccaggagccagtgaatgataagcgcgaacgcaaattgaaatttaaggatcagctagtcgatttggaggtgcctcccctggaagataccacaaccttcaagaactatttcgaaaacgaaagaaacatgttcggcaaattatctcagctctgtatttcaaacgattttggccaggaagacgtgttgctgagcctcactaacggctcgtgtgaagaaaataaggacagaacaatcttagttgaaagagatggaaagttcgaattgctgaacctgcaggatatcgcgtcgcagggtttcctgccacctatcaataacgcgaatagtaccgagaacgatccgcagcagctgttgccaagaagttcaaattctagcgtttcaggaaccaagaaagaggattccacggccaagatccatgccgtaacgcatagtagtactggagagcctctggcttacatagcacaaccacccctgaacagaaaaacttgcccatccagcgccgtgaacagcgatagaagcaaaggcaacggcaagagcaaccatcgaactcagtcagctcacatttcccctgtcactagtacatattgtttgtcccctcggcagaaggagctgcaaaagcaactggaagagaagcgtgagaagctcaaacgagaggaagaacggagaaaaatcgaagaggagaaagaaaaaaaacgcgaaaatgatattgtcttcaaagcctggttgcagaagaagagagagcaagtcctggagatgcgtcggatccagagagcaaaagagatcgaggatatgaattctcgacaggaaaacagagaccctcagcaggccttcaggctgtggctgaagaagaagcacgaagaacaaatgaaggaaagacagaccgaggaactgcgtaaacaggaggagtgtctgttctttctaaaagggactgaaggtagagaacgcgcctttaaacagtggcttagacggaagcggatggaaaaaatggctgagcaacaggcagtgcgagaaaggacccggcagttacggctggaggccaaacggtctaaacagctccagcatcatctgtacatgagcgaagcaaaaccattccgctttaccgaccactacaactag

SEQ ID NO: 27211 - DNA, 1071 bp, Artificial Sequence
  Description of Artificial Sequence: Synthetic coding sequence
atgaatgaaaataaggataccgatagtaaaaaaagcgaggagtacgaggatgacttcgagaaggatttggagtggctgatcaacgagaatgagaaatccgacgccagcattattgagatggcttgcgagaaggaggagaacatcaatcaagacctgaaagagaatgagacggtgatggaacacactaaaaggcactctgatcctgataagtccctgcaggacgaagtcagtcctcggcgcaatgacattatatctgtgcctggcatacagccactcgaccctatctcagattccgactccgagaacagcttccaggagagtaagcttgaatcccagaaggatctagaggaggaagaggacgaggaggtgagacgctatattatggaaaagatcgtgcaggctaacaaacttctgcagaatcaggagcccgttaacgacaagcgtgagagaaaactgaaattcaaggaccagctggtcgaccttgaagtgccaccgctggaggacaccacaacattcaaaaattattttgagaatgagcggaatatgtttggaaagctatcgcagctgtgcattagtaacgatttcggccaggaagatgttctgctgtccctaacaaacgggtcttgtgaggagaacaaagatcgaacgatcctcgtcgagagagatggtaagtttgaactgttgaatctacaggacattgctagtcagggattcctgcctcccataaacaatgccaacagcacggagaacgatcctcagcaactgctgcctagatccagcaattcttcagtgtctggcaccaagaaggaggattctaccgccaagatccacgccgtcacccatagctccacaggtgagcccctcgcttacattgcacagcctcctctgaacagaaaaacatgcccgtcttcggcggtgaattccgatcggtctaagggcaatggcaaatctaaccaccgcacccagagcgcccacattagccctgtcacctctacatactgtctctcacccagacaaaaggaactgcagaaacagctggaggagaaaagggagaaactaaagcgcgagtag

SEQ ID NO: 27212 - DNA, 1527 bp, Artificial Sequence
  Description of Artificial Sequence: Synthetic coding sequence
atgaacgagaataaagacactgattctaaaaagtcagaagaatacgaagacgattttgagaaggaccttgagtggctgattaacgaaaatgaaaaatcagacgccagcatcatcgagatggcctgtgagaaggaagagaacatcaaccaggacttaaaagagaatgaaaccgtcatggagcacacaaagcggcattctgacccagataagtcactgcaggatgaagtgtccccccgaaggaacgatatcatttccgttcccggaatccagccgctggatcccattagcgactccgattctgaaaacagctttcaagagtccaagttggaaagtcaaaaagatttggaagaggaggaagacgaggaggtccgacgttacatcatggagaagattgttcaggccaataagctcctgcagaaccaggaaccagtcaacgacaaaagagagcgcaaattaaaatttaaggaccaactcgtggatctggaggtgcctccgctcgaagatactactacgtttaagaattattttgagaatgaacgcaatatgtttggtaagctgagccagctgtgcatctcgaacgactttggccaggaggacgtgttactgtccctgaccaatgggtcctgtgaggagaataaagatcgcacaatcttggtggaaagggacggtaagtttgagctccttaatctgcaggatatcgccagccagggtttcctgcccccaatcaataatgcaaactccacggagaatgacccacagcaattgttaccgaggtcaagcaacagttcagtgagcggcaccaaaaaagaagactcaacagctaaaatacacgctgtgactcacagcagcacaggcgagcccctcgcatacatcgcacagccacctctcaacaggaaaacctgtccgagttccgccgtgaattccgacaggagcaagggtaatggaaagtctaaccatagaacacagagcgcacatatctcacccgtgaccagtacctactgcctgtcgcctcggcagaaagagttgcagaaacagttggaggaaaaaagggagaagttaaaacgggaagaagagaggagaaaaatcgaggaagagaaagagaagaaaagagaaaacgatatcgtattcaaggcctggctgcagaagaaacgcgagcaggttttagagatgagacggattcagcgagccaaggaaattgaggacatgaattccagggaaaacagagaccctcagcaggcgttcagactctggctgaagaaaaaacatgaagaacagatgaaagagcgtcaaaccgaagagttgcgaaagcaagaggaatgcctgtttttcctgaaggggacagagggaagggaacgagccttcaagcaatggctccggaggaagcgtatggagaaaatggcagaacaacaggccgtgagagagcgaacaagacagctgagactggaggccaagaggagcaagcagttacaacatcacctgtatatgtcagaggccaaaccatttcggttcactgatcactataattag

SEQ ID NO: 27213 - DNA, 429 bp, Artificial Sequence
  Description of Artificial Sequence: Synthetic coding sequence
atgacagtgggcgcgaggttacgctccaaggccgaatctagtcttctgcgccgcggaccaagaggacgtggcaggacagagggagacgaagaagctgctgctattctggagcacttggaatatgccgacgaggccgaagccgcggcagagtcaggtaccagcgcggcggatgaacgcggaccaggaacaagaggcgcccgaagagttcatttcgcgctcctgcctgagagatatgagccactggaagaacctgccccttccgagcagccaagaaagaggtacagaaggaagcttaagaagtacggtaagaatgttgggaaggtgattattaagggatgcaggtacgttgtgatcgggctgcagggctttgcggcagcctatagcgcaccttttgccgtcgcgactagcgtggtgtcctttgtcagatag

SEQ ID NO: 27214 - DNA, 333 bp, Artificial Sequence
  Description of Artificial Sequence: Synthetic coding sequence
atggaatggggaccggggagcgactggagtagaggggaggccgcgggcgtcgatcggggtaaggctggcttaggcttaggaggccggcctccaccacagcccccgcgtgaggagcgggcacagcaactgcttgacgccgtggagcagagacagcgccagttactggatacaatcgcggcctgtgaggagatgctgaggcagctgggccggcgccgacctgaacccgcaggcgggggaaatgtatcagccaaaccaggggctcccccgcagccagcagtcagtgcccgaggagggttcccaaaggatgcaggggatggcgccgccgaaccttag

SEQ ID NO: 27215 - DNA, 144 bp, Artificial Sequence
  Description of Artificial Sequence: Synthetic coding sequence
atgctgaggcaattgggacgccggcgccctgagccagcgggtggaggaaacgtttcagctaagccgggcgcacctccacagcccgctgtatccgcgcgtgggggtttccctaaggacgccggtgatggcgctgctgagccttag

SEQ ID NO: 27216 - DNA, 480 bp, Artificial Sequence
  Description of Artificial Sequence: Synthetic coding sequence
atgggaccaggacttcgtcttgttactggagtccgaggcgggccctctgggcgggaggagggagcctggccaagagcctctgccggcccagatcgattgtctctcgccctgagcagagccggccgtctacccgcctggaccgccgggagaaggggatggggcagcgctggcggacatcctcacagccggcctgggagatctgccccttccagctgctggacaaggtggagttcagggtccggctcatcctggaccccatcccagcctgctagacggtgctacggttcatgggccgccggggccaggagcaggctcgtagccgggacgtctcaacccaacttggagagaccacctagccggctgtcccctccagaggcggcttttcagcggatgctggctatggaactgcggtccccggaccatccaagagccgaatatcccgattttagcccaagtcctggaccagtcgccggcctctag

SEQ ID NO: 27217 - DNA, 144 bp, Artificial Sequence
  Description of Artificial Sequence: Synthetic coding sequence
atgctgaggcaactcggaaggagacgccctgaaccagctggagggggaaatgtcagcgcgaagcctggcgcccctccccaaccagcggtgtccgccagaggcgggtttccgaaagacgccggagacggcgctgccgaaccgtag

SEQ ID NO: 27218 - DNA, 483 bp, Artificial Sequence
  Description of Artificial Sequence: Synthetic coding sequence
atgggcaagatagccctgcaactcaaggcgacccttgaaaacatcactaacctccgccctgtgggagaggactttagatggtacttgaaaatgaagtgcggtaattgcggtgaaatctccgacaaatggcagtacatccgacttatggattccgtggccttgaaaggagggcgtgggtctgcttctatggtccagaagtgcaagctatgcgcgagggaaaactcaatcgagatactcagctcaactattaagccctataacgccgaagacaacgaaaactttaaaacgattgtcgagttcgagtgccggggactcgagccagttgattttcagccacaagcaggattcgccgctgaaggggtggagagcggcactgccttttcagacatcaacctccaggagaaggactggactgattatgacgaaaaagcgcaggaatctgttggcatctacgaggtaacccatcagttcgtgaaatgctag

SEQ ID NO: 27219 - DNA, 414 bp, Artificial Sequence
  Description of Artificial Sequence: Synthetic coding sequence
atggggaagattgcgcttcagctgaaggctacccttgaaaatatcacaaacctcaggccagtcggcgaggactttcgttggtatctgaaggattcagtggccctcaaaggcggaaggggatccgccagcatggtgcagaagtgcaaactgtgtgccagggaaaactccatcgagatcttgtcttcaactatcaaaccttacaatgcggaggataacgagaattttaagacaatcgtcgaattcgaatgtagaggattggaaccagtggactttcagccactagggcttctcttgaaggtttggagtcaaggtcagccttctgtgactctcatctgccggagaaggacaggcctcacaatgatgaaacgaccaaggtctctgtgggagagcatgaggtcgccgaccagtctctag

SEQ ID NO: 27220 - DNA, 624 bp, Artificial Sequence
  Description of Artificial Sequence: Synthetic coding sequence
atggatgatgacttaatgctcgcactccggttgcaggaggagtggaatctgcaggaggctgagcgcgatcacgcccaagaaagcctgtctctcgtcgatgctagctgggaactggtggacccaactccagacttacaggcacttttcgtgcagtttaatgatcagttcttttggggtcaactcgaagcagtggaagtgaagtggagcgtcagaatgaccctgtgtgcaggcatttgttcatatgagggtaagggagggatgtgttccattcgtctctcggaacccctgctgaaactgagaccacggaaggacctggtcgaggtataccacacttttcacgatgaggtggacgaatatcggcggcattggtggcgttgcaacgggccatgtcagcaccggcccccatactacgggtacgtaaagcgggccactaatcgcgagcccagtgcccacgactattggtgggccgaacaccagaaaacctgtggaggcacatatatcaagatcaaggaacccgagaactactccaaaaagggcaaaggaaaagctaagctgggcaaagaaccggttctcgccgccgagaacaagggaactttcgtgtatatcctgctgatctttatgtag

SEQ ID NO: 27221 - DNA, 1470 bp, Artificial Sequence
  Description of Artificial Sequence: Synthetic coding sequence
atggacgacgatctcatgctggccttgcgtttacaggaggagtggaatctccaggaagctgaacgagaccatgcccaggagtcactatctctggtagacgcgagctgggaactggtcgaccccacccctgacctgcaggcgctgttcgtacagttcaacgaccagtttttttggggccaactagaagccgtagaagtgaagtggtcagtcaggatgacactgtgtgctggcatttgttcttacgaaggtaaggggggcatgtgctccatccgtctcagtgagccgttactcaagctccgtcccaggaaggaccttgtggaaaccctgctacacgagatgatccatgcctacctgtttgtaaccaacaatgataaagatagagaaggccatggccctgaattctgtaaacatatgcaccgcatcaacagtctgacaggggcgaatattaccgtgtaccatacatttcacgatgaagtggacgaataccgcagacattggtggcgatgtaacggcccctgccagcaccgcccaccgtattatggctacgtgaagcgtgctactaatcgggaaccctccgcgcacgattactggtgggcggaacatcaaaagacctgtggggggacctacattaaaataaaggaacctgagaattactctaaaaaaggaaaagggaaggccaaactcggcaaggaacctgttctggccgctgagaacaaggataagcctaatcgaggcgaagcacagctagtgattcctttttctgggaagggatacgtgctgggcgaaacatctaacttaccaagtcccgggaagctgatcacttctcacgcaatcaacaagacgcaggatcttctgaaccagaaccactccgccaacgctgtcaggccgaatagcaagatcaaggtgaaattcgaacaaaatggttcttcgaagaacagccatctagtgtccccagccgtgtccaactcacaccagaatgtattgagcaactatttccctcgtgtgagtttcgctaaccagaaagcttttcgcggcgtcaatggaagtcctcggatctctgtgacagtgggaaacatacccaaaaatagcgtcagcagctcgtcccagcgacgcgtgtccagttctaagatttcattgcgaaacagtagcaaagtaacggaatccgcaagtgtcatgccttcacaagacgtaagtgggtccgaggatacctttccaaataagaggccgagactcgaggacaagacggtgtttgacaactttttcattaagaaggaacagatcaagagctccgggaatgaccccaaatacagtactacaaccgcccagaatagctctagctccagttcccagagcaagatggtgaactgtcctgtctgtcaaaacgaggtgctggagtcccagatcaatgagcacttagactggtgcctcgaaggcgattccatcaaagtgaagagcgaagagtcattatag

SEQ ID NO: 27222 - DNA, 564 bp, Artificial Sequence
  Description of Artificial Sequence: Synthetic coding sequence
atgaaaaagaccctactgcacgaaatgattcacgcatacctttttgtgactaacaatgataaagacagggaggggcacggaccagagttttgtaaacatatgcataggatcaactcactaacaggagcgaatattactgtgtaccacactttccacgatgaggtcgatgagtatcgtcggcactggtggagatgcaacggtccttgtcagcataggccaccctactacggatatgttaagagggcaacaaatagagaaccatccgcccacgactactggtgggccgaacatcagaaaacttgtggtggtacctacattaaaataaaagaacccgagaattattccaagaaaggaaaggggaaagccaagcttggaaaggagcctgtgcttgctgctgagaataaagataagccaaatcgaggagaagcacagctggtgattcctttcagcggcaaagggtacgtcctcggcgagacttccaatctacctagtccaggcaaactcatcacaagccatgccattaataagactcaggacctcctgaatcagaatcacagcgcttag

SEQ ID NO: 27223 - DNA, 753 bp, Artificial Sequence
  Description of Artificial Sequence: Synthetic coding sequence
atggatgacgacctgatgttagcactgaggctgcaggaagagtggaatctgcaggaagcagagcgagaccatgctcaggaatcactgagcctcgtggacgccagctgggagctagtggaccccacacccgacctgcaggctttgttcgtgcagtttaatgatcaattcttttggggacagttagaggccgtggaggtcaagtggagtgtccgtatgaccttgtgtgccggtatctgctcctacgaagggaaggggggtatgtgtagcattcggcttagcgagcctctcctcaagttacgtcctcgaaaggaccttgttgagacattgctgcatgagatgatccatgcttatctgtttgtgaccaataacgataaggacagagagggtcacggacctgaattctgtaaacacatgcaccgaattaattccctcacgggagcaaacatcacagtctaccatacatttcatgacgaggtagacgagtaccgtaggcactggtggagatgcaacggaccatgtcagcataggccgccttactacggttatgtcaaacgggctacgaaccgggagccctctgctcacgactactggtgggccgagcaccagaagacttgtggaggcacctacattaagattaaagaaccagagaactattcaaagaaaggcaaggggaaagccaagctgggcaaagagcctgtcctggccgccgagaataagggcacgtttgtgtacatcctactgattttcatgtag

SEQ ID NO: 27224 - DNA, 585 bp, Artificial Sequence
  Description of Artificial Sequence: Synthetic coding sequence
atggacgacgaccttatgctggctcttagactgcaggaagagtggaacctgcaagaggctgagcgggatcatgcacaggagtccctgtctctggtagacgctagctgggagctggtggaccctaccccagatctgcaagccctgttcgtgcagtttaacgatcagttcttctggggtcagcttgaagcagtggaagtgaagtggtcagttcgtatgaccctctgcgccggaatctgttcttacgaaggaaaggggggtatgtgttctatccggctgtccgagcccctactgaaactgaggccccgcaaggacttggtggaagtctatcacaccttccatgacgaagtggatgaatacaggagacattggtggcggtgcaatgggccttgtcagcaccgccccccctactatgggtatgtgaagagggcaacaaatcgtgagccaagtgcacatgattactggtgggctgagcatcaaaagacctgcgggggcacatacatcaaaataaaagaacccgagaattacaaaaaacggcagagaaaaggcaagacccggaagggaacctcaataggaaggcgagaatag

SEQ ID NO: 27225 - DNA, 2472 bp, Artificial Sequence
  Description of Artificial Sequence: Synthetic coding sequence
atgtggggcagccccgcgctggcttgggccgtatggttggcttgtgtgcagcctaccgtgtttccctggtctttgtcctttagatccgatactgacaagcctagttcagccgccgaagtgctgaccgaggcttcaagctgctggacagacacggtggagtgtttttctgattacatgacgctttggatcccgaggtcccacgtggaaggtttgcgacgatggcttgctcgaactttgcatctgcctggtacatggcggtcccccgaccatcttgactccagcctggccaagtgcgggtatttcctccaccttgctagtgacggagactttctgttcagggtacagtattccgcgtgctttgtccagaaagagaaagccaattacaggctggaaattcgcatctttcagaaaggagtgatgggcctcgaaagaagtgatcgatatatcatgaagtgccctatgctaaggagccggctaggccaggagagcgtgcactgcggaccgatgtttatccaagttagcaggccgctgcccctatggagagataatcgccaaaccccctggctgctgagtttgagaggagagctagtagcttcactggaggacgctagtctcatgggcctctacgtcgacatgaacgccacgaccgtcactgttcaatcaccgcgccagggcttactgcagaggtgggaagtcctcaacacatccgcagagctgctgcccctgtggctagtctctggtcaccacgcatatagcctggaggcagcatgtcctccggtgtcattccagccagagagcgaagtcctagtgcacatcccaaagcagcggctcggattagtaaaacgcgggagttacatcgaggaaacccttagccttaggttccttcgggttcaccagtccaacattttcatggtgactgaaaacaaagactttgtagttgtttctattcctgccgccggcgtgctgcaagtccagagatgtcaggaagtagggggaacgcccgggacccaggctttctatcgagtggatttaagtttggagttcgctgaaatggccgctccggtgctctggaccgttgagtcgtttttccagtgcgttgggtccggcacagagtcaccagccagtaccgcggcgctgcgcaccacaccatctcctcccagcccgggccccgagactccgccggcaggtgtacccccagccgcaagtagtcaggtttgggcagctggtcccgctgctcaggaatggttgtccagggacttactccaccgacctagcgatgcgctcgccaagaaggggctcggccccttcttacagactgccaaacctgcccggcggggacagacctccgcgtcgatactaccacgcgtagtgcaggcccagcgcggacctcagccaccacctggggaggctggaatccccgggcacccaaccccccctgccacgcttccctcagagcctgttgagggtgtacaggcctccccatggaggccgaggccagtcctgcccacacatccagcactgactctgcccgtgtcctccgatgccagtagcccttctccgccagccccaagaccagaacggcccgagtcgcttctggtatccggtccatctgtgacgttgacagaagggctcggcacagtcagaccagaacaggaccctgcaaaatcccccgggagccccctgctgctgagaggtctgagttcaggagatgtcgccgctcctgagcccattatgggggagccaggccaggccagcgaggagttccagccactggctcgcccctggagggctacactggcagcggaagaactggtgtcacaccgatccccgggagagcctcaagagacgtgctctggtacagaggtggaacggcctcggcagacaggccccggcctgccccgcgagggtgcacgcgggcacatggatttgagctcaagtgagccttctcaggacatagaaggccccggactgagtattctccctgctagagatgctacgttctcaactccctccgtacggcaacctgatccgtcggcgtggttgtcttctggtccagagttaacgggaatgccccgagttcgcctggccgcgcccctagccgtcctacccatggaacctttacctcctgagcctgtccggcctgcggctctgctcacccctgaggcgtcatccgtagggggcccagatcaggctcgttacctggaatctgcccccgggtggccagtaggacaggaggaatggggagttgcacatacatcttcacccccgagcactcagaccctgagtctctgggcccccactggcgtgttgctcccctcattggtcgagctcgaatatccatttcaggctggccgaggcgcgtctttgcagcaggagctaaccgaacccacattggccctcagcgctgagtcccacaggcctcctgaactgcaggacagcgtcgagggcttgtctgagaggccctctaggtag

SEQ ID NO: 27226 - DNA, 1971 bp, Artificial Sequence
  Description of Artificial Sequence: Synthetic coding sequence
atgaagtgtccaatgttgaggtcacgccttggccaagagagcgtgcattgcgggccaatgtttatccaggtgtctaggcccctgcctttatggagagataatagacagacaccatggttactatctcttcggggagagcttgtggcatcactggaggatgcatccttgatggggctctacgtcgacatgaacgcgacaacggtcaccgttcagtccccccgtcagggcctcctgcaacgatgggaagtttctggcggacaacaggccctgcccggagtttccttccagcccgagtctgaggtactcgttcatatccctaaacagaggctaggactggttaaaagaggcagctacattgaggagactttgtcacttagattcttgcgggtccaccagagtaatatattcatggtaacagaaaacaaggactttgtggtggtgagtattcccgctgctggtgtccttcaggtgcagcgatgccaggaggttggcggaactccaggaacccaggccttctatagagtcgacctcagcctggagttcgcggagatggccgctccagtcttgtggactgtagagagctttttccagtgcgtaggctccggaacggaatcaccagctagtaccgccgcactgcggacgactccaagccccccttcacccggcccggaaacgcctccggccggagttcctccggcggcatcgtcccaggtttgggccgccggcccagcagcccaggagtggttatctcgggacctcttgcaccggccaagtgacgccctcgccaaaaaggggctgggtcctttcctgcagacagccaaacccgccaggcgcggtcagactagcgcatcaatactgccgcgtgtcgtccaggcccaacgcgggcctcaaccgcccccaggcgaagcagggatccctgggcatcccacaccccctgccaccttgccgagcgagcctgtggagggagtccaggcgtctccatggaggcccagaccagtgcttcccactcatccagccctgacgctgccagtgagctccgatgcctcttctccctcaccccccgcaccccgacccgagcggcccgagtcccttctggtctccggcccatcggtgacactaactgaggggctgggcaccgtgagaccagagcaggacccagcaaaatcgcccggctcaccgctactcctgcgtggcctctcgtcaggggacgttgccgcgcccgaacccattatgggggaacccggccaggcctccgaggagttccagccactggccagaccatggcgcgcaactctggctgcagaggaactagtctctcaccgatccccgggtgagcctcaagaaacatgcagcggcacagaggtggagagaccacgacagaccggtcccggtcttccccgcgaaggcgcgagagggcacatggaccttagttcatcagaaccaagtcaggacatagaaggcccaggtctgagtatcctgccagctcgcgacgctacgttctcaactccctcagtgcgacagcctgacccaagcgcatggctgtcttccggccctgagctgacgggaatgcctagagtacgcttggcggctcctttagcagttctccctatggaaccactgccgccagaaccagttcggcccgcggccttactgactcccgaagctagctccgtcggaggccccgaccaggcccgctatctggagagcgcacctggatggcccgttggtcaggaagagtggggcgttgcccacacctctagcccaccctcaacgcagaccttgtccttatgggcccccacaggtgtgctgcttccatcccttgtagagctcgagtatccctttcaggccggaaggggcgccagcctccagcaagaacttactgagcccacccttgccctgagcgctgagagtcatagacctcctgagctgcaggacagcgtggagggcctcagcgaacgcccgtccagatag

SEQ ID NO: 27227 - DNA, 1722 bp, Artificial Sequence
  Description of Artificial Sequence: Synthetic coding sequence
atgctcacccgcaaccctaaaaccaagtccagtttgcagatcctgcaggattcagtcaagtggcaccacatggctcataaggtgaatagtctcctggacgcatatagcggattgctttctaatgaatccatgatccttgccgtgaacagcagcttcgtggatcctctgctgcagttcgaaagtcagttaaaaattatcgaatcatcatttggcatgttagtagtaatgccctccctggataaggtgaaagagatgggcagttcctatgaatatatcgaagacatggaaaacctgtaccataacatcttaaacatctacgagaacatcctaacctccctggtcagcaaggatctctataagctgcagattctgaaggaaatgctggtatggatgtccaaagacagtagttacctccaggagaggatcatggtgattataaacaaagttttgcgcttcacagtaaccaaagtgcggaagtatatctcagtagacgcaccctgcctcgggcttctcgccgccgagttgtccctcctgtgttcccacgaggatccttcgattgtaaaacaggcctctctcgggatgtgccaccttctgtatattgcccgctgccagaacgatatcggcacaaataagccaactaatgggaaaagtcacagccttcagttcccaagcagcgacgttgagttcctgcctaaagagttccagcaggacgagtccaaaatcgcgcagcgtgttggacagaccctcctgcctcccctactcacagacttcgtgcagtcacttctgatgaagctgtccagcccagatgataagatcgcgagtgacgccgcctctatcctgatcttcactttggaatttcatgctgaaaaggtgactatggtcagtaaaatagtcgatgcgatctataggcaactttgcgataataattgtatgaaggacgtgatgttacaggtgattacactgcttacctgtactagccccaagaaggtgattttccaattgatggattaccctgtcccagctgacgataccctgattcagatgtggaaagccgcctgcagccaggcctctgttgctccccatgtcctcaagaccattctcctgatcctgaagggtaagcccggggagatggaggacactgtgacggagggcaagcgtttttcattggacatcaccaaccttatgcccctggctgcgtgtcaggccctctgcactttcctccctctcggatcatacagaaaggccgtggcgcagtattttccccagctcctgaccactcttatgttccaggttttctacaactccgagcttaagcctattctgaaggatcgggccttgtacgcgcaggacgccttacgcgtgctgctcaattgttctgggcttcagcaggtcgatatcaccttgatgaaggaaaatttctgggaccagctcagcgaagacctctgctactaccatggagtctgctttatcgccaaaaccctgagcgagtataattttccacaatttccagagacactgtcttacttgtacaagctgtcagtggaaggtccaagaaggtctgaggataccgttattgtcttaatttttctgacagaggtgtcctttgtcgactgcgaacagttgtgtagccatttcctgtttcttccgaaattcaaatcaaaatttcagtttctggtcagtctgcctttaaatgtcggatcctaccaggatctgcggtcctag

SEQ ID NO: 27228 - DNA, 2586 bp, Artificial Sequence
  Description of Artificial Sequence: Synthetic coding sequence
atgctgacgcggaacccaaaaaccaagagctctctacagatcctgcaggactccgtgaagtggcatcatatggcccacaaggtgaacagcctcttggacgcctatagtggcctcctgtccaacgaatctatgattttggccgtgaacagttctttcgttgaccccctgctacagttcgaaagccagttgaagatcattgagtcttccttcgggatgctggtggtgatgcccagcctcgacaaggtcaaagagatggggagcagttacgagtatatcgaggatatggagaacctctaccataatatcctgaatatatacgagaacattctgaccagtttggtcagtaaagatttgtacaaacttcaaatactcaaggagatgctggtgtggatgtctaaggactcttcctacttgcaggagaggattatggtgatcattaacaaagtgttaaggttcacggtgacaaaagtcagaaagtacataagtgtcgatgccccttgccttgggttgctagccgctgaactgagcctgctgtgcagccatgaagaccccagcattgtgaaacaggcctcattgggtatgtgccatcttctttacattgctaggtgtcagaatgatataggcaccaacaaacccacaaatggaaagtctcactctctccagtttccatcaagcgatgtggaattcctgcccaaggaattccagcaggacgagtctaaaatagcccagagagttgggcagaccctcttaccccctctcctcaccgacttcgtgcagagcctgctgatgaagctaagctctcctgatgataagattgcctcagatgcagccagcatcctgattttcaccctggaattccatgcagagaaagtgactatggtcagcaaaatcgtggacgccatttatagacagctttgcgataataactgtatgaaagacgtcatgctgcaggtgattactctcttgacctgtacatcgccaaagaaggttattttccagctcatggactatcccgtccctgccgacgacaccctaatccagatgtggaaggccgcctgttcacaggcgagtgtcgcccctcatgtccttaagactatcttactgatccttaagggaaagcccggggagatggaagatactgtgaccgaaggaaaaaggttcagtctggatataacaaaccttatgcccctggctgcgtgtcaggccttgtgcacatttcttccgttgggcagttacagaaaagcggtggcccagtactttccccagctgctgactacgctgatgttccaggtgttttacaactcagagcttaagccaattctgaaggatcgagctctttacgcccaagacgcgctccgggtgctgttaaattgttctggacttcagcaggtggacattactcttatgaaggaaaacttctgggatcagctttcagaggacctctgttactatcacggcgtgtgtttcatagccaagaccctctccgagtacaattttccgcagttcccagaaacccttagttacctttataaactgtccgtcgaagggcctcggcggtctgaggatacagtgatagtgctgatttttctgaccgaactactaaacaacttttttaaggaccctctgcctgaggagtttctggtcctttttattaactggatcaacgattccaatccggtcgtttccaggctcatcttgcacaggatcgtgcatatgagtcccattataaataagactgaaaacgtaagctctatcctcatagccatactcgatgccttcttgtccaaagatgacaacgttgtcttacaggccctgttgacgctcaggcgacttttgaacgaactcgataaggtaacttatagcctcggcaccagaattggctcctcctattgcaccctcatggatcacattaacggtggtattcgctctatggctatcaggcatttcggccagctggtgcgggatatgcgacaatacacgtggatggtgaacgacgtggttttagaggggctcgtgcctctgatactgtttcttgaagacgacgataagcgagttgcggaggcttgcaaatataccctgaagatttgcacatcccagctgaagtggtccacaagccgtcttctgaaggatgagaattattccttcgagatggtcgttctgaacatctgtaataacctcattatttcacataggaattatatcacagaccttaccagcgataccttgcgctttctctggtctcctcggacataccttaaaagggcctccgttatcctgattggatatctggcaaaatccggaggccatctcctcctgcgggacgagatcgaggtcatgctggatgtaatcgagcgcctactccgcgacgaagatcctatgatcaagcagctggccgagatcacatacgatatctttaagaaaaaagctcacaagctgaccagtgctccactcaagcagaactttcagaagcttctgaagctgttctatatcaaaaagttgaagcctctgtataactacaactcccccaatgggcagatcgactcccctactgactccaaggatgtgaaaaacgacaaagctctttag

SEQ ID NO: 27229 - DNA, 564 bp, Artificial Sequence
  Description of Artificial Sequence: Synthetic coding sequence
tgaatgccactggcagcttgtcaagccctctgtactttcctgcctctgggaagctaccgaaaggcggttgcccagtattttccacagcttttaaccactctaatgtttcaagtgttctacaactctgaactgaaacctatacttaaagaccgcgctctctatgcccaggatgcgttgcgcgtgctgctcaattgctcagggctccagcaggtggatatcactcttatgaaagagaatttctgggaccagctgtccgaggacctctgctactaccatggtgtgtgcttcatcgccaagacactgagtgaatacaattttcctcagtttccagagaccctgagctacctttataaactttccgtagagggtccccggcgatcagaggacactgtaattgtgctgatctttctgacagagctgctcaataacttcttcaaggatccattgccggaggagttccttgtcctcttcattaattggatcaatgatagcaaccccgtcgtctctaggctcatcctgcatagaattgtccatatgtctccgattattaataaggtcgattag

SEQ ID NO: 27230 - DNA, 750 bp, Artificial Sequence
  Description of Artificial Sequence: Synthetic coding sequence
atgcgggtggattccagcgccgatcctacgatgagtcaggagcagggtccaggttctagcacccccccctctagcccaaccctgttggatgcactgctgcagaacttatacgacttcgggggcacagaaggggagaccgagcagaaaaaaataatcaaaaaacgggagaataaaaagcgcgatgtgatggcctctgccgccttggccgccgaaccttccccactccctggtagcctgatccgggggcaacgaaaatctgccagcagtttctttaaggaacttcgggaggaacgacactgtgcgccgtcagggacccctaccgggcctgagatcctggccgccgccgtccccccgtctagcctgaagaacaaccgggaacaagtggaagttgttgaattccacagcaacaaaaagaggaaactgaccccagaccacaataaaaacactaagcaggccaacccatccgtgctcgagagagatgtggacacacaggaatttaacctcgagaaggctagactggaggtgcaccggtttggcatcaccggctacggaaaaggaaaggaaagaattttagaacaggaacgggcaataatgcttggagccaaaccaccaaaaaaaagctatgtcaattacaaggtcctccaggaacagattaaggagaagaaagccgccaaagaggaggagaagcgcctcgcccaggagacggacatctttaaaaagaagaagcggaaggggcaggaggatcggtag

SEQ ID NO: 27231 - DNA, 792 bp, Artificial Sequence
  Description of Artificial Sequence: Synthetic coding sequence
atgagccaggaacagggccctggcagcagtacccccccctcatctccaacgctcctggatgcactcttacagaatctctatgactttggtggtacagaaggggagaccgaacaaaaaaaaatcatcaaaaagcgggagaacaagaaacgtgacgtgatggcgtccgctgcccttgctgccgagcctagtccactgcctggctctcttataagggggcagcggaaatcagccagtagcttctttaaagagctgcgggaagagaggcattgcgctccatcaggcacgcctactggcccggaaatcttagccgctgccgttcccccaagcagcctaaagaacaatagagagcaggtagaagtcgttgaatttcactctaacaaaaagagaaaattgacccctgatcacaataaaaacacaaaggcacggctagaagtgcatcgattcggcattactgggtacggtaagggtaaagagaggattcttgaacaagagcgcgctatcatgctgggagccaaaccaccgaaaaagtcttatgtgaattataaggtattacaggaacagataaaggaaaagaaggccgccaaggaagaagagaaacggctagctcaggagaccgacattttcaagaagaaaaaacggaagggtcaagaagacaggaaatcgaaaaagaagtctgcccccagtatactgtccaatggacggattggccaggtcggaaaattcaagaacgggacattgatcctgagccccgtggacattaagaaaattaattcctctcgggtggcgaagtag

SEQ ID NO: 27232 - DNA, 882 bp, Artificial Sequence
  Description of Artificial Sequence: Synthetic coding sequence
atgcgcgtagactcctccgccgacccaaccatgtctcaagagcaggggccaggttcttctacgcctccctcatcccccaccttgctcgacgccttactccaaaatctttacgactttggaggtaccgaaggtgaaacggagcaaaaaaagattatcaaaaagagggaaaataaaaagcgcgatgtcatggcgtccgccgcactggccgccgagcctagtcctctccccggctcgcttatccggggacagcggaaatcagccagctcattctttaaagaattacgcgaagagcgacactgtgcaccctcgggaacacctaccggcccagaaatcctagccgccgctgtacctccttcatccttgaaaaacaatcgagagcaggttgaggtcgtcgaatttcatagcaacaaaaaacgcaagctcacccccgatcacaataaaaataccaagcaggccaatccgtccgtgcttgagcgagacgttgatactcaggagttcaatcttgagaaggcgaggctggaggtacatcgctttgggatcacagggtatggtaagggcaaggaacgtatcttagagcaggagcgggctatcatgttgggcgccaagccccccaaaaagtcttatgtgaactataaagtgctccaggaacaaatcaaagaaaagaaagctgccaaggaagaagagaaacggctggcccaggaaacagatattttcaagaaaaagaaacgtaaaggccaggaggaccgtaagtcaaagaagaaatctgccccaagcattttgtccaacggaagaattgggcaggtaggcaagttcaaaaacgggactctcattctgagccctgtggatatcaaaaagatcaactcatcacgcgtggccaagtag

SEQ ID NO: 27233 - DNA, 879 bp, Artificial Sequence
  Description of Artificial Sequence: Synthetic coding sequence
atgcgcgtagactcctcggctgaccccaccatgagtcaggaacagggacccggttcctccacaccaccatctagccccacactattggatgcattactccagaatctgtatgatttcggaggaactgaaggtgagaccgagcagaagaagatcataaagaagagagagaacaagaagagggatgtcatggcatcggccgccttagctgctgagccctccccgctaccaggatctttaatccgaggccagcgcaagagcgcttcgagcttttttaaggagctgagagaggaaagacactgcgcaccaagcggcacacccacaggcccagaaatcttggcagcggccgtgccgcccagctcccttaagaataaccgggagcaggtggaggtagtcgaattccatagtaataaaaagcgcaaactcactccagatcataacaagaataccaaagcaaatccttccgttcttgaacgagacgtagatacacaggaatttaacctggaaaaggcccggctcgaagtgcaccgctttgggatcacaggatatggcaagggaaaggagcgtatcttagaacaggaacgggctataatgctaggggccaagccccctaaaaagtcatacgtgaactacaaagtgctgcaggaacaaataaaggagaagaaggccgcgaaggaggaggaaaaaaggttggcccaggaaacagacatttttaagaaaaagaagcggaagggccaggaggacaggaaatcaaagaaaaagtccgctccatctatattatcaaatggacgcatcggccaggtcggcaagtttaagaacggcacactcatcctgagcccagtcgatatcaaaaaaatcaactcctctcgggtggccaagtag

SEQ ID NO: 27234 - DNA, 771 bp, Artificial Sequence
  Description of Artificial Sequence: Synthetic coding sequence
ggatccagtacccccccatcaagccctaccctgctggatgccctactgcagaatttgtatgattttggcgggactgagggggaaacggagcaaaagaaaatcattaagaaaagggagaacaaaaagcgcgatgtgatggccagtgccgcactggctgcggaaccaagtccacttcccggctccctcatccggggtcagcggaagagtgcttcttcgtttttcaaggaactccgcgaggaaagacactgcgccccttcaggcactcccaccgggcccgaaatcctcgccgctgcggtgcccccctcatcgctaaaaaataacagagaacaggtcgaagtggtggagtttcactccaataaaaagaggaagctcacccctgaccacaacaagaacactaaagctcgccttgaggtccacagatttggcataactggctatgggaaaggcaaagagaggatactggaacaggagagagccattatgctcggagcaaaaccacccaagaaaagctatgttaattacaaggtgctgcaggaacagataaaagagaaaaaagcagcaaaagaagaggagaaacgtctggcacaggaaaccgacattttcaagaagaagaagaggaaggggcaggaggacaggaagtctaagaagaagtcagccccttccatattatctaacgggcgcattggccaggtcggaaagtttaagaatggcactttgattctcagccccgtcgatatcaagaaaatcaacagtagtcgcgtggccaaatag

SEQ ID NO: 27235 - DNA, 438 bp, Artificial Sequence
  Description of Artificial Sequence: Synthetic coding sequence
taacgaaggggcgccggcgttcgcagcgggtgtgcgtctagggcctgcagtggcgccttggggggacgtgggccaggggaaagtctctttgcacagtatccccgccgggccgagggcaggagagaaaagcaacaagtcactgagcagaggaatggctggccttcccaaagctggtcctgctgctgttcaacttgtagccccaacaaatgtagctatattttaatgacccagtgcattggaagtcgcgagatggagctcagcgctgaatggccgggatgcagcgttaatatgaaggcaacaaaaactgcaagaggctcagagctcatactttccctcggaagctttagtgggcgggccggccagcggcggcgtccaccccccggacaccaagacggcagtgatacccggggcctccgccgcgttcagctggccctgtag

SEQ ID NO: 27236 - DNA, 303 bp, Artificial Sequence
  Description of Artificial Sequence: Synthetic coding sequence
atgactcactccggctggcagggaagcggaggagccggacccggccctcgtgccccagccagatcacgctgccggccaggcctgccttcgctaccctgccgccctaatcccttggaagctagaggatgtggaagtgctctgcgtccttgggatctcgccgccaggacgccaatcccttgcttttgtgatcattcatgggctcttggcaagttactgggtccaaagcggcgtgagggacgcaaagggtccgaacgaagacgacggggacccggaggccagcagccgcagcccgcggaagagtag

SEQ ID NO: 27237 - DNA, 1074 bp, Artificial Sequence
  Description of Artificial Sequence: Synthetic coding sequence
atgcggcgcactggcccagaggaggaggcttgcggagtgtggctggacgcagccgcccttaaaagacggaaggtccagactcacctcatcaaacctggaactaaaatgttaacgctgctcccaggagagaggaaagcaaatatatatttcacccagcggagggctcctagtactgggatccaccaaaggagtatcgccagcttcttcaccctgcaacctggaaagacaaatggatcagatcaaaaatccgtttcgagtcacactgagtcccaaatcaacaaagagtctaagaaaaatgccacccagctggaccatctcataccgggactggcgcatgactgcatggcatctcccctggctacaagcactacagccgatatacaggaggccggcctctcccctcagtcattgcagacaagtggccatcatcgaatgaagacccccttttccaccgaactgagtttgctgcaaccagatacacctgactgcgcaggggatagtcatacccccctcgccttctctttcactgaggacctagagagcagttgtttattagatagaaaggaagagaagggagacagtgcaagaaaatgggagtggctgcatgaatccaagaagaactatcagtcgatggaaaaacataccaagctgccaggggataaatgttgtcaaccattaggaaagactaagctcgagcgcaaggtgtccgctaaggagaatcggcaggccccagtgctgttacagacttacagagagtcctggaacggtgaaaacatcgaatccgttaagcagtcccgtagtccagtatcagtgttttcttgggacaatgagaaaaacgataaggatagctggagccaactgttcacagaagacagccaggggcagcgcgtcattgcgcacaatacgcgcgctcccttccaagacgtcactaataattggaattgggatctgggacctttccctaactctccctgggcacaatgccaggaggacgggccaactcagaacctcaaacctgacctcctctttacgcaagacagcgaaggcaaccaagttatccgtcatcagttctag

SEQ ID NO: 27238 - DNA, 1116 bp, Artificial Sequence
  Description of Artificial Sequence: Synthetic coding sequence
atgcggagaaccggcccggaggaagaagcctgcggcgtgtggctggacgctgccgccttgaagaggcggaaagtccaaacgcacctgatcaaaccaggcacgaagatgctgactctccttcccggtgagcggaaagccaacatctactttactcagcgtagagcacctagcaccggtattcaccagcgatccattgcaagcttctttacacttcaacctggtaagaccaacggcagcgaccagaagtctgtttccagtcataccgaatctcagatcaacaaagagtctaaaaagaacgctacccagctggaccacctgatcccagggcttgctcatgactgcatggccagcccgctagcgaccagcaccactgcggacatccaggaggctggcctcagtccccagagtctccagaccagcggccatcacaggatgaagacccccttttctactgaactttctttactacagcctgatacccccgactgtgccggcgacagtcacactcccttggcattctcttttactgaggaccttgagtcaagttgtctgttggatcggaaagaggagaaaggcgatagtgctcgtaagtgggaatggctccatgagagcaaaaaaaactatcagtcaatggaaaaacatactaagctacccggcgacaagtgctgtcagccactggggaaaaccaagctggagcggaaggtttccgcaaaggagaataggcaggcccctgtgcttctgcaaacttatcgagagagttggaacggggagaatattgaatcagtaaagcaaagtcggtcccctgtgtctgtgttctcctgggacaatgagaagaatgacaaggattcctggtcacagctcttcactgaggattctcagggccagagagtcatcgcccacaacacccgtgccccctttcaggatgtaaccaataactggaactgggatctcggaccctttcctaacagcccctgggcccagtgccaagaggacgggccaacccagaatctaaaaccggacttgctgttcacccaggatagcgaggtgcaagcccttgcctgccaacaagattgttgcaggcgcagcatcttgaagcgacagaaacatctcagatag

SEQ ID NO: 27239 - DNA, 297 bp, Artificial Sequence
  Description of Artificial Sequence: Synthetic coding sequence
atggcactgaagacttctcttggcagcgtgcagtttatggaacagttttgttggccccatctgcgttcgttctgtgaaacatgtgtgggctcgtggtctattcagatgcgccagcaccatcatcagtcgagctttccgggctccttacctcaggagaccaacctcaccctgaaggtctgcaaacctcaagccccacagaagcttgatccaaccctttcctcttgcttttttatcgaatcatgtggggcacaagtgccagtcgagggaagtcggagagagacctctataacggtgtag

SEQ ID NO: 27240 - DNA, 390 bp, Artificial Sequence
  Description of Artificial Sequence: Synthetic coding sequence
atgtggctgtggcaggacattcagtgctgccctgcacctccttcagctccacctagggctctggaacctggaagagctccaccccccccaggtgaagggctgggtgccggaatcccctcactctcaccaccacaaaaaaagcctcagagcgttggcatatgcgtgcgccagaagggaagacagaaagccggtctggaaaaggggaaccgcaaaaaagaactgagacaagcaaattgcccatcacttcggcctcagagaaaaggcgctgatactcgaagactgccccgagagacaagacctactaaaaaacggactgccgcagcgcagccttttctgcagttgtggaaccctgcaccacataccagcaatggaagaaccggcgatttgtag

SEQ ID NO: 27241 - DNA, 243 bp, Artificial Sequence
  Description of Artificial Sequence: Synthetic coding sequence
atggctgaaaagattctggaaaagcttgatgtgctcgacaagcaggccgagattattttggccaggcgcacaaaaatcaacagactgcagagtgagggacggaaaacaactatggctattccgctgacattcgattttcagttggaatttgaggaagcactggctacttcagcctccaaagctatctccaagattaaggaggacaagtcttgcagcatcaccaagagcaagatctcagaatag

SEQ ID NO: 27242 - DNA, 243 bp, Artificial Sequence
  Description of Artificial Sequence: Synthetic coding sequence
atggcagagaaaatccttgaaaagcttgacgtgctggacaaacaagctgaaattattcttgcacgcagaacaaagataaatagactgcagtcagaaggccgtaaaacaacgatggctattccattgacattcgacttccagctggaatttgaagaagccttggcaacctccgcctcaaaggccatctccaaaattaaagaggataagagctgctccatcaccaagtccaaaatcagtaattag

SEQ ID NO: 27243 - DNA, 846 bp, Artificial Sequence
  Description of Artificial Sequence: Synthetic coding sequence
atggctgagaaaatcctcgagaaactggacgtgctggacaagcaggccgaaattattcttgcacgaagaaccaaaataaatcggttacagtcagaggggagaaagacaacaatggcgatcccacttacatttgatttccaactggagttcgaagaggcactggctactagtgcaagtaaggctattagtaagatcaaagaggacaagagctgttcaattaccaagtccaaaatgcatgtgagttttaagtgcgagcccgagccccgtaaatcaaactttgagaaatcaaatctgagaccttttttcatccagaccaatgtcaaaaataaagagtccgagtccactgagcctgtcgaagagcatctgaaaagccgcagtatacggccctacctgtatctcaaggatacaactgaaatggagaatgcaggccctctgaacgtcctgtatagccagcaccgacaggcctgtcggcgctctctgggcagcacagacttttcacctatgtttaacatccaaagtaacgcgcacaagaaagagaaagactctacgctgtttactgcccagatagagaagaagccccggaagccactcgattcggttggcctactggagggggaccgtaacaagcgcaaaaagtcgcctcaaatgaacgattttaatatcaaggaaaacaaaagcgttcggaattaccaactttcaaaatatcgctctgtgcgcaagaagagcctgctgcccttgtgctttgaggacgagctgaagaatccccacgctaagatcgtcaacgtgtccccaaccaagaccgtaacctctcacatggaacaaaaggacacgaaccctataatttag

SEQ ID NO: 27244 - DNA, 1203 bp, Artificial Sequence
  Description of Artificial Sequence: Synthetic coding sequence
atggccgagaaaattctagagaagttagatgtcctcgataagcaagcagaaataatcctagcgcgtagaactaaaatcaaccgcttgcagagtgaagggagaaagacgacaatggccattcctttgacttttgactttcaactggagtttgaggaggccctggcgacttccgcatctaaggctatctcgaaaatcaaggaggataagagctgctctatcactaagtctaagatgcacgtgagttttaagtgcgagccagaaccaagaaaatctaactttgaaaaatccaatctccgccccttcttcattcaaacaaacgtcaagaacaaggagagcgagtctaccgcacagatagagaagaaacccagaaagcccctggacagtgttggcctgcttgagggtgatcgcaacaagcgcaagaagagcccacagatgaacgactttaatattaaagagaacaaatccgtccggaattatcaactgtccaaatataggagcgtcaggaagaaaagcttgctgcctctgtgcttcgaggacgaattgaaaaaccctcacgctaaaattgtgaacgtttctccgactaagacagttactagtcacatggaacagaaagacaccaaccctattatttttcacgacactgagtacgtgcggatgttgctcctgaccaagaataggttttcaagccaccctctggagaacgaaaacatctacccacacaagcggacaaacttcattctggagcgaaattgcgagatcttaaagtctataatcggaaatcagtctataagcctctttaagccccagaagacaatgccaactgtccagcggaaagacatccaaatccccatgagcttcaaagcgggccacacaaccgtggacgacaagctgaagaagaaaaccaataagcagaccttggaaaatcgcagctggaatacattgtacaacttctctcagaacttcagttcgctgacaaagcagtttgtcggttacctggataaagccgtgattcacgaaatgagtgctcagacaggcaaattcgagcgcatgttttccgctggcaaacctacatccattcctacctccagtgccctgcccgtgaagtgttactctaagcccttcaagtatatctatgagctgaataacgttaccccacttgacaatctcttaaatttgagcaacgagattcttaacgcctcatag

SEQ ID NO: 27245 - DNA, 1203 bp, Artificial Sequence
  Description of Artificial Sequence: Synthetic coding sequence
atggctgagaagatcctggagaagttggacgttttggataaacaggcggaaattatcttggcccgccgtactaagattaatcgtctgcagtccgagggccggaagacaaccatggcaatccctctgacatttgatttccagctggaatttgaagaggcattggcaactagtgcttctaaggccatcagcaagattaaagaagacaagtcatgttctatcacgaagtcgaagatgcatgtgtcattcaagtgcgagccggaaccccggaaatccaacttcgaaaagagcaatctgaggccctttttcattcaaactaacgtgaagaataaagagagcgagtcaactgcgcagatagaaaaaaagcctcgtaaaccactggactcagtagggttgctggagggggacagaaataaaaggaaaaagagtcctcaaatgaacgacttcaacattaaagaaaacaagagcgtgaggaactaccagttaagcaagtacagaagcgtccgcaagaaatcattattgcctctgtgtttcgaggacgagttgaagaatccacacgccaagatcgtgaacgtcagcccgaccaaaaccgtgacgtcacacatggagcagaaagataccaatccaattatcttccacgacacagagtatgttcgcatgctcttgctgactaagaaccggttttccagtcacccactcgagaatgagaatatctaccctcacaaacgcacaaactttatcttggaaaggaattgtgagatccttaaatcaatcataggaaatcagtccatcagcctgtttaagccccaaaaaaccatgcctactgtgcagaggaaggatatccagattccaatgagcttcaaagctggtcatactactgtcgatgacaaactcaagaaaaaaacaaataagcagacactggagaatagatcctggaacacactctacaatttttcgcagaatttttcctctctcactaagcagtttgtcggataccttgataaagccgtgatccatgaaatgagtgcccagacaggaaagttcgaaagaatgttcagcgctggcaaacccacatccatccccaccagctcagcgttgccagtaaaatgctattcaaagccctttaagtatatctacgaactcaataacgtgactcctttggacaatctgctgaacctgtccaatgagatcttgaatgccagttag

SEQ ID NO: 27246 - DNA, 846 bp, Artificial Sequence
  Description of Artificial Sequence: Synthetic coding sequence
atggccgagaaaattttggagaaactggatgtgctggataagcaggccgagattatcttggcccgcagaaccaagattaatagacttcagagtgaggggcgcaaaaccaccatggcaataccactgaccttcgatttccaactcgaattcgaagaggccttagccacctctgcaagcaaggcaatttctaaaatcaaggaggataagtcatgttcaataacaaagtccaagatgcacgtctctttcaaatgcgaaccagaaccacgcaagtcaaacttcgaaaagagtaatctccggcccttcttcattcagactaacgttaagaataaggagtcagaatctacagagcccgtggaagagcatctcaagagtcgttcaatccgcccctacctgtatctaaaggatactacggagatggagaacgctggccctctgaacgtcctttactcacagcacaggcaagcctgcagaaggtccttgggttccacagatttttcgcccatgttcaatatccagtcgaacgctcataagaaggaaaaggattcgaccttgtttacagcccagatcgagaaaaagccaagaaaaccgctggatagcgttggacttctggagggggatcgcaacaaaagaaaaaagagcccacaaatgaacgatttcaatataaaggaaaacaagtctgtaaggaattaccagctctccaagtaccggtcagttcgcaagaaatccctgctgcctctgtgctttgaggacgaactgaagaacccccatgcaaaaattgtgaatgtgagccccactaaaactgttacttcacacatggagcagaaggacaccaaccctatcatttag

SEQ ID NO: 27247 - DNA, 1203 bp, Artificial Sequence
  Description of Artificial Sequence: Synthetic coding sequence
atggctgagaagattttagaaaaactcgacgtccttgataagcaggctgagattatcttagcgcgaaggactaagatcaatcggctgcagtcggaggggcgcaagactactatggccatacccttgacctttgactttcagttggaatttgaggaggcactggctacctctgcgtccaaagcgatctccaaaattaaggaggacaaaagttgctccattactaaaagcaaaatgcatgtgtcctttaagtgtgaaccagagcctaggaaaagcaattttgagaagtccaatctacgccctttttttatccagacaaatgttaagaataaggagtcagaatcgaccgctcagatcgaaaagaaacctagaaagccacttgatagcgttggcctgctcgagggcgaccgcaacaagcgtaaaaaaagtccccaaatgaacgattttaatattaaggagaataagtcagtaaggaattatcagctgtcgaagtacagatcagtccgtaaaaagtcactcctccctctgtgctttgaagatgaactgaagaatccccatgctaagatcgttaatgtaagtcctactaagaccgtgacttctcatatggagcagaaagacaccaacccaattattttccacgataccgaatacgtacggatgctgttgttgactaaaaacaggttttcttcacacccactcgaaaatgagaacatatatccccacaagcgtacgaattttatcctagaaagaaactgtgaaatccttaaaagtatcattggcaatcagtcaatttccctttttaagcctcagaaaactatgcctacagtccagcgcaaagatatacaaatccccatgagcttcaaggctggccataccaccgtcgatgacaaactaaagaagaaaaccaataagcagacattggagaaccgctcctggaacaccctgtacaatttttcccagaatttcagcagcctcactaagcagtttgtcgggtatttggataaagcagttatccatgagatgagcgctcaaaccggcaagttcgagcgaatgttttccgcgggaaaaccaactagcatccccacctcatccgccctgcccgtgaagtgctactccaaaccctttaagtacatctacgagctgaataatgtgacaccgctcgacaacctgctcaacctgtccaacgagatcctgaatgcgtcctag

SEQ ID NO: 27248 - DNA, 477 bp, Artificial Sequence
  Description of Artificial Sequence: Synthetic coding sequence
atgcggcggagcctgcgcgccgggaagcgccgacagaccgccggaaagagtaaaagcccaccaaaagtcccaatagttatccaagatgatagcttgcctgccggtcctcctcctcagatcaggatcctcaagaggcctactagcaacggggtagtatcatctccgaacagcaccagtagaccgacactccctgtcaaatcactggcccagagggaggccgagtacgccgaggccaggaagagaattctagggtctgcttcgccagaggaagaacaagagaagccaattctggacaggccaacgcgtataagccagcccgaggattccagactgcaaaccgcacagatcaacgccgggaagaaacgatgccgtcgatgttgtcgacaccggctgctgggccgtccgccgagagtggccctgccttggcagacagccggactcgagcaacgcgaaagaccggacctgctggctctatag

SEQ ID NO: 27249 - DNA, 459 bp, Artificial Sequence
  Description of Artificial Sequence: Synthetic coding sequence
atggaggacgaagaagtcgcagagtcgtgggaagaggcagctgattccggcgagatcgacagacgcctggaaaagaagttaaaaattacccagaaggagagcaggaagagcaaaagcccccccaaggtgcccattgtcattcaagatgatagtttgcctgctggccctcctcctcagattcgcatactcaaacgcccaacgtcaaatggggtcgtgagcagtccaaatagtacttctaggccgactctccccgttaaaagtcttgcacagagggaagcagaatatgctgaagctcggaaacgcatattaggctccgctagtccagaggaagagcaggagaaacctatcctcgatcgacccaccagaatcagccagcctgaggattcgcgccagcccaacaacgtgatccgccagccattgggcccagacgggtcacagggcttcaaacaaagaaggtag

SEQ ID NO: 27250 - DNA, 402 bp, Artificial Sequence
  Description of Artificial Sequence: Synthetic coding sequence
atgcggaggagtttacgggcaggcaagagacgccagaccgcagggaggaaatcaaaaagcccccccaaggtccccattgttatccaggacgacagtctgcctgccggaccaccaccccagattagaatactgaaaagacccacctccaatggcgtggtttcctccccgaactcaaccagccggccaacccttccagtaaagtctctagcccagcgggaagccgaatacgcagaggcccgcaaaaggatcctagggtccgcgagcccggaggaagagcaggagaagccgattctcgatcggccgacgcgtatcagccagcctgaagattctcgtcaaccaaacaacgttatcaggcagccacttggcccagacggcagtcagggattcaaacagcgaagatag

SEQ ID NO: 27251 - DNA, 423 bp, Artificial Sequence
  Description of Artificial Sequence: Synthetic coding sequence
atggaagatgaggaagtggctgaatcctgggaggaggcggcagattccggcgagattgatagacgcctggaaaagaagttgaaaattacgcagaaggagtccaggaaaagtaagtctcctccaaaggttccaatagttattcaggacgacagtcttcccgcaggtcccccccctcaaatacggattctgaagcgtcccacatctaatggcgtagttagcagtccaaattccacttcccgccccactttaccagtaaagtctctggcccagcgcgaggcggagtatgcagaagctcgcaagcgaatactcgggagtgcctctcctgaagaagagcaggaaaagcctatccttgaccgcccaacccgcatttctcaacccgaagattcccgacaacccaataatgtgatcagacagcgtcgatag

SEQ ID NO: 27252 - DNA, 480 bp, Artificial Sequence
  Description of Artificial Sequence: Synthetic coding sequence
atgtcttacgaggtcgccaccgctctggagaaccggtctcataaggtgagatactcagactctgtcgagaatggatccattattttctccttatccggtgttgccttcctactcatggatactaaagagtgtttgctgagcacagaagagattttccttgccaagatcgaaaagtttatcaacatccatcagaattcttttctggtgttgtccgctgcactacacggccctgaggagtggaaactgatgtttagaatccagcaaaggttcctcggttgtaacctgcgtatcttgccagtgcataacaccgtaaacgcgataaatctcatgtgtacaatcgctaaaacgacttccaaaccctacattgattctatttgctataggatgatcacggcaaaggcttacattatcgagcagagccccgtatggaagacacttcagaaaattaagttgaacagcgactccgtcaatcccaattag

SEQ ID NO: 27253 - DNA, 543 bp, Artificial Sequence
  Description of Artificial Sequence: Synthetic coding sequence
atggcagagagcggtaaggaaaaaataaaatggactaccacgatcatcatctctagtagcctcaagagctatgaagtagctactgccttagagaacagaagccataaagtccgctactctgactctgtggaaaacggaagtatcatattttccctgtccggtgtggcattcctcctcatggataccaaggaatgcttgctgagcacagaagagatttttctggctaaaattgagaagtttatcaacattcaccagaatagcttcctcgtacttagtgctgccctacacggaccagaggaatggaagctgatgtttaggatccagcaacggtttctggggtgcaacctgcggatcttgccagttcataatacagtgaatgctatcaatctgatgtgtaccatagctaaaacgacttcaaagccctacattgattcaatttgttacaggatgattactgccaaggcttacatcattgagcagtcccctgtgtggaagactctgcagaagataaaactcaattctgatagcgtgaacccaaactag

SEQ ID NO: 27254 - DNA, 813 bp, Artificial Sequence
  Description of Artificial Sequence: Synthetic coding sequence
atgcaaggcaacaacctacagccaccgtctccccgacccctcgagtgttggtccctccacagagaggccccgcaaagaacagaagccagtcggacacatccatcccctttcctggccctgccaggaagtcaccggactgcgaaccaagctcaagtagtccctgggctggtgcaccacccgcaggaaaacacacagcgcctccgaatccgggctggactgagcccttttccacgtgctaggctagccgctatcgggtcaactcacggacatcgctgggtccctggcatctgtttaccacggtgtctgtgtcctgcgtcttgtgccctccacgcgtgtcctccacattgtaataatgctgaagctcactcctggctgaggctgggaggaccactccagagccgcagcgttgagcaccaacagcacgcatgcggttggggctgggtgacacatgccacgtacggcgaaagaggaacgagccaggcggcggagaggcagaggatcgcccacacccgcgcccttagtgttggaaactgccctcggtcccacttccagtgtgaattctcgagtatctctaaatggtcggaggggacagggacattcagcccacggccccgggcagtaaaatctggcgtggggggccagccgtccccccacatacggattacttggcgatcctgcactactctgacctcaaagccatgctctcgggcaatcacaccggaatgcgttgtcggttggagcagaagatctagacactggtactctgatatgcggactggcgaatgccaggggctctcaccgatcacacgatag

SEQ ID NO: 27255 - DNA, 333 bp, Artificial Sequence
  Description of Artificial Sequence: Synthetic coding sequence
atgacttaccctccccacagggccttctctagatcagatgtgccataccccctgctgtcctcgccggtacaatggcctctttctctggtggtcggcgacaccagtacaaggtggccacagcaaccatctgcactggagtcggattgcccaggcccttctcacccatgcttagcggggctgttgggaccaatgcacccagtagacatccccctgtccaccgccctgcacagcaagcatcagagaaggttgacccaatgcgtcttgatggttcagagtccatctaagcagagatccctgtatcttttaaacaaaaagatcccacatgacgcctag

SEQ ID NO: 27256 - DNA, 408 bp, Artificial Sequence
  Description of Artificial Sequence: Synthetic coding sequence
atggggaattacctgcttaggaaactcagctgcctgggggagaaccagaagaagcctaaaaagggcaaccctgacgaagagcgcaagcgacaagagatgacgaccttcgaaagaaaactccaggatcaggataaaaagtcgcaagaagtctccagtacaagcaaccaggagaacgaaaatggatctggatcagaagaggtgtgttacaccgtgattaatcacatcccccatcagcggtcctccctgtcttccaacgacgatggctatgaaaacatcgattcactgacccgcaaggtgcgacagttccgcgaaagatcagaaacagagtacgccctcctccgcacctccgtgagccggccctgttcttgtactcacgagcacgattacgaagttgtctttccacactag

SEQ ID NO: 27257 - DNA, 348 bp, Artificial Sequence
  Description of Artificial Sequence: Synthetic coding sequence
atgggcaattatctgttgcgaaagctcagacaagagatgacgactttcgagcgaaagcttcaggaccaagacaagaaatctcaagaagtgtctagcacctccaatcaggagaacgaaaacggctccggctcagaggaagtctgctataccgtcataaatcacatccctcaccagcgctcctcgctatcatctaatgatgatggctacgagaatatcgattcgctcacccgcaaagtccgccagtttagggagagatcggaaaccgagtatgcactcctgagaacgagcgttagtcgcccctgctcctgtacacacgagcacgactatgaagtggtcttcccccattag

SEQ ID NO: 27258 - DNA, 402 bp, Artificial Sequence
  Description of Artificial Sequence: Synthetic coding sequence
atggtaatgcttgaagattctaactcttcgactgggtgtggagcccgcaactgtgtcgaatgtttggtttttctatctgtcctggggtgccaatccgaacgaaaaggtcagatgcgcacccagcaggctgggcggtggctaagagctggaagggaggcttcttctgaaacaaacccagagggcaccctaatcctagatttccagtcaccagagctgccactcgctgcccgggggtggcaggaacatgagcccgtggttcgctgcaatgtcctgcctcacgcattctcctcatggtgtttcgggcagaatttccccaagtggagcgagacacaggaactacgcaatcgggtgactgtcaaacgctgggagattatttcctgtgaaaacagcggcgagtcttag

SEQ ID NO: 27259 - DNA, 348 bp, Artificial Sequence
  Description of Artificial Sequence: Synthetic coding sequence
atgggtaactatcttctgaggaaactaagacaggaaatgactacctttgagagaaagttacaggatcaggataagaagtctcaggaggtatcttcaacaagcaaccaggaaaacgagaatgggtccggctcagaggaagtgtgttacaccgtgataaaccacattccccatcagagaagctccctcagctcaaacgacgatggctatgagaatatcgacagtctcactcgaaaggtaagacaatttcgtgaacgtagcgagaccgagtatgccctgctgaggacctcagtatctagaccgtgttcttgcacccatgagcacgattacgaggtggtgtttccacactag

SEQ ID NO: 27260 - DNA, 243 bp, Artificial Sequence
  Description of Artificial Sequence: Synthetic coding sequence
atgggaaactatctcctccgcaaactgtcctgtctaggagagaaccagaagaagcctaagaagggaaatcctgacgaagaaagaaaaaggcaggagatgaccacattcgagcgtaaactgcaggatcaggataagaaatctcaagaggtgagttccacgtccaaccaggagaacgaaaacggttcggggtccgaggaggtgtgctacaccgtcattaaccatatccctcaccagcgctcgtag

SEQ ID NO: 27261 - DNA, 348 bp, Artificial Sequence
  Description of Artificial Sequence: Synthetic coding sequence
atgggaaattacctcttacggaagcttcggcaggaaatgaccaccttcgaaagaaagctccaggaccaggataagaagtctcaggaggtctcgtccacaagcaatcaggagaatgaaaatgggtctggaagcgaggaagtgtgttacactgtgattaaccatattccccatcagaggtccagcctcagctctaatgacgacggatatgaaaacatcgactctctgacacggaaggttcgtcagttcagggagcgttctgaaactgagtacgccctacttagaacgtcagtctcccgaccttgcagttgcactcatgagcacgactacgaggtggtctttccccattag

SEQ ID NO: 27262 - DNA, 585 bp, Artificial Sequence
  Description of Artificial Sequence: Synthetic coding sequence
atgtttctgactgcagttaatccgcaaccactatctacccctagttggcagattgaaaccaaatactccactaaggtcttaacgggcaattggatggaagaaagacgcaagttcacgcgtgataccgataagactccccagagcatttacaggaaggagtatataccctttccagaccaccgccctgatcaaatcagtcgatggtacggcaaaagaaaggttgagggtcttccctacaagcatctcattacacaccaccaggagccccctcacaggtatctgattagcacttatgatgatcactataaccggcatgggtacaatcctggacttcctccattaaggacatggaatggacaaaagctcctgtggttgcccgaaaaatccgactttccactattagcacctcctacaaattacggattatacgagcagctgaaacagcgacaactgacgcctaaggccggcctgaagcagtcaacctacacttccagttaccctcgcccgcccctctgcgccatgagctggcgcgagcacgcagtccccgtgccaccccacagattgcatccattcccacatttttag

SEQ ID NO: 27263 - DNA, 471 bp, Artificial Sequence
  Description of Artificial Sequence: Synthetic coding sequence
atgttccttaccgccgtgaaccctcagcctctgagcaccccttcctggcagattgaaacaaaatactctacaaaggtgcttacaggtaattggatggaagagcgccgcaaggggttaccctacaagcatctgattacacaccatcaggagcccccccaccgctacctaatctccacatacgacgatcattacaatcggcacggatataatcctgggcttccgccgctgagaacgtggaacggccagaagctgctgtggcttccggagaagtcggattttccgttgctcgcccccccaaccaactacggcctttacgagcagctgaaacaacgccagctgacgcctaaggcggggctgaaacagtctacctacacatcatcctatccacgtccacccctgtgtgctatgagctggcgtgagcacgccgtaccagtgccacctcaccggctgcacccatttcctcatttttag

SEQ ID NO: 27264 - DNA, 4422 bp, Artificial Sequence
  Description of Artificial Sequence: Synthetic coding sequence
atgaccaggatgtcttgcccctggggctcttaccagtgggagccaggcgcctgcccagcagccccgaggggtatcggaggaggtgacatggcaggcgggattccagacgttcgagggctgcaggaggccgcattgggagctgggcgatctcaggaggaggcccggctcgttgaagaggcccagactccagtcatgctgccccaggacagcgggcaacgagtggaagaggttcccggcgatctaatggctaaacggatgtcactgatcctccacgtgcagaagctaccctgggaccacgtgccctgcctccgacgtactagacagaatttgtatcaggacgtcggggggcacgcccacggtagtgggcttggaggtgctaaaaggggagcagccaggtcagcattgcgcagaccattgcctccggcaacttgccgaccagccggaattgtttccggaccatctcctagactggactctaaccccaccggtgctcacttgatcaagcagacacgccccctcaccgtggagtggacgaaagatacccccgtgcccgaacctatggagctgcgatccgatgcttcgcacaaggaaaatgtcagccccaagcctgctgcccttcctaaacctggcaagcgtttgaaacagaggcggtttaggagatcgcttggcatcggcctctcaggacggcatgatcagtgggttcccggatgtcaagtggagagaggtggccctgcggccacaccttctccaggagccgtgctcgaccaggagccatgccgagttcagacaaacctagcctcacccggccctcgtctgggattggccctgaaagatactacggggcagctcgtgaactcttcattctggcagcagtctaatctgcagtcacttgcgcgacgccgccagggtaaggcccgcgaatttgcaatacaacagtccaacttgagtatcaacgagacctcctccccgcatttgtgtccagagcctggcggcagcagcggcccccacaagctgccttggggccccctgctaagtcaagagccgctggcgagaccctcctcctgcttgagacagtccggtctgcctgcaccgggcaccccctcaggcgattttcgacccacagaggcctttgccccactggacggccacacacaacccgggcttcgaagctggggagggctcgggtcgtggagaagccggttagtaggtgaaccattaaccttagaggacttagcggtgccttcccagaatcaaactcaagccccaagccgagcggcagtgcaccaactcctggctagtgtgcattgcctcgctcaggaagccgctaggctcagatgtcaggccccacaggagcccccagcatggggggtttcaccaaagcagaaaggggaagagggcgccccgcgggaaagagtccatcgggaggaagagcgcaccgcattccatttgagtgatacagtcccagcttcgtctgcctcaaaaaataaggcccaaaacattacagctcccgaaagtgaggcgatctgttggcagttgctcagccggtgttttcggtcatggcggcatctggtgaaacgtcaacgggagcctgcggcagctgcagttgcccttggacggtggcagcttcttaggaagtgcctgcaggccttgtggctcagggaggctcagttagaagctgcgtgggggcagtacactaaggttctcctcgtgcgtagttttagagaggtgagcggcctgcaggtgggccccggggggagggtaaagcagtgcccgggcagcctccgagaggaggagatcgctcagcgactgctgtcgcaccctagacagaggacggactcccgccatgaaagggtccagatactgcaagccctgcagctggcggtatttttcctctggtgccagcagaagaagcgcgctcggcaagagcgcgaaaccctgcggaaagcgacaagagccacacaacggacaggctctttcccccaggcatggcactcgacagccgctggcgtcgcttgggtggctcctctctccccccaacaccagagggcctggctctgtagatgctttggggcgtggcagcagtttgttcagcgaggctctcggtatcgcgatcacctggctgacaggcgtaccgggacgctgcgcaagtgtttagaacagtgggtccgcatgaagcaacttagggaatcagacggggccaaggtgacacagctctcgctctgtcgacagaaggcaggacgtgaggccgtctacacagcaggcccaggcgcatgtggccttggagcagtgggtcaggcgcagggccaacaggagcagggccgaggctctttacaggacgcgtgttggaccctcgcgttgtgttgggcgttgttgctatggaaaatgcgcttatttcaacggcagtgggcaaacagcttctttcaagggttacagcagagaatgctgcagagatcactgcgatggtggcatcttagggctcttgggccagatgccacctccagctgcacaaaaacaccctcagccctggaacctctatccagtagtactttgcaagactctttagagaaggtaccacgagctccaactctccctgacaccctccaagggtcactgctttgggctgctggtcaacgtcaacagggacaatgcctcctactgtggcaggccagagcgcagcagtttcaggggaccgcacgctggtaccagcacactcgtcaacgtagaatcttcctgagctggtctcgctgggccactgctcagtgggcatggcgcgagctggccagccaccgggcgtgggaccgaacatgtcgggccgttctgggcctgtggagacagcggctactgcagagccggttggttgaatggtgggcacaagagagaggatggaggttggctagggacgccttatgccactggcacagttgctggcaaggccagcagtttctgcacgagaaatgccagacctgggtccaggtacacttacaagggttacaaaaagtggtgttccgctcatggcaacaggccgccgcccaccaaagatgtactgtcacaagaccagagcaactacttctccagagctatttccaggcttggtgtgaggtcgtgagggacactggcgtgctcagggcccagcaccaggcgtttcaggacggacttcggcgccgcgctcttggcgccgtatttgctacatggcgcgaggctcaagaagtggcagccggagcccaggaacagcgcgtcgcacaagcgagtcttgcccgttggcgctcctgtggccagcaggggcaggaagacggtcagcaaaagaaggcccgcgcacctcaggcatttcctgcctggcccgtggcacccggcatgcatcacgaggctcaacagcaggcaggcgagagcgccggcgcacaagctgctcaatgttggacctggtgctgggctttgtgggtgcatgagagctgcaggggccaggtgtcacgagcgcatgccagttggaaacctagggcgtgggtgctggaggcctcagtccagtctgctgtgcgaggcggcgtgcagcgggcgatcctgacgcagttgaggcctgctgagctgcgccggttccttcggaccgtgcagctaagggtcaggcttgggttacccggcgccggaaagacgcggtcctgctggacacaggctaccgaactggtgccccctgcgcccagcctgcagtgctctctgggcggacgaagaaagcccaggggcacggcttgggcccagcgctgcagagaacattctctttgtccagcctttcaactatggccccagtggcccggccaatctagctgggtgcctggcctgcctttgtggacacgcgatcaaggaccacgagcacatagttctcccgagcccagagcatgtaaggcacaatctaaggcacacaaaaggaggctgcgggccaggtcctgtcgcattttagaaaagcaggcccaggctcacggctccgccttactgctggcattgaagggccacgacgcacttggtcatcaagaggaggtgcccgccgcacctgtgcccaggggaaccgcttcacgggccgcagggtttcccgccgggcaggtccctggcagtggaatggcagccttgggtgggtgtcccagggggcgagctgcgggggcagacccagctcagggtgttgccccagagatgggactggccgatgtagtcgccgccgacccagcgacggcctctgggtcggcagtgactgctgccgggcgttgggcctttaaaaaatggcaccagcgtcttgccgctcggtcgcccagaaggggagcagcaagttccccccggccctggtccaagcctggtcctaaaggccctgagagtgggcaggaagccgcaagagcaccacgtggatgggggcttggcgccgagcacggggcccaattgcagctctag

SEQ ID NO: 27265 - DNA, 732 bp, Artificial Sequence
  Description of Artificial Sequence: Synthetic coding sequence
aggtccgatgcatcacacaaagagaatgtctcacccaagccagctgcactgcctaagcccgagcaaaggcgctttaggaggtctctcggcattggactgtctggccggcacgaccagtgggtgccaggctgtcaggtggagcggggcgggccagccgcaaccccttcccctggcgctgtgctggaccaggagccttgcagagttcagacaaaccttgcatctcccggcccccgcctcggactggcccttaaggacaccaccggtcagcttgtaaattcaagtttttggcagcaaagcaacctgcagagccttgctcgtcgccgtcagggtaaggcccgtgagtttgctatccaacagtccaacctgtccataaacgaaacatcctccccccatctctgtcctgagcccggaggatcgtcagggccacacaaactcccctggggacctttactgtcccaggagcctttggccagaccttctagctgtctgcggcagagcggcttacctgcaccaggcactccttctggagacttcaggccgacagaggccttcgccccacttgacggtcacacgcaacctggtctgcgctcctggggggggctgggctcctggcgttcccggttagttggtgagcccctgaccctggaggaccttgcggtgccatcccagaaccagacccaggctccctcccgggcagccgtgcatcaactactcgcgagcacccttgggtag

SEQ ID NO: 27266 - DNA, 2187 bp, Artificial Sequence
  Description of Artificial Sequence: Synthetic coding sequence
atggaaggggagggcgtgcgcaattttaaggaacttagggccaaattccagaatctggatgccccaccccttccagggccaatcaagtttcctgccggtgtgtccccgaagggggatatcggcgggacccagtccactcagatccttgcaaacgggaaacctctctccagtaaccacaaacagcgaaccccctactgctccagcagcgaaagtcaacctctgcagccccagaagatcaaactcgcacaaaagagcgaaattcctaagtgcagtaattctcctgggccacttgggaaatctacggtatgttctgcaacttccagccagaaagcgtctctgctgctcgaagtgacacagagtaacgtggagatcattacaaaggaaaaagtcatggtcgccaactcttttcgtaacaagttgtggaattgggagaaagtgtcaagccaaaagagtgagatgtcttcagcactcctcttggctaattacggctcgaaagccatccatttagaagggcagaaaggtatgggattgacccccgaggagccaagaaagaagctcgagaccaagggtgcccagacattaccttctcaaaagcacgtcgtggcccctaagattctgcacaacgtcagtgaggatccatctttcgtgatcagccagcacattagaaagtcctgggaaaatccgccaccagagcgaagtccagcatcaagcccttgtcagccaatatacgaatgcgagctggctagccaagcacctgagaagcagccggatgtgcgacaccatcatctcccaaaaaccaaacccctgccctctatcgattctttaggacccccgccacccaaaccatcccggccgcctatcgtgaacctgcaagcatttcaaagacagcccgcggctgttccgaaaactcaaggagaagtgactgtggaagaaggttccctttcacccgaacgcctgttcaacgctgaattcgaagagccacataattatgaagccacaataagctatctccggcacagcggaaactctattaacctgtgtacggccaaagagattgcagatcccacgtacgaagttggcatcgaggaattgcagaagccagggaaaaactttccatacccagaaccgtctgctaagcatgaggataagaaaatgaaggaaaaacaaccttgcgaactgaaacctaaaaataccgagaaggagccctactcgaaccacgtctttaaggtcgatgcttgtgaaggcacgccagagaaaatccagatgacaaacgtacacactgggcggaggaatatgctggccggaaaacaggaggccatgatagatataattcagactaatccttgcccggagggtcccaagctcgccagacacagccagggccattgcggacacctcgaagttctggagagcacaaaagagacccccgatctgggggtgagtaagacatcgagcatctcagaggagatctatgatgacgttgaatattctagaaaggaagtgcccaaactcaattacagcagcagcctagcttctagcagcgaagagaatcgggagctttacgaagatgtgtataaaacaaagaataactatcctaagatcgatctggatggaaaggaggcattaaaacggttacaacaattctttaaaaaggaaaaagatcgcttcaagattaagaagacgaaatcgaaggagaacctgtccgccttttccatcctgctccccgaccttgagctcaagtcccaggaggtaattatctacgatgacgtcgatttgtccgagaaggagtctaaagatgaggataagcttaagatgtggaagccaaagtttttgacccctaaagaaaaaaaggaaaagaatggcgctgaagaatctgaatcgttttcaccacgcaatttttttaagacaaagaagcagaacttggaaaagaaccgaatgaaacgagaagagaaactgttccgtgagcgcttcaaatacgacaaggagataattgttattaatacagctgtggcctgcagcaataactcccgcaacggtatcttcgacttgccgattagccctggcgaagaacttgaggttattgacaccaccgagcagaacttggtcatctgtcgcaacagcaaggggaagtatggttacgtcttaatcgagcacctggatttcaaacaccaatcgtggagtccatag

SEQ ID NO: 27267 - DNA, 2091 bp, Artificial Sequence
  Description of Artificial Sequence: Synthetic coding sequence
atgcccacacaggatggccaattgcggagacccgcaagaccccctggcccaagggcatggatggagcccaggggcggagggtcgtcacagttttcaagctgccctggcccggcaagctccggcgaccagatgcagagactgctgcagggcccagcccctaggcccccgggggagcctccaggatcacccaaaagccctggtcactctaccggctcccaaaggccgccggatagccccggagcgcctccacgttctccctctcgcaaaaaaaggcgtgccgttggggcaaaaggaggaggccacacaggagcctctgcgtctgcccagacaggctctcctctgctgccagctgctagccctgaaaccgcaaagttgatggcaaaggccggccaggaagagctgggacccggacctgccggtgccccagaacctggccccaggagccccgtccaagaagaccggcctggccccggcctgggactgagcactccagttcccgttactgagcagggcacagaccagattagaacaccgagaagggcaaaactccacaccgtgtccaccactgtatgggaggcactcccagacgtgtcccgggcgaaatctgatatggccgtctccactccggcttctgaaccgcagccagacagggacatggccgtatcaacaccggcctcggagccacaatcagaccgcgacatggccgtgtccacccctgcttctgagccccagcctgacacggatatggccgtgtcaactcctgcaagcgagccccaacctgatagggacatggcagttagcattccagccagcaagccccaatctgacacagccgtgtctaccccggccagcgaaccacagtcttcggtagccctttccaccccgatatctaaaccccagctcgatacagatgtggctgtgagcacgcctgccagtaagcacggcctggatgtggcattacccaccgctggaccggtcgccaagctagaggtggctagtagcccaccagtttccgaggcggtgccccgtatgactgagagcagtggcttggtctcaacacccgtgccgcgggccgacgccgccgggttggcctggccaccaactagacgcgccggcccagacgtggttgagatggaggcagtagtttcagaaccatcggccggagctcccgggtgttgctctggcgcacctgctctaggactaacacaagtgccccgcaagaagaaggtgcggtttagcgtggcagggccatcccccaacaagcccggaagtggacaggcctctgcccgaccatctgccccacagactgcgacaggtgcccacggcggcccaggagcctgggaagctgtcgccgtggggccaaggcctcatcagccgaggatcctgaagcacctgcctagaccacccccctccgctgtgacacgcgtcggccccgggtcttctttcgctgtcacgctgcccgaggcatacgagttttttttctgtgatacaatagaagaaaacgaggaggcggaagctgccgctgcagggcaagatccagccggagtccagtggcccgacatgtgcgagtttttttttccagatgttggagcccagcgctcgaggcggcggggctcaccggagccactccctcgggccgaccctgtacccgcccccatcccaggtgatcctgtgccaattagcattcccgaggtgtacgagcactttttctttggggaggacagactggagggggtgttgggccctgcagtccccctgcccctgcaggccctggagccacctaggagcgcaagcgagggggccggccctggcacacccttaaaacctgctgtggttgagagactccaccttgcactccggagagctggcgagttgagagggccggtccctagcttcgctttctcccagaatgacatgtgtctagtttttgtggcatttgctacctgggccgtaaggaccagtgatccgcacactcccgatgcctggaaaactgctttactggcgaatgtgggcactatatccgccatcaggtacttcaggcgccaagtggggcagggtcgccgttctcactcaccctctcctagctcatag

SEQ ID NO: 27268 - DNA, 1197 bp, Artificial Sequence
  Description of Artificial Sequence: Synthetic coding sequence
atgcccagaccaggccatccgcgtcccgcctctgggcccccgcgcctgggcccatgggagcgcccaacagaactgtgtctggagacatacgacaaacccccacagccacctccaagtcggagaactagacgccctgaccctaaagatcccggccatcacggacctgaatcaatcaccttcatctcggggagcgccgagcccgccttggagtctcccacctgttgcttgctatggaggccttgggtttgggaatggtgtcgagccgccttttgttttcggaggtgccgagactgtctccagcggtgtggagcctgtgttagaggctgcagcccctgcttatccactgaggacagtacagaaggcacagccgaggccaattgggcaaaagagcataatggggtacctccttcacccgatagggctcccccatccagaagagatggccaaagactaaagtccaccatggggagctctttctcctacccagacgtaaaattgaagggtatcccggtttatccctatcctagggctacatctcctgccccggacgctgacagctgctgtaaagaacctttagctgacccccctcccatgagacattctcttccatctacctttgcttcttcccctaggggctcagaggagtactacagcttccacgaatcagacctggacctgccggagatgggatccggatccatgagctctcgtgagatcgacgtgcttattttcaaaaagctaaccgaactattctctgtacaccaaatcgatgaactggccaaatgcacatcagatacggtgtttctcgaaaaaaccagcaagatctcagaccttatcagttcgatcacacaagattaccacttagacgaacaagatgccgagggtagactcgtccgaggcatcataagaatcagtactagaaagagcagggcccgtccgcagaccagcgaggggagatccaccagggccgccgcacctaccgccgcagcgcccgactccggacatgagaccatggttggtagcggacttagccaggatgagctgactgtgcagataagccaagaaaccaccgcggacgctatcgctagaaagcttagaccgtacggagcgccagggtaccctgcttcacacgattcgagctttcaaggaactgataccgacagcagtggagcccctctgttgcaggtctactgctag

SEQ ID NO: 27269 - DNA, 624 bp, Artificial Sequence
  Description of Artificial Sequence: Synthetic coding sequence
atgcctaggccgggtcaccctcgacccgcatcaggccctcctcggctgggtccctgggagagaccgaccgagttatgtctagagacctatgataagccacctcagccaccaccttctcgcagaacacggcgaccggatccaaaggaccccggacaccacggcccagagtccattaccttcattagcggttccgccgaacctgcgctggagtcacccacttgcttgctgcgcacgccacttcggggactgctcaagcccacagggcctcgttccacaatggagtgtcctccagccctcatcgtacatccccctgccggaggtatggcctctggttctagccagccctgggccgctgccagtgctacccccatgctctcaagcaaggcttcattatgcattcccactaggggccctcctccccagccactgatgaggacacctgcagccagatctcactggccgattccacacccttgtgacacagcttgtccggccccactgcccgttgtgctggtggccccgcggagtacaattctatccatgagtaggacatggacatgccggcggtgggctgtcgccccatgtagagccgaaaagctcatgtgctcaagttcacggtcttag

SEQ ID NO: 27270 - DNA, 4593 bp, Artificial Sequence
  Description of Artificial Sequence: Synthetic coding sequence
atgtcacactcacacccagctggcctgctggcagcctacaactctcttatggataagcacttggccgggtacttcaataatactcggatccgcaggcacctgttaagatcaggcctgattacccgctcaggacgaattctcagtgagaaggagtacaaactgaacatgatgaaacgagatcatcaaaaatacataagagaatgcttggcccaggctatcttccataaggttctggacatggaaaggtaccaccagctggagatcaagaagaagctcgaaacgctcgcaaggaaggaaaggatccagaggttcaaaggtgaacacacacgacggtctgtagaaaacaacatgccaatacttagccctcaccctcccgtcggacccaagtctaacagaggccatagcgttcttgtggatgagggacacagctcccccttagcattgacagctccaaggccatacactgctcccggcaatatgcaacctcctatccggctgcagcccctacctagtaaccccgcggtcgaaacagtccccaaagtgacatcacgatcgagatccaaaacctctctactcgagaacgaagcactgttccccataggaggtaagaaggccgtaatgaaatttcgaaattccatcggcaatagccaacgtatgaacagttaccagttgcctaacattaactcctacatgatgcccattccccccccgctgcctccaactgggaagattactagagagaacaggtccgaaacctggcgcaggagaaggttccgccctactacagcccctaacgggttggagcctcttcttacaaaggactctcgtcggatacacaagacatctctacactctaatgctgcgattaccatgatttaccttggaaaaaacgtgcatctgagcagcgataatccagatttcagagatgaaattaaggtctaccagcagcattgtggcggcgaaaacctctgtgtttacaaaggcaaactgctcgaaaaagaaacctttcaatttatcagcaagaggcatcacggtttcccctttagtttgacatttttcctgaacggaatgcaggtgaatcgactctcgagctgctgtgagtataagcaccggaagggatctcggctgggaggtaagagaggctacttcgggtttgtatgtgtcgagagatcttctccatgctacaagtgcattattgccatggggttggacaaaaaaccgagtctgccaaagagcaggaaagaaaaatctactgaaaaaggggaggagttgaagaaagctgagggaaaggttcgtaaggagagagagtacgtgattccgaagcggaatgagatcaaagagaacaaaacctcagtcagcgctaagttcagtgcgcaggagataaagacgggattgaaggaggtggtcacagctgtcgaagagatgacgtccaagggcaagcccggccaggaagtcctggaggacgaccaggagaatacattgaaatacgaatatgaagaggactttgaagtcgacgaggaaaagcagggtgagaagtccaacgaggaaggccaggctgacgtgcagatgaatggtatcccacaatcgcctctggacgacaagaaggacaacctcgatcctgagaaggagagtgagacctcaagccagaaagctcctgacgcccgcgacaacgttaaggacgagaacgatgggtgcagtgagtccgagctagaagaagataagcaggacatgaagacagcaagttcaacctccagccgcagccatccctattcttctgatagcgaagacgagagcgccgtaggtgacagggaagcccatactgattcttccacagatgagagcgctcgcaggtcctcttcccaagaactttcagagaatgacaaacctaggaagtcccatttaccaatagaggagagtcttgagattgagatcgaagaccaagaaattacgaaggctgacgtcgagactaaacccatgccaattgacgagtcctttgagaatgtgcttaaagaaggcacagagaaggggacccaggagattgctgagggtctcagcgagaagtcggggaaacatgtgagcgcggaagagaaagaaaaagacaaaagtaagctttgggaggaaagcacagctcaggttaaggataagaaagccggcctgcccggcctggaagagggggggaaggatagcctgcctctggcctacgtgctggccctgggggctcctacgatgaactttatggttgatgaaacagccgctatcaactccaataaagaatcccagcagctcgtccaaaaaacatataccttggagaaaaaggaagctatggaagaggatgaagcgccacagcatcgcgacgcggatatagtacagggtaaaggcgaagcggccctgtggggggaagccggagccgtccatgaagcccctctgagagcctggaaacctactgccgaacagccggagctggccgaagagtttacggaaaaacgggaaatacctcctggaattgagagaggcgccgaaggggcggccgaggctgagggtgtcaggcgtttgggggaaggcggaagcgatccgataggccaggcagctgctaaagacgctgtgggtctctctaaagacgaggccccggaaaagcaggcactgatgctgacagtgctggaaacagacaaagccgcctctgagggggaacaagggctggagaaggctgttctggcaaatgaggccgcagctctgaacctggagcacctacacgaagtcgcagccctgcgggaagctgcgacttccgaagagggtgaggctgaagggggcgtagcagtcagcgatgtgggggagagtgaggaggaggcctctatcgaccttgaagacacgggccccatggaggataccgcctccaaacgggaggacggatctgaagaggccatcttgggcggggaggaacccgcaaaggaacgcaaagaggtgatgagaaccgagaccaggctgtcaccctttacaggagaagcggaagcctctcgtatgcaggtgtcagagggctccccagaggaggggtcactcgctaaggaagcattcctttgcaaagaggacgtcgaaggggaggagatggttacagaggccgaggctaaccgggaagacgaccgaaaggaaattctccctaaggaactcgatttagcacgggagcgaaggaaagcggagagacccaaaacctctttgcgcaagacagacagcgagagggaggaagtgactcgggccaatgccctgaaggacgaagacgcctttaaggaagaacagaagttgaaggcggaggagggggaaaccgagaccgaggtgagagcagaggaagaaaccaaagccccgcccaatgagatgggaagtgatgcggaaaatgaagcccccgtggaggcttctgaattatcggataatccaggactgttaggagaagacagcctgaaagaaaccgtcgttccaatctttgaggccacaccagggttcgagaagagtcttgagaacatcacggccctacggaaggagggcgggggtgaaagattgagtgaggcaagggacacagaacacaaagaccgggaggagctcagtagccgtgagaatcgggccttgaaggagggtcatcgacaagacggagaaggcgcacttgctgcgccagaggccgaaccagccggcaaggtccaggctcccgagggcctcatccctgcaaccgggcaggctgaagaactcgctgcaaaggatcatgactcatgtgctgggctcgaaggccgcgccgaagggcaaggcggggtcgacgtggttcttcgaacgcaggaagctgtcgccgaggaagacccaatcatggcagaaaaattcagagaggaggccgtggatgaagaccccgaggaggaagaagacaaggagtgcaccctggagacagaggcaatgcaagacagaaacagtgagggtgatggggacatggagggagaaggcaacacacagaagaatgagggtatgggggggggcagggtcgtggctgtggaggttctgcacggcgggggggagaccgccgaaaccgcggctgaagaaagagaggttttggctgggagcgagacagcagaagagaaaacaattgcgaacaaagcttcctcatttagtgacgtggcggaagaagaaacatggcaccagcaggacgaacttgtgggaaaaacagccgccgccggcaaggtggtagtggaggagctggcacgcagcggagaggaggtgcccgccgcagaggagatgacagttacttatactactgaagccggtgtcggaacccccggtgccttagagagaaaaaccagcggactgggtcaggagcaggaggagggctcggagggtcaagaggctgctaccggcagtggtgacggccggcaggagactggggccgctgagaagtttcgtcttggtctcagccgggagggcgagagggaactgagtccagagtctctgcaagctatggctaccctgccagtaaagcctgatttcactgaaacccgtgagaagcagcaacacatggtgcaaggcgagagcgaaactgccgacgtttccccgaataacgtgcaggtgtag

SEQ ID NO: 27271 - DNA, 1602 bp, Artificial Sequence
  Description of Artificial Sequence: Synthetic coding sequence
atgctcgcaaagggcaagaaggcagtgatgaaatttcgcaatagcattggcaattcgcagcgcatgaacagttatcagttgccaaacatcaactcatacatgatgcccattcctcctccgctgccccccaccggaaagatcacaagagaaaatcgcagcgaaacatggcgtcggagaaggttccgccccacgactgctccaaacggcctggaacccctgcttaccaaggactctaggcgaattcacaagacttcgttacattccaacgcagcaatcactatgatctatctcggcaagaacgtgcatctctcttccgataacccggactttagggatgagattaaggtgtaccaacagcactgtggcggcgagaacctgtgtgtgtacaagggcaaattgcttgaaaaggagacctttcagttcatcagcaagagacatcatggcttccccttctctcttacattctttcttaatggaatgcaagttaatcggctcagttcatgctgtgaatacaaacaccggaaagggagtagactggggggtaagcgcgggtatttcggatttgtatgcgtggagaggtcctctccttgctataagtgcataatcgctatgggcctcgacaaaaagccctcactgccaaaatccaggaaggagaagagcactgaaaagggggaggaactgaaaaaagctgaaggaaaggtcagaaaggaaagagagtatgtgatacctaagcgaaacgagattaaggagaacaagacttctgtgagcgctaagttctccgcccaagaaataaaaactggcttaaaggaggtggtgaccgccgtggaggaaatgaccagcaaaggaaagcctggacaagaagtgctggaggacgaccaagaaaacacgctgaaatacgagtacgaggaagacttcgaggtcgacgaggagaaacagggggaaaaaagtaatgaggagggacaggccgacgttcaaatgaacggcatcccccagtccccactggatgacaaaaaagacaatctcgatcccgagaaagaatccgaaaccagctcccagaaagcacccgatgcgcgggataacgtgaaggacgaaaacgatgggtgctcggagagcgagttagaggaagataagcaggacatgaaaaccgcgagcagtacaagcagcaggagtcacccatatagcagcgacagcgaggacgagagtgcggtgggggatcgcgaagcccacacggatagtagtaccgacgagtcagcccggaggtcttcaagccaggagttgtcagaaaatgacaaaccacgtaagagccatctgcccattgaagagagtctggaaatcgaaatagaggatcaggaaattactaaggcagatgtggaaactaagccgatgccaattgacgaaagttttgaaaatgttctgaaggaggggactgaaaaaggaacgcaggagatcgccgaagggctgtccgagaagagcggcaaacacgtgtccgccgaagaaaaggagaaagacaagagtaaactatgggaggaatcaaccgcacaggtcaaggacaaaaaagctggcctacctggccttgaggagggagggaaatacggacggtag

SEQ ID NO: 27272 - DNA, 732 bp, Artificial Sequence
  Description of Artificial Sequence: Synthetic coding sequence
atgcgctcccgaaagcttaccggcgctgttcggtcaagcgcccgtctaaaggccaggtcatgcagtgctgctagactggcatcagcgcaggaggtcgctggaagtacttctgctaaaactgcctgcctcacttcttcctctcacaaggccaccgacacaagaacaagcaaaaagttcaagtgcgacaaaggacatctggtcaagtcagaactccaaaagctggtgcctaagaatgatagcgctagcctccccaaagtgacacccgaaaccccatgtgagaatgagttcgcggaagggtctgctttgctgccagggagcgaggccggagtgagcgttcaacagggtgccgcttcactgccgttgggaggttgtagagtagtgtccgacagccgcctggccaagacccgggatggactgagtgttcctaaacacagcgcgggcagtggggctgaagaatcaaatagctccagtacagtccagaagcagaacgaacccgggcttcagactgaggacgtgcagaaacccccccttcaaatggacaatagtgtattcctggacgatgactccaaccagcccatgcccgtgagcaggtttttcggaaacgttgaactcatgcaggacttgcctcctgcttcctcaagctgtccctctatgagtcggcgtgaattccggaaaatgcacttccgcgcaaaagatgatgacgatgacgacgacgacgatgccgaaatgtag

SEQ ID NO: 27273 - DNA, 1245 bp, Artificial Sequence
  Description of Artificial Sequence: Synthetic coding sequence
atgagagagagccaggatgccgctggagcccacggatggaaccgtgtgggaagcactgccaccaaatggttcacgggcgctcctttcggggtccagagtcaccgattcgatatcagcgctgtgtaccctaattggaagaagttcagcaccttcacggaagccccatactcaactagatactccactcaagttagtcacatcggacctggcacctattcaagcaaggagacgtgtttctcaaagaagaagctgatgaaagaggtggatacaggctgggctaaagcacaggaagccacaaggctgacccagctgccccatttccagtaccaagcgataatgaaagagaaaaggcttaaggagcagaaactaggccccggttcatacaatttgaaagactttctggaacagcttcgcgagaagccttgcagcacaagaggcctgctgagctccggcgaagtgaggtttcgcggtctaaccgggaattattaccctggtccaggaaactatggtgagaagggtaatccttacacaaaactcgaagagaatgcgtggaacagaagccacagtgaaggtctgatgtgccgcatgtctaacaagccccacccacgaccataccaggggtcaggcctggggcctggcacttatttctttaagtcagatcttgagacatacgtggcacgcagcgtcggcaccagagggccctacgacaccttctctggggacaggagcaaaccacttccgtacggacactatagtatgcaaaagaagaaacccagggagctcatgaactttaagagcttcgtagaagagctcaactctcaccacaacaaaaagcacggtgtcttctcgaaactgccacggaatcctaaaacacccacagagagaatctactgggctaatctgtctcagtgccctagaactctggctacatctggaccttctttttggctgccacaggaaaaaaagtgtaagccagtgaaccagccacctttcttactgactagtaaaggtagtggcgccaaagcctgtcagatgatcatgggatcatggaaccccgtaggggtcgggagatacctgaacacctggttgatggaaacaaaggataggagacagcgctatagaagcctgtttctctctggatccaaacggtacctgtccgatctggcgagggatatgctgatgcagattcgtctgttttgttggaagggactggaggtgattaattttggcctgtcccccatgtag

SEQ ID NO: 27274 - DNA, 1257 bp, Artificial Sequence
  Description of Artificial Sequence: Synthetic coding sequence
atgagggagagccaagacgctgccggtgctcacgggtggaacagagtcgggagcactgctaccaagtggttcacaggagcacccttcggagttcagtctcataggttcgatatttcagctgtgtatcccaattggaaaaagttcagcacattcactgaggctccttatagcacccgctattcaactcaggtgtcccacatagggccggggacatatagtagcaaggagacttgtttcagtaaaaaaaagcttatgaaggaggtggacactggatgggctaaggcccaagaggcgactcggttgacccagctgcctcactttcaatatcaggctattatgaaggagaagcgcctgaaggaacaaaaactgggccctggaagctacaatctgaaagacttcttagaacagcttcgtgagaagccttgttccactcgcggcctactgtcctcaggcgaagtccggtttcgggggctgaccggtaactattatcctgggccaggcaactacggggaaaagggaaacccatacacaaaactcgaagaaaacgcctggaataggtcccattctgaggggcttatgtgccgtatgtctaacaaaccccatcctcgcccataccagggctccgggctcgggccaggaacatacttctttaagtctgatcttgaaacctatgttgcacgcagcgtcggtacaagggggccctacgacactttcagcggtgatcggagtaagcctttgccttacggacactacagtatgcagaaaaagaaaccacgggagctcatgaatttcaagtcatttgtagaggagctgaacagccaccacaacaagaagcacggggtcttttcaaaacttccgcggaatccgaaaactcctacggagagaatatactgggccaacctgtcccagtgcccaaggactctcgctacgagtggcccttccttctggttaccccaggagaaaaaatgtaagcccgtcaaccaacccccattcctgctcactagcaaagggtcaggagccaaggcgtgtcagatgattatgggctcgtggaatcccgtgggagtgggacggtacctcaatacctggcttatggagacaaaggacaggcgccaaaggtacaggagcctgtttctttctggatcaaagcgctacctgagcgacttggctcgggacatgttaatgcaggagcgcatcacaccctttaccaagggcaagtgcccaccaaccgtggactacaatagcgaccctaccccatag

SEQ ID NO: 27275 - DNA, 372 bp, Artificial Sequence
  Description of Artificial Sequence: Synthetic coding sequence
atgctgggccctaacgcacaggtgactgttgtggttgcccagcccggccccgaccatctggatcacctgcttctcgatacacaacattgccagcattcttcttgcggcagcgcggcgtgcacgcagctcacgtgggtcccctgccttgggggatcccacaaggcttcaataaaaatgagtgcccaggccgtggtttccacagaagctccttgggagcggccctgtttccaggcccacctcggttgtctccagaattcagttctttgctcatgtcgcatggagggcttcagcttattccttgctatgttgtggggcggcgtcggcgagctaccttccgatccgagggggcacttgcagtttcttgccacttag

SEQ ID NO: 27276 - DNA, 372 bp, Artificial Sequence
  Description of Artificial Sequence: Synthetic coding sequence
atgctggggccgaacgctcaggtaaccgtggttgtggcgcagcccggtcctgatcacttggaccacctgttactcgatacacagcactgccagcactccagctgcggatctgccgcgtgtacacagctaacctgggttccgtgcctcggtggctcccacaaggccagcattaagatgtcggcacaggcagtcgttagcactgaagctccttgggaacgaccctgtttccaggctcacttgggatgtctgcagaacagtgttctgtgtagctgccggatggaggggttttccttgttcctagcgatgctctggggcggggttggtgagctgccttcggatcccaggggccacctgcagtttcttgctacatag

SEQ ID NO: 27277 - DNA, 306 bp, Artificial Sequence
  Description of Artificial Sequence: Synthetic coding sequence
atgtcagtcgagaagatgaccaaagtggaagaaagttttcagaaggcaatgggactgaaaaagaccgttgaccggtggcggaactcccatactcactgtctctggcagatggccctcggccaacggcgcaacccatatgcaaccttacgaatgcaggacactatggtccaagaactggccctcgcgaagaagcagctgctgatggttcggcaggctgctctgcatcaattatttgaaaaagaacaccaacaataccagcaggagcttaaccagatgggaaaggctttctatgttgagcggttctag

SEQ ID NO: 27278 - DNA, 534 bp, Artificial Sequence
  Description of Artificial Sequence: Synthetic coding sequence
atggccaccaactattccgctaatcaatatgagaaagccttttccagcaaatacctgcagaattggtccccaactaaacctaccaaggaaagcatttcctctcacgaaggctacactcagataattgctaatgaccgcggacacctgctgccctccgtcccccgatccaaggccaacccctggggtagcttcatgggtacatggcaaatgcccctcaaaatcccacccgctagggtgacactgacgagcaggactacagcaggagctgccagcctgaccaagtggatccagaagaacccggacctgctgaaggcctctaacggactttgtccagaaatcctgggcaagccacatgacccagactctcagaagaaactccggaagaaaagcataaccaagactgtgcaacaggctagatcgcccactatcattccatcaagccctgcagccaatctcaactctcctgatgagctgcagtcttctcacccgtctgccggccacacaccaggacctcagcgacccgctaaatcctag

SEQ ID NO: 27279 - DNA, 510 bp, Artificial Sequence
  Description of Artificial Sequence: Synthetic coding sequence
atgccgcccactcgagatcccttccagcagccaacgctggataacgatgactcttaccttggcgaactccgcgccagcaaaaagctgccttacaaaaatcctactcacctcgctcagcagcaagagccatggtctaggctgaacagtacacctacgatcacctcgatgcggcgtgatgcttattacttcgatcccgagatccctaaggacgacttggactttaggttggcagctctctacaatcaccacaccggaacgttcaagaataagtccgaaatcctcctaaaccaaaagaccacacaggatacatacaggacgaaaattcagtttccgggggagttcctgaccccccccacccccccgatcacttttcttgctaatatcagacattggataaatcccaagaaagagagcattcactccattcaggggtctatcgttagtccccacacagctgctaccaatgggggctattcacggaagaaagacggcggattcttcagcacttag

SEQ ID NO: 27280 - DNA, 474 bp, Artificial Sequence
  Description of Artificial Sequence: Synthetic coding sequence
atggaacggagccccagccggcggagaagactagaggaagcccctaaactcccctacaagaatccaacccatcttgctcaacaacaagagccatggtcacgtcttaattccacacctactattacatccatgaggcgcgacgcctattattttgacccagagatccccaaagacgacctcgacttccgactagctgctctgtacaaccaccataccgggaccttcaaaaataagagtgagatcttgcttaaccagaagaccacacaagacacgtaccggaccaaaatacagtttcctggcgagtttctcaccccccctactcctcccatcacttttctcgcaaatatccgccattggatcaaccctaagaaggaaagcatccactccatccaaggatcgatcgtcagcccacataccgcagcaactaacggagggtactccaggaagaaagacggtgggttttttagcacatag

SEQ ID NO: 27281 - DNA, 381 bp, Artificial Sequence
  Description of Artificial Sequence: Synthetic coding sequence
atgccgtcttctactctgacctgcaaacccttcgacttgaagcagcggagcagccgccgcggtccgaagtcgactgcatccgcgtcaccacgttcttgcctcaaaccctcctgtggcaaacaggtgtgcttgttgctatctgtccgccggagccagtcactcgcacatccagggcgcgactctacacgagtgctaagctatcagcagacgtctagcgacgcggtaagtcagtataagcataccggaaaggtagaggagctttatggcctgcgactttcgtggctgtcccaagcccaatttctgctggcacaggataagacagcttatgctgtcaaaagcgtcgtgctccctgcctctaaccataaaacgaaaggacagtag

SEQ ID NO: 27282 - DNA, 216 bp, Artificial Sequence
  Description of Artificial Sequence: Synthetic coding sequence
atgcctagttcaaccctgacctgtaaacctttcgacctgaaacaacggtcctcgcgaaggggcccaaagagcacggcgagcgctagcccacgatcgtggattctgtcccagaaccccaaagctcagtcaagccatgagaaaacatctgggaagccaaagtttcgagaggtcttacaaaatactaatcagtacagctccaagtttagccgttcttag

SEQ ID NO: 27283 - DNA, 282 bp, Artificial Sequence
  Description of Artificial Sequence: Synthetic coding sequence
atgactaacacaaaagacccgaaaagagctatggaatccactctcgctacaagtaattctgcgaccgggcctgtgacattcagccacgtttttggacagcagtgccaactgatgcaggcagctgtgcagagtcttcacacactcaacgaccaaatatcccatttcatagtcacaaagtcaaaggctctggaagaggataaagatccattcctgcctacggagaaagaaacactgaagtcctccatgattctcatgaggcaccttctgatggacgcccagtag

SEQ ID NO: 27284 - DNA, 984 bp, Artificial Sequence
  Description of Artificial Sequence: Synthetic coding sequence
atggcctctatggcagcggccatcgccgcaagcaggtctgccgtgatgagcgggaatagaccattggacgatagagagagaaaaagattcacctactttagcagtctgtcccccatggctaggaagattatgcaggacaaggaaaaaattcgcgagaaatacggcccagagtgggccagattgcctccagcccaacaagatgagatcatagacaggtgcctggtgggaccccgcgctccggccccccgagatcccggggatagtgaggagctgaccaggttccctggcctgaggggaccgactgggcagaaagttgtgaggtttggtgatgaggaccttacctggcaggacgagcactcggcccctttcagttgggaaaccaaaagtcagatggaattcagtatttcagctctctccattcaggaaccgtctaacggaactgctgcttctgaaccacgccccctcagcaaagcctcccagggcagccaggcattgaagtcttcgcagggaagtaggtcatccagccttgacgccttgggacctacacggaaggaggaagaagcttctttctggaagatcaatgcagagagatcaaggggggagggacctgaagctgagtttcagtccctgactccatcccagatcaagtcaatggagaagggagagaaagtgttaccaccctgctaccggcaggaacctgcaccaaaagaccgcgaggcaaaggtagaacgtccgtctacactgagacaagagcaacgccctctcccaaacgtgtccacagagagagagaggccacagcctgtgcaagcgttttcaagtgctctgcacgaagctgccccatcccagcttgaaggaaaactgcctagccccgatgtgcggcaggacgacggtgaggatactcttttttccgaaccaaaattcgcacaagtcagtagtagcaatgttgtgctgaagaccggattcgattttctggataactggtag

SEQ ID NO: 27285 - DNA, 870 bp, Artificial Sequence
  Description of Artificial Sequence: Synthetic coding sequence
atggctcgaaagatcatgcaggacaaagaaaagattagggagaaatacggacctgagtgggcccgtcttccaccggcccagcaggatgaaataattgatcgatgtttggtgggaccacgagctcctgctcctcgagaccccggagacagcgaagaattgactaggtttcccggattgagagggccgacagggcaaaaggtcgtgcgctttggagatgaggatctaacttggcaggacgagcactctgccccattttcatgggagaccaaaagccagatggagttttctattagcgctctatccattcaggaaccatctaatgggacagctgcttcagagccgagacctctgagcaaggcatcacagggcagccaagcactaaaatctagtcagggttcccggagcagctccttggatgctctcggcccaacccgcaaggaggaggaggcctccttttggaaaattaatgcagaaaggtcccggggtgagggacctgaggccgaattccagtcactgacgccatctcagattaagagcatggaaaagggggaaaaggtgctaccgccctgctataggcaggaacccgccccaaaagaccgtgaggccaaggtcgaacgcccttccaccctgcgccaggaacagagaccactgcccaacgtctcgacagagagggaaaggcctcaacctgtccaggcattttctagtgcgttacatgaagccgctccaagccagctggagggcaagctgccctccccagatgtcagacaggacgacggcgaggacacgctgttttccgagcccaaattcgctcaggtaagttcaagcaatgtggtgcttaagaccggatttgattttttagacaactggtag

SEQ ID NO: 27286 - DNA, 594 bp, Artificial Sequence
  Description of Artificial Sequence: Synthetic coding sequence
atggagttctccatttcggcactgagtatccaagagccttccaacggcactgcagcttctgagccaagaccactgagcaaagcttcacagggatcccaagctctcaaaagctctcagggcagcaggtcctcgtccctggatgccctgggtcctactcggaaagaggaggaagcatccttttggaaaattaacgctgagagaagccggggcgaaggacccgaagcagaatttcagtctttgactccatctcagataaagagcatggaaaaaggcgaaaaggtcttaccaccttgttaccgacaggagccagcccccaaggaccgtgaagccaaggtagagcgtccctccactttgagacaagaacagaggcccctacctaacgtctcaacagaacgggaacgccctcaacctgttcaagcattctcgagtgccctacacgaagcggccccctcgcagctcgagggcaagctgccttcaccagatgtccgccaggacgatggcgaggacacactcttctctgagcccaagttcgcccaggtgagttcctccaatgtagttctcaagactggatttgattttctggacaactggtag

SEQ ID NO: 27287 - DNA, 504 bp, Artificial Sequence
  Description of Artificial Sequence: Synthetic coding sequence
atgcctagccagagcgcgtgtcccgttctctccacagcgcccggaacgccatgcgacctgaggaagcatctactgaatatggtgagtgaggagaaacgttctccacagctgagcgcgaaaacatggaggaggggcctaagactgcagaaaagacgcaatgcactctttctccccgaaggagacatttgcgtggtcggtagtactagcggagctagggcactgatcccagaaacttccaaattagagaggtcgggcactgtcatcgcctattgcaatctggaattattggccagctccgacccaccagtttgggcttcacagtctaccgggatgacaggcatgtcttaccgaagtcaaccacagctgggttttaaatcaactccacctgcacattcgtctgtcttccaccatagcgtgaaggcgcccaaagaggatcaagctcaggaggccgcttcacgaccattaactagccaggatggttggaaccccaacatcaaaaaatag

SEQ ID NO: 27288 - DNA, 864 bp, Artificial Sequence
  Description of Artificial Sequence: Synthetic coding sequence
atgaatgccctggcaaacatcccagatgtgccagtcaaatatcgcaagaacgatattcctggtcccggattctataacgtaatccaccaatctcccgtgtccaatagcgtgtctctctcaaaaaagggaacatgcatgttcccgtctatgtgtgccaggttggataccataataagtaagtatcccgcggcaaacgcctacaccataccttctgatttcatttccaagagagacttctcgaacagttgcagctctatgttccagttgcccagcttcatgaaggccctaaaattcgagacacccgctcccaactattacaacgctagcgtgtcctgctgcaagcaaagaaataatgtctgcacacgcgccggcttcatgtctaagacacagaggggcagctttgccttcgccgacaagggccccccaccagggcactacgacataaacgaatcacttgtgaaacagtctcccaataccctgatgtcgtgttttaaatcaaagacaaacagaggcctcaagctcacgtcaacaggcccagggccgggatattataacccttccgactgcactaaagtacccaagaaaactcttttcccgaaaaacccaatcctgaacttttccgcacagccctccccgctaccacctaaacctccgtttcccggtcccgggcaatatgagatcgtagattatctgggacctaggaaacattttatcagctccgccagtttcgtttccaacacatctaggtggacagccgcccctccacagccgggtctccccgggcccgcgacatacaagcccgaattgcccggcaagcagagttttctgtacaacgaagacaagaaatggattccagtcctctag

SEQ ID NO: 27289 - DNA, 1005 bp, Artificial Sequence
  Description of Artificial Sequence: Synthetic coding sequence
atggacaatagcgcccagaaaaatgagcgcactggcaagcatcccagaagagcttcggaggttcagaagggattcacagcagcctaccccacacaatctagtatccccttcaagtcacaggccagcgtgatccccgaaagcgagaaaaagggctttaacagccaggctaagcggttcccacacaagaagaacgacataccggggcctggattctacaatgtgatacaccagagccctgtgtccaactcagttagtctgagcaagaaaggcacatgtatgttcccttccatgtgcgccaggctggatacgataatttcaaaataccccgcagccaacgcatataccattccgtccgactttatttccaagcgggattttagcaatagttgtagctctatgttccagctgccctccttcatgaaggccctgaagtttgagacaccggctccgaattactacaatgcttcggtgtcatgttgtaaacagcggaataatgtttgtactagggccggattcatgtcaaagacacagagaggcagctttgctttcgcagacaagggccccccccctggtcattacgatattaatgaatccctggtcaagcagagcccaaataccttgatgagctgttttaaaagcaaaacaaacagagggctaaagttgactagcactggaccaggcccaggctattataatccttctgactgcacgaaggtccccaaaaagacccttttcccaaagaatcccatcttgaatttctccgctcagccttcccccctgcctccaaagcctccattcccagggcccggccaatatgagatcgtggactacttgggaccaaggaaacatttcatctcatctgcctcgttcgtcagcaatactagccgttggactgccgcccctccccagcctggcctgcccggccccgcaacatacaagcccgaactgcccggaaagcagtcctttctatataacgaagacaaaaaatggattccagtcctctag

SEQ ID NO: 27290 - DNA, 510 bp, Artificial Sequence
  Description of Artificial Sequence: Synthetic coding sequence
atgtgtgcgcgactggatacaattatcagcaagtatccagctgccaacgcctataccataccaagtgattttatcagcaaacgggatttctcgaattcctgcagtagcatgttccagttgccaagctttatgaaggctctgaagtttgagacccctgctccaaactactataacgccagtgtcagttgctgcaagcagcggaacaatgtgtgcacccgcgctgggtttatgtctaaaacccaacgggggagcttcgcctttgctgataagggtccacccccagggcactacgatatcaacgagtccctggtgaagcagagtcctaacacgttaatgtcttgctttaagtctaagactaaccggggactgaaactgacctccaccgggccaggaccaggatattacaatccgagtgactgcactaaagtgcctaaaaagaccctgtttcccggcggctcaaaggcctctgacctggccggacacctgcccaagagcacacagccgacatag

SEQ ID NO: 27291 - DNA, 1005 bp, Artificial Sequence
  Description of Artificial Sequence: Synthetic coding sequence
atggataactcagctcagaagaacgagcgtactgggaagcacccacggcgggcgtccgaggtgcagaaagggtttactgctgcatatccaacccagagtagtataccgttcaagtctcaggcatctgtaatccctgaatcagaaaaaaagggttttaacagtcaggccaagcggtttccgcacaaaaaaaacgatatccctggccccgggttttataacgttatacaccagtccccagtgtccaactccgtgagcctgtccaagaaaggtacatgtatgtttccaagcatgtgtgctcgtttggacaccatcatatcgaaatatcccgccgccaatgcttacactatcccttctgactttatttcgaagagggacttctctaattcatgctcttccatgtttcaacttccctccttcatgaaagcactgaagtttgaaacaccggcacctaactattataatgcatccgtgtcatgttgtaaacaaaggaataacgtatgtacccgagccggtttcatgagcaagactcagaggggctccttcgcttttgccgacaaaggcccaccacctggacactatgatattaatgaaagcctggtgaagcagagccctaataccctgatgtcctgtttcaagagcaagacaaatcgagggctgaagttgacgagcacaggacccggccctggatattataacccaagcgactgcacaaaggtgccaaagaagactctttttcctaagaaccccatcttgaacttcagtgcgcagcctagtccccttccgcccaagcctccattccctggcccgggccagtatgaaatagttgattacctgggccctcggaaacattttatttccagcgccagctttgtgtcaaatactagtcgttggacagccgccccacctcagcctggtctccctggaccagccacatataagcctgagctccctggcaagcaaagcttcttatacaatgaagataaaaaatggattccagtgctgtag

SEQ ID NO: 27292 - DNA, 435 bp, Artificial Sequence
  Description of Artificial Sequence: Synthetic coding sequence
tgatttacagcagcctaccccacccagtctagtatcccttttaaatcacaggcaagtgtgatccccgaatccgaaaaaaagggattcaactcccaggcaaagcgctttcctcacaagaagaacgatatacctggaccagggttttacaacgtcattcatcaatcccccgtgtcgaactccgtcagcctgagcaagaagggcacatgcatgttcccttcaatgtgcgcccgtctcgacacgatcatctctaagtatcctgctgccaatgcctacactattccctctgacttcattagcaaacgggatttcagcaattcatgctcttccatgtttcagctgcccagcttcatgaaggcattgaagttcgagacacctgcaccaaactattacaacgtgaggacacttccaatgctggccaaatatcgtagcaactag

SEQ ID NO: 27293 - DNA, 1152 bp, Artificial Sequence
  Description of Artificial Sequence: Synthetic coding sequence
atggacaatagcgcgcagaagaatgagaggactggcaagcaccctaggcgggccagtgaagtacagaaggggtttacagctgcgtaccctacacagtcctcaatcccctttaaatcccaggcaagcgttatcccagaatccgagaagaaggggttcaacagccaagcaaagcggtttccacataagaaaaacgacattcctggtccaggtttttacaatgtcatccaccaaagccctgtgtccaactccgtctccctcagcaaaaaaggtacctgtatgttccccagcatgtgcgcacgcctggacacgatcataagcaagtatccagccgcaaacgcctatactatccctagcgatttcataagtaagagagatttctcaaactcttgcagttctatgttccagctgcccagcttcatgagtaaaacgcagaggggttctttcgcctttgcggacaagggaccgccaccaggtcattatgatatcaacgagtcgctggttaagcaatcccccaataccctgatgagctgctttaagagcaaaactaatagaggtttgaagctgacatcgaccgggcccgggcccggatactacaacccttctgactgtacaaaagtgcccaaaaaaactctgttccctaaaaacccgatcctgaacttctcagcccaaccaagccccctcccgcctaaacccgcctggccaagctatgtgcaggccagagcgtcacgtaaagcagttctgcctctgcagcgcggccaggagatggatcctggctcagtaggcatgtcccacaaggtgaaagaaaattcttctcaccaaccaaccctgcccagtgtgccacgcacgtttctaagacgaagacctatcatgtccgtcgccgccgacaatctggggggaggatcaacgaccctggcctggcaccccagccgaactgcggctatcgcgtttgtgttgagctggcggcattgttctctcgaaaccagccctcaaccccaccggttacaatggctgccagagcagaagggaggggtggacagagccccttggttgctgccccacgctcctatccaggcagccttccggcatgactccctgccacagaccgaagggacccccgaggcacagactagcagacgaatatcacctccctag

SEQ ID NO: 27294 - DNA, 507 bp, Artificial Sequence
  Description of Artificial Sequence: Synthetic coding sequence
tgtgccaggctggatactataattagtaagtatcccgctgccaatgcctacacaatcccatcggacttcatttctaagagagacttcagcaactcttgcagctctatgttccagctgccttccttcatgaaggccctaaaattcgaaacgccagctccaaactactataacgcatccgtatcgtgctgtaaacagagaaacaatgtatgtacccgcgcgggttttatgagtaaaactcagagagggtcctttgcttttgccgacaaagggcctcctcccggccactatgacatcaacgaaagcctggtgaagcagagtccaaacaccctgatgtcatgctttaagtccaagacaaaccgagggctaaagctgacttcgacgggccctgggcctggatactataaccccagcgattgtacaaaagtacccaagaagacactgttcccaggcggaagcaaagcttccgacttggctggtcacttaccaaaatctacacaacctacgtag

SEQ ID NO: 27295 - DNA, 864 bp, Artificial Sequence
  Description of Artificial Sequence: Synthetic coding sequence
atgaacgcactggccaacataccagatgtgccagtcaagtatcggaagaacgacatacccggacctgggttctataacgtgatccatcagagccctgtgtccaactctgtgagtttaagcaagaagggcacttgtatgtttcccagcatgtgtgcaaggctggatactatcattagtaaataccctgcagccaacgcgtacacaataccttccgatttcataagcaagagggacttcagcaactcatgctcttccatgttccaactaccatccttcatgaaagccctaaagttcgagactcctgcgcccaattactacaacgcctctgtttcttgctgcaagcagcggaacaatgtgtgtacgagagcaggctttatgagcaaaacccagagaggttcgttcgccttcgctgataaggggccccctcctggtcattatgacatcaacgaatcactcgtcaagcaaagcccgaataccctcatgtcctgctttaagtccaagaccaataggggtctcaaactgaccagcacaggtcccggacctgggtattacaacccctccgattgcacaaaggttcctaagaaaacccttttccccaagaatccgatccttaacttttccgcccaaccgtcgcctcttccaccaaaacccccatttcccgggcctggccagtatgaaattgttgactaccttggcccccggaaacacttcatctcaagtgcaagtttcgtatctaatacaagtcgctggaccgctgcccccccacagccaggactgcccgggcctgccacctacaaacctgaactgcccgggaaacagagctttttgtacaatgaagataaaaagtggatccccgtgttgtag

SEQ ID NO: 27296 - DNA, 708 bp, Artificial Sequence
  Description of Artificial Sequence: Synthetic coding sequence
atgggtatgctggccccgggcccgctccagggaagacgacccaggaagggtcacaaggggcaggaggacgccgtggctcccggctgtaaggcctctggcaggggcagcagagtgacccatttattaggctaccctacccagaatgtttcacgcagtctgcggcgtaagtatgctccacccccatgtggaggccctgaggatgtggcactggccccatgcaccgctgccgctgcctgtgaagccggcccgagccccgtttatgtaaaggtcaagtctgccgagccagctgattgtgcagagggccccgtacagtgtaaaaacggactcctggtatccagccctcattgtgaagagccttgtgctcacagctgcgcccatccaggtttgcctccccaccttgtacacaagttacccctgagttatcttcagactcaggacactgatgctgctagtaggcggattaatgcgcccttggctgccggatggagctggctgcggctgtggctggtcaccttagccagcggtgttgactttcctcaggtcagcgcttggatgcgtgccctgcccagccctgattgtcccggcctgcggacaaccggggaacagatgcagaagttgctacttaaggaaaacaaggtcaagactcgaaagtccaaacgacggagtggagagggctcacatttgaccacctctatccttgagcaatag

SEQ ID NO: 27297 - DNA, 366 bp, Artificial Sequence
  Description of Artificial Sequence: Synthetic coding sequence
atgggctgcgccagtgctaaacacgtggcaaccgtgcaaaacgaggaggaagcccaaaaaggcaaaaactaccagaacggggatgtatttggggatgaatatcgcataaagcccgttgaagaagtcaagtatatgaagaatggcgcagaagaagagcagaaaatcgctgctcgcaatcaagagaatctggagaagagcgcgtcttctaacgtgagacttaagaccaataaggaagtccccggcctggtgcaccagccaagggccaatatgcatataagcgaatcacagcaggagttttttagaatgttggacgaaaaaatcgaaaagggacgtgactactgctccgaggaggaagatatcacatag

SEQ ID NO: 27298 - DNA, 264 bp, Artificial Sequence
  Description of Artificial Sequence: Synthetic coding sequence
acaggcaatcaccatagtacattctgtctacacgagttcgactacagccgtttactttgcatactcgagaaatttctgtgtgacactgagaaatcggccagctccaacgtgcggcttaagaccaataaagaggttcccgggctcgttcaccagccccgcgccaatatgcacatctctgagtctcaacaggagtttttcaggatgctggatgagaagatagagaagggcagagattactgttctgaagaggaggatatcacctag

SEQ ID NO: 27299 - DNA, 279 bp, Artificial Sequence
  Description of Artificial Sequence: Synthetic coding sequence
atgtggccagtgttttggacagtggtgcgaacttacgccccgtatgtgacattccctgtcgcgtttgtcgtcggcgcagtggggtatcacttggaatggttcatcagggggaaggacccacagccagtggaagaggaaaagtccatctccgaaaggcgggaagatcgcaaattagacgaactgctcggtaaggaccacacccaggtggtgtcattaaaggataagttggaatttgcgcctaaggccgtgttgaaccggaatcggccggagaagaattag

SEQ ID NO: 27300 - DNA, 279 bp, Artificial Sequence
  Description of Artificial Sequence: Synthetic coding sequence
atgtggccagtgttctggaccgtggttagaacatacgccccctatgtgaccttccccgtggccttcgttgtgggggccgttggctaccacctcgaatggttcatccggggtaaggatccacagcctgtggaggaggaaaagtcaatcagcgaacgaagagaagacagaaaattagatgaactcctaggcaaagatcacacccaggtggtgtccctcaaggataagctcgaattcgccccgaaagcagtactgaaccgcaaccgaccggagaagaattag

SEQ ID NO: 27301 - DNA, 279 bp, Artificial Sequence
  Description of Artificial Sequence: Synthetic coding sequence
atgtggcctgtattctggactgtcgtgcgtacatatgctccctacgtgacattccctgtcgcatttgtcgtaggagcggtcggctatcatcttgagtggtttatccggggcaaagatccccaaccggtggaagaagagaaaagcatttcagagaggcgcgaagacagaaaactagacgagctgctgggcaaggaccacactcaagtcgtgtccctgaaagacaagctggagttcgcccccaaggccgtactcaacaggaaccgtcctgagaaaaactag

SEQ ID NO: 27302 - DNA, 279 bp, Artificial Sequence
  Description of Artificial Sequence: Synthetic coding sequence
atgtggcccgtcttctggacagtggtgcggacatacgcaccttacgtcacatttccagttgccttcgtggtcggcgcagttgggtatcacctcgaatggttcattcgggggaaggatccacagcccgtcgaagaagagaaatctatttcggaaagacgtgaagaccggaagcttgatgagttactgggaaaggaccatacacaggtggtttcacttaaggataagctggaatttgcgccaaaggctgtactcaacagaaaccgacccgagaagaactag

SEQ ID NO: 27303 - DNA, 279 bp, Artificial Sequence
  Description of Artificial Sequence: Synthetic coding sequence
atgtggccggtgttttggactgtcgtcaggacgtatgccccttatgtcacgttccccgtggccttcgtagtaggcgctgtgggttaccatctggagtggttcatcaggggaaaagaccctcagccagtggaggaggagaagtctatcagcgagcggagggaggaccggaaactggacgaactcctgggaaaagaccatactcaggtcgtttccctcaaagacaagctcgaatttgcacctaaggctgtcctcaatagaaataggcccgagaaaaactag

SEQ ID NO: 27304 - DNA, 381 bp, Artificial Sequence
  Description of Artificial Sequence: Synthetic coding sequence
atgctggccgtgcctgtccgactgaaggttgggtctcggaagcccgagtggggaacaaacagactcacctcctgcccagcaaaggatcctctcgatcgaagactgcagaacttacgagatcgagagagagtacctgagccccagcgcagtctgcgccccggggtgcaggaagatagccgagaacacgggcaggttccagaggtttcggacccccaggtggacctcgaatttgtggatctccaggcaaagccccgctataggcggcttatcctgaagacacaaattccggaggcctcagactcccaggcagcgcagaagcctcaagcccaccgccagattccagagaccacagaagccggaagggagacgacttctaactag

SEQ ID NO: 27305 - DNA, 690 bp, Artificial Sequence
  Description of Artificial Sequence: Synthetic coding sequence
atgttcgccatccagcccgggctggctgaagggggacaattcctgggagaccctcctcctggtctctgtcagccagagttacaacctgatagcaattccaacttcatggcttccgccaaggatgcaaatgaaaattggcatggaatgccagggagggtggaacctatactgcggcgaagtagttccgagagcccttcagacaatcaggcgtttcaggcacctggcagtccagaggaaggggttagatctcctcctgagggtgcggagatcccgggcgcagaacctgagaaaatggggggtgccgggaccgtttgctctcctctagaggacaatggatatgcatcctcttctctttctatcgactcacgctcctcatcccctgaaccagcctgtggcaccccacgggggcctggaccaccggacccgttactaccttccgtagcacaagccgtacagcatttacaggtgcaggagcggtacaaagagcaggagaaggagaagcaccacgttcatctcgtgatgtacagacgcctagccctcctccagtggatccggggactccagcaccagctaattgaccaacaggcacgcctgcaggaatcgtttgatacaatcctcgacaaccggaaagaactgatccgctgtttgcagcagcgtgctgctcccagccggccccaggaccaagcatag

SEQ ID NO: 27306 - DNA, 600 bp, Artificial Sequence
  Description of Artificial Sequence: Synthetic coding sequence
atgtttgctatccaaccaggcctcgcggagggcgggcaattcctgggggatccaccaccggggctctgccagcccgaactgcagcctgacagcaactcaaatttcatggcatccgcaaaagatgccaacgagaactggcatggtatgcccggacgggtggagcctatcctcagacgttcgtcctccgagtcgccgtctgataatcaggcctttcaggctccagggagcccacttgaggataatggctatgccagcagcagtctgtccatcgactctagaagttcctcccctgagcccgcctgcgggactccccgtggacctggacccccggaccccctcctcccatcggtggctcaggcggtacagcatctgcaggtacaagagcggtacaaggaacaagagaaagagaaacaccacgtgcatttagtcatgtacaggcgtcttgccctgctccagtggatcagggggctgcagcaccagctcattgaccagcaggcacggctacaggagagctttgataccatcctcgacaataggaaggagttgattagatgtctgcagcagagggccgctccctccaggccccaggaccaggcatag

SEQ ID NO: 27307 - DNA, 321 bp, Artificial Sequence
  Description of Artificial Sequence: Synthetic coding sequence
atgccggacgcccaattccataggatcatggcatccgagaagctgagcttcatacgcgtgcaagaaaacgaatactcattaaactcagtgcgagcctcgggctttcagcgtgttttgaacctgcttgaaagctccctactatggctatacctgcccacaacagagaacctcctctgttcatccccaaggctgagcggagatcccaccgggtacgcggacccaccgccccagaaccaccgccgcaggcagtccaggtccacgccccgtcttcccggacccggccagctgctgagttccaggactcgaacacttgagggatag

SEQ ID NO: 27308 - DNA, 2289 bp, Artificial Sequence
  Description of Artificial Sequence: Synthetic coding sequence
atggaggacgacgggtccctgcttccagaagacgagctgttggcggatgctctgctgctcgaagatgaacgggatgaactcgaagatccagagttcgatataaaatgcttgttgcaggaagcagaagacgacgtcgaccccgggcacagttcttctgtgaaagaactggacaccgatgcggacaaactgaaaaaaaaaacagcagaggatcggactcaagcgtttcatctgaggcagaacttgtccgcgctcgataagatgcacgaagagcaggagcttttcaccgagaaaatgcggggcgaattgagagcttgtcggcagagacgcgatctaatcgacaagcaacaagaggccgtggctgccgagattgctacggaggaagaggctggcaatatggcggccgtgggccggcttcaggctgtgtctcggaggctgttcgccgagctggaaaatgagcgggatctgcaaagccgaaccgaggccgtgctgaaagagagcgaaaataccatgtggcatattgaaatccaggagggtaggttggaggcctttagaaccgcagaccgtgaggaggtcgaagccaccggcagaagactgcaggttagagctgcagaacagctgtgcagggagcaggaagctctgggtaaggtcgagaggaatcggttgctgagaatcaggaagagcctgaatacccagaaggaactcgggctcaggcatcagaaactactggaagatgcgcgcaagaaccataaggtggccgttaggtttctgaaagccagtctagggcggataagggagcaagaaaagaaagaggagatggaatgccatgagtatatgaggcgtcgtatggatgccgtcgttgctctcaagggatctatatccgccaatagagacactctccgtaaatttcaggcatgggaccgcgctaaggctgaattagctgagcagcgcgtccaggccgagaagaaagcaatactcgcacagggtcgggatgctttccggcaccttgtgcaccagaggcgtaggcaggaactggaggcacagaaaagagcattcgaagaagaacaaaaacttagaaaacaggagataatctctagaatactcaaggaagaggctgaggaggaaaagaggaaaaaacagcatccacccacaagtgcccggcacagactgacacttagggataaaacgtggaactatatctccgatttctgcaaaaagacaaccgtacccaccaacacctacaccctagactatgaggctgcggcaggaccgggcccttcccgcctgctcgaggtcgtgagttccgaactgattcagggggaccctggcgcaagtagtgaggaggaaaccttggccgaacctgaaatttccggcctgtggaacgaagactacaagccttatcaggtcccgaaggaagacgtggacaggaaaccagtggggggtaccaagatggataaagatattctggaaaggaccgtcgaacggcttcgctcacgggtggtccacaagcaggtggtctgggggagagaatttcaaggtcgtccttttaatagtaaaccagagctgttgcacttccaggacttcgacattggtaaggtctataagaagaaaatcacgctggtgaatacaacctacaccatcaattactgcaagcttgtcggcgtcgaggagcatctgcgggattttatccacgtggatttcgacccccctggcccactgagtgccgggatgtcgtgcgaggtgctcgttaccttcaaacccatgataaacaaagatcttgagggtaacatctcctttctggcacaaacaggcgaatttagtgtccctctgaagtgttccactaagaaatgcagcctttcactggacaaggagctcatcgactttggctcgtacgtggtcggagaaactactagccgaaccatcactctgacaaatgtgggcgggctcgggactacctttaaatttctgcccgccagcgagccctgtgaaatggacgacagtcagagcgccctgaagctgtcctccctgttgacttacgaggataagtccctttacgacaaggccgccacatcttttagcgagcaacagctggaagggacagagagcagccaagctgatatgcaatctaggaaagaattggaaaagctggacaaggaacaggaggaggaacagcctgcaggcgagcccggatgtcaggctaagcctggctgggctggcggcgaaggtctgcgggctgcttttcaaggcgcagaaggacctagaggaggtctcgaatccagggagttcagctag

SEQ ID NO: 27309 - DNA, 306 bp, Artificial Sequence
  Description of Artificial Sequence: Synthetic coding sequence
atggaagacgatggctccctgctacccgaggatgagctgctggctgacgctttacttctggaagatgagcgtgatgaactggaggatccagagttcgacataaagtgcctacttcaagaagctgaggatgatgttgatcctggacactcctcttctgtcaaggaactggacacagacgccgacaaattaaagaaaaagaccgctgaggatcggacacaggctttccatctccggcaaaacctcagcgccctggacaagatgcatgaggagcaagaactgtttactgaaaaaatgagcgtttcttag

SEQ ID NO: 27310 - DNA, 516 bp, Artificial Sequence
  Description of Artificial Sequence: Synthetic coding sequence
atgttcgaaaatctcaatactgcacttactcccaagctgcaggccagtagatcattcccacacctgtctaagccggtggcccccggcagcgcacccctcggttctggtgagccaggcggcccagggttatgggttgggagtagccagcacctcaaaaacttgggtaaggcgatgggtgctaaggtcaatgattttctgaggcgcaaggagccttcctctctagggagcgttggcgtcaccgaaattaataagactgcaggagcacaactggccagtgggaccgatgccgcccccgaagcctggctcgaagatgaacgttccgtgctgcaggaaacctttccacgactggaccccccacctccgatcacacggaaaaggactcctcgtgccctcaaaactactcaggacatgcttatttcttcccagccggttctgtctagtctagagtacggaactgagccctcccctggccaagcacaggattctgctcctaccgctcagccggacgttccatag

SEQ ID NO: 27311 - DNA, 948 bp, Artificial Sequence
  Description of Artificial Sequence: Synthetic coding sequence
atgttggttctggtggcccaggctggcggcgatacacttaaggtcacaggacactatgtgaagtgtgttttcctcttgttcgtgtcccatctcttaagcgagcccctgtcgcgaacagttgaccatggaatgttcgagaacctgaataccgcacttacacccaaactgcaggcctctaggtctttcccccatttatccaagccagtggcccctgggtctgccccactagggtcaggcgagcctggaggcccgggcttgtgggtggggagttcccaacatttgaagaatttaggcaaggccatgggagccaaagttaacgattttttgcggagaaaggaacccagtagtttgggctctgtcggcgtgactgaaatcaataaaactgcaggtgcacagttagcttcagggaccgatgcggctccagaggcgtggctggaggacgagaggtcagtccttcaggagacatttccacgcctggatccccctccaccaatcacgcgaaagaggaccccacgagctcttaaaacaactcaagatatgctaatttcctcccagccagtgttgagttcactcgaatatggcactgagccatctccgggccaggctcaggattctgccccaactgcccaacctgacgtgcctgcagacgcttcacaaccggaggccactatggagcgcgaggagcgtggtaaagtgctgcctaatggagaagtgtccctatctgttccggatttgattcacaaggactcccaggacgagagcaagctaaaaatgacagagtgccggcgtgcctctagcccttccctgatcgagcgaaacggctttaaactgagcctctcaccaatcagtcttgccgaatcatgggaagatggatctccaccaccgcaagctcggacatccagcctggacaacgaggggccgcaccccgacctgctgagcttcgaatag

SEQ ID NO: 27312 - DNA, 819 bp, Artificial Sequence
  Description of Artificial Sequence: Synthetic coding sequence
atgttcgaaaatctgaacaccgcgttgacacctaagcttcaggcttcccgctcctttcctcacctctcaaaaccagtcgcacccggctcagcccccctgggaagcggggagcctggtggtcctggcttgtgggtgggctcctctcagcatctaaagaacttgggcaaggccatgggcgccaaggtgaacgacttcttgagacgaaaagagcctagtagtctaggttcagtcggggtgaccgagatcaacaaaaccgccggggctcaactcgctagcggcactgacgccgccccagaggcctggctggaagacgagaggagcgtgctccaggagacctttccccgcctggatccacctcctccgatcacccggaagcgcactcctcgcgcactgaaaaccacgcaggatatgctaatctccagtcagccagtgctatcctctctggaatacggaaccgagccctcccctggccaggcccaggattcggcccctacggcgcagccagacgttccagctgatgcaagccaaccagaggctactatggagcgcgaggagcgaggcaaagtgcttcctaatggcgaagtaagcctctctgtgcctgacctgattcacaaggactcccaagatgagtctaagctgaagatgaccgaatgccgtcgtgcctcatccccgtccttaatcgaacggaacggcttcaaactctctcttagccccatctcactagcggagagttgggaagacggatctcctcctccacaggcgcgcaccagcagtctcgacaacgaagggccgcacccagatttactgagcttcgagtag

SEQ ID NO: 27313 - DNA, 297 bp, Artificial Sequence
  Description of Artificial Sequence: Synthetic coding sequence
atggcctccatcaaccgcacaattgagattatgaaaaaacatggggtcagtaaacagcacctcctggaagaaataaacaaaaagagggagtcaaactgcctcgtggaacgctccaaccaagtgtcccttctgagggtccagaagcggcactttcccgatgcctaccagtcatttaccgacacgacaacaaaagagccagtgccaaatagtggccgatcttcatggattaagttgagcttactagcgcatatggagagaaaacatttccctcctaagaataatgctatcttcggctag

SEQ ID NO: 27314 - DNA, 1323 bp, Artificial Sequence
  Description of Artificial Sequence: Synthetic coding sequence
atgactagcatcaaagagcaggccgccatttctcgcttgctgagcttcctgcaggaatgggataacgcaggcaaagtggctcgttcccatatcctcgacaagtttattgaaactaaccagggaaagaccgcccccgaactggagcaggaattttcacagggagcctctctgtttcttgtgaggctgacaacatccctacggattacgtacatgaccgacagttgtctggaaaagctcctccgaagtatcggcatctttctgtctgccgtaagttccaacaggtatttaatagagttcctagaggtaggcggtgttttgaccctgttagaaatcctgggcctcgaaaaaataaaggaggaggccaaaaaagaatcagtcaaattgctgcaggtgattgccaattcaggccgcacatataaggaattgatctgcgaaagctatggagttcgaagtattgctgagttcctggcaaaatccaaatccgaggaaacacaagaggaagtacaagtcctactggactccttggtgcatggcaacccaaagtaccagaaccaggtctacaaaggactgatcgctttgctcccatgtgaatcccctaaggcccagcagctttccctccagaccctgcgcacggcgcaacctatcatcggcacgacgcatccgtctattgttgactgcgtgctcaaggtcctgggaaccatgcacttggaagtccagtatgaagctatcgaactgattaaggatctggtgggatacgatgtccgtcaggcattgcttaagggccttgtggccctcctgatcccctctgtgaaggagatcagcaagttgcaggcgaaaatcctctctgacccctctgtacttcagttgaccccaagcctgccgatgtttcttcagcaggccgcggccgcaaaggcaatcggagtgctggctaggaacgatatgagtattgcagaggagctgctatatctgagagttgtcagaggccttatggctgcgatgggaaatacagaccattcaaattctcagcgcctcgcctcacttaccctggaatgtttcgtgcagatgttcccacttgtagctgagcacgtgagaaagtgcatgggcgaggaactgtaccaactgttcctgagcaacgccgaggacctctacatgaaaatagactctatccaggccgacatcttagcagcaaatacggtcaacgtgactaaggccttatgcctgcacggctcctcctatagcatgaacacactgtacgggtcaagagattccgctcagatggcctatctgacccacttcgaggaagatgtggaaagtaaggaatag

SEQ ID NO: 27315 - DNA, 1323 bp, Artificial Sequence
  Description of Artificial Sequence: Synthetic coding sequence
atgaccagcatcaaggaacaggcggccatctcacgcttactcagcttcctccaggaatgggacaatgccggcaaggtagcccgctctcacattctcgataagtttattgaaaccaatcaggggaaaactgcgccggaattagaacaagaattttcccaaggagcctccctcttcctagttcggctgacaactagtctcagaatcacttatatgaccgactcctgcctggagaaactgttgcggagtattgggatttttctctctgctgtgagttcaaaccgatacctcattgagtttctcgaagtaggcggggtcctgacactcctggagatcttggggctagagaaaataaaggaggaggccaaaaaagagtcagtgaaactcctacaggtgatcgctaattccggtagaacttacaaagaactcatttgcgagtcctatggagttcggtctattgccgagtttcttgcgaagagtaaaagcgaagaaactcaggaggaggtacaggtcctactcgatagcctcgtgcacggaaatccgaaatatcaaaaccaggtttacaagggtctaattgcgttgttgccttgcgaatctcccaaggcgcaacaactcagcctgcagacgttgaggaccgcccagcccataatcgggaccacccacccaagtatagtggattgcgtgctcaaagtactaggaaccatgcacctggaggtgcaatatgaggccattgaactcattaaggacctggtcggttacgacgttcgacaggctctcctaaaggggttagtggcactcctcatcccttctgtgaaggagatttcaaaacttcaggctaagatcctgtctgatccctcagtgttacagctgacaccctcactccctatgtttttacaacaggccgcggccgcaaaggcgatcggagtcctggcaaggaacgacatgtcaatcgcagaagagttgctctacctccgcgttgtgcggggcctcatggcagcgatgggtaacactgaccattccaacagccagaggctggctagtctgaccctggaatgctttgtgcagatgtttccactagttgcagagcatgttcggaagtgcatgggcgaagaactataccagctgttcctctctaatgctgaagacctctatatgaagatcgactcgattcaggctgacatcttggccgccaataccgtgaatgttaccaaagccctctgcctgcacggatcttcttacagcatgaacaccctctacggttcacgcgacagtgcacaaatggcttacctcactcatttcgaggaagacgtggagtcgaaggagtag

SEQ ID NO: 27316 - DNA, 714 bp, Artificial Sequence
  Description of Artificial Sequence: Synthetic coding sequence
atgggtttgtgcactctccagcctctgggccccccaaggaagtcttctacaagctgcggtacctggaccgcctccggcctgccatccctcggacacctgccaagacgcctgcgtcttgccttcgattttctagaaccccgcgcccgcggacagcgcggaggcagcggcggatgccaaagcacacgtgcagctgagcggacccgtccaccccacccacccaatgctgtcctgttgttgcagcccgaaccctctctgacttgggcccagggccgcggctgtcgaggccacttccgatcgttgcctgcggcagcgtcccgctccggatccaggaccttgcgctgtgcctccagtgaccgcagtctgcgagagcagaaacagcgcagggccggtcccgacccaactccaagtcccgctccaccccctgctggaccgcgcccatcccccgggtccctgggcccttccgctcctgccgctccccgcaccgcccgaggcgcttatgaattacaggggggagcttcccaggacgggccaggacaggccgctgtcggcgccacacctaccaccggtcccggaaccggaggtgaaggggctctgctgggctgcggcagcgggagaacacccccaacctctgcaacgtggagacggcgactgttaccagcagaggtgcctcccggagctgccgctgccaacttcccagagagggagagactatag

SEQ ID NO: 27317 - DNA, 681 bp, Artificial Sequence
  Description of Artificial Sequence: Synthetic coding sequence
atgagagcaccccccctcttactgctgctggccgcctgcgcccctcctccatgcgcagcagctgctcccaccccacccggatgggagcccacacctgatgcaccttggtgtccatataaagtgctgcccgaagggccggaagcaggaggcggacggctgtgtttcagatcccctgcccgaggcttcagatgccaggccccaggttgcgttctgcacgccccagctgggaggagcctccgagcatctgtcttgcggaatcgatccgtgctcctgcaatggcggctggcacccgctgccgcccgccgcgtgcgtgcatttgctctcaactgtagctggagaggagcatacaccagatttccctgcgagagagtgctgctaggagcttcctgccgtgattacctgctgcctgacgtgcacgactcggtgttgtaccggctgtgccttcagcccctccccctgcgagccggcccagccgcggccgccccggaaactcccgagcccgcggagtgcgttgaatttacagcagagccggctggaatgcaggacattgttgtggcgatgaccgccgttgggggctcaatctgtgtcatgctggtcgtaatttgtctgctggtagcttacatcacagagaacctaatgagacccgccttggctcggccagggcttaggagacatccctag

SEQ ID NO: 27318 - DNA, 792 bp, Artificial Sequence
  Description of Artificial Sequence: Synthetic coding sequence
atgttcggctcttccaggggaggtgtccgaggcgggcaggaccagttcaattgggaagatgtgaaaacagataagcagcgcgaaaattatcttggtaacagcctcatggccccagtgggtcgttggcagaaaggaagagatctcacctggtatgcaaaggggcgtgccccctgtgccggccccagtcgcgaggaagagctcgcagctgttcgtgaagcagaacgcgaagcccttttggccgccctaggatacaaaaatgtgaagaagcagcctaccgggctgagtaaggaggatttcgcagaggtctgtaaacgggaaggtggcgatcctgaggaaaaaggggtagatagacttctgggactgggaagtgcttccggctccgtaggtcgtgtggcaatgtctcgggaagataaagaagcagcaaagctgggcctttcagtgttcactcaccacagagttgagtctggcggcccggggactagcgctgcttctgccagacggaaaccccgcgctgaggatcagaccgaaagtagctgcgagtcccaccgcaagtctaaaaaggaaaaaaaaaagaagaaaaaaaggaagcataaaaaagagaagaaaaaaaaagacaaggagcataggcggcccgctgaagcgacatccagcccaacatcacccgagagaccacgccatcaccatcacgactctgatagcaacagcccctgttgtaaaaggagaaaacgcgggcacagtggggaccggaggagcccctcccggaggtggcacgacagaggctcagaagcctag

SEQ ID NO: 27319 - DNA, 1545 bp, Artificial Sequence
  Description of Artificial Sequence: Synthetic coding sequence
atggagccagttcccctgcaggatttcgtgcgcgcgctagatccggccagcttaccacgcgtacttagagtctgcagtggtgtttattttgaaggtagcatctacgagatatccggcaatgagtgctgcctatccactggggatctgattaaggtgacccaggttagattgcagaaggtggtgtgcgagaatcccaaaacttctcagactatggagctcgcccccaattttcagggttattttaccccactgaacactccccagtcgtacgaaaccttggaagaattagtatcagccaccacccagtcatctaagcagcttcctacctgcttcatgagcactcatagaatcgttacagagggtcgggtcgtgactgaagaccaactgcttatgctagaggccgttgtaatgcatttaggcatccggagcgctaggtgtgtccttggaatggaggggcagcaggttatacttcacctacccctatcacagaagggacccttttggacctgggagccaagtgctccacgcacgctgctccaggtccttcaggatcctgccctcaaagacctggtgttgacctgcccgacgctgccttggcattccctgatcttgcgcccccagtacgaaatccaggccattatgcacatgaggcggactattgtgaagatcccgtccactcttgaagtggatgtggaagacgtcactgcctcatcgcgacatgtgcactttataaagcctctcttgctgagcgaggttctggcctgggaagggccctttcccctgtctatggaaatcctggagcgattaagcgatcaggccggggaagacgaggaggaggagtgtaaggaggaagccgagtcaccggaaagggtgctacttccattccactttcccggctctttcgtggaagagatgagcgattcaagaagatactcactagcggatctgactgcccagtttagcctgccttgtgaggttaaggtggtagccaaagacacttctcaccctaccgatcccctcacctctttccttgggctccgtctggaagagaaaattactgaaccgttcctggttgtgtctctcgactcagaacctggcatgtgttttgagatcccacctcgctggctggatctgaccgtggtaaaggcgaaggggcaacctgacctgccggaggggtccctgcccatcgccacagtagaagagttgactgacaccttttactaccgcctgcgtaaactccctgcttgcgagatccaggcgccgcctcctaggcccccaaaaaaccagggactgtctaagcagcgaaggcactcatctgaggggggggtaaagtcctctcaggtcctagggctccagcagcatgccaggctgccgaaacctaaggccaagacactcccagagttcattaaggacggctcatctacttattctaaaatacctgcacaccgcaaggggcatagaccagctaaaccccaaaggcaagacctcgatgatgatgagcacgactatgaggaaattcttgagcagtttcagaagactatatag

SEQ ID NO: 27320 - DNA, 1932 bp, Artificial Sequence
  Description of Artificial Sequence: Synthetic coding sequence
atggagcctgtcccccttcaggacttcgtccgcgccctagaccctgccagcttgccacgtgtgctgcgtgtttgtagcggcgtatactttgagggttcaatttacgaaatttccggaaacgagtgctgtctttctacgggagatctgatcaaggtgacacaggtccgccttcagaaggtcgtatgtgaaaatcccaaaacctctcagacaatggaacttgcaccgaattttcagggctactttacacccctcaacaccccccaatcctacgagacactggaggagttggtctcagcgactacacagtcatcgaagcaactcccaacctgctttatgagtacccaccgaatcgtgacagaaggtcgtgtcgtgactgaggatcagctgttgatgctggaagctgttgttatgcaccttggcatccggagtgcccggtgcgttcttggaatggaaggtcagcaggttatactccacctgcccctgtcacagaaaggccctttctggacatgggaaccctccgccccaaggacacttctgcaagttctgcaggaccccgctctgaaggatcttgtgctcacatgccccaccttaccttggcactccctgatccttcgcccccaatacgagattcaagccataatgcatatgaggcgaacaatcgtgaagattccgagtactttagaagtggatgtcgaggatgtgacggccagttctcggcatgttcacttcatcaaacccctcctattatccgaggtgctggcttgggaaggtccttttccactgagcatggagattctggaagtccccgagggtcggcctatctttttatccccgtgggtcggatcgctgcagaaaggtcagcggctgtgtgtgtacgggttagcctcaccaccctggcgggtcctcgcatcttccaaaggccgtaaggtgccccgacatttcctcgtatcggggggttaccaggggaaattgaggcgccgcccccgggaattccccaccgcatacgatttgctaggggcctttcagccgggcagaccactgcgcgtagttgctaccaaagactgtgagggggagagagaagaaaaccccgaattcacgagtctcgcagtaggcgaccggcttgaggttttagggccaggacaggcccatggagcccaaggtagtgatgtagacgtgttggtttgccaacggctctccgaccaagctggtgaagatgaagaagaagagtgtaaagaggaggccgagagcccagaacgcgtgctcctgcccttccatttccctggaagctttgtcgaggaaatgtctgacagcaggaggtactcgttagcggacctcactgctcaattttccttgccatgtgaggtgaaggtggtcgccaaagatacaagtcatcccaccgatccactaaccagctttctggggcttcgcctcgaggaaaaaataaccgagcctttcctcgtggtatcactcgactccgagccagggatgtgtttcgagatcccaccccgctggctggacctgaccgtcgtgaaggcgaaaggtcagccagatttgcccgagggatcattgccaatagcaacagttgaagagttgactgacaccttctattaccgccttcgaaagttacctgcatgtgaaattcaagcccctccacctcggcccccgaagaaccaggggctgagcaaacaacgaaggcactctagcgagggaggcgtaaagagctcacaggtattgggactccagcagcatgcccgtctgccaaagccaaaggcaaagactctgccggagttcattaaggacggatcatcaacttacagcaagattcctgctcaccgcaagggccacaggcccgctaagccccaacgtcaggacctagatgatgatgaacatgactacgaagagatcctggagcaattccaaaagaccatttag

SEQ ID NO: 27321 - DNA, 783 bp, Artificial Sequence
  Description of Artificial Sequence: Synthetic coding sequence
atggagcctgtgcccctacaggatttcgtccgggctttggacccagctagcctacccagagtgttaagagtgtgtagcggcgtctactttgagggctctatctacgagatttctgggaacgaatgctgtttgtcaaccggcgacctgatcaaggtgacccaggtacggctccagaaggtcgtgtgcgagaatcccaagacaagccagaccatggaactggccccaaatttccagggctactttactcctctcaatacaccacaaagttacgaaactctcgaggagctcgtgagtgccactacccaatctagcaaacagctgcctacctgtttcatgtcgacccataggatagttacagagggccgcgttgtgaccgaagaccagttgctgatgctagaggccgtggtcatgcacctcgggatccggtctgctagatgtgtgctgggcatggagggtcagcaggttattctgcatttacctctctctcagaaaggacctttctggacgtgggaaccttccgcccctcgcactctcttgcaggtcttacaggaccccgcactgaaggatctggtgctcacgtgccccactctcccatggcacagccttatcctccggcctcagtacgaaatacaggccataatgcacatctttagttctcttagaattgcagctacacgaagcgccgcacagactcagggggaggacctcgccagagttcaccagggatggctgcagtacgtacagcaagattcttgtccccaggagggaccacaggcacgctag

SEQ ID NO: 27322 - DNA, 372 bp, Artificial Sequence
  Description of Artificial Sequence: Synthetic coding sequence
atggaacccgtccctttgcaggattttgtccgggccctggatcctgccagccttcctcgagtgctgcgcgtctgctccggcgtgtattttgaaggaagcatttacgagatctccggaaatgaatgctgcctctccaccggggacctcatcaaagttactcaggtgcgccttcaaaaggtggtttgtgagaaccccaagactagccagactatggaactagcgccaaactttcaggttttcagcagtctgcgaattgccgccacacggtccgccgcacagactcagggtgaggatttggctcgtgtgcatcagggatggttacagtacgtccagcaggacagctgtccccaggaggggcctcaggcccggtag

SEQ ID NO: 27323 - DNA, 402 bp, Artificial Sequence
  Description of Artificial Sequence: Synthetic coding sequence
atggagcctgtaccactgcaagatttcgttcgtgctctggaccccgcttcactgcctagagttcttcgcgtctgctcaggagtatatttcgaagggtattttactcccttgaatacacctcagtcttacgagactctggaggaacttgtatccgctacaacccaatctagcaaacagcttccaacttgctttatgtctacccacaggattgtaacagagggcagagtagtcaccgaggaccagctgctgatgctcgaggccgtcgtcatgcatttaggcatcagatcagctagatgcgttttgggaatggaagggcaacaggtaatccttcacctgccactttcccaaaaaggccctttttggacgtgggagccatctgccccacgcaccctcctccagtag

SEQ ID NO: 27324 - DNA, 744 bp, Artificial Sequence
  Description of Artificial Sequence: Synthetic coding sequence
atggagccagttccactgcaagacttcgtccgcgcgttagatccagcttcgctgccgcgcgtgctgcgagtttgctcaggagtgtatttcgagggtagtatttatgaaatcagtggcaatgagtgttgcttatcaactggcgacttaatcaaagttacacaggtgcggctgcagaaagtggtgtgtgagaatccaaagacatcccagaccatggagctagcaccaaattttcaggttagacgcactatcgtgaagattccttcaactttggaggttgacgttgaagatgtgaccgcctcaagccggcacgtgcactttatcaaacccttgctgctgtcagaagtgttggcatgggagggacccttccccctctccatggaaatcctcgaagttcctgaggggaggcccatatttctctcgccttgggttggcagtttacaaaaaggacagaggttatgtgtgtacgggcttgcgtccccaccgtggagggttctcgcttcttccaagggaaggaaggtgcctcggcattttttagtcagcgggggataccaaggcaagctgcgaagacgtccccgggaatttcctaccgcgtacgatctactcggtgctttccagcccgggcgccctcttagggtggtggccacaaaagattgcgagggggaacgcgaggaaaacccggagttcacctcactggcagtcggagataggcttgaggtgctgggaccaggccaggcacacggctag

SEQ ID NO: 27325 - DNA, 1176 bp, Artificial Sequence
  Description of Artificial Sequence: Synthetic coding sequence
tgaacttgtttcatgtctacccacaggatcgtgaccgagggccgtgtcgtgactgaggatcagctcctcatgctcgaggcagtggtgatgcacttaggaatccgcagcgcccgatgtgtgctggggatggaagggcaacaagttattttacatttgcctctgtcgcaaaaaggccctttctggacatgggagccttccgctccaagaactctgctccaggtgttacaagacccagcattgaaagacctggtgttgacttgtccgacacttccctggcactcactaattcttcggcctcagtatgaaatccaggcaatcatgcatatgaggcggaccattgtcaaaatcccctcaacccttgaggtagatgtggaggatgtgaccgcctcctccagacatgtgcacttcatcaagccactgctgctgagcgagcgccttagcgaccaggcaggtgaggatgaagaagaggaatgtaaagaagaggctgaaagtcccgaacgtgtgctgctaccattccactttcctggatcttttgttgaggagatgagtgattcacggaggtatagtctggccgatcttacagcccagttcagcctgccatgtgaggtgaaggtggttgccaaggacacaagccatcctaccgaccctttgacctctttcttgggcctgaggctggaggagaagatcacagagccgttcttagttgtgagcctggatagtgaacctggaatgtgtttcgaaatcccccctagatggctcgatctcactgtcgtcaaagccaagggccaaccagaccttccagagggaagtcttcccattgccacagtagaggagctgaccgatacattctactatagactacggaagctgcccgcctgcgagatccaggccccgccccctaggcctcccaaaaaccaaggccttagcaagcagaggagacactcatccgagggtggggtgaagagttcacaggtgttggggttacaacaacatgcccggttacctaagcccaaagccaagacgctgcccgagtttattaaggacggctccagtacatacagtaaaatccctgcgcatcggaaaggacatagacccgcgaaaccacagaggcaagatttagatgatgatgagcacgactacgaagaaatactggagcagtttcaaaaaacaatctag

SEQ ID NO: 27326 - DNA, 600 bp, Artificial Sequence
  Description of Artificial Sequence: Synthetic coding sequence
atggaggatgcggcagcacccggtagaactgagggggtactcgaaaggcagggcgcccccccagccgctgggcaaggcggggcgttagtggagctgacgccgactccggggggcctggcgctcgtttcaccgtatcatactcatcgcgccggcgatcccctggacctggtggccctggccgagcaggtacagaaagccgatgaatttattcgagccaatgctaccaacaagctcacagtgatagccgaacagattcagcatttacaggagcaggcccgcaaggtattagaggatgctcaccgagacgctaatctccaccacgttgcctgcaacattgtcaaaaaacccggtaacatttactatctgtacaagagggaatctgggcagcaatactttagtattatttcccctaaagagtggggaacaagttgtccccacgatttcctgggggcctataagctgcagcatgatctctcctggactccttacgaggacattgaaaaacaagatgccaaaatttcaatgatggacacactacttagtcaatcggtcgccctgccgccttgtactgagccgaatttccagggcctgactcattag

SEQ ID NO: 27327 - DNA, 336 bp, Artificial Sequence
  Description of Artificial Sequence: Synthetic coding sequence
taaagtgctctcctgctgggtgtggacggcctcctttctggcatcctggccatcatttacgtgtccgcggccagtttccacctatgcttttactcccccggcgtaccgagtacatataagggcttaccatgtccctacgcctcttgtatcttagcctctacctccctcctcacaaaggggaatcggtttattttgtgctgtatggcatcattgatgattttgtttatgatggaccagtcatactacccttatgataaaatacttgagtcagaaaactggaaaaaactcgtgtacatcggcggccagttccgtttcattataggctggaatttctag

SEQ ID NO: 27328 - DNA, 690 bp, Artificial Sequence
  Description of Artificial Sequence: Synthetic coding sequence
aaagggaccagctttttcctctcccatgaccagtcccattctcaaatcaatgaggtgagttggaaggacgtaacatctgccctatccctggcgaacatggtcctggggttattcagcataatcttttctttctctagaaaatgccattacgcctccagaatgctgcttgtctccttcttgctagacatggctgtccgggccatgaccagccacattaatatctgtagcaagctgggcgcggaattaaacgacttcgctgtgttcaccacgtttgggctagcctccgctctccttctgggggtggatgggctgctgtcaggtatactcgctattatctatgtttcagccgcgtcttttcacctgtgcttctacagtcccggagttccctctacttacaagggtctgccttgtccttacgcctcttgtatccttgctagcacttccctcctcacgaagggcaaccggttcatactgtgttgtatggcatctctgatgattctgtttatgatggaccaaagttattacccttatgacaagatcctggaatctgaaaattggaaaaaactcgtgtatatagggggcgtaattatgctcttcttctcacctctcagcctgtctgcgttctattgtcttatgtggtccctttcatacattttcttcccggacgccctctggggaaaggcggcctag

SEQ ID NO: 27329 - DNA, 699 bp, Artificial Sequence
  Description of Artificial Sequence: Synthetic coding sequence
taattctttttgtctcatgaccagtcacactctcagataaacgaggtgagctggaaggatgtgacctcagcactgagcctcgctaacatggttctgggcttgttttccattatcttcagcttctccaggaagtgccattacgcgagtcgtatgctcctggtcagcttcttgctggacatggcagtgcgggcgatgacaagtcatataaatatttgcagcaagcttggagccgaactgaacgacttcgctgtattcactacattcggattagcctcggctctgctgctgggagtggatggcctgcttagcggaatactggcgataatctatgtatctgccgccagctttcatctatgtttttattctcctggcgtgccaagcacctacaagggcctgccctgtccatacgcctcgtgcatactggcaagcacctctctgcttaccaaaggtaacaggttcattctgtgctgcatggctagtctgatgatcctcttcatgatggatcagagttattatccgtatgacaaaatcctggagtcggagaactggaagaagttggtttatattggcggggtgatcatgcttttctttagccccttaagtctttccgccttttactgtcttatgtggtcactgtcctacatttttttcccagatgccctgtggggtaaagccgcttgcctttctcctcaacactag

SEQ ID NO: 27330 - DNA, 1158 bp, Artificial Sequence
  Description of Artificial Sequence: Synthetic coding sequence
atggactcaccctcaagtgtgtcatcttacagttcctactcactcagtagttccttcccgacttctccagtgaacagcgactttggtttccccagtgactccgaacgcgaggacaaaggcgcgcatggaccccgcccggatacagtgggacaacggggagggagtcgtccttcacccggacctatacggtgtagacatagaagcaaggtaagcggcaaccagcataccccttcgcaccccaaacagcgtgggagcgcatcccctatggctggctccggggcaaagagaagccgggatggagaactggagactagcctgaacacacagggctgcaccaccgagggtgatcttctcttcgctcaaaagtgtaaagagctccagggtttcatccctccactcaccgacttactgaacggcctcaaaatgggccgctttgagaggggcttgagttccttccaacagtccgtggctatggatcgcatccaacggatcgttggagtcctgcaaaagcctcagatgggagagaggtatctcggaacactgttgcaagtggagggaatgcttaaaacatggtttccccagattgcagcccagaagagcagcctcggggggggcaaacatcagttaactaagcattttccttcacaccactcagattccgccgcgagctcccccgcctccccgatggaaaagatggatcaaacccagctcgggcacctggcgctaaagccaaaacaaccctggcatctgacacaatggcctgctatgaatctgacttggattcacacaacccccatctgcaatccgcccctgtcatctcctggcacaataagttttagccatggaccactgggaaccggtacgggtatcggcgtgatcctcttcttacagcacggggttcagcccttcactcatagcgccccaactaccccagtgcctccgactacggcctcgcccgtaatcccaggtgaaccaatgaagctaagtggggaaggacctaggtgttactccctcccagtgaccctaccgtctgactggagttatactttgagtcccccctctttaccaacactcgctcggaaaatgactataggccaccgagaacagcaacgaagtcacccaccggtagctgcagatgcacatcttttgaacctgtag

SEQ ID NO: 27331 - DNA, 1158 bp, Artificial Sequence
  Description of Artificial Sequence: Synthetic coding sequence
atggactctccttcctccgtgtccagctattcttcctactctctgtcttctagttttcctacatcacccgtaaatagcgacttcggttttccaagcgattccgagagagaagataagggagcgcatggaccaagacccgacacggtcggccaaagggggggaagtcgcccctcacccgggccgattcggtgcagacaccgatcaaaggtcagcggaaaccaacatacaccttcccatccaaagcagagaggcagcgcctcaccaatggcaggaagtggcgcaaaacgcagccgcgatggagaattggaaacatcactgaatactcagggatgcaccaccgagggagaccttcttttcgctcaaaagtgtaaggagctgcaaggatttattccaccgctcactgatctgctgaatgggttaaagatgggtagattcgaaagaggcctgtctagcttccagcagagtgtggctatggaccggattcaacgtattgtgggagttctgcagaagcctcaaatgggggagcgctacctcggtacccttctgcaggtggaggggatgctgaaaacgtggttcccacagattgccgcccagaagagttcattgggcggaggtaagcaccagctcaccaagcactttccgtcccatcactccgactctgcagcgagctctccagcctcgcccatggaaaagatggaccagactcagctgggccatctagcgctaaagccaaaacagccctggcatcttacgcaatggccagcgatgaatcttacctggattcataccacacctatctgtaaccctccgctatcttctcctggaaccatcagtttttcacacgggcccttgggaactggtacgggaatcggagtgatccttttcctgcagcacggcgtgcaacccttcacccacagtgcccccacaactcctgtcccacccaccacggcttcaccggtgattcctggagaacccatgaagctttcgggggaggggcctaggtgctacagcctgccagttaccttaccatcagactggagctacaccctttccccacccagcctgcctactctggccagaaagatgactataggccaccgagaacaacagcggtcacacccccctgtagccgccgacgcacatctgcttaacctttag

SEQ ID NO: 27332 - DNA, 1158 bp, Artificial Sequence
  Description of Artificial Sequence: Synthetic coding sequence
atggacagcccatcctcggtgtctagttattcttcctactcgctgagctcaagctttccaaccagccccgtgaactcagatttcggttttcccagcgattctgagcgtgaggacaaaggagcccacgggccccgaccagatacagttggacaacgcggagggtcacggccctcccctggacctattcggtgccggcatcggtcaaaagtctcgggaaatcagcatactccttcccatccaaagcaacgggggtccgcctctccaatggcgggctcaggggctaagaggtcacgagatggcgagctggaaacaagcttaaatacgcaggggtgtacaacagagggggatctcctgttcgcccagaagtgtaaggaacttcaggggtttattccaccacttacagatctgctgaatggactcaaaatgggtcgcttcgaaagaggtctttcctcattccagcagtcagtcgccatggatcggattcagagaatcgtaggggtcctccagaaacctcagatgggcgagcgttatctgggtacactgctccaggttgaggggatgctgaagacctggttcccacagattgccgcccaaaaatcttccctgggaggggggaaacaccagcttaccaagcattttcctagccatcactcggattccgcagcttcttcccccgctagcccaatggaaaagatggaccaaactcaactcggacacttggctctgaagccaaaacagccctggcatctgacgcaatggcctgcaatgaacctgacctggattcacaccacgcctatatgtaatccgccactttctagtccagggactatctcattcagtcacggacctctgggaactggcactggcatcggcgtgatcctctttctccagcatggggtgcagccttttacacattcagcgccaaccacaccggtgcccccgactactgctagcccagtgatcccaggcgagccgatgaagcttagcggcgagggaccgagatgttactcattgcctgtcaccttgccttcagattggtcttatactttatctccccccagcctacccacgctggcccgtaagatgactattgggcaccgagaacaacaaaggtctcatcctcctgttgctgcagatgctcacctgctcaacctgtag

SEQ ID NO: 27333 - DNA, 504 bp, Artificial Sequence
  Description of Artificial Sequence: Synthetic coding sequence
atggccgctgaagagaaggacccactgtcttatttcgcggcctacggctccagctccagcggttcttccgacgaggaggacaatatcgagcctgaggaaacgtcacgacgcactcccgaccccgcaaaatctgcaggcggatgccgcaataaagcggagaagcgcctgcccggtcctgatgaactgttccggagcgtgacacgtcccgcatttctatacaaccccctaaacaagcaaatagactgggagcggcatgtcgtgaaagcccctgaggagccacctaaagagttcaagatttggaaaagcaattatgtccctccacccgaaacttacaccactgaaaaaaaacctccaccacccgagcttgatatggctatcaagtggagtaatatctacgaagacaacggcgatgatgcaccccagaacgcaaaaaaagctaggctcctgcctgagggtgaagagacgttagaatccgctctggaggaccttgagattcagaattag

SEQ ID NO: 27334 - DNA, 549 bp, Artificial Sequence
  Description of Artificial Sequence: Synthetic coding sequence
atggccgcagaggagaaggatcctctttcatacttcgcagcatacggcagctcttcctctgggtccagtgatgaggaggataacatcgagccagaggagaccagtcgcaggacgccagaccccgcgaaatccgctggaggatgtcggaacaaggcggagaagcgattgccaggcccggacgaacttttccgctctgtcacccgtccagcttttctatataatccactaaataaacaaatcgactgggaacgacacgtcgtaaaggcacccgaggaacctcccaaggagtttaagatctggaaatcgaattatgtgcctccccccgaaacgtataccaccgaaaagaaaccgcctccccccgaacttgacatggccatcaagtggagcaacatttacgaagacaatggagatgacgctccccagaacgctaagaaagcccgcctgctacctgagggtgaagagaccttagagtcagatgatgaaaaggacgagcacactagtaagaagcgaaaagtggagccaggcgagcctgccaagaaaaagaaatag

SEQ ID NO: 27335 - DNA, 438 bp, Artificial Sequence
  Description of Artificial Sequence: Synthetic coding sequence
atggcagcccgccagatttgggctaggacaggagcagccctgtgccgccagccaagcgctgcccccccgcccgccccactctgggtgagggccggctttagacaacagctgtcactgacgctgtgcccggctaatgaaggcaattgcggtgggagtgcgccctccacccccggtcgacctgagagggctgctaggcccagcgtgagtgaggaattgactgccgccgaaaggcagattgccgaacttcacgccgctgcttgtgcggccgggcaactcaactacgttgatcctgccaccggctatgtggtgctgactcaaattgcccacttgcagcgaggagagtgttgtgggagtgcttgccggcactgtccttatggtcaggtgaatgtcaaggacccgtcaaaaaagaagcagtttaatagctacttttacgtgtag

SEQ ID NO: 27336 - DNA, 396 bp, Artificial Sequence
  Description of Artificial Sequence: Synthetic coding sequence
atggacgtcctgttcgtggctattttcgccgtgccattgatcctgggccaggaatatgaagacgaggaaaggttgggggaggatgaatactaccaggtggtgtattactacacggttacgccatcttatgacgatttttccgccgactttacaattgactattccatctttgagagcgaagatcgattgaacaggttagataaggatattaccgaggcaatcgaaacgactattagcctggaaaccgctagagctgatcatccaaagcctgtgactgtgaaacccgttacaactgaaccctcccccgatctcaatgatgccgtgtcctcattgcgttcgccgatcccactattgttatcatgcgccttcgtgcaggtgggaatgtattttatgtag

SEQ ID NO: 27337 - DNA, 1356 bp, Artificial Sequence
  Description of Artificial Sequence: Synthetic coding sequence
atggcggaagccgccgcgctggtgtggatacgcggccccgggttcggatgcaaggccgtccgctgcgcttctggaagatgtaccgtgcgagacttcatccatagacactgtcaggatcagaacgttccagtcgagaactttttcgtgaagtgcaatggcgcgctgattaacactagcgacacagtgcagcatggcgctgtgtattcactcgagccaagactgtgcggcggtaagggcggcttcggtagtatgctgagggccctgggggcgcagatcgagaagacaactaaccgcgaggcctgtcgggatttgtctggtcggaggctgcgagacgtgaatcacgagaaggccatggctgagtgggtaaagcagcaagctgaaagagaagccgagaaggagcagaagcgcttagagagactgcagaggaaactggttgaacccaagcactgcttcacaagccccgattatcaacagcagtgccatgagatggccgaaaggttggaggattccgtgctgaaaggcatgcaggcagccagctcaaaaatggtgagcgcagaaatttccgagaatagaaagcgacagtggccaactaagagccagacggataggggagccagcgcggggaagcggagatgtttttggttggggatggaagggctggagactgccgagggttctaattctgagtccagcgatgacgattcagaagaagcgccttccacaagtggcatgggcttccacgcccccaaaataggctctaacggtgtggaaatggcggccaagttcccctccggttctcagcgagcacgagtggtcaacactgaccacggctcccccgaacagctgcagatccccgttactgatagcgggcggcacatcttggaggactcctgtgctgagcttggtgagagcaaggaacatatggagtccaggatggtgaccgaaacagaggaaacacaagagaaaaaggcagaaagcaaggagccaattgaagaagaaccaactggcgccgggttaaataaggataaggaaaccgaagaacgcacagacggggaaagagtagccgaagttgcacccgaggagagggagaatgtagccgtggccaagttgcaggagtcacagccgggaaacgctgtcatcgacaaagaaaccatcgacctgctcgctttcacatccgtggctgaacttgaattgctgggccttgaaaagctgaagtgcgagcttatggcccttggcttaaaatgtgggggaacattgcaggagagggctgccagactctttagcgtacgcggcttggctaaggagcaaattgaccccgcattgttcgcaaaaccactgaagggcaaaaagaagtag

SEQ ID NO: 27338 - DNA, 1071 bp, Artificial Sequence
  Description of Artificial Sequence: Synthetic coding sequence
atggagcactcacttacacctgtgactcagtgctcaatggaattgttcattgtgtggaaccccgatttcgccgtggagaaagaggtgctggatctctgtagcgagcatctggtcctgcgactgagacgtcagccaatcgaaaaactggtggagcccaagcactgtttcactagtcccgattatcagcagcaatgtcatgagatggcagagagactcgaggacagtgttttgaaaggcatgcaggccgccagtagtaagatggtatcagctgagatatcagagaatagaaagcgacagtggcctaccaaatcccagaccgataggggcgcaagcgctgggaagagaaggtgcttctggcttgggatggagggcctcgaaaccgcagagggctccaactctgagagtagtgatgatgatagcgaggaagctccctcgactagcggaatgggctttcacgcccccaagattggatccaacggggtggagatggcggccaaattcccaagtgggtctcaacgggcacgtgtcgttaacaccgaccacgggtccccggagcaactgcaaatccctgtgacggactctggacggcacatactggaggactcctgcgctgagcttggggaatcaaaggagcacatggagagccgaatggtcactgaaaccgaagaaacccaggagaaaaaggctgagagtaaagagcccatcgaagaggagccgacaggtgcggggctgaataaggataaggaaactgaggagaggaccgatggggaacgcgtggcagaggttgctcccgaagagcgcgagaatgtggcagtggccaaactccaggagagccagcccggaaatgcagtcatcgataaggagactatagacctgttggcctttacttccgtggctgaacttgaactcttaggcttagaaaagttgaaatgtgagctgatggccttgggcctcaagtgtgggggcacattgcaggagcgggccgctaggctttttagcgttcgcggattagctaaggagcagattgaccccgccttattcgcaaagccactgaagggcaagaaaaaatag

SEQ ID NO: 27339 - DNA, 1320 bp, Artificial Sequence
  Description of Artificial Sequence: Synthetic coding sequence
atggctgaggccgcagcactggtgtggattagaggtccaggattcggatgcaaagcggtcagatgcgcaagtgggcgatgcactgtaagagattttatccatagacattgtcaggatcagaacgttcctgtcgagaattttttcgtgaagtgccatggcgccgtttatagcctggaaccccgtctttgcgggggcaagggagggtttggcagcatgctcagagctctgggtgcacaaattgagaaaaccacgaatcgggaggcatgtcgggacctcagtggacgccgcctcagggatgtgaatcacgaaaaggcaatggccgagtgggtcaagcagcaggctgaacgggaggccgagaaggagcaaaagagacttgagcgactgcagcggaagttagtcgagccaaagcattgttttacgtccccggattatcagcagcagtgccacgaaatggctgagagactggaggattctgttctcaagggtatgcaggccgccagttccaagatggtgtccgctgagatatcagagaataggaaaagacagtggccaaccaaatcgcagaccgacaggggggcaagtgccggcaaacgaagatgtttctggctgggcatggagggattggagacggcggaaggtagcaacagcgagagttctgatgatgatagcgaggaagccccttcgacgtctggtatgggttttcatgcccctaagatcgggtctaacggcgtcgagatggccgccaaatttcccagcggtagtcagagggccagggtggtcaacactgatcacgggtctccagagcaactgcagattccagtgactgactcgggacgccatatccttgaggacagctgcgccgaattgggagagtctaaagagcatatggagagccggatggtgactgaaacggaggagacccaggagaagaaagcagaatcgaaagaacctattgaagaagaaccaacgggcgctggcctgaacaaagacaaggaaactgaggaaagaacagatggagaaagggtggcagaggtcgcaccggaagaacgagaaaatgtcgcagttgccaaactgcaggaaagtcagcctggaaacgcggtcatcgacaaggagaccatcgaccttctcgctttcaccagcgtggccgaacttgagctgctcggactggaaaaacttaaatgcgagttgatggcccttggtctgaaatgtggcggcaccctgcaggaaagagccgcgagactgtttagcgtcagaggactggccaaagagcagatagaccccgccttgtttgcgaaaccgctgaagggaaaaaaaaaatag

SEQ ID NO: 27340 - DNA, 873 bp, Artificial Sequence
  Description of Artificial Sequence: Synthetic coding sequence
atgtccaactacgtaaacgacatgtggccaggctcgcctcaggagaaagactctccttctacaagcagatctggtgggtcctcccgtctctcgagtagatcaaggtcccggtccttttcacgctcctccagatcccacagccgggtgagttccagattctcttctaggtcccgcagatccaagtctcgttcacggtctagaaggcggcaccagaggaagtatcgaagatacagccgcagttacagtaggtctcgctcccgcagccgctcgaggaggtaccgagagaggcggtatgggttcaccagacggtattacaggagcccttcccgttaccgttcccggtcccgaagccgatctagatctagggggcgtagctactgcggcagggcatacgctatcgcacggggtcaaagatattacgggttcggtcgcacagtgtacccagaggaacactctagatggcgtgaccgctctcggactaggtccagaagtaggacacctttcagattatctgaaaaggatcggatggagctgcttgagattgctaagactaacgcagccaaagccctgggaaccacaaacatcgatctaccagcctctctcagaacagtacccagcgctaaagaaaccagtcgtggaatcggggtgtcttccaatggagcaaagccagagctgtccgaaaaggtaacagaagatgggactagaaaccctaatgagaagccaactcagcagcgcagtatagctttcagttcaaacaacagcgtggccaaaccaattcagaagtcagcaaaagcagccacagaggaggcttcttcacgatctcccaagattgaccagaaaaagtctccgtacggtctctggatcccaatttag

SEQ ID NO: 27341 - DNA, 876 bp, Artificial Sequence
  Description of Artificial Sequence: Synthetic coding sequence
atgtggcccggatctccccaggagaaagatagccctagcaccagtcggtcgggagggagctctagactgtccagtagaagccgttcccgcagtttctcccgtagctctcggtcacactcacgcgtctctagtcgcttctcctcacggagtcgacgttctaaaagccggagccggagcaggaggaggcatcagcgcaaatatcgaagatactctcgttcatatagtcgaagtcgatcccgcagtaggagcagaagatatagagaacggaggtacggatttaccagaagatattatagatcccccagcagatacagaagccgcagtaggagtcggtccagatccaggggaaggagttattgcggcagagcatacgctattgccagaggccagagatattatggtttcggccgcacagtatatcctgaggagcattcccggtggagagatagatcaaggacaaggagccgtagcaggactccatttcggctctcggagaaagatcgaatggaactgctggaaattgcaaaaacaaatgcggctaaggcacttggtaccactaatattgatttaccggcttcgctacgaactgttccaagtgctaaggagacgtcccgggggattgatatagatgaggaaaatttgctggtgatcgacacctgggccaaggcttcagaactttcagaaaaagtcaccgaggacggtaccagaaaccctaatgaaaaacccactcagcaacggagtattgcgttcagctctaataattccgtcgccaagccaatacagaagtctgccaaagcagcaactgaggaggcttcctctagatcgcccaagattgatcagaagaagtcgccttacggtttgtggatccccatctag

SEQ ID NO: 27342 - DNA, 681 bp, Artificial Sequence
  Description of Artificial Sequence: Synthetic coding sequence
atgagtaactacgtcaatgacatgtggcctggaagcccccaagagaaagatagccctagcactagccggagcggggggtcatcccgcctgtcctccagatccaggtccaggagcttctcacgaagctctaggtctcactccagagtgagctctaggtttagcagcagatctagacgttcaaagagccgctcccggagtcgacgaaggcatcaaagaaagtacaggaggtacagccgctcctattcccgcagcaggagtagatcacggagccgtagataccgcgagaggagatatgggttcacaagaaggtactaccgatctccaagtcggtatagatcaaggagtcgatcaagatctagatcgagagggagatcttattgtggcagggcgtatgccatcgcccgaggacagcgttattacggctttggccgcaccgtctaccctgaggagcactccaggtggcgagatagatcccgcacccgcagccggtctagaacgccttttaggctgtctgaaaaagacaggatggagttacttgaaatcgctaaaacaaatgcggcaaaggcgctagggaccaccaacattgatttacccgcatcattacggacagttccatccgcaaaggaaacatccagggggataggtgtgtccagcaacggcgctaagcctgagaagagttag

SEQ ID NO: 27343 - DNA, 525 bp, Artificial Sequence
  Description of Artificial Sequence: Synthetic coding sequence
atgtcaaactacgtcaacgatatgtggcccggctccccgcaggagaaggacagccctagcacttcacgttccggaggaagctctaggctttcctctagatcgaggagtcggagctttagccggtcatcaagatctcactctcgagtgtcatcccgatttagctccaggtctaggcggagtaagtcccgctcacggtcccgtcggcgacaccaacggaagtatcgtcgtacagtttacccagaggaacattcgcggtggcgtgaccgatctcggacccggagtcgatcccgaactccattccgcctgtccgaaaaggatcggatggaactgttggagatcgctaagactaacgccgctaaggctctgggcaccactaacatagacctaccggcttcattgcgcaccgtgccgtctgcgaaggagacatccagaggtatcggcgtgtcctctaatggggccaagcccgaggtttccatcctcgggctgtccgagcaaaattttcaaaaagccaactgtcagatctag

SEQ ID NO: 27344 - DNA, 510 bp, Artificial Sequence
  Description of Artificial Sequence: Synthetic coding sequence
atggccccatctgaggaccccagagattggcgtgctaatctcaagggtaccattcgtgagacaggcctggagactagctccggtgggaagcttgccggtcaccagaaaacagtacctacagctcacctgaccttcgtcatcgactgcacccacgggaaacagctgtcattagcagctaccgccagccctccacaagccccctctccaaacaggggtctggtaacgccccccatgaagacatatatcgttttctgtggtgagaactggccgcatctcactcgcgttacccccatgggtggtggctgcctggctcaggcccgggctactctgcccctgtgccggggctcagtggcatctgccagttttcccgtctcccctctttgtccacaagaggtgcctgaagccaagggcaagcctgtgaaggctgctcctgtccgaagtagcacatgggggacggtgaaggattctctaaaagccttatcctcctgcgtgtgtggccaggcagattag

SEQ ID NO: 27345 - DNA, 1872 bp, Artificial Sequence
  Description of Artificial Sequence: Synthetic coding sequence
atggcagggtttagtcacttttcccagcctccttaccgcgatctttgggagccccctcgtcccggaggagagagggaatcaacacagcgactggggggccaacggtccggcgctgactctaccgcgtgcagccgcgctggaacacctggagccgagagcgaagcaggggcctgctggctccatcctcactgctccttcacaccaaggccaaggagaaggggctgctccgattccctcaggggatccagaagcctgtccgacgtggctcggcgccctttagagagaagccggaagcacaggcctaggtccaggcgcctagaggacgcatggggggagacaggcaccaaacctagaccagcctggcagccccagacacagctgccaccccagcgtccacaaccttgtccacactatcctctagctcagggcgactctcctcctccatgcccagggggtgccggtacacccctgtcagggacattcagagttgagaaggcccagggaggggaccagtgggcagtgcccctggggaggcatctcgggaggtggtccccgtcatccgtcccctccgaacggtcttctgttcctagtcagaagttcaaaaggcacagcgcctgtgtgtgcgcccagaagagagactcatccgaccaggtggagtcactggcatccagagacagccagccactggccagctccaaagaaatgagatctccacatacccaagtgttgaaaagcaagcttgaagaggtcgtggtctcatcacaagatcagcaaatcgtggccctggtgttgacacggctgaagaaggctcagcgcatacgcgagctgcagcagcaggcagccaaagcctgggaggaactgaagcggtccgaccagaaggttcagatgacactggaaagggaaagacgtctgctgcttcgccagtctcaggagcaatggcaggagaaggagcaacggaagacgctacagtctcccgaacagcgcggcctgaggagggattcgcagaggaagaacgtgccaccgggcgaatcccgatggaaggaacagccggaagaccaggagagtccaagacaggagaaacttgagaaagcacgcgcccaggctgagcacagaaagcagtgccaggtgcgacggttgcgtgagcaagaaaagatgctccggaacctgagggaacagcactcattgcagctccagcgaaggctggtcgaagcttgccgcaagcgccatctgcatgcagttgagggacagaagaaggttcaggacacaaatctctccagcttgataaattaccaggccagaaaggtgctgatggactgccaggccaaggccgaggagctgctgcgccagctcagccttgagcagtctttccagcgatcccaggaaatccatcaggggctgcgaaaagagaggcaaagagagctccgcgagaaggcccagaaggaagaggagcaactccaacaagcacggtggcgcgctggagagagcgaggagcagaggaaaatgaggaagagaatcctggtagagctcgccgacgagaagatcaggcaggcaaggagccatgtgcacaagaccacgagggacaaagtgcagcacctccgggagctaaaccacctgcgcgaaaaaaatcatcatatactcaaactcaaagcagaaaaagaagaaaagtgtcatatcgagggaattaaagaagccattaaaaagaaagagcagagggtgcagcacatttcacaggggaaagatccaaatttccaggaatttcagaagctgccccaggcgtcccggcgagaagagcgagccccaccgaactccagtctggaccaaatggtcctggaggcgcaactgagggcctgccaacagaatagggggtactag

SEQ ID NO: 27346 - DNA, 753 bp, Artificial Sequence
  Description of Artificial Sequence: Synthetic coding sequence
atgtgtgaccagcagaagcagccccaatttccaccctcgtgcgtcaaggggtccgggctgggggccggacagggaagtaatggtgcaagcgtcaagtgccccgtgccatgccagacacagaccgtctgtgtgactggtcccgccccgtgccccacacaaacgtacgtgaaataccaagtgccctgtcagacacaaacgtatgtgaaatgccccgctccttgccagcgaacatatgttaagtacccgactccatgtcagacctatgtgaagtgtccagcgccttgtcaaactacctatgttaaatgtcctaccccatgtcagacttacgttaaatgtccagccccttgccagatgacatacattaagtcccccgctccgtgccagacacagacatgctacgttcagggcgcctcaccctgccaaagctactacgttcaggcccctgctagcgggagcaccagccaatactgtgtgaccgacccttgctctgctccttgcagtacatcttattgttgcctggctcctagaacttttggagtttctccgctgcgccgttggatccagagaccccagaattgtaatacgggctcatccgggtgctgtgaaaacagcgggtctagtggttgttgcgggtctggtggctgtgggtgttcttgtggatgcggaagtagtggctgttgttgccttggaataatccctatgcggtctagggggccagcctgttgcgaccatgaagacgattgttgttgctag

SEQ ID NO: 27347 - DNA, 753 bp, Artificial Sequence
  Description of Artificial Sequence: Synthetic coding sequence
atgtgtgaccaacagaagcaaccccagtttcctccatcatgcgtgaaggggagcggactcggcgccggccagggatcaaacggagcctcagtgaagtgcccagtgccatgtcaaacacagacagtgtgtgtaactggcccggctccctgcccgacccagacatatgtgaagtaccaggtcccttgccagactcagacgtacgtcaaatgtcctgctccctgccaacgcacatacgtcaagtatcccaccccctgccaaacttatgttaagtgccccgccccatgtcagacaacctatgtgaagtgtcccactccctgtcagacatatgttaaatgccctgccccatgtcagatgacgtacattaagagtccagctccttgtcagacccagacatgctacgtccagggtgccagtccctgccagtcatattatgttcaggctccagcaagcggttcaacctctcagtactgcgtgacagacccttgttcagcaccgtgctccacatcatactgttgtttggcacccaggaccttcggggtcagcccccttcgtaggtggatacagagacctcagaactgcaacactggctcatctggatgctgtgaaaattctgggtcatctggatgttgcgggagtggcggctgtggatgtagctgtggctgcggaagttccgggtgctgttgcctgggcatcatcccgatgcggagccggggcccggcctgctgtgaccatgaagacgactgttgttgttag

SEQ ID NO: 27348 - DNA, 810 bp, Artificial Sequence
  Description of Artificial Sequence: Synthetic coding sequence
atgttgctgcttgatttaatgagtagtccctcgccccagctgctggtagccgccgctcagcagacactcggcatgggtaagagacgatcaccgccccaggccatatgcctacaccttgcaggggaagtgctggccgtggcccgcggtctgaagccggccgttctttacgactgcaattgcgctggtgcctcagagctgcagtcgtacttagaggaattgaaggggttgggattcctcactttcggcttgcacattttggagataggcgaaaattcattaatcgtctctcccgaacacgtgtgccagcacctggagcaggtcttactgggaaccatagcgttcgtggatgttagtagttgtcagcgacacccatctgtctgcagtctggaccagctccaggacctcaaggcacttgtggcagaaattatcacccacctacagggtctgcagcgggacctcagcctcgctgtgtcttatagtcgattgcacagctccgattggaacttatgcacagtctttggtattctccttggctatccagtcccctataccttccatctgaatcaaggcgacgataactgcctggctcttactccactgcgtgtcttcacagcccgtatctcctggcttctggggcagcctccaatcttgctctattcattcagcgtccctgaatccttatttccgggactgagggacatcctgaacacctgggaaaaagatctccgtacaaggttcaggactcagaacgacttcgctgacctttcgattagttctgagatagtcacccttcccgcagtcgcactctag

SEQ ID NO: 27349 - DNA, 552 bp, Artificial Sequence
  Description of Artificial Sequence: Synthetic coding sequence
atgagaggctccgtcgaatgtacttggggatgggggcattgcgccccaagccccctcctgctttggacgctgctgctgttcgccgctccttttggactgcttggagagaaaaccagacagcttctggagtttgactcaactaacgtgtcagacacagcagctaagccactgggccggccttatcctccatactctttggctgacttttcgtggaacaacatcaccgattcactggatcccgcaactctctctgcaacctttcagggacatcctatgaacgatccaacccgtacctttgcaaacgggtccctggcttttagggtccaagctttttctcggagttctagacccgcccagcctcctcgactgctacatacggcagacacttgtcagctggaggtagccctgatcggtgcctctcctcgtggtaaccgatccttgtttggactggaggtggccactctgggccaggggccagattgcccctcaatgcaggaacagcacagtatcgacgatgagtatgctcctgctgtgttccagcggcgggactag

SEQ ID NO: 27350 - DNA, 852 bp, Artificial Sequence
  Description of Artificial Sequence: Synthetic coding sequence
atgtgcggtcctgaacatctgttatgttgccccaaggatctggccatgtttcctagacagctgagcctcaccgcttgcttaccaggcacccctgtatcacacaaatgccaccatatctggctgtgggtgggtgttcctgcgtggcatccacgcgcttcaagatgtgggggagcacagcccagctcttggctcaggcagaaagcagcccgcgccttctggctttccctgccagcagctaagcttagacaccattcttcccgatggctgcgtcgcagtggagcattttcctccggatccacactgaagccacccccatcaccttcccccgctccgctttgccacgcagataatctaagaacaggcaggacaagaccttccggtggcagaccatggttcctgttgggtggtgatgaacgagagcggttgtgggcagaactcctccgtacagtctctccagaattgatactggaccacgaggtcccctccctcccagcatttcctggtcaggaaccacggtgcggacctgagcctacggaagtctttacagtgggacctaagacatttagctggactccatttccacccgacctgtggggccctggaagaagctacagactgctgcacggcgccggaggtcacctggagtcccccgccaggagcctgccgcagcggcctgcgccagatccctgccgggcaccaagagtggaacagcagccctctgtcgagggggccgccgccctgagatcctgcccaatgtgccagaaagagttcgcccctcgactgacccagctggatgtcgatagtcacctagcccagtgcctggccgagtccaccgaggatgttacatggtag

SEQ ID NO: 27351 - DNA, 543 bp, Artificial Sequence
  Description of Artificial Sequence: Synthetic coding sequence
atggaagccgctcgcagaccccggctgggattgagcagaaggaggccacgccctgctggggggccttctggcggcagaccctggttcctgctgggcggtgatgagcgggagcgcctctgggcggaactactacgcacagtgtcgccggaattgatcctcgaccacgaggtccctagtcttccagcatttccagggcaggagccgcgctgtgggcctgagcctactgaggtctttacagtgggcccaaaaacgttttcatggacgcctttcccccccgatctatggggtcccggacgctcttaccgcctcttgcacggtgcaggcggtcacctggagagccccgcccgctctctgccacagcgccccgcgcccgacccatgccgtgcacctagggttgaacagcagccaagcgtcgagggggcggccgccctccggtcatgtcctatgtgccagaaggaattcgcaccccgacttacacagctcgacgtggactctcatctcgcccagtgtctggcagagagcacagaagacgtgacttggtag

SEQ ID NO: 27352 - DNA, 444 bp, Artificial Sequence
  Description of Artificial Sequence: Synthetic coding sequence
atggaagcatggggtctgtgtgcatggccgagaggcctgcgcggcaattttcacacatgtgctcccgggttgacccagaggcacgaagttgcgaggcctccccttcctggatcctctgaggatggatctgcaacaccggacacctggcagctggccgccctccccctgggcagccttagctccggacaattgtgtctccacctaagagggacttccacccccgccccaacttgtgtgccactcgccccaaagctgcccccctatgtttgggttgcttctgagatgtggggtaggagacatagcagaaagaaaggcattaggggcgcatctactagtagcgagcattttatacctcaggatgccacgcggagtttgagctggagatcaaggagcgttcatcgcgtgctcttcccctggaaaatgtgcactcttgagaccgcctag

SEQ ID NO: 27353 - DNA, 339 bp, Artificial Sequence
  Description of Artificial Sequence: Synthetic coding sequence
atggaggcagcacgccgacctcgtctgggattgagcagaagaagaccccggccagcaggagggagtccaggagctgctcgttcgcctcttaagtcatccttgtccgaccccaggcctttccccggccacccatttcggcgcacgtgtggcgcccgagccgtccccaccggttgcttcaccgggcaggagggcacttggaaccccccccccggcccctgccctagtgctagacacttaatcccagctggtccccctggctggtcgtcttcaaggctctggcgggtccctcggccctgcgccgccgccccatgcgctcggcggagctcaccgcccggatag

SEQ ID NO: 27354 - DNA, 588 bp, Artificial Sequence
  Description of Artificial Sequence: Synthetic coding sequence
tgagaggcagcccgcaggccccgcctcggactctcccgccgccgaccccggcccgccggcgggcccagcggcgggcggccttggttcctcctggggggtgatgagagggagcgcctctgggcagagctgttgcgcacagtatctcccgagcttatcctcgatcatgaagtaccttcactcccagcatttcctggacaggagccccggtgcggaccagagcctacagaggtctttactgtgggcccaaagacctttagctggacgccatttcctcctgacctttggggaccagggcggtcataccgtctcctccacggagccggtggacacctcgaatctcccgccagaagtctgccgcagcgtccggctcccgacccgtgccgggcaccccgcgtggaacaacagccttcagtggagggcgctgcagcactgcgatcatgtcccatgtgccagaaggagttcgctccacggtccaaaaatagctcagggatgcgccgccacaggagccctaagcttgctgctaataacaacaataataaacggaagggaagggctcgctggctcaccccggtgattcctgccctgtag

SEQ ID NO: 27355 - DNA, 1641 bp, Artificial Sequence
  Description of Artificial Sequence: Synthetic coding sequence
atgtcctccgcatggaagacaccccgtggctctgacgcaatgcctgagattatggtgaaaattattggatctaagcatttccagtacctggtggagaagcctaagattaaggagaacgacagccttaaaaccgaaacgcagacaatgcaccagaagccaatgacggacaacgctcgacagatgagcagagacactccagttccaattaatttcaccgaccagcaaacaaccgacaacccagatgatgtgaaagagaaaaagcaccccgagaataatcagaagtccgagaataatcaaaagcttttaacaggcgccaattcgagtcgattcctcgacggaaatattccatcccaggcaaacgtacattgcagttcagtgccaaccggggatcagtcactgtcctatgtgcacgggattccgagaaggaagctcagggattggtcactggagcagatggtacgaggctcaagcgatcagccagaggatatcggccagagtcctagcggtactaccaacgaggacgccttccttctggcactcgttaggagagaactaaagagcaggcccctttcaagcaatctactggaaaaactccagaaagagttgaagattctggacccaatcagctcagggttcttattacagagtcagctgtcacgcctttttcttaagcatgaagttcccctgcaactgccgaccgtcaaaatcttatgtcagagattctccaagagaggaagtcccgaaatggtaaactatgaaaaactgctgtggttcctcaatagtgctgcctccgactacccacaacagaataaggctgccgcagacctccgcaagacagagagccatggcacacattcccagtcgaccccgcctcagcattcgtcttcacagccagaagtcaatcggtccctcctggagattctcaaaatggccctgcggacgacaaatggtcgactgaatatagacaaccttaacctaagtttccggaaagaggatcgctcattttcgggctgcctccctcttcctaaggttcgggccatctgcggcaaacatggactgtatctaacactaagtctgctggagactctgctgaatcaccaggacttaggctaccaaaacgaaatcaaatggcaaaattttgtagaaatgctgacccgagcctctagtgatctcctgtcggacctccccactggaaaaaatgaaaagaaagcacccgcgccgcccatggagccagaggtaccggagatgtcacagagcaagactgagcatatgaaaacacctgaagaagaactgcagccagaaagcagtccagctgaaactagcgcctgcaaggatccattaaagccgcttaaaataagacccgtgtcgcagccctttgtgaatcccgccgtcaaaaataaagctgaggagtgcgagacttggatcgaccgcttcagaaaactcgagaatgcattatacctctgcgacctgagcaacaccggcgtgctggagaaagaacgcgctaggcgcctcattcataattataatctgatctacaacttgtccctgtcaccccaaaaaatcgatcaggccttgcgccgattcagaagcggcgaaaacatgttacttgaaccagccctacgctatctaaaggaactgtag

SEQ ID NO: 27356 - DNA, 543 bp, Artificial Sequence
  Description of Artificial Sequence: Synthetic coding sequence
atgtctcggggatgttcttctgatctgaggttccacacctggctcggacttcgcatgctgaagaacataatcgccgtagctcttctgatgcttgggaaaaacgagaagaaagcccccgctccgcctatggaacccgaagtgcccgagatgtctcagtccaagacagaacatatgaagacacctgaagaggaactgcagccagaaagttccccagccgaaacttctgcctgcaaggatcccctcaaacctttaaaaatccggcccgtaagtcagccgttcgtgaacccagctgtcaaaaataaggctgaagaatgtgaaacatggattgaccgatttcgcaagctggagaacgcactgtacctgtgcgacctcagtaacactggggtcctggagaaggagagagccagaaggctgatccataactataacctgatctataacctctctctgtccccgcagaagattgaccaagcgctgcggcgctttcggtccggagagaacatgttactggaaccagccctaaggtatctgaaggagctgtag

SEQ ID NO: 27357 - DNA, 714 bp, Artificial Sequence
  Description of Artificial Sequence: Synthetic coding sequence
atgagcagcgcctggaaaactccgagaggctccgacgcgatgcccgagatcatggtaaagatcatcggaagcaagcacttccagtatttggtggagaaaccaaaaatcaaagagaatgatagtctgaagaccgaaactcagacaatgcaccagaaaccaatgactgataatgcgcggcagatgtccagggatacccctgtccccatcaacttcacagaccagcagaccaccgataaccccgacgacgttaaggaaaaaaagcacccagaaaataaccagaaatccgagaacaaccagaagctcctgactggagcaaatagcagtcggttcctcgacggcaatgttagggctatttgcgggaagcatggcctgtatttaacactgtccctgctggagaccttactgaatcatcaggatcttggttaccagaatgaaattaagtggcaaaactttgtggagatgctcacccgcgcctcatctgacctgcttagtgaccttcccaccggtaaaaacgaaaagaaagcgcctgccccacctatggagccagaagtgcccgagatgtctcagtccaagaccgaacatatgaagacacctgaggaggaactgcagcccgaaagcagccctgccgagacctctgcctgtaaggaccctctgaagccactgaaaatccgaccagtgagtcagccatttgtgaatcctgccgtcaagaactag

SEQ ID NO: 27358 - DNA, 276 bp, Artificial Sequence
  Description of Artificial Sequence: Synthetic coding sequence
atggtgtgctacctgtactgggagacctttccatccatcagccaccttctgaagataacccttagtgccagggactgtcatgtgtgtggcctgaacctgttcatatttatggaccccgtggaaaatcaagcacttcaccctgttatcatggcccttatactgatgccatccttgcactgtttcggcaatatccttatcttgctgtttctgaagtccccagcccaattattttgccgcatgagcgtggatctggcgcttcttttcccccacaaatag

SEQ ID NO: 27359 - DNA, 264 bp, Artificial Sequence
  Description of Artificial Sequence: Synthetic coding sequence
atggagcggaacacgatttacaccggatggctgcagtctaacctgatcctggaccctgtcgagaatcaagcactccatcctgtgattatggcattgatcttaatgccatctttacactgcttcgggaacattttgattcttctgtttttgaaatcacctgctcagctattctgccggatcggccgcttcgagaccggagaggagaaaaccagaagaagggagggatccgatgtgaccaccgaggccgcgatcggggtcatgtag

SEQ ID NO: 27360 - DNA, 447 bp, Artificial Sequence
  Description of Artificial Sequence: Synthetic coding sequence
atgccaggcggcgacacaacacccgaagaggccgccgccccttcatgtgctgggtataaccctggcttgcttctgttcagagcccagaaggctcagggtgcatgcgttactagcaccgagggggcctggccaaggagagccagcgcactttacggcggtagaaaaatgcgatgcggcgaatctggggccggacctgacccacgatccaattccgccgaggtttcctctagccagcccgctctggcatccaagtcccagtctaaatgggggccgacgtcgaacaacccccggggagctctgaccaccaccgaattcgaaatggccggaaaccgatcacagaacataaaacacaagcaaacggccctcattgcaatccccatgtcatctcagacgccgaggatgctaggaaggcctaggaatcagggacagttatatccccaaccgtag

SEQ ID NO: 27361 - DNA, 627 bp, Artificial Sequence
  Description of Artificial Sequence: Synthetic coding sequence
atggattttagcattatccagtactccaaatttatgacccttctggccatgagtctccagaacctcaagacactccacatgtctctggaggagagcattaagtggttaggcgaagtgatggccgagatagggcccacgcactctcagaaatccgaggattggaatatttttgacgttaaacaggccaatgccataatcgactacctgaagattagtcttttccagcactataaactgtacgaattcatgttctatagtgcgagagaagaaattgtgataggaaccgagcaggtcatcgaagtcgtcaaatcggcatgcggtcctttccccaaccccctggaggaaggcatttcatttgacatttattcaaccttcatagaaccccccacaatcctggatacagagatgaagcgactcgatcaggaacaaggtccagaggagtcccagccagagacagatacatctgacatggatcccctcgtggggtttacgatcgaggacgttaaatctgtgctcgatcaggttacagacgacatcctgatcggtatccagactgaaattaacgagaagctgcagatacaggaggaggcctttaacgcccgcatagagaaattgaagaaggcttag

SEQ ID NO: 27362 - DNA, 255 bp, Artificial Sequence
  Description of Artificial Sequence: Synthetic coding sequence
tgagctgatcctgggggcaatcatgctagaatcggagccttacacatgtctttagaggagtctataaaatggctgggggaggttatggccgagatcggtcctacgcactctcaaaagtcagaagattggaacatcttcgatgtaaagcaagcaaatgccataatcgactacctgaaaatctctctgttccagcactacaagctatatgagtttatgttctatagcgccagggaagagattgtcataggcacatag

SEQ ID NO: 27363 - DNA, 597 bp, Artificial Sequence
  Description of Artificial Sequence: Synthetic coding sequence
atggaatcttcacgctgggacaaagatccacccggggagagaagaccccaacagtctcagcattggaggtcgtgcggtgtgggtggcgctggggaagcaacccggggagggctcttcccagtgcctttccccagtggagactcttggccagaagttacacaacactggatgagatttcagggacagggcccctggtgccccggcctgtggactacccccgcgcatagccattgtaaaccacagacaggcgcagtggacaacgcctcacctaggcaacctcacgctcctgatcaacatgaaaagaatgctggccggcagcacctgcacctctggtcactagcatgccctccctggttgcatagcatacctcacataaagggcaccatactgagtgaggccttatctggttttttagtgagcgatcgccggaccaagacagtggcaggactgagatggctatggttaaggaaagaagctacgccaaccgcgtcgaggaccacactgtcctcaagcctcgcacctagaggtcgaggcgttaataccctgggcagaggaggatgtactttgatggtcctgtctagcgacttatgtgattag

SEQ ID NO: 27364 - DNA, 666 bp, Artificial Sequence
  Description of Artificial Sequence: Synthetic coding sequence
atggagtcctctaggtgggataaggatccgccaggcgaaaggagacctcagcagtcacaacactggagggcccgggaccatggagcccggggctgtggcccacgtcaacctaccgccacagcctcaccaagaccaggattgtggatcactccagcacacggtagtcacacaccgcagacaaacacaagacggactcaagccgataacatctttatttacgaatcctggctcatccaccatggcactcagatgagctctgtgctcccccaaccacctctggtgaggggaccctggcacaatacaaattctccttgggactcatgggccagccgtgggaaactccgagtctgcccctgccgcacgccgagactgcattcctccgggtgtttcagtagtaaagcaggaactgctttgtctccatctcttcctgtccctggcctgaggcctcaaccaccatttctccaaaagcccttgtcaatactggcccctgctacccctcctgcactggtgtctcctacacctccaaagctcagcccaggacaactttccccacactcagttaatgtgcactggggccctcagggacacctgcaccttcctcggtcaggcacaactgtgcttcacgcgtatttgcaaacgctgagttcgcccgcaagccaccagtag

SEQ ID NO: 27365 - DNA, 681 bp, Artificial Sequence
  Description of Artificial Sequence: Synthetic coding sequence
atggccggcctggtcgttagaggcacccaggtctcctacatcgggcaggattgtcgggagatccctgagcatctcggtcgcgattgcggccattttgcaaagcgactcgacctctcctttaatctgctgcgttccctcgaggggcttagcgcttttcggagcttagaggagctgatcctggacaacaatcagctgggtgatgacctcgttctgcctggcctgccccgcctgcacacccttaccctaaataaaaaccgcatcacagatcttgagaacctgttagaccacttggcagaagttacaccggcattagagtatttgtcgctgcttggcaacgtcgcttgtccaaatgaactcgtgtccttagaaaaggacgaggaagactataagcggtatagatgtttcgttctgtacaaactcccgaacctcaagtttctcgacgcccagaaagtaacaagacaggagagggaggaggcactggtccgcggggtttttatgaaggtggttaaacccaaagcatcctccgaagatgtggcatcttcccccgagcggcattacacaccactccccagtgcctctagggagctcacaagccaccagggagtgcttggaaaatgccgttatgtctactacggcaagaactctgaaggaaataggtttatccgagatgaccagctttag

SEQ ID NO: 27366 - DNA, 597 bp, Artificial Sequence
  Description of Artificial Sequence: Synthetic coding sequence
atggagaaatacctgtcactaagcggcaaccatagcagtaacaagagatctctggagggcctaagtgcgttccgttctctcgaggaactcatcctggacaataaccagttgggcgacgatctggtccttcctgggctcccgaggctgcacactctaaccctgaacaaaaatcggatcaccgacttggagaatctgctggatcatctcgccgaagtgactcctgcgctcgaatacctctcactgctgggcaacgtggcatgtcctaacgagttggtttccttggagaaggacgaggaggattataaacggtatcgatgttttgtcctgtacaaactccctaatttgaaattcctagacgcccagaaggtgaccaggcaggagcgagaagaagccctggtgagaggggtgttcatgaaggtggttaaaccaaaagcatcttcagaggacgtggctagttctccagaacgtcactatacccctcttccatccgcctcgagagaactcacttcccaccagggagtgctaggcaaatgtaggtacgtgtattatggtaagaattccgagggaaataggttcatccgtgacgatcagctctag

SEQ ID NO: 27367 - DNA, 438 bp, Artificial Sequence
  Description of Artificial Sequence: Synthetic coding sequence
atggaatctatggcccccgaaatttccgaagacatcgggtgccccctggcatatatgagggagtctgtgtgcgcgctcctgattaatcagtcatttttcagctgcgtggctgaaatgtacattcccgatatgaatagacctgggaaagcggagcgtcgcgcagaaaagggactgaggccccctaggaaactagtaggtgagaccaggcgtctgcagtcctggcccaccctcgcccggtggttacggcgggtgtccttttccctgtacaaaccccccattcaggcagcccccgagcctgaccctgggaattgggcaaagtcacccaggctcagcctcgggccagagggtatcacgaaggggaagcacgggtttaaattccaaggaatcaaggagaaatttaatgtgagcaagaaagtgttgaaaatgacctttctctag

SEQ ID NO: 27368 - DNA, 240 bp, Artificial Sequence
  Description of Artificial Sequence: Synthetic coding sequence
atggcgaaaagcgagcgccgtatctattccatggaatcaatggcaccggaaataagcgaggacataggctgtccactggcgtatatgagagaaagtgtttgtgcactgctgatcaatcagtcattcttctcttgcgtggccgagatgtacatccccgatatgaataggctggaagaacggacggctgccctctatcccatcggattggtccgccagaatggtgagccacgaagggcctag

SEQ ID NO: 27369 - DNA, 468 bp, Artificial Sequence
  Description of Artificial Sequence: Synthetic coding sequence
atggctaagagcgaacgccgcatctatagcatggagtcgatggccccagagatatctgaagacatcggatgccctctggcatacatgagggagtcagtctgtgccttattaatcaatcagtccttcttttcatgtgtggccgagatgtatatcccagacatgaatcgaccaggaaaagccgagcgccgagccgaaaaaggcctgagaccccctcgtaagttggtgggcgaaaccagacggttgcagtcctggccaaccctggctagatggttgagacgggtgtcgttcagtctctataaacctccgattcaggccgcccctgaaccggaccccggcaattgggcaaagagtcctcggctgtctctgggccccgaaggcatcacaaagggcaagcacgggtttaagtttcaggggattaaagagaagttcaacgtttcaaaaaaggtgttaaaaatgacatttctgtag

SEQ ID NO: 27370 - DNA, 411 bp, Artificial Sequence
  Description of Artificial Sequence: Synthetic coding sequence
atgcaatcccgcgagcccagcgggtggcgaaccgcagaacgcaggagaggttggcgatgccggggagtgcctacacctagtggcgaccgcggacccggggcggccaggcccgctgcccgcgggggggccggcgagactacaggccagcagcgccccctccaagtgcccggcgccagcgctgccgccgcccgcaccagactcttgaggtggcatcatcgggtgccttctccccgcgccacccggtcccctggcagcatcaggagaactagtccttgtagtggcgggccggaccggccagagagacccgagtgcgcagatgcctgctgctacctgctagacccttttacattgccactgatccaggactttttccggggttgcgccgcttcagactttgaccggcgggactag

SEQ ID NO: 27371 - DNA, 285 bp, Artificial Sequence
  Description of Artificial Sequence: Synthetic coding sequence
atgttcacacgccatacactgtttcgtcagttcgccgtgctcgctgacacttcatttaattacattaaagttaaaccgcttctagtgcagtcccgtaccacaatgactgctatttccagctcaagccactgcacctccagcatcgacggcaaacacgtagacgttgtttccgatcaggcagctctgcaactctccccaaaagggaaactgagcgagtcacccaaagaggaatcactcgaagaaccctcgatgagacaatcaagtccagcagagaccgttgactag

SEQ ID NO: 27372 - DNA, 285 bp, Artificial Sequence
  Description of Artificial Sequence: Synthetic coding sequence
atgttcactagacacactctgttccgacagtttgctgtactagcggatacttcattcaattacatcaaagtcaagcctctgcttgtgcaatctcgcaccacaatgactgctatttcctcgagcagccattgcaccagctccattgacgggaagcatgttgacgttgtgagtgaccaggccgccctccaactgtccccaaagggtaaattgtcggagagtccaaaggaagaaagccttgaggaaccatccatgagacagagctctcctgcagagaccgtcgactag

SEQ ID NO: 27373 - DNA, 168 bp, Artificial Sequence
  Description of Artificial Sequence: Synthetic coding sequence
atggcgtccaagggcttgcaggacctgaaacaacaagttgagggcaccgcacaggaagctgccatggaccagctggctaaaaccacacaagagacaattgataaaaccgcaaaccaggccagcgacactttctcagggatcggtaaaaagttcggtctcctgaaatag

SEQ ID NO: 27374 - DNA, 231 bp, Artificial Sequence
  Description of Artificial Sequence: Synthetic coding sequence
atggcctccaaaggactccaggatttgaagcaacaagtggagggcacagcccaggaggccgtctctgcggccggtgctgccgcacagcaggtggtcgaccaggccaccgaggccgggcagaaagctatggaccagttggccaagacgactcaggaaaccattgacaaaacagccaaccaagcctcagataccttcagtggtatcggcaaaaaatttggcttgctgaagtag

SEQ ID NO: 27375 - DNA, 117 bp, Artificial Sequence
  Description of Artificial Sequence: Synthetic coding sequence
atggccagcaagggactacaggatctgaaacagcaggtcgagggcaccgcccaggaggccgccatggatcagctggccaaaaccacccaggaaactattgataagacggccaactag

SEQ ID NO: 27376 - DNA, 636 bp, Artificial Sequence
  Description of Artificial Sequence: Synthetic coding sequence
atgtccgaaacagaccatatcgctagcacatcctcagacaaaaacgtggggaagacccctgaattgaaggaggactcttgcaatctcttctctgggaacgaaagctcaaaactcgagaatgaaagcaagctgttaagtttaaataccgataagaccctctgtcaacccaacgagcacaacaacaggattgaagcccaagagaactacattccggatcacggtggtggggaggactcttgtgcgaagaccgataccggtagtgagaacagcgagcagattgctaacttcccaagtggtaactttgccaagcatattagcaaaactaacgaaactgagcagaaggtgacacagattctggtggagttgaggtcaagtaccttccccgaatcggctaacgaaaagacatacagtgaatctccatacgacaccgactgcactaaaaagtttatctcaaagattaaatcagtgagcgcaagcgaggacctgctggaggagattgagtccgagctcctttcaacagaatttgcagagcatagggtcccaaatggcatgaacaagggcgagcacgcactagtccttttcgaaaagtgcgttcaggataaatatcttcagcaggaacatattataaagaagtag

SEQ ID NO: 27377 - DNA, 636 bp, Artificial Sequence
  Description of Artificial Sequence: Synthetic coding sequence
atgagcgaaacagaccatatagcatcaacctccagtgataaaaacgttggtaagacaccggagctgaaggaggattcatgcaatctgttctcggggaacgagtccagcaaactggagaatgagtccaagctgctgtcattgaatactgacaagactctgtgccagccaaatgaacataacaaccggattgaggcacaggaaaattacatccccgaccatggaggcggggaggactcatgcgccaaaacagacacgggatccgagaacagcgagcagattgctaacttcccctcgggaaattttgccaaacacataagtaagacaaacgagaccgagcaaaaagtcacacagatcttggtggagttgcgatcgtctacatttccagagagtgccaacgagaagacgtacagcgaatcaccatacgacaccgattgtacaaagaagtttattagcaagatcaaatctgtctcggcgagcgaagacctgcttgaggagatcgaatcagagctgttgtctaccgaatttgccgaacaccgagttcccaatgggatgaataagggtgaacacgccctggttctcttcgaaaaatgcgtccaggataagtatttgcagcaggagcacataataaaaaagtag

SEQ ID NO: 27378 - DNA, 2697 bp, Artificial Sequence
  Description of Artificial Sequence: Synthetic coding sequence
atgagtgagacagaccatatagctagtacatccagtgacaagaatgtgggaaaaactcccgagcttaaggaggattcctgcaacctcttttctgggaacgaatcctcgaagttggagaacgagtcaaagctcctcagtctcaacaccgacaagaccctctgccagcccaacgaacacaataaccgtatagaggcccaagaaaattacattccagaccatggcggaggtgaggactcctgtgctaaaacagataccggaagcgaaaatagcgagcagattgccaacttcccctcaggcaactttgcaaaacatatttcaaaaacgaacgaaaccgaacagaaggtaacacagatcctggtggagctacgctccagcactttccctgagtccgccaatgagaagacctatagcgagagcccatacgatactgactgcacgaagaaattcatttcgaagattaaaagtgtgagcgcctcagaagaccttctggaagaaatcgaatccgagctgctgtcgactgaattcgcagaacaccgcgtaccgaacggaatgaacaaaggagaacacgcgctcgtgctgtttgagaaatgtgtgcaggataagtatctgcaacaggagcatatcatcaagaaactgatcaaggagaacaagaagcaccaagaattgtttgtggatatttgcagcgagaaagacaacttgcgtgaggagctgaaaaagcgcacggagactgaaaagcagcatatgaatactatcaaacagctggagagtcgcatcgaagagctgaataaagaggtgaaagcaagccgagatcagttaatagcccaggacgtgactgctaaaaacgcagttcagcaattgcacaaggagatggcacagcggatggagcaggccaacaaaaagtgcgaggaggctcgtcaggagaaggaagcaatggtgatgaagtatgtgcggggggaaaaggaaagtttagacttaagaaaagagaaggaaacgttagagaaaaaacttcgggacgcgaacaaggagctagagaagaatacgaacaaaatcaaacaactctcccaggaaaaagggcgtctccaccagctatacgaaaccaaagagggggagaccacacgcctgattcgggaaattgacaaactgaaagaagatatcaactcacacgtgattaaagtaaaatgggcacagaacaaattgaaagccgaaatggactcccataaggaaaccaaagataaactcaaagagactaccactaaactgacccaggccaaagaggaagctgatcaaattagaaaaaactgccaggacatgattaagacctatcaggaaagtgaagagattaagtctaatgaattagacgctaagctccgcgtgaccaaaggcgagctggagaagcagatgcaagagaagtccgatcagctggaaatgcaccacgctaagattaaagaattggaagatctgaaaagaaccttcaaagaagggatggatgagctgaggacgctccggacaaaggtgaagtgtcttgaagacgaacgcctcaggaccgaagacgagctgagtaagtacaaagagataatcaaccgccagaaggctgagatccagaacctgttggataaggtcaaaacagccgatcaactgcaggaacagctccagagagggaaacaagaaattgagaacctgaaagaggaggtggaatcactgaattccctcatcaatgatctgcagaaggacatagaaggcagcagaaaacgcgagtctgagctacttttattcactgaacggttaactagtaagaatgcccagcttcagtccgagtctaatagtttgcagagccagttcgataaggttagctgtagtgagtcacagttacaatcacaatgcgagcagatgaaacaaacgaacattaatcttgagtcgcgcctactgaaagaggaggagcttcgcaaggaggaggtacagacattgcaggccgagttggcatgtcggcagactgaagtaaaggcgctctccacgcaggttgaggaactcaaggacgaacttgtgacccaaagaagaaaacacgcatcttccatcaaggacctcactaaacagttacagcaggctaggaggaagttagaccaggtggaatcaggaagttatgataaggaggtcagttctatgggatcgcgttcttccagcagtggaagcttgaacgcccgctcaagcgctgaggatagatctccagagaacacagggtcttctgtcgctgtggataacttcccccaggtggacaaggccatgctgatcgagagaatagtccgcctccagaaggcgcatgccagaaaaaacgaaaagatcgagttcatggaagatcacattaaacaattggtcgaagaaatccgtaagaagacaaaaataatccaatcttacatcctccgcgaagaatccggcaccctgtcgagcgaagcatctgacttcaacaaggtgcacttgagtcgacgaggaggtatcatggctagtctctatacgagccacccagcagacaatggcttaacattagaactttctttggagataaatcgaaagctgcaagccgtgctcgaagatactctgttgaagaatataacactgaaggagaacctgcagactctgggcaccgagatcgagagattaattaaacaccagcacgagctggaacagagaacgaagaagacatag

SEQ ID NO: 27379 - DNA, 1311 bp, Artificial Sequence
  Description of Artificial Sequence: Synthetic coding sequence
tgaagacttataagagagatcgacaagctgaaggaggatataaattctcacgtcatcaaggtgaaatgggcgcaaaacaaattgaaggctgaaatggatagccacaaggagactaaggacaagctgaaggaaaccactacaaaactgacacaggccaaggaagaggcagatcaaatcagaaaaaattgtcaggatatgatcaaaacgtaccaggaatcagaggagatcaagagcaatgagttggatgcaaagctgagagtgaccaagggagagctggaaaaacagatgcaggagaagagtgaccaactggaaatgcaccacgccaagataaaggagttagaggatctgaagcggaccttcaaagaaggcatggacgaacttagaaccctgaggactaaagtgaagtgtttggaggacgaacgcctgcgcaccgaggatgagctctcaaagtataaagaaattatcaaccgtcagaaggccgaaatacaaaaccttctggataaggtgaaaacagcagaccagctgcaggaacagctgcagcgggggaagcaggagattgagaatttgaaagaggaggtcgagagcctgaatagcctgattaacgacctgcagaaggatatcgagggaagtcgcaagagggagtcggaactgctgcttttcaccgagcgtctgacctcaaaaaacgcccagcttcaatccgagtctaatagtctgcagagtcaattcgacaaagtctcttgttcagaaagccagctgcaatcacagtgtgagcagatgaagcaaaccaatataaaccttgagtcaaggctgctgaaagaggaagaactgagaaaagaggaggtgcagactctgcaggctgagctcgcttgccgccagactgaagtcaaggccctatcaacccaggtcgaagaacttaaagacgagctggtgacccagcggcgaaaacatgcgagttccatcaaagatctgacaaagcagctgcaacaggcccgcagaaagctcgatcaagttgagagcggctcgtacgataaggaagtgtcaagtatgggcagtagatctagctccagtggctccctcaacgccaggtcaagtgcggaagatcgcagcccagaaaacactggctcaagcgtggccgtcgacaactttccacaagttgacaaggccatgctgattgaaagaatcgtacgactccagaaggctcatgcccggaagaacgagaaaatagaatttatggaggatcatataaagcagctggttgaggagattcggaagaaaaccaagaagatttacaagcacctggaacaaaagtag

SEQ ID NO: 27380 - DNA, 3015 bp, Artificial Sequence
  Description of Artificial Sequence: Synthetic coding sequence
gtgggctgtgtctcacatagagggctgtttctgccactcctggccgggtggacaccattgtggaagtcttggccactaagccaaagctctagctcactggtccgagcatggccagaggcttggatcagtggtcgtaaaaaatcttggatttccagccaaaatatctggatacggattctactcctctctctggataacctggtcacttgtgggaaccaaaaacgcgagtatagcaagaatacgcagtactcaccccggtgtaagacaaagatacgatccaggttcgaagaacttcagtccgaactggtgccagtgagcatgagcgagacggaccatatcgcatccaccagctccgataaaaacgtaggaaagacaccggaattgaaagaagacagttgcaacctgttttcaggcaatgagagcagcaaactggagaacgaatcaaaactcctctctcttaatactgataaaaccctatgtcagcccaacgaacacaacaatagaatagaggcccaggagaactacatacccgatcatggcggaggcgaggacagttgtgctaaaactgatactggatcagagaatagtgagcagatcgcaaactttccttccgggaacttcgccaaacatattagcaagactaatgagaccgaacagaaagttacccagatcctagttgaactgcgaagcagcacgtttcctgagtccgccaacgagaagacttactcagagtcaccttacgacacagactgcacaaagaaatttatctccaagatcaagagtgtgtcagcttcagaggatctgctcgaagaaattgagtccgagctgctcagcacagaattcgctgaacacagggttcctaacggcatgaataaaggcgagcatgccctagtgttgttcgaaaagtgtgtacaggacaaatatctccagcaagaacacataattaagaagctcattaaggagaataagaagcatcaggagctgttcgttgatatttgtagtgagaaggacaatctgagagaggaattgaaaaagcgtactgaaacggagaaacagcacatgaacaccatcaaacagcttgagtcccgaatcgaggagctgaataaagaggttaaggcttccagagatcagctgatagcacaggacgtcacagccaagaacgccgtgcagcaattgcataaggagatggcacagcggatggaacaggccaacaaaaagtgtgaggaagcccgccaggaaaaagaagccatggtgatgaagtatgtccgtggtgaaaaagagtcattggacttgagaaaggagaaggagaccctggaaaagaagcttcgggatgctaataaggaattggaaaagaacacgaataaaattaagcagctgagtcaggaaaaaggtaggcttcaccagctgtatgagacaaaggaaggtgagaccaccagactgattcgcgagattgataagctgaaagaggacattaacagtcacgtgatcaaggtgaaatgggcacagaacaaattaaaggccgagatggatagccataaggagaccaaagacaaattgaaagaaaccactactaaattgacgcaagcgaaagaggaggccgaccagatacgcaaaaactgccaagacatgatcaaaacttaccaagaatcagaggagatcaagagtaacgagctcgatgccaagctccgcgtgactaagggagaacttgagaaacagatgcaggagaaaagcgaccaactggagatgcatcatgccaagataaaggaactcgaagatttaaaacggacctttaaggagggcatggacgagctaaggactctgcgaacaaaggtcaaatgcctcgaggatgagaggcttcggaccgaggatgagctctccaaatataaggaaataatcaatcgacaaaaagccgaaattcagaatctgctggacaaagtaaaaaccgccgaccagttacaggagcagctgcagagagggaaacaggagatagagaacctcaaggaagaggtggagtccctcaacagcctcattaacgacctccagaaggacatcgaaggcagccggaagagagagtcagagcttctcctattcactgaacgcttgacctcgaagaacgcgcagctgcagagcgagagtaactctctgcagtcgcaatttgacaaagttagttgttcagaatcacaactgcagagccagtgcgagcaaatgaaacaaactaacattaaccttgagagccgtcttctgaaagaggaagaacttcggaaggaggaggtacaaacactgcaggcagaactggcctgccgccaaacagaggttaaagctctgtcaacccaggtagaagagctgaaggacgagctggtcactcaaaggcgcaagcatgcctcctctattaaagacctgacaaagcagttacaacaggccagacggaaacttgatcaggttgagtctggctcgtacgataaggaagtgagtagcatgggatcaaggtctagttcaagtggatccttaaacgcacggagcagtgccgaggaccgctccccagaaaatactggctcaagcgtcgcagtggataactttcctcaggtggacaaggccatgttgatcgagcgcattgttcggttgcaaaaggcccacgcaaggaagaatgagaagatcgagttcatggaggaccatatcaagcagcttgtggaagagatcaggaaaaagactaagattatacagagctatattctgcgggaggaatcaggaacactgagttcagaagcatctgactttaataaagtgcacctgtccagaaggggcggaatcatggcgagtctgtatacctcccatcccgccgacaacgggctgacccttgagttatcattggagatcaaccggaaactacaagccgtattagaagacactctgctgaagaacatcacgctgaaggaaaacttacaaaccctgggaaccgagatcgaacgtcttatcaagcatcagcacgagctggaacaaaggacaaaaaagacgtag

SEQ ID NO: 27381 - DNA, 1218 bp, Artificial Sequence
  Description of Artificial Sequence: Synthetic coding sequence
atggattcccataaagagactaaggacaagttaaaagagacaaccactaaactcacccaagccaaggaggaagcggaccagatacgcaagaactgccaagacatgattaaaacctatcaggagtccgaggagataaagtcaaacgaactcgatgcgaaactgagggtgactaagggggagctggagaaacaaatgcaggaaaagagcgaccagcttgagatgcatcatgccaagataaaggagctggaggacctcaagcgcacatttaaggagggcatggatgagcttaggacactgagaaccaaggttaaatgtctggaagacgagcgtcttaggacagaggatgagctctcaaagtataaggaaattatcaaccggcagaaggccgagatccagaacctgctagataaggttaaaacagctgaccagctgcaggagcaactccagaggggaaagcaggagattgagaatctgaaggaggaggtggagtctctgaattctttaatcaacgatttacagaaagacattgagggaagtcggaagcgagaaagtgaactcctcctgtttactgagcggctcacaagcaaaaacgcccaattgcagagtgaaagcaactccctccagtcacagtttgataaagtgagttgtagtgagtcccagttacagtcacagtgtgagcagatgaaacaaactaatatcaacctggagagcaggttgctcaaggaagaggaactgcgcaaagaggaagtgcaaacacttcaggcagaactggcgtgcaggcagacagaggttaaagctctgtccacccaagtcgaggagctcaaagatgaattggtaacacaaaggcgaaagcatgcttcatcaattaaggatttgacgaagcaactgcaacaagcacggcggaagctggaccaggtggaaagcggctcatacgacaaagaagtttcatcaatgggttcaaggtcctcatccagtggttctctcaacgccaggtcatctgcagaggatcgtagccccgaaaacaccggatcgtcagtggctgtagacaactttcctcaggtagacaaggctatgttgattgaacgaattgtccggctgcagaaagcccacgctaggaagaatgaaaaaattgagttcatggaagaccacattaaacagctggtcgaggagattaggaaaaaaaccaagaaaatttataagcatctggagcagaagtag

SEQ ID NO: 27382 - DNA, 3744 bp, Artificial Sequence
  Description of Artificial Sequence: Synthetic coding sequence
atgcagtcatccgccttagtggagtctctgattacagtgaagatggcagccgagaatagcgaagagggaaacacctgtatcatcccgcaacgtaacctgttcaaagccctgagtgaggaagcctggaattctggcttcatgggcaattccagtagaaccgcagacaaggaaaacacactgcagtgtccaaaaaccccacttcggcaggacttggaggcgaatgaacaggacgcccgaccaaaacaggaaaaccacctccactctttgggccggaataaagtaggctaccaccttcatccatctgataaaggtcaattcgaccattctaaagatgggtggctgggcccaggcccgatgcccgccgtacacaaggccgcgaatgggcactcacggaccaaaatgatctctacatctataaaaaccgcaagaaagagtaaacgtgccagtggcctgagaattaatgattacgataaccaatgcgatgtcgtgtacatctcccaacccatcactgagtgccactttgaaaatcaaaagagcatcctgagctcccggaagacagctcgcaagagtacccggggctatttcttcaatggcgactgttgtgagctgccgactgttaggactttagctagaaacctccattcacaggaaaaggcatcatgctccgcattggcctcagaggctgtattcacacccaagcagacattaactatccctgcgccccgccacactgtggacgtccagttaccacgtgaggataacccagaagagccttcgaaggagataacatcacatgaagaaggcggcggggatgtatcaccacggaaagaaccacaggaaccagaggtctgccctactaagatcaaaccaaacctcagcagcagcccaaggtcagaagaaacaacggcatcttcccttgtctggcccttgccggcgcacctgccggaggaagatctcccagagggaggttctaccgtcagcgctcccaccgcttccggaatgtcatcccctgagcacaaccagccgccggtagccttacttgatacggaggagatgagcgtgccacaggactgccatttgctccctagcacagaaagtttcagcggaggggtgtccgaggatgtcataagcaggcctcattcaccaccagaaattgtgtctcgcgaagagtcccctcagtgcagtgaaaaccagtcaagcccgatgggcctggaaccgccaatgtcactgggtaaagcagaagacaatcaatcaatcagtgctgaggtggagtctggtgatactcaggaactgaatgtcgatcctcttctgaaagaatcatctacctttaccgatgagaatccatcagaaactgaggaatccgaagccgccggtggcatagggaagctcgagggcgaagacggggacgtaaagtgtctatccgagaaggatacttacgatacctcaatagattccctggaggaaaacttggacaaaaagaagaagggaaagaagttcccagaggcgagcgataggtgcctgaggtcacaactgagcgacagttcaagcgcagatcgttgtctgaggaaccagagctcagatagtagttcagcctgcctggagatcaaagtgcctaagaacccctcagctaaacgttctaagaaagaagggcacccaggcggaacgactcccaagggcttactgccggatagttttcataccgagactctggaggacacagagaaaccatctgtgaatgagaggccatcagagaaagatgctgagcaggaaggggaggggggtggaataattacacggcagactctgaaaaacatgctggataaggaggttaaggagctcagaggtgaaatctttccctctcgtgatcccataaccacagccgggcagcccctgcctggcgagaggctggagatatatgttcaaagcaagatggatgagaagaacgcgcacattccttccgagtcaattgcatgtaagcgggaccccgaacaggctaaagaagaaccgggacatatacccacacaacacgtggaagaggcagtgaatgaggtggataatgagaatacccagcagaaggatgatgagtcagacgctccctgtagctccctcgggctctctagctcaggttccggagatgctgctcgggcacccaagtctgtcccccgccccaaacgccttaccagtagcacctacaaccttcggcatgcgcattctctgggctctctggacgctagcaaggtgaccagtgaaaaagaggccgcacaggtgaaccctatcatgcccaaggaaaacggagcatccgagagcggcgacccactagatgaagacgatgtcgacaccgtggttgacgaacaacccaagtttatggagtggtgtgcagaggaggagaatcaggagctcatcgctaattttaacgctcagtatatgaaggttcagaagggttggatacagctggagaaagagggacagccgaccccacgggcaaggaataagagcgataaactgaaggaaatctggaagagcaagaagcgatcaaggaagtgtcggagcagtttggagagtcagaagtgcagtccggttcagatgctgtttatgactaactttaagctgtctaatgtgtgcaagtggtttcttgagactacagagactcggtctcttgtaatagtcaagaagctgaatacccgactgcccggagacgtccccccggtgaagcacccacttcagaagtatgcaccttctagcctttacccatcaagccttcaggcggagcggctcaagaaacacctaaaaaagttcccaggggcgacaccagccaaaaacaactggaagatgcagaagttatgggccaaatttcgggagaaccccgaccaagtggaaccagaagatgggtccgatgtctcacctggccccaacagcgaggacagcattgaggaggtgaaagaggaccggaattctcaccctcccgccaacctccctacacccgccagcactaggatcctgcgtaagtactcaaatattaggggcaaactgagggcacagcagcgccttatcaagaatgagaagatggaatgccctgacgccttggctgtagaatcaaaaccgtccagaaaatccgtgtgtatcaatccactgatgagtccaaaattggcactccaggtggacgcagacggcttccccgttaagccaaagtccactgagggaatgaaaggtcggaagggcaagcaagtttccgaaatcctccctaaagccgaggtgcaaagcaaaagaaagcgaaccgaggggtcctctccgccagatagtaagaataaggggcctaccgtgaaagcctccaaagaaaaacatgcggacggggctacaaaaactcccgcagctaaacggcccgctgcccgggaccgttcaagtcagcccccaaaaaagacctcactgaaggaaaataaagtaaagatacctaagaaatcagccggcaagagctgcccgccttccagaaaagagaaggagaatacaaacaagcgcccatcacaaagcatcgcttcagaaacgctgaccaaacctgcaaaacaaaagggtgcgggtgaatcaagctctcgcccccagaaggccacaaatcggaaacagagctcaggcaaaacgagggcccggccctccactaaaacccctgagtccagcgccgctcaaagaaagagaaagcttaaagccaagctcgactgtagccactcaaagcgaagaaggctcgatgcaaaatag

SEQ ID NO: 27383 - DNA, 2970 bp, Artificial Sequence
  Description of Artificial Sequence: Synthetic coding sequence
cagccgataactgagtgtcatttcgaaaaccaaaagtccatcctgtctagtaggaaaacagctcgaaaaagtacgcgcgggtatttctttaatggcgattgctgcgagctcccaactgtgaggaccctggcacgtaacctgcactcacaggagaaggcctcttgttcagccctggcctccgaagccgtatttaccccaaaacagaccttaaccattcctgcacccaggcacactgtcgacgtgcagctaccacgcgaagacaatccggaagagccttcgaaggaaattacttcacatgaggaaggtggcggcgatgttagtccccggaaagaaccacaggaacccgaagtgtgtccaaccaaaatcaagccgaatctatcatctagcccacgcagcgaggagacaactgcctcctcactggtgtggccactcccagcacatttgccagaggaggacctccccgagggcggcagtaccgtttcagcacctaccgcctctggaatgtcttcccccgagcataaccaaccacccgtggcgcttcttgatacagaggagatgtctgtacctcaggattgccacctactcccatctaccgagtctttttccggcggcgtatcagaagatgtgatttctagaccacatagtccacctgaaattgtctcacgtgaggagtctccccagtgtagtgagaatcagagctctccaatgggactggagccaccaatgagccttgggaaggctgaggacaaccagtccattagtgccgaagtggaatccggcgacactcaggagctgaatgtggaccccctcttaaaggagtcctctaccttcactgacgaaaatccaagcgagaccgaggaatcagaggccgccggcgggatcgggaagcttgagggtgaagatggcgacgtgaaatgcctatccgaaaaggacacttacgacaccagtatagactcactcgaggagaacctggataaaaagaagaaaggcaaaaagttccccgaagcatctgatagatgtctcagaagccagctgtcagatagctccagtgccgaccgctgcttaagaaaccagtcttctgattcatctagcgcctgtttggaaattaaagttcccaaaaatccctccgcaaaaaggtccaaaaaggaagggcatcctggtggcacgactcccaagggtctcctgccagattctttccacaccgagaccctggaagatacagaaaaacctagtgtcaacgaacggcctagtgaaaaagatgcagaacaggagggtgagggcggaggtatcatcactagacagaccttaaaaaacatgctggacaaagaagtgaaagaacttaggggtgagatcttcccatctagggaccccattacaacagctggtcagcccctgcctggagagcgtctcgagatttatgtccagtcgaagatggatgaaaaaaatgctcatattccatcagagtccatcgcgtgtaaacgcgatcccgagcaggcaaaggaggagccgggacatatacccacacagcacgtcgaggaggctgtcaacgaagttgataatgagaacacacaacagaaagatgacgagagcgatgcgccctgcagttccctcggcttaagttcgagtgggagtggggacgctgccagggccccgaagagtgtacctaggccgaagcggttaacctcctcaacttataatcttcgccacgcccattcactaggctccctcgatgcatccaaggtaacaagcgagaaagaggcagcccaggtcaatcccatcatgccaaaagaaaatggcgcttcagaatccggagacccgctggatgaagatgacgtcgacactgtcgtggacgaacaaccaaagttcatggaatggtgcgccgaagaggagaaccaggagctgatcgcgaactttaatgcgcaatatatgaaagtccagaaaggctggatccagctagaaaaagaaggacagcccacccctcgagcgcgaaataaatccgataagcttaaagaaatctggaagtccaaaaagcgctcccggaagtgccgttcttccctggaaagccaaaagtgtagccccgtccagatgctgtttatgacaaactttaaactgtccaacgtgtgtaaatggtttctggaaaccacagaaacacggtcacttgttatagtgaagaagctgaacaccaggttgccgggcgatgttccccctgtgaaacatccgctccagaagtacgcaccatcctctctgtaccctagcagcctccaagcggagcgcctcaaaaagcacctgaaaaaattccctggggccacacctgccaagaataattggaaaatgcagaaactgtgggccaagttccgcgaaaaccctgaccaagtcgagcctgaggacggtagtgacgtttccccaggacccaactctgaggacagcattgaggaggtgaaggaggaccgcaattcacacccacctgccaacctacccacccctgcgtctacccggattctgcgaaaatattccaacattagggggaagctacgcgctcagcagcggctgataaagaatgagaaaatggagtgccctgatgcccttgcagtcgagtccaaacccagcaggaaatcagtctgtattaatcccttaatgtcacccaaattggccttacaggtagacgccgacggctttcctgtgaagccaaaaagtactgagggcatgaagggacgcaagggaaagcaagttagtgagatcctgcccaaggccgaggttcagtccaagcggaagcggactgaggggagctcaccacctgatagcaagaacaaagggcctactgtgaaggcatctaaagaaaaacatgccgatggtgccacaaaaactcctgcagccaaacgtcctgcggccagggatagaagttctcagccacccaagaaaacaagcctaaaggagaataaagtcaagatcccaaaaaaaaaagagaagtag

SEQ ID NO: 27384 - DNA, 1008 bp, Artificial Sequence
  Description of Artificial Sequence: Synthetic coding sequence
atgatccgtgagtggaaaaacgattgtcagcgtatcgagaaacaaagagcttctgatacgatggtgcaggagagaaaaaacgagaagccagtgagaatctttaataccaacagcagttttcaagatcaagcccctacttgctgccaagaagacttatcaagtgcttcccctttacgcatctggtccaaattctatcggtcagaccctcgaattgctttaggcaagtatagcccccttgaaaaggagatcctgcggctcggcggcatacacacaatcgctgcccgcaggctattagcctacaagcaggaggaggaatgccgaatgctgaaggagctgcagcttttgagtccagattacaagcaggcaatggaatacaaaaagaaacattcaagcccttgcgccatttgcgtcccacttgagaagatctggacagccaaggtcatagcccccctcgaggcgttcaaaatgccacaacgggaacaggtaaacgtgtccaagcatatcgagcggatgagactggcccgagccctgggcaaccaccagcctttgccatacattgagcgatttacaaggagctcatttctttccggagtcgggctcgggcccatggctaagaataaagcacgaagaaaggaggataattatgacacacacaattgtgatgacgccaatcaagacaagaaggaagaggctgaaggcaaaaatacaaagcggagggagataaaaatgaacgttgttttcaaatcaaaggagcctaaaaaatgtttgacataccatggtaacgaccgcaaatcctttctgccggccaagaaaccggagaggagcattgctgggcttacaaatagaaacctgttttgcatctccgagtttccaggagatctgatgctgatgaaccaggacttcatctcgcgaagggaccattttagtgatttagttaaaacttactctctagaggaagaatctatctggaaagagagaatgagaaaagccacaccctaccattattag

SEQ ID NO: 27385 - DNA, 480 bp, Artificial Sequence
  Description of Artificial Sequence: Synthetic coding sequence
taatgtcaaagaatcgaaaaacagcgcgcatccgacacgatggtgcaggagaggaaaaacgaaaagccagtacgcatttttaataccaattctagctttcaggaccaggcacctacttgttgtcaggaggatttaagctcagccagtccactccggatatggtctaaattctacagatcagatccccggattgcgctgggcaagtactcaccactggaaaaagaaattctccgtcttgggggaattcacacaatcgcagcccgcaggctcctcgcttacaagcaggaagaggagtgtcggatgctgaaggaattgcagcttctttcgcccgactataaacaggcgatggagtacaagaaaaagcatagttcaccctgtgctatctgtgttcctctcgaaaagatttggacagctaaggtcatcgccccgctggaagcttttaaaatgccacagagagagcaaaactctcttgtgacatag

SEQ ID NO: 27386 - DNA, 561 bp, Artificial Sequence
  Description of Artificial Sequence: Synthetic coding sequence
atgacaaaagggcgacggtttaacccgccttccgataaggacggccggtggtttccccacattgggctgacgcagaaaactcccgagtctatcacctcagctaccagtaaggagccccaatctccgcacctgccccggcaggctgaggggaagctgccccccatctacaaggtgagagagaagcaggctgttaacaaccagttccccttctccgtgcatgacaaccgccactcgctcgaaaattctggctgctacctggacagcggacttggcagaaaaaagatttctccagataagcgccagcatgtatctagaaattttaacctgtgggcttgtgattacgtcccaagttgcttggatgggttttccaataatcagatttcctatgtgtataaagaagccatggtggtcagcagctttcgtagatttcctcggtgttacaaggaaatttggaatgcctttacattcctgcctgagcgcagctacacagaggttctcaagaagaagccaaaagtgaggttcaccgtggataaaaaagttgtaagttccttagaatcttag

SEQ ID NO: 27387 - DNA, 405 bp, Artificial Sequence
  Description of Artificial Sequence: Synthetic coding sequence
atggtagctctaaagggagtgcctgcactcctatcacctgagctgctctatgccctcgcccgaatgggtcacggtgatgaaattgtactggcagacttgaatttccctgcttcctccatatgccagtgcggacctatggaaatccgggccgatgggctaggcatcccacagctgctggaagcagtgctaaaacttctgccattggacacttatgtggagtcccccgccgccgtgatggaactggtgccctctgacaaagagcgaggtctgcaaacaccagtgtggactgaatacgagtcaattttgcgaagagcagggtgtgtaagggctcttgctaagatcgagagattcgagttttacgagcgcgcaaagaaggccttcgccgtggttgccacaggatgttag

SEQ ID NO: 27388 - DNA, 330 bp, Artificial Sequence
  Description of Artificial Sequence: Synthetic coding sequence
atggagattcgggcggatggtctcggtattccacagcttctggaagccgtgttgaagctgctccccttggacacatacgtcgagtctccggctgctgtgatggagcttgtgccctctgataaggagcgtggactgcagactccagtgtggactgagtatgagtcaattctgcggcgcgccgggtgcgtgcgcgcgttggctaaaatcgagagattcgaattctatgaacgcgctaaaaaggctttcgctgtcgttgccaccggcgagacagccttgtatggaaatttgatcttacggaaaggcgttctggccttgaatcccctcctctag

SEQ ID NO: 27389 - DNA, 465 bp, Artificial Sequence
  Description of Artificial Sequence: Synthetic coding sequence
atggtggccctgaagggtgttcccgcattgctgtcccccgagctcctttacgccctggcccgtatgggtcatggggatgagatcgtgctggctgatttaaactttccagcctctagcatttgccagtgtggacctatggagataagggctgacggacttgggattccacagctgctggaggccgtgctgaaactcctcccactcgatacatatgttgagtccccagccgcagttatggagcttgtcccttcagataaagagaggggcctgcaaacgcctgtctggaccgaatacgagtccattctgaggcgcgcaggttgtgtccgcgccctcgccaagattgagcgctttgagttctacgagagagctaaaaaggccttcgcggtagtggctacaggtgagacggccctatatggaaacctgatcctgcggaagggggtgctcgccttgaatcccctactgtag

SEQ ID NO: 27390 - DNA, 333 bp, Artificial Sequence
  Description of Artificial Sequence: Synthetic coding sequence
atgggtcacggagatgagattgggttgggaatcccacagctgctggaggccgttctgaagctactgccattagatacctatgtggaatcaccagctgcagttatggagctcgttcccagcgataaggagcgaggcctgcagacacctgtatggaccgaatatgagagtatactgcggagggcggggtgcgtcagggctctggcaaaaattgagagattcgaattttacgaaagagcaaagaaggcctttgccgtggttgctacaggagagactgcattgtatggaaacctgattcttagaaagggcgtcctggccctgaaccccctcctttag

SEQ ID NO: 27391 - DNA, 519 bp, Artificial Sequence
  Description of Artificial Sequence: Synthetic coding sequence
atgaaccattgtatccaattcagtccccagagcttacaaaggtggctcattttaccctgctacgaccttaagctgcctatctgggctaacacaacagaattttgtccacacggtccccgacgagccagtcaggatccccaattgttggcctggctcccagatcaatccctggaagtaagcctggagctttacgactggaattccatgaccttcacgctgttcctggagactgtggagccagtggctgtggagtcagaagggtccggaattttctcttttgtctggcagcagctgatcttccccgcagaggctcgctggtgcttttcttgggcacaggattgcgggctcgatggctcatttcccggatctgcccatacggaacctttcggcaaggccgcagcaggacagggtagcgttgcgggcaaagaagccaagaaggcgggcccaggatttcatagacagctgctgtacctccagttccaaaaacgctgtctattcaactacccggagctcctctag

SEQ ID NO: 27392 - DNA, 480 bp, Artificial Sequence
  Description of Artificial Sequence: Synthetic coding sequence
atgaaccttggcgtcagcatgcttcggattctgtttctactggatgtgggcggagcccaggtgcttgccacagggaaaactcccggggcggaaattgactttaagtacgcacttataggaacagctgtgggtgtggccattagcgccggatttcttgcattaaagatctgtatgatcagacggcacctctttgacgatgattcctctgacctcaaaagcactccaggcggcctgtccgacactatcccgctgaagaaaagggcgccgagggctcacgtccttagggatgggcctgcactcggtcctctgcacctgcttttttctgtcatcggaatgctttttgcgagaaagcttcaggccagcactctttttagcttcaagtctctgctgcagtgccatcactgtatcatggagggcctcttcaaagcaaaaccccagtttctacagaaggttagctgtaagtcggatcatctctcctag

SEQ ID NO: 27393 - DNA, 354 bp, Artificial Sequence
  Description of Artificial Sequence: Synthetic coding sequence
atgcttaggattctcttcctcctcgatgttgggggagcccaagtcctggccaccggcaaaacaccaggagccgagatcgattttaaatacgctctgataggtacggcagtgggtgtggccatttcagccggctttttggcattaaagatttgtatgatccgccgacacttgtttgatgacgacagttctgacctgaaatctacccccggaggactgtctggagaaaccaccatcagcccgaaagcctcaggccaaatttgtgcgaatagtcctactacagaatctgaaaagtttcccaagatctgcttactcacctccagaaatgatttctcattttgtcatcaaagcggatag

SEQ ID NO: 27394 - DNA, 519 bp, Artificial Sequence
  Description of Artificial Sequence: Synthetic coding sequence
atgaatctcggcgttagtatgctcaggattctattcctgttagatgtggggggggcccaggtcctggctaccgggaagacccccggcgctgagattgacttcaaatacgctctgattggtactgccgtgggggtcgccatctcggccggcttcctcgcattaaagatctgcatgatccgaaggcaccttttcgacgatgatagttcagacttaaagtctacaccaggcgggttgagtgacacgattccactcaaaaagagagcgcctcgcgcacacgtcctgcgagatggccctgccctgggaccacttcacctgctgttctccgtgatcgggatgctcttcgctcggaagctgcaggcttccacactgttctccttcaaatctttgttacagtgccaccactgtatcatggaggggcttttcaaggccaaaccccagtttctgcagaagcacctggcacgtagcgtccagatccaccagctccaaaaggtcaaatcttttccgaaatatgcctattag

SEQ ID NO: 27395 - DNA, 390 bp, Artificial Sequence
  Description of Artificial Sequence: Synthetic coding sequence
atgaacctgggcgtcagcatgctgcgaatcctttttctgctggatgtgggcggcgcacaggtgcttgccacaggaaagacccccggagccgagatcgattttaaatatgctctcattggaacagcggtgggagtagctatctctgccgggtttctagcccttaagatttgcatgatcaggaggcacctatttgatgacgacagttccgaccttaaatcaacgccgggagggctgtcagatacaatcccactcaaaaagagagcacccaggaaattgcaggcaagcacactctttagcttcaagagtctcctccaatgtcaccattgcataatggagggactttttaaggctaaaccccaattcttgcaaaaaaggtgcaccggagactag

SEQ ID NO: 27396 - DNA, 348 bp, Artificial Sequence
  Description of Artificial Sequence: Synthetic coding sequence
aggattctgtttctgctcgacgtgggaggggctcaggtgctcgcaaccggcaagactcccggcgctgaaatcgactttaagtacgccctgatcgggaccgctgtaggcgtggcaatctccgctggattcctcgcactgaagatctgcatgattagaaggcacctcttcgacgatgattccagtgatttgaagtcaacacctggaggactgagcggcgagaccaccatctctccgaaggcatctggtcaaatctgtgctaattctcccacgactgagtccgagaaattccctaagatttgcctgctgacttcccggaatgacttcagtttctgccaccagagtggttag

SEQ ID NO: 27397 - DNA, 771 bp, Artificial Sequence
  Description of Artificial Sequence: Synthetic coding sequence
atgtcggaggaaatggataatattactgccgaggaaataattgataaacacctgcagaaggatctggacgccgaagagaaccagaacgtagcaaagacgctgagggggaaagtaagggagaagctgaaaatcagcaagattaataagggagaaaagtccagcaccgaacagttgatcgattctgagatacaccagaggagcaagctcagccctcagactgaggtgtccttggatgagagtctgagtttctttatcctatctggtgaggaaggatcagccctcgggaagagctctgaacaaaggccagttaatagaagttacccgaaatgtttttcacttggcgtcaacctgcagaacgttgcggaatccgaggaagaagaatttatgaaggagttcatcctgacagacattttaaaggtgaaggcagcagactacgaggatgatcaggaacaaatcaagaaacagaaggctaacatcttcgtgcccagtagttctcccgttgtgaaccagaggaagctgcctaaggacatgatgccacgcattctggaagatgagggcttttatattcagcgtaagcccgaaatttataaaaaaacgtgcaacaagatggaaaatcgacttctgaagttggaggaggccaaatgctggttcggcgagtccggggagattatgagtcttcctaccccaatcaaacaaagctggaactttcggctgaatgtgcggaaagagccactaaatcctctcctgaagaccatttacaggaaactttag

SEQ ID NO: 27398 - DNA, 531 bp, Artificial Sequence
  Description of Artificial Sequence: Synthetic coding sequence
atgggcgtgcagatgtcagaggagatggacaatatcacagcagaagaaattatcgataaacaccttcaaaaggatctggatgcagaagagaaccagaacgtcgcaaaaacacttcgcggtaaggtgagggagaagttaaagatctccaagattaataaaggggagaaatctagcacagagcagctcatagatagtgagattcaccaaaggtcaaaactgtccccacaaacagaagtatcactggacgaaagcctttcattctttattctaagtggcgaggagggatctgctcttgggaagtcctccgagcagagaccagtcaaccggagttaccctaaatgtttctctttaggagtgaatctgcagaacgtagcggagtctgaggaggaagagtttatgaaggaatttatactgacagacatactgaaggtcaaggctgcggactacgaggacgatcaggagcagataaagaagcagaaggctaacatttttgtgcccagcagtagcccagggaacatcctcagtcagtag

SEQ ID NO: 27399 - DNA, 2337 bp, Artificial Sequence
  Description of Artificial Sequence: Synthetic coding sequence
atgcagcaggagtccgagcggtgtcgtgtaagagcgcgtagacccgacatggcactgtacgtcccaaaggcaagaaggggagccgtgttgttaaagaccggagatgaagaggaatcttgcggtagccctaacagcgtggtgaaagagaaacagaaggagagttccctgtcccagaaagaagtcttcaaggataagccagaggctcgccggctgaacattaacccagatagaaaggaacataactgtcgagaggagaaaaagagttccaccaaactgcgtatggatacttgccttcagaagaccaacagggtctgttccaagagagggaccaccgagagtaaggaggtgttgagccaaggacagcagcaaggcgctcctaacgctggcgtaattactaacgctcctctacaacggcacttcaaacctaagaaggtcgagtgcctggaggtcgagactaccgacgtgaccgggcatgagcgcatccttctaagccaggcatgcttagaaattagcgaggctcaggtcccatctaaaccgtttcagaatgtcgagttctgtgacttttctagacatgaaccagatggggaggcattcgaagacaaggacctggaggggcgcatagaaactgataccaaggtgctggagatcctctatgagtttcccagagtattcagctcggtcatgaaaccagaaaacatgatcgtgccgatcaagttgtcctccgactctgaaatcgtccagcagagtatgcagaccagcgacgggattctgaatccctctagtggaggcatcacgactactagcgtgcctggatcccccgacggcgtgttcgaccaaacctgcgttgacttcgaagtggagtcagttggcggaatagccaactcaacgggctttattctagaccaaaaagacactgactccatcccggctactatggggcacattagcctgtcagaaagtacgaacgacaccgtgtcgcccgttatgattcgcgaatgtgagaagaatgacagcacggcagatgaactgcacgttaagcatgaaccacctgatacagctgtgcttgcccatgagacccacagagattccgggttcaaaaatgtcggggacataaccaacaaggcctgtatgatggatacgactggaatgtcatgttccgatcatgttacagtggattctccctatgtcgttgcagtcagaatcgctgacgagactagcatcaataccagatctttttcaaagttcgttggcatgagcgccgatgccacgcctctgcatgttgcgcgctctggtaacgacacagaagacttttctaacccatctgcttgcagcgacatttatggtgaatccatttcatcccactttactgagagcaccggcaaattaatagagtcgttatcagactgcgcctccagcttacccatcaaaaagatcgctggatccaactataatactttcctggactcggagctcagcatgctcaatggaaccaaggttttgtccgactccgcagttggaattgatttgggaagtacgggcgacacgaccgaggctcttcacgagctacgtactgctgaggagttcaagaccgaagagcaagacgattctgggagtatcgagttcggcgtctcatttcctgaccgcgagagcagtagcatggagacaagtattgagccgaaggcaacggagaccagtcacacggaaggaatcaccgcaatcgaggaaagctgggaaagcatgttcaacgacgacggcgattgcctggacccccgtctgctgcaagagctctcaggtaacacaaaaagcagggagtccatccaggaaccccggtctgattattacaaccacgaggtgccggacatcgatttaagcgactgtgaatttccacacgtcatagagatctacgacttcccgcaggagtttcacacagaggatctgctgagagtcttctgctcgtaccagaagaaagggtttgacattaaatgggtcgatgacacacacgctctaggcgtctttagcagccccatcacagcccgcgatgctctaggaatcaaacatacgatggttaagattaggcctctgagccaggccacgagagccgccaaggccaaagcccgggcgtatgccgagttccttcaacccgctaaggaacggccagaaacatccgcagctctggcacggcggcttgtgatttccgcattaggagtgagatccaagcagtccaaaacagagagagaggccgaactaaagaagctgcaggaggcccgtgagagaaaacgcctggaagccaaacagcgcgaagacatttgggagggacgcgatcagagtacggtgtag

SEQ ID NO: 27400 - DNA, 585 bp, Artificial Sequence
  Description of Artificial Sequence: Synthetic coding sequence
atgcacattaagcccgagaaccattgtagcaagctttcagggaacaccaagtctcgggaatccattcaggagccccgcagtgactactataatcacgaggtgcctgatattgacttgtctgactgtgagttcccacatgttattgagatttatgatttcccccaagagtttcatacggaagaccttcttagagtgttctgcagttatcagaagaaggggtttgacattaagtgggtggatgacacccatgccctcggcgtgttctcttcgcccattaccgccagggacgcattgggtatcaaacacaccatggtgaagattagacctcttagccaggctaccagagccgccaaggcaaaggcacgcgcctacgccgagttcctgcagcctgctaaggaaaggccagaaacctccgctgcgctggcacgcagactcgttatcagtgccctgggggtgagatcaaaacagtctaagacggagagggaggccgaactgaagaaactccaggaagccagagagcggaagcgtcttgaagcaaagcagcgcgaagatatttgggagggtcgagaccaaagtaccgtctag

SEQ ID NO: 27401 - DNA, 2337 bp, Artificial Sequence
  Description of Artificial Sequence: Synthetic coding sequence
atgcagcaggaatcagagcggtgccgcgtccgggcacgtcggcctgatatggcattgtacgtcccgaaagcaagacgcggcgccgtgctgctaaaaactggagacgaagaagaatcctgcggcagccctaatagcgtggtcaaggagaagcaaaaggaatcgtctctgtcccagaaggaggtgttcaaggacaaacccgaagcaagacggcttaacatcaaccctgaccgaaaggaacacaactgcagagaagaaaaaaagtccagtacaaagctgaggatggacacatgtcttcagaagaccaatagggtttgttctaaaagaggcactacagaatctaaggaagttctgtctcaggggcaacagcagggcgcgcccaatgcaggtgtaataactaatgcccctctacaacggcactttaaaccaaagaaggtcgagtgtctggaggtcgaaaccaccgacgttaccggtcacgaacgtatactgctgtcccaagcctgtctagagatctctgaggcccaagtgccaagcaaacccttccagaacgtggagttctgcgatttctcgcgtcatgaacccgacggagaagccttcgaagataaagatctcgaaggaagaattgagactgataccaaagtactggagattttatacgaattccctcgggtcttctcctcagtgatgaagcccgaaaatatgatcgtgcccataaagttgagcagcgatagcgagattgtgcagcagagtatgcaaacctccgacgggattctcaaccccagcagcggcggaattaccacgacttcagttccagggtctccggacggagtcttcgaccaaacttgcgtggactttgaggtcgagagcgttggcgggattgctaattcaacggggtttatactcgatcaaaaagacactgactccatccccgcaaccatgggacacatcagcttaagcgaaagcacaaatgacacggtgtcacccgtgatgattcgggagtgtgagaagaatgatagcaccgccgacgaactgcacgtcaagcacgagccacctgacacggcagtattggcccacgaaacacacagggactcaggttttaagaatgtcggcgacataactaacaaagcttgcatgatggacactactggtatgtcttgcagcgaccacgttaccgtggacagcccttatgtggtcgcagttcggattgccgatgagacctctattaacacccgttctttcagcaagtttgttggtatgagcgctgacgctactcccttgcacgtggcccgctccgggaatgacacagaggacttttccaatccttccgcctgtagcgacatctacggggagtccatttcatcgcactttacggagtccaccggcaagttgatcgaaagcctcagcgactgtgccagctcacttcccatcaagaagatcgccggctctaattacaacaccttcctggattcagagctgtctatgcttaatggtacaaaggtactaagcgactctgcggtcggaatcgatcttgggtcaacaggcgatactacagaggctctgcacgagctgcgcacagctgaagaatttaagaccgaagagcaggacgactccggcagtatcgaattcggagtctcattcccagatagagagagtagttccatggaaactagcatagagccgaaagctaccgagactagccacaccgagggcataaccgccatcgaggagtcttgggagtccatgttcaatgacgacggagactgcctggatcccagactgctgcaggaactgtcaggaaataccaaaagccgcgaatcaatccaagaacctcggagtgattattataaccacgaggttccggatatagatctttccgactgcgagtttccccatgtcatcgaaatatacgacttcccccaggaattccacacagaggacctgctgcgcgttttctgtagttatcagaaaaagggcttcgacattaaatgggtcgacgacacacacgccctgggagtattttcaagccctattacggcccgagatgctttgggtatcaagcacactatggtgaagatcagaccattgtcccaagctaccagggccgcaaaagccaaagcccgcgcatacgccgagttcttacagccagcaaaagagcggccagaaaccagcgccgcgctcgcccgacgcctggtaataagtgccctcggcgtgcgcagtaagcagtctaagaccgagagggaggccgagctgaagaaacttcaggaggccagagagcggaagagactggaagccaaacagcgggaagacatatgggagggccgcgaccagtccaccgtgtag

SEQ ID NO: 27402 - DNA, 555 bp, Artificial Sequence
  Description of Artificial Sequence: Synthetic coding sequence
atgctttctggaaacacgaagagccgcgaatcgatccaggaaccacgttctgattattacaaccatgaggtccccgatatcgacctgagtgattgtgaattccctcatgtgattgagatttacgatttccctcaggaattccacactgaggacctccttcgcgtgttctgctcataccagaaaaaaggctttgatatcaagtgggttgacgacacacacgcactcggggtgtttagttccccgattactgccagagacgcattgggcattaagcacaccatggtaaagatccgaccccttagtcaggcgacccgagccgcgaaagccaaagcacgcgcctacgccgagtttttgcagcctgccaaagagagaccggagacaagtgccgcacttgcgaggcgcctcgtgatcagcgcactgggcgttcgctccaagcagtccaagactgagcgagaagccgagctcaaaaagctgcaggaagcccgagaacgcaaacgcttagaggccaaacaacgcgaggatatttgggagggacgggatcagtccacagtctag

SEQ ID NO: 27403 - DNA, 984 bp, Artificial Sequence
  Description of Artificial Sequence: Synthetic coding sequence
atgcagcaggaaagcgaacgctgtcgcgtacgcgctaggcgcccagatatggcactctatgtgcctaaggccagacgcggggctgtgctgctcaagactggcgacgaggaagagtcctgcgggtctcccaacagtgttgtgaaggaaaaacagaaggagtcaagcctgagccagaaagaagtctttaaagacaaacccgaagcccgccggctcaatatcaatccagaccgaaaggaacataattgcagagaggagaagaagtccagcaccaaactgaggatggacacctgcctacagaagaccaaccgcgtgtgttcaaagcgaggtactaccgagagtaaagaagtactaagccaaggccaacaacagggcgcccctaacgcaggcgtaatcactaacgcacctcttcaaagacactttaagccgaagaaggtggagtgcctggaggtggaaacgacagatgttacaggccacgagagaatcttactctcccaggcttgcctggaaatctccgaagctcaggtcccctccaagccatttcagaacgtcgaattctgcgacttttcgcggcatgagcctgacggcgaggcattcgaagacaaggatctggaaggacgaatcgaaacagacacgaaagtgttagagattttgtacgaatttccacgagtgttttcctctgtgatgaaacccgagaacatgatcgtgcctatcaagttgagtagcgatagtgagatcgtccagcagagtatgcagacttccgatgggatcttaaatcctagctccggcgggattaccacaaccagcgttccaggtagtcccgacggcgttttcgaccagacgtgtgtggacttcgaagtcgagagtgtcggcggtattgcaaattccaccgggttcatcttagatcaaaaaattcaaattcccttcctgcagctttgggtgacgtccttgtgtcagcgggcacagatgaccctgctggtccaatag

SEQ ID NO: 27404 - DNA, 558 bp, Artificial Sequence
  Description of Artificial Sequence: Synthetic coding sequence
cagaaactgagtggcaataccaaaagccgggagtcaattcaggaaccacgctcagattattacaatcacgaagtaccagacatcgacttgagtgattgtgagttccctcacgtgatcgaaatttatgattttccccaggaattccacactgaagacctcttaagggtattctgtagttatcagaagaaaggattcgacatcaagtgggtcgacgatacgcacgctcttggagtgttcagttccccaataacagcaagagacgcactggggattaagcacaccatggtcaagatcaggccactatcccaggcaactcgcgcggccaaagccaaagcgagagcttatgccgaattcctgcagcccgccaaggagcggcccgaaacgtctgccgccttggcacgacgcttagtaatttccgctctcggcgtcagatctaagcagtctaaaaccgagcgggaggctgagttaaagaagctccaggaagcccgggagaggaaaagactggaagccaagcaaagagaggatatctgggaaggccgagaccagtccactgtgtag

SEQ ID NO: 27405 - DNA, 321 bp, Artificial Sequence
  Description of Artificial Sequence: Synthetic coding sequence
atgatggccacgggcacccctgagagccaggcacgatttgggcaaagcgttaaaggcttactcaccgagaaggtgaccacctgtgggacagatgtgattgccctgaccaagcaggtgctgaagggaagcagatcaagtgaactgttggggcaggctgccagaaacatggtgctgcaggaggacgccatcctgcactctgaagactccctgcgcaagatggctattatcacaacgcatctgcagtatcagcaggaagctattcagaagaatgtcgagcagtcaagcgacttacaggatcagttaaaccacctgcttaagtag

SEQ ID NO: 27406 - DNA, 321 bp, Artificial Sequence
  Description of Artificial Sequence: Synthetic coding sequence
atgatggccacagggacgccagagagccaggccagattcgggcagtctgtgaaggggctgctgaccgagaaggtgacaacatgtggcacagatgtgatcgccttgactaaacaggtcctaaagggaagcaggagctcagagctgctcggccaggcggccagaaatatggtgttgcaagaagatgccatactgcactctgaagattcactgagaaagatggccatcatcaccactcatcttcagtatcagcaagaagccatacagaaaaatgtcgagcagtcctctgacctacaggaccagcttaaccatttgctcaagtag

SEQ ID NO: 27407 - DNA, 387 bp, Artificial Sequence
  Description of Artificial Sequence: Synthetic coding sequence
atgaaacacaagtacaatactctgtcctggtacaaaaaggaaaggtctacacagctgcgccgatttatagtccatcagcctgaggttgggctgttttttttcctgagggatgtcgtatacaattatatcacggaaaaaaccacttgtcggtgccccctcacacaagaaaggccttgcgatacaggcggaaagttcggacggatctggatttgccagcccgaagaactggggaagatgcagatttggatatgccagcctgaggaactgggaaaaatgcagatcgacaaaaatcgcaccatggttcagcagatgtggtacatctggtacggaggccttgatacttctaccaatagcctgctgcctatcctggtgagaggaatggcatag

SEQ ID NO: 27408 - DNA, 387 bp, Artificial Sequence
  Description of Artificial Sequence: Synthetic coding sequence
atgaaacacaaatataataccctgtcctggtacaagaaagaacgcagtacccagcttcgcaggtttattgtccaccagccagaagttggactttttttcttcttgcgtgacgtcgtatataattatatcactgaaaaaaccacctgtaggtgtcctctcacccaagaacgaccgtgtgataccggcggtaagttcggccggatctggatttgtcagcccgaagagcttggaaagatgcagatatggatttgtcagcccgaggaacttggaaaaatgcagatcgacaaaaacagaaccatggtccaacaaatgtggtatatctggtatggcggactggacacgagcacaaatagcctgctgcccatccttgttaggggaatggcatag

SEQ ID NO: 27409 - DNA, 387 bp, Artificial Sequence
  Description of Artificial Sequence: Synthetic coding sequence
atgaagcataaatataacacactgagctggtacaaaaaagagcgaagcacacagctccggcgcttcattgtgcatcagccggaagtggggctgtttttctttctccgagacgtggtatacaattacattacagagaagaccacttgccggtgtcctctgactcaggaaagaccgtgtgacactggcggtaaatttggacgtatttggatctgccagccagaagagctcggtaagatgcagatctggatctgccaaccagaggaactgggaaaaatgcagatcgataagaaccgcactatggtccagcagatgtggtatatatggtatgggggtcttgacacatctactaacagcctgttaccaatcctggtaagaggaatggcctag

SEQ ID NO: 27410 - DNA, 912 bp, Artificial Sequence
  Description of Artificial Sequence: Synthetic coding sequence
atggaggagagtatggaggaagaggagggcggcagttacgaagcaatgatggacgatcagaaccataacaactgggaagccgcagtagatgggttccggcagccactccccccccccccacctccatctagtattcccgccccggcccgagagccacccggcgggcagctgcttgccgtacccgcagtgtctgtggacagaaagggacctaaggaaggtttaccaatggggcctcagccacctccggaggcaaacggagtgatcatgatgctgaagtcatgtgatgcagcagcggccgtagcaaaggcagcccccgcccccacggctagctctacgattaacatcaatactagcacctccaaattcctgatgaacgttataacaattgaagattacaagtcaacgtactggccaaaactggatggcgctatcgatcagcttctcacccagagccctggggactacattcctatttcgtacgagcagatatactcatgtgtgtataagtgcgtgtgccaacagcactcagagcagatgtattcggatctgatcaaaaaaattacaaatcatcttgaacgcgtgtcaaaagagctacaggcctctccgccggacctttacatagagagattcaatattgctctgggccagtatatgggcgctctgcaaagcatcgtccccttgttcatttatatgaataaattctatatagaaactaaattgaaccgggatctaaaagatgacctgattaagttgtttactgagcatgttgccgagaaacatatctacagtctgatgccacttctcctggaggcccagagtactccattccaggtcactccctccactatggccaatattgtgaaagggctgtatactctccgccccgttagtcagaatttcacagccgtttag

SEQ ID NO: 27411 - DNA, 1110 bp, Artificial Sequence
  Description of Artificial Sequence: Synthetic coding sequence
atggaagaaagcatggaggaggaagagggcggttcctacgaggccatgatggacgaccagaaccacaataactgggaagcagccgtagacggatttcgccaaccactgcctccgccaccccctcccagcagcatcccagcccccgccagagagcctcccgggggtcagctgttagcagtcccggctgtgagcgtggatcggaaggggcctaaggaaggcctgccaatggggccccagccccccccagaagctaatggggtcatcatgatgctcaagtcttgcgatgccgcggccgctgtggccaaagccgctcccgcgcctaccgctagcagcacaattaacatcaatacttctactagcaagttcctgatgaacgtaatcacgatcgaagactacaaaagtacttactggcctaagttggacggtgcaatagaccaactactgacgcagagcccaggggactacatccctatcagttacgaacagatctactcctgcgtgtacaagtgtgtttgccagcagcatagtgaacagatgtattccgatctgattaagaaaatcaccaaccatttggaacgggttagcaaggagctccaggccagtccacctgatctgtacatagagcggtttaatatcgcgctcggccagtacatgggggcactgcagtcgattgtgcccctgtttatttacatgaataagttttacattgagactaaactcaatagggacttaaaggatgaccttatcaagttgtttaccgagcatgtggcagaaaagcacatttacagcctgatgcctttactccttgaggcgcagagcactcctttccaggtgactccctctactatggctaacatcgtaaaggggctgtataccctgcgtccggaatgggtgcagatggcacccacactgttttctaaatttatccccaacatcttgccccccgctgtcgagtccgagctgtccgagtatgccgcacaggaccagaagttccagagggagctcatccagaacgggttcacacggggggaccagtccagaaagcgcgctggggatgaactcgcgtataatagcagctccgcctgtgcctcttcccgaggatacagatag

SEQ ID NO: 27412 - DNA, 741 bp, Artificial Sequence
  Description of Artificial Sequence: Synthetic coding sequence
atgaacgtgattactattgaagactacaaatccacttattggccaaaactggacggtgctatcgatcagcttttgactcagtctcctggcgactacatccccatttcctatgaacagatctatagctgtgtttataaatgcgtatgccagcagcattccgaacagatgtactcagatttaatcaagaaaataactaaccatctggaacgcgtgagtaaggaacttcaggcttctcccccagacctatacatcgagagattcaatatcgctttaggacagtacatgggagccctccaatccatcgtcccactgttcatctacatgaacaagttttatatcgaaacaaaattgaatcgagacttaaaggacgaccttatcaagctcttcaccgagcacgtggcggaaaaacatatttacagtctcatgcccctgctccttgaggcccagtctaccccttttcaagtgaccccatctacaatggctaacatcgtcaaaggattgtatacattgcgacccgaatgggtacagatggctccgacactgtttagtaagtttatcccaaacatcttgccacccgctgtcgagagtgaactctccgagtacgccgctcaggatcagaaatttcagagggagctaatccagaatggctttacaaggggggatcagtcccgtaagagggctggcgacgaactcgcttataattcctcctccgcctgcgcctcctcaaggggttatcgctag

SEQ ID NO: 27413 - DNA, 543 bp, Artificial Sequence
  Description of Artificial Sequence: Synthetic coding sequence
atgaccaccaccccagtgctatccagatttgctagcccccctgacctgtatatcgaacgcttcaacatagcactcggccagtatatgggtgcacttcagagcattgtgcctctctttatttacatgaataagttctatatcgaaacaaaactgaaccgcgatctgaaggacgatctgatcaaactgttcacagagcacgttgccgagaaacacatatacagcctcatgcctttgttgctggaagctcagagtactccttttcaggtcaccccaagcactatggcgaacattgtgaaaggcctgtacactcttcgccctgagtgggttcagatggctcctacactgttcagcaaattcatccctaatatccttccacccgcggtcgagtccgagctgtcagagtacgctgcccaggatcaaaagttccagagggagctaatccagaatggctttactaggggcgatcagagccgaaaacgcgccggggacgagctggcatacaatagcagttcagcatgcgcttctagtcgcggctatagatag

SEQ ID NO: 27414 - DNA, 1308 bp, Artificial Sequence
  Description of Artificial Sequence: Synthetic coding sequence
atgcctgtgactcatagaaaatccgacgccagcgacatgaattccgatacaagccccagctgccgcctccgggcattttccagaggggggtccctggaaagtagatcgtctagttccagaagccggagctttaccctggacgacgaaagcctaaagtacctaacccatgaggagaaagacgtgctccttttcttcgaggagacgattgattcactggacgaggactttgaggaacccgtcctgtgtgacgggggagtctgctgcctctgtagcccctctctggaagagagcacgtcctctccctcagaaccggaggatgtgatcgacctggtacagcctgcaccaggcgccggagaagccgaaggactccctgagggtactcaagcagctggtcccgccccagctgggaaggagcatagaaagcaggatgctgaaacacccccccctcccgatccaccggccccagagactctgcttgcccccccccccctgccctcaacacccgatccgccaaggcgagagctacgcgccccttcaccacccgtagaacaccccagacttctgagatccgtcccaacccctttggtgatggcgcaaaaaatttctgagcgcatggccggcaatgaagcactttcccccacctcaccattcagagaaggacggccaggggaatggaggacgcccgcagcacggggcccacgatcaggcgaccctggtcctgggccttcccaccccgctcaacctaaagcaccccggtttcctagcaatattattgtaactaatggcgcggcaagggagccgcggaggaccctgtcgagggcggccgtaagcgtccaagagcggagagcacaggtactggcaaccattcacgggcacgccggagccttcccagccgccggggacgctggtgagggggctcccggaggagggagctcgcccgaaagagtcgctaggggacgcgggctccccggtccagccgagtcactgcgcgcgggaggtcaggcaccacgcggccccgcactcgcaaacggattccctagcgctcatgaagccctgaaaagcgctcctagttctttcgcccccgccggcaaatccctgtgctttcggccagggccagcactcccctccacaagggcccgccagtcctttccggggcctcgccagccgaatggcgcccaagattggagacgcgccgactccctccccaggccccaggggattactgtccaattcgctggacggggatcatctgaggaggctcgacgtgaggctcttaggaagctgggcttgctacgggagtcgtcttag

SEQ ID NO: 27415 - DNA, 720 bp, Artificial Sequence
  Description of Artificial Sequence: Synthetic coding sequence
atggcccagaaaattagcgagcgtatggccggaaatgaggcactgtccccaacctctcctttcagggagggccgccccggggagtggcggacgcccgccgcgagagggcctcggtcaggagatcctgggccaggcccctctcacccagcacagcccaaagccccaaggttcccatctaatataatcgtgaccaacggcgcagctagagaacctcggaggacactctctagagctgctgtcagcgtgcaggagcgtcgcgcacaagttctcgccaccattcatggacacgctggggcatttcccgccgctggggacgcgggagagggggcccccggaggtggttcgtcgcccgagcgggtggcacggggtcggggtctacccggtccagcagaaagcctgcgcgctggagggcaagccccccggggaccggcgctggctaatggcttccccagtgcccacgaggctctgaaatccgcacccagctctttcgcgcccgccggtaagtccttgtgctttagaccaggccctgctcttccaagcactagggctaggcaatcttttcctggaccaaggcaacctaatggcgcgcaggactggcggcgcgccgattccctgcctaggccacagggtatcaccgtgcaatttgcgggcaggggatcctcagaagaggcgaggcgcgaggccctcagaaaactcgggctgttaagggaaagctcgtag

SEQ ID NO: 27416 - DNA, 1029 bp, Artificial Sequence
  Description of Artificial Sequence: Synthetic coding sequence
atgccagtcactcaccggaagtctgacgcctcagacatgaactctgacacaagtccttcttgccgcctacgggccttttcgcgtggtgggtctctggagtcaagatctagctcctcacgctccaggtcttttacgctcgatgatgaaagcctgaagtatcttacccatgaagagaaagacgtgctcttattcttcgaggagacaattgacagcttggatgaagactttgaagagcctgtgctgtgcgatggtggcgtgtgttgcttatgttccccatctctagaggagagcacttcctccccttcagagccagaggacgtcatcgacctcgtacagcctgctccaggggctggggaagccgagggtctgcctgagggcacccaggccgcaggtcctgcacccgccggtaaagagcatagaaagcaggatgctgagactccaccgcctccggatcccccggctcccgaaaccttgctggctcccccacctctccccagtacgccggacccgcctaggagggagctgcgggctcccagccccccggtggagcacccaagactgctgcgatccgtgcctactcccctggtaatggcacagaagataagcgagaggatggccggaaacgaagctttaagtcctacttccccttttcgagagggaagacccggagaatggcgcacccccgctgctcgaggcccgcgttccggagatcctgggcccggtccgagtcacccacctgccctggcaaacgggttccccagcgcacatgaggcactaaaatccgcaccctcctcttttgcacctgctggtaagtctctgtgttttagacctggtccagctcttccttccactcgggccaggcagtcgtttcctgggcctagacaacccaatggggcacaggattggcggcgagccgactccttgccaagaccccagggtatcacggtgcagttcgcaggcaggggttccagtgaagaagcacggcgcgaagctctcaggaaactggggctcctgcgcgaatcctcttag

SEQ ID NO: 27417 - DNA, 1026 bp, Artificial Sequence
  Description of Artificial Sequence: Synthetic coding sequence
atgccggtgacacaccggaagagtgacgcatccgacatgaactccgacaccagcccatcatgtaggctgcgagctttcagccgcggcgggtctctggaatcccgctcctcgtccagcagaagcaggtcatttactctggacgatgaaagccttaagtatctgacacatgaagagaaagacgttctcttgttctttgaagagaccatcgattcgttagacgaggactttgaagaacctgtgttgtgtgacggaggcgtctgttgcttgtgcagcccaagcttggaggaatccaccagctccccttctgaacccgaagatgtcattgacctggtgcagcctgcacccggggccggcgaagcggagggcctgcctgaaggcacccaagccgccggtcccgcccccgccggtaaagaacacagaaagcaggacgctgaaactcctcccccacccgacccccctgctcccgaaactctgcttgctcccccaccgctaccaagtacccccgatccgccaagacgggagctgcgggctccttcacccccagtcgaacatccaaggctactccgtagtgtacccacgccgcttgtgatggcacagaaaatttccgaaagaatggcaggaaacgaggcactgtctcccacaagtcctttccgcgaagggcggcctggagagtggagaactcccgcagctagaggtccacggtctggcgatccgggtccggggccatcacaccctgccttggctaacggattcccctccgcccacgaagctcttaaatccgcgccgtcaagcttcgcgccggccggcaaaagtctgtgtttcaggcctggccctgcgttaccttccacaagagctcgccagagctttccgggacccaggcagccaaacggcgcacaggattggaggcgcgcagacagtttgcctcgccctcagggtattacggtacagtttgccggaaggggatcttccgaagaggcccgccgggaagcattaaggaagctgggtctactgcgtgagagctcatag

SEQ ID NO: 27418 - DNA, 258 bp, Artificial Sequence
  Description of Artificial Sequence: Synthetic coding sequence
atgccagtgactcatagaaagtctgacgccagcgacatgaactccgatacttcacccagttgcaggcttagggccttctctagggggggcagcttagaatctcgctctagctcttctagatcgcgctcctttaccctggatgacgaaagtctgaaatacctcactcacgaggagaaagacgttttgctattttttgaggagaccatcgactccctggacgaagattttgaggagccagtgctctgtgacgggggatag

SEQ ID NO: 27419 - DNA, 282 bp, Artificial Sequence
  Description of Artificial Sequence: Synthetic coding sequence
atgcctaaaaatgcagttgtgattttacgatatggaccttattctgctgcagggctccccgtggagcaccacacatttcgtctgcagggactccaagctgttttggccatcgatgggcacgaagtgatcctggagaagatcgaggactggaatgtggtggagttgatggtcaatgaggaagtcatttttcactgcaatatcaaggacctggagttcggcggggacggaaaactcgatccgctgtgcgaaaaagcacgcatagccgtgctgaacgcctattag

SEQ ID NO: 27420 - DNA, 474 bp, Artificial Sequence
  Description of Artificial Sequence: Synthetic coding sequence
atgcctaagaacgctgttgtaatcctgaggtacgggccgtatagtgcggccggtctgcctgtggaacatcatacatttcggcttcagggactacaggccgtcttggcaatcgatgggcacgaggttattctcgagaaaatcgaggattggaacgttgtagagctgatggtaaacgaagaagtcatctttcactgcaacatcaaagaccttgagtttgggaagctgacaccctcttccgataaaaggactacttcttcttcccggcttacctttcaccagctgagctctccgtgccgcatgaaagtctcccctttgcaacagtttccccagaagacccaggatctgacttgtactgttcttgctcagatcggatcatgtatacattttcagactaatctgtgcgacttaggatggcctggccttgatcatatgctgattagcggcctggagaagaggggaacacaaccctactag

SEQ ID NO: 27421 - DNA, 282 bp, Artificial Sequence
  Description of Artificial Sequence: Synthetic coding sequence
atgcccaagaacgccgtggttatcctccgctacggcccctacagcgctgccgggctgcccgtggaacaccacacctttaggctccagggactgcaggccgtgctcgctatcgacggccacgaggtgattttggagaagattgaggattggaacgtggtagaactgatggtgaacgaggaggtgatcttccactgtaacattaaggacctcgagttcggaaagccattcggagatgccagttcacagcaatttgcgagttccgaggagtcactgaatttctag

SEQ ID NO: 27422 - DNA, 474 bp, Artificial Sequence
  Description of Artificial Sequence: Synthetic coding sequence
atgcccaaaaacgccgtggtcatccttcggtacggtccctactctgcggcaggattaccagttgagcaccatacgttccgcctacaaggactgcaggccgtgttagccatcgacggccatgaggtcattctggagaaaatcgaagactggaatgttgttgaactgatggtaaatgaggaggtgatctttcactgtaacatcaaggacttagagttcgggaaactgaccccttcctcagacaaacggaccacgagcagttcccggctgacattccatcaactgtccagcccctgtcggatgaaggtctctcctctgcagcaattcccacagaaaacccaggatctgacatgtactgttctggctcaaatcgggtcgtgtattcattttcagacaaatctatgcgatctgggctggcctgggcttgaccatatgctgatctccggactcgagaagcgaggcacccagccgtactag

SEQ ID NO: 27423 - DNA, 456 bp, Artificial Sequence
  Description of Artificial Sequence: Synthetic coding sequence
atgtttctgcatctcgatagtcacagtagtctcgagcgcacaaagccaactgtggttggtgtcgatacacacatggagcttgacgaagtgcattgttgcccaggcagggatagcggtggcggctttatcaagggacctatgcttcaagggctgcaaggcgaggggaagctggcgcccattccaaaaccgaccctgccaagcccttcccggctgactctatttgtttcctcatcacagatggaagatcatggcttcccagctcggcgcaatggattaactcaagcttccttcatctatcagatgcccgctggatggggatccccggggggactctttctcccatgtcaaccagttccaacacccgtcgtacttaagccccccctcccaccttgcccaatctcgtggggagagtcaggccctgctgtggacggcatcagacgtactcccgccccctag

SEQ ID NO: 27424 - DNA, 456 bp, Artificial Sequence
  Description of Artificial Sequence: Synthetic coding sequence
atgttcctgcaccttgattcccactccagcctggagagaactaaacctactgtcgtaggcgtggatactcacatggaactagacgaggtccactgttgtccaggcagggatagcggtggtggatttattaagggcccgatgctgcagggactgcaaggagaaggcaagcttgctcctattccaaagccaacccttcccagcccatcacggttaaccctgtttgtgagcagttctcagatggaggatcacggctttcccgctagacgtaacggtctgacacaggcttcattcatctaccagatgccagcaggctggggaagccccgggggcctgttcctgccatgtcaaccagttcccacgccggtcgttctgaagccgcctctaccaccctgcccgatttcctggggggaatccgggcccgccgtcgacggcattcgacgcactcccgctccgtag

SEQ ID NO: 27425 - DNA, 558 bp, Artificial Sequence
  Description of Artificial Sequence: Synthetic coding sequence
atgatggctcttgtgcgagatcgccgggctcactatgttatgtctattgttatccggtgggtgcattgcttctcctccagtctcaggggaaccttcggcacaagatgggaggctatgaaagcaaaggccactgagctgcgtgtttgctgcgcccggcgcaagagggaggcacgagaatttaaaccccctcagatgcggggcagtaccaggttgaacatctccgatgatctgaaaattggcttcttttctacggaccacgccactcagacggactcaagcgaaatactgtctgttaaggagctctcttcctctacacagaaattagctcagatgatgaagagtctacaggtagattttgggtttctaaaacaactactgcagctcaagtttgaggatcggttgaaggaggagtccctgtctttgttcactattctgcacgacaggatactggagattgagaagcattatcagcagaatgaggataagatgagaaaatcatttaatcagcagttggctgatgcgatagcggtcatcaagggcatgtaccagccactgtag

SEQ ID NO: 27426 - DNA, 891 bp, Artificial Sequence
  Description of Artificial Sequence: Synthetic coding sequence
gggaggaaaatcatggagggcctggaagcttcaatcgagcagttccaattcaatccaagactgaacatcagcgatgaccttaagattggcttcttttctacggaccacgctacacagacggacagctctgagatactgtctgtgaaagaactcagttccagtactcaaaagctggcgcagatgatgaagtccctacaggtcgactttggcttcctcaagcagctgctgcaattgaaatttgaagaccgcctgaaggaagagtctttgtctctctttactatcctgcacgatcgaatattagagatcgagaagcattatcagcagaatgaagacaagatgaggaagtcttttaatcagcagcttgctgatgccatcgccgtaattaagggcatgtaccaacagttttttgaggtggaagaagagaacgtctcccttcaggacgcgtctactgtgaaaactaatatcctgctgcgcaaactgaaggagaaagaggaagtgatcaaagagctgaaagaggaactcgaccagtacaaggactttggcttccacaaaatggagagcttcgctaaggagacctcctctcctaagagtaacctcgaaaaagagaatctggagtacaaagtagaaaacgaacggttactgcagataatatcggaactcgaggaggagatccagattaaccttaaggagaactctggtctggaggacgagctgatctccatgaaggagatggctgagaaggaccacaagacaatccagaaattaatggactcccgggatcgcctgagggaggaactgcactacgaaaagagtcttgtgcaggatgtgattaacaaacagaaggaggataaggagatgagaaaaaagtacggatccctcagcgtcaagtag

SEQ ID NO: 27427 - DNA, 1887 bp, Artificial Sequence
  Description of Artificial Sequence: Synthetic coding sequence
atgaccgaagaacagacttatcaagctgccgagaagtctcaggcccacaacgaggtgcccaacgagcggttagtcgttgagcatcaagagtcactgtccaagaccaaactgcagatcaagaaacaggaaacgtccacggaacagcccctaacgactcccgacaaagaacctaacgagaacttgatcctgcgacatcaagatagcatgtcaaaatccgagatgcaagtcaaggaacagcggaccctgaaaggccagaggatcattacccacgatgaagagcccggcaaaaaccttgtcctggaacaccaagatagtgtgtctaagctcgagatgcaaatagaaaagacaaagaagctccctagggagaaaaggcactctacgcatgatgaggaatccggagagaaccccatgttaaaacaccaggacagtgtgtctaaaatccaggtccagcttgaaatccaggagacctccgaaggtgaggggcgatccatcccagataaaaactcgatgtttgtccatcaggattctgtgagtaagctgcagatgcaagaaaagaagaaaataaccccaggtagggagagacggaacacaagaatagtggtgccaaatgaaaacgtcatcagtgtccatcaggacagtaagagcaaactccagatgcaggaaaaaaaacaaataaattctggtgtagagcggcacaagacctttccgctcgaaatcaaaaagaaggatataagtcttgagcatttgctgcccgaggaaaaagttctgcttagccgcagcgagagccagacaaagaagttacaggctaaggttaccagccgcaaaaaaaccgacatagaatcactgcgcggcgccctgggtaggagactgcttaacgatgagttcaagactcagagtaagagctttcccggccccgatatcgagcagctcaccgacgcctttgggcgcgacatcctcaaagacgaatttaaaaccaggagcaaaagcctccctgagacagatgagcgcctacactccaccacagagcgtggcaccattaacgacgccattaagactcagcttaagaggaagagctaccccgagaccgtcctgaaacatctaaaaggagtcaatggtaaggacattatcaagcatttgatcaacatacaatccaagtcacacggtgagaccgacaaaaatttcttcgcttatgcaacagggagagggctaatgaaagaatcaacaacgactcagttgaaatctcatccagaaaccgataaggagttccttgccgatgctattggacgcgggattataatcggccccatcacaacccaacttaagtcgcatcgcgagactgacaaggagttattgaaagatgcaatcggccgtgatatcatcaagggccctatctcagcgcagttgaagtcacaccaggagacagacgttgagcccctcacaaatgccatcgggagtagtaagacaataggtgaaatcaagacccagctacggacgcactacgatgtcaatctctttaagaacaaggatatgtctgttcagcggcaagaaggcatttttactaggagcatcactccctctaaattccctactaaggtgattaacctttccccgttcgagaacaaagaggaaacttatgaatacagctccccttatgtgactgccccttctaaagcgatctacaggacgtatagggctggccctagtttcagcaaggacatacacctccccttgctcaaccagctacccagtggccattcaaaagtcgttacactgtctcaaaaaaccatcgagtttactttgcctacggtcaccaacacggtgggaaaacccacatataaggttctgcatgccgctgctcggaagtcagtgcctcacccttacttttag

SEQ ID NO: 27428 - DNA, 2079 bp, Artificial Sequence
  Description of Artificial Sequence: Synthetic coding sequence
atgaccgaagaacaaacttatcaagcagccgagaaatctcaggcccataacgaagtgccgaacgagcggttggtagtcgagcaccaggagagcttaagtaagactaagctgcaaattaaaaagcaggaaaccagcacggaacagcccctgaccacgcctgacaaggaacccaacgaaaacctcattctccgccatcaagatagtatgagcaaatccgaaatgcaggtgaaggagcagaggaccctcaagggccaaagaattatcacgcatgatgaggaacccggcaagaacctagtgttagagcatcaggactccgtaagtaagctggaaatgcagatcgaaaagactaagaagctccctagagagaaacgacatagcacacacgatgaggaatccggcgaaaatccaatgctcaagcatcaggattctgttagtaagattcaagtgcaactggagatacaggaaacaagtgaaggtgagggtcggagtatccctgacaagaatagtatgttcgtccatcaggattctgtgagtaaactgcagatgcaggaaaaaaagaaaatcactccagggcgcgaaaggagaaatactcgcatcgtggtgcctaacgaaaacgtaatttcagtgcatcaggacagcaagtctaagctccagatgcaggagaaaaaacaaattaatagcggcgtcgagaggcacaagacatttcctctggaaatcaagaagaaggacatctcactggagcatcttctgccggaagagaaggttctgctgagtcggagcgagagtcaaaccaaaaagttacaggctaaggtaacaagccggaagatcaaaaacgaagctgccagtgaactccctgatactgcagagaatttgcctgcgatgtatccttctatttctgatctgattattcagtttgacctgaacaaggtggtggaaaccgacattgaaagccttagaggggccctcggacgtcgtcttcttaacgatgaattcaagactcagagtaagtcattcccaggacctgatattgagcagctcaccgatgccttcggacgggacattctcaaggacgagtttaagacccgttccaagtccctgccagagactgacgagcgactccactccaccactgagcggggtacaattaatgacgcaatcaaaactcagctaaagcgcaaaagttaccccgagactgtcttgaaacatcttaaaggcgttaacgggaaggatataatcaagcatctaattaatatccagtccaaaagccatggagagacagataaagaacacctggccgatgacactggacgcggaatcatcaagggctcaatcaacgctcaactcaagggccatcaaaaaactgataagaactttttcgcttacgccaccgggcgaggattaatgaaggaaagtactacaacccagctgaagtcccatcccgagaccgacaaggaatttctcgccgatgcaataggcagagggattataattggacctattacgacacaactaaaaagtcacagggagaccgataaggagcttttgaaggacgcaatcgggcgcgacataatcaaaggccctatctctgcccagctgaagtcacaccaggagaccgacgtggagcccctgacgaacgcaatcggcagcagtaagactattggggagattaaaacccagctccgaacccactacgacgtgaacctttttaaaaacaaggacatgagcgtccagcgtcaggaggggatcttcacccgttctattacaccctcaaaatttcccaccaaagtgattaacctgagcccttttgagaacaaggaagaaacctacgagtactcatcaccttatgttaccgcccccagcaaggctatctaccggacgtatagggccggacctagtttttcaaaggacatccacctgcctctgctgaaccagctaccctctggtcactccaaggtggtgacattgtcgcagaaaacgatagagttcactctgccgaccgtgacaaacacagtaggcaaacctacatacaaggttctccatgccgccgcaagaaaaagcgttcctcatccctacttctag

SEQ ID NO: 27429 - DNA, 1815 bp, Artificial Sequence
  Description of Artificial Sequence: Synthetic coding sequence
gcccataatgaagttcccaacgagagattggtggtagaacaccaagaatccttgtcaaaaacaaagctacagatcaagaagcaggaaacctctaccgaacagccactcacaacaccagataaggagcctaacgagaatctgatcctcagacaccaggactccatgagcaaaagcgagatgcaagtgaaggagcagcgcaccctgaagggacaaagaattatcacgcacgatgaggaatctggcgagaacccaatgctcaagcaccaggatagcgtcagtaagatccaggtccaacttgaaattcaggaaacgagcgaaggcgaaggtcgctccatccccgataagaactcaatgttcgtgcatcaggatagcgtgtctaagctccagatgcaagagaagaagaaaatcactcccggccgggagaggcgcaacacgaggatagtcgtgcctaacgagaacgtgatctcagtgcaccaggactctaagagcaagttacagatgcaagagaaaaaacaaattaattcaggcgttgaaagacataagaccttccccttagagatcaaaaaaaaagatattagcttagaacacttactgcctgaggagaaagtgctgctgagccggagcgagtcccagacgaagaagctccaagccaaggttacttcccgcaaaaaaacggatatcgaatcacttaggggggctctcggccggcggttactcaatgacgaatttaaaacccagtctaaaagcttccctggaccggacattgagcagctcaccgatgccttcggacgagatatactgaaagacgaattcaagacccgctccaagtctcttccggaaacagatgagcgattacacagcacaaccgagcgaggaaccattaatgatgccatcaaaactcagcttaagcggaaatcataccccgagactgttctgaagcatttgaagggggttaacggtaaggatattataaagcacctgataaatattcagtcgaagtctcatggtgagactgataaagagcacctagccgatgacaccggacgcggaataatcaagggaagtattaatgcccagctcaaaggccaccagaaaacggacaaaaatttctttgcatacgcaaccggtcgaggcttaatgaaggagtccacaaccacacaactcaagtcccacccggaaactgacaaggagttcctcgccgacgccatcgggcgcggcatcatcatcggccctattaccacgcagcttaagtcacatagagaaacggataaggagcttctgaaggatgccataggacgtgatattataaagggccctatcagtgcccagttaaagtctcaccaggagactgacgttgaaccgttgacgaacgccattggaagctcaaaaacgattggagaaataaaaactcagttgcgcacccactatgacgtgaatctattcaaaaacaaagatatgagtgtgcagagacaggaaggcatcttcacgagatctattacgcctagtaagtttcctacaaaagtgattaacctgtcaccatttgagaataaggaagaaacctatgagtactcttctccatacgtgaccgccccaagcaaagctatctaccgaacctatagagcaggaccctcattctctaaggatattcaccttccattgctgaatcaactgccatccggacattcaaaagtcgtgaccctctcacaaaaaacaattgagttcactctgcctactgtgacaaacaccgtgggcaagccaacttacaaggtgctgcacgctgctgcaagaaaaagcgtgccccatccctatttctag

SEQ ID NO: 27430 - DNA, 2160 bp, Artificial Sequence
  Description of Artificial Sequence: Synthetic coding sequence
atgatgcaagggaataaaaagtgcaccgatgccttttcagactcctcctccataggaagtgtgctcgacgacgccgaccgggaggtctcatcacttactgacagagcctttcgatccttatgtatttcagaggacacctcctttcacgacagctacctggctgtttcgcccgacatcacacgccaagtgtttgggaccttccaccagcgcacagtgggacatactcagcgcaagtctggaatctggtctcaattgccttcacaggggaccgaacattccggttgggctgcaacattccagcaactgcctaagtatgttcaaggcgaagaaaagtatccaaaaacctcgcctccacctacccccgtgcaaaggcggcttgaagtgccagtgtctggactgcgctccagcaataaaccggtgtccaaggtctcaaccctcattaagtctttcgatcggactgagtcacagcgctgcgagagcagacctactgcttcaaagcctcccgcacttaagaatcctcccaaatttgctcccctcccagaaaactcggttaacttctgtttcgatagcgccttcctgaccgttaggagggtgccggcagaggttagcaacacccatcaaaactcttatcaacccggtaggaaacatggcgagcaggaaagtagtaagaatcccgagatggcctgccacggttcatccagctttctgcccgcagccaacgacacggctacactctgcgaaagtaagttccccagccctcaccacaagccggtgaccggtgagccaggacggggcaaaggtactttcctgcattctgagaattctgcttttgaaagttggaacgcccatcagcccaagttgctggaacggaaggatactgccggcacagtgcccgagagtaaagcaccaaagcactatggggacactacactgctgagagaaccctgcccaccagaacgaacagtatccccctgccaggtccaggcatcttgctcacaagaagaaaaccgcctggccgcaggagcattgtcaacctctatcccttggggatgccgtgatcctggtgcccaggtatttgcggttgagggaaaggctccttcctcacagcccgacagccaggagaagcctgcccaaccaccatggcggaaaccaaagactggcaaaaagggaaaagagagtctgcaagacacgttggaggagaaaacacagaccaaccagagaggaccccccttgtacaccaaacataatccccaagagcaattctctgaaaataacgcgcttgacctccccgtggagccaaacgagcattacgaccccccctttaacatctcaaaactgctcactccaataattccaagtaagcatgctcttgatagtgctgattcccaaccagcggagcgaacgcctagtcctcccggccaattgaatggttatcaggaaaaggagccttctgaatgtcaatcacgtgatagttataagtctaaagccccatcgcttctctttaatcttaaggacgttaggaagagagtgaagtcaacgtactccagcagcccactactcaaagtcctggatgagaaaacacgcggcaaggtcgacggcaagcaggagccggtatcaaacggtgtgatccttccaaacgggctggaggagtctccaccgaacgagctgagtaaagaacgaccagcagacgaccccacggcgagtcatataaacccacagaaggaccccactgcagacccaagtgaaccaagtgctgacagctacctcacactttccaccgctccaaccattgcgaaagctcctttctatgtaaatggtgaagcggcggagcgaagttcttatgagaacaaagaagtggaaggtgagcttgagatggggccggccgggagtagttggtgtcccgactctcgcgagcaccggccccggaagcatctaagtctccggttgtgtaaccgcgatcccgagcctggaggcgctacagaaaagatgaaaactcatcagctagagaacggcctctcacggtcggtttcacaggaaaccgagccagagcgcgaggctggactgcagaacacccatacccacacccacacccacactcacacccacgaccaccagcatatcctgtcacttttcagaagcatcaagtcgaggcggcagtag

SEQ ID NO: 27431 - DNA, 4308 bp, Artificial Sequence
  Description of Artificial Sequence: Synthetic coding sequence
atgatgcagggcaacaaaaaatgtacggacgccttctcggatagttcaagtattgggtccgtgctggatgatgcagatcgggaagttagttcccttactgacagggcttttcgaagcttatgcatctcagaggacacttcatttcatgatagctatctcgccgtatctccagacatcaccagacaggtattcggaactttccaccagaggaccgtagggcacacccaacggaagtccggcatttggtcccaacttccctcgcaaggcacagaacactctgggtgggccgcgaccttccaacagcttccaaagtacgtgcaaggcgaggagaagtacccaaagaccagccccccccctactcctgttcagagacggctagaggtgcccgtgtccggcctgaggtcctcaaacaaacccgtatccaaagtgtcaaccttgatcaagtcctttgatcggacagagtcccagcgatgcgagagccgcccaactgcaagtaaacctccagccttgaaaaacccccccaagtttgcccccctgccggaaaactcggtgaacttttgcttcgattcggctttcttgaccgtccgcagggtgcctgctgaggtcagcaacacccaccagaattcttaccagcctggaagaaaacacggagagcaggagagcagtaagaatccagaaatggcgtgccacggcagctcatcctttctacccgccgccaacgataccgccacactgtgcgaatccaaatttccgagtccccaccataagccagtcacgggtgagcccggtcgtggcaaagggacctttctgcacagcgaaaattctgcctttgagagctggaacgcacaccagcctaaacttctcgagagaaaagataccgcgggcactgtccctgaatccaaggcccccaaacactacggcgacaccacccttctgcgggagccctgtcccccagaaagaacagtaagcccttgtcaggtgcaggcctcatgttcacaggaagaaaacaggctggccgccggagccctgtcaacatctattccgtggggctgcagggatccaggggcacaagtgttcgctgtggagggcaaagccccgtcatcccagccggatagccaggagaagcccgcccagccaccatggagaaagccaaagaccggcaagaaagggaaagagtcacttcaggacactctggaggaaaaaacccaaacaaatcagagaggacctcctttgtacacgaagcacaaccctcaggaacagttcagcgaaaacaacgccctggatctgccagtggaacctaacgagcactatgaccccccattcaatatctcaaagttattgaccccaataataccatcaaaacacgctctcgatagtgctgacagccagcctgccgagagaacaccctcacctccgggacagctgaacgggtaccaggagaaggagccctctgaatgtcagtctagggatagttataagtccaaagcaccgtcattgctgttcaacctgaaagacgtgaggaaacgggtgaaatcgacatacagttcctcacccctgctgaaagtcctggacgagaagacaaggggcaaggttgacggcaagcaggaacccgtgagcaatggcgttatattgcctaacgggttggaagagtcgcctccaaatgaactctcaaaagagcgcccggccgacgacccaacagcctctcacatcaacccccagaaggatcccaccgctgatccatccgaacctagtgccgactcgtacctgaccctctccaccgctccaactatcgctaaggcccctttctatgtcaacggagaggccgctgagcgctcctcatatgagaataaagaggtcgagggcgagttggagatgggcccagcgggaagtagttggtgccccgactcgcgtgagcatcggccgcgaaaacacctgtccctcaggctctgcaacagggatcctgaacctggcggcgcaaccgagaagatgaagacccatcagctggagaacggactatctagaagcgtgagccaggagaccgagcctgaacgcgaagccggactgcagaatacccacctcaaccagaagttcttccctggacccctgtcaccggaagaagaggatgtgttttactcagacagtcaatccgattttatgccctcccttaagggaaaagcgaagttcagcacctccagcagtgatcagtctttcgcttccttcgacgaccagcagaagatgtggtttacagagaaccagcgggaagaccggcgcaaagatgtgtccgcaggcgatagccagaaagacgagaaagagaatgttatgcgtaaagatgagctccagtactgtgcccttagcaacgggcatgcatgcctggaaaataggtctcagggcgaagccctacagcgggaacgggaatccgtctctgggggtagaactagaaaggcatccgctgaggaagccaatttccggggatcctggattggagagaataaaggaaccacgttcagccaggctaaggatcttacccccagtccgagctctgccagcaacagacacatgttgttcaccattaaagacaacactctcagggcaacgccagtaattaagccaattatgctgcccttgctgagaacgatgtcattggaagattctttaagcagtggccataaggaggaggaactgccacgccccgaatggggtgaagaccccgggttctgcgctcccgagaaccaggatatcttaggcacctccacgccgacgaacaccagaggcaccagggtaaaatgtatggctaacgaagttatggaggaccccggtcaaggatcatccatggccaggatggaagcttcacagcccgcaccaaaaggaaacttcccatccatgccccttgtgggagaaggcgaccgcgtgaaagccccacccgatgccgccccaggtctggtggcaagcaactgcaaaagcggaagcgctgactcagggaaacttgcggcaccatggcacatcccaaccattgctctcccagagggtgatatcgaagatcagccccccccctggcaacctgagaattgttgggaggagcagacccccgggtttaagagccacttcctgtcgaccccaagagctggcccgcctggacgccgcctggttccctctgaaagggccaacagccccaacccgggtagccccggcgaaagttctgcatgttctcctgccgcttccaatatttgggaggagagcagtcaggctcctggtggcccggagttactccctgaagagcccaaccaagcatcaccgtgggcaagcagttcacccgcacgggttacacggcgcgaagatttgactcacgctctagtgtgggagggtggctctgaccctctgctcgaactgtcggccgaggaccttcgaacactgtccccaagaggctcattgttggacgtcgccacaagtcccgctgggacatctggacgactggagctgcctgctcaactggaacggactgcgtcgaagcccccggcagtccctcctaaaactgaaaaggctttacgccgggccaagaaactggcctctaagcgccggaagactgatcaagcacaagagaagcatggcgagagccaggaaggtaagccctgtccagaagatctcgagcagactcaacagcggcctctgtgcccgcgtgagaggccccggcacaattttcccgtggtaagatctcttccgcctccagtgcaccgccacagcgtctcaggcttttcagagccagtcggccggcgcccaggcggacctcagtcacttacccctcttccagcgtaccctgcaacccagaaggtgttgcaggatccacaaagcggcgagtactttgtttttgacctgccacttcaagtcaaaatcaagacattctacgatcccgaaaccgggaagtacgtgaaagtaagcatcccttcctccgagggcgcgtcccccgagccccctcccccagatgctctcgcagctccctatgtgctctaccctggattccagcccgttcctgtcacggccctcatgcctttgcggtgtagctctcagctcagcgcaccaaccttcctccgccagggacctcgggcatccgcagccagagctaggacccagtccgtccacgagtctggactacaattagacccaggcccacacggcgattgtacaccgcacagcgccggccaaaggccgcatggaccaccgcaatcccctggagaggaaggggtcgaggctcctgggctcggaattatttctacggacgacctggaggactttgcgactgaggggatttcctag

SEQ ID NO: 27432 - DNA, 480 bp, Artificial Sequence
  Description of Artificial Sequence: Synthetic coding sequence
cccatgcgacatcggaagaaagccgcggacaagaatttgccgtgccgacccttggtttgcgctgttctggatctcatggtcgagttcatcgtcacacacatgatgaaggaattccctatggatctttacatccggtgtatccaagtggtgcacaagttactgtgctaccagaagaaatgccgggtgagactgcactacacgtggcgtgagctgtggagcgcgctgatcaatctgttaaagtttcttatgtccaatgaaacagtgctccttgcgaagcacaatatttttactctggctctgatgatagtaaatctgtttaatatgttcatcacatatggcgacactttccttccgacgccatccagctacgatgagctgtactacgagataatccggatgcaccagtccttcgacaatctgtattctatggagccgtctagcactacgctgacaccaaagctctctcccacactgctctag

SEQ ID NO: 27433 - DNA, 597 bp, Artificial Sequence
  Description of Artificial Sequence: Synthetic coding sequence
atggagagctattttttcaaagagactagccacgagagcgtcgattcatctaaagaagagcctcagaccctcccagagacacaggacggggacctccatcttcaagagcaggggagtggcatagattggtgcctaagtcctgccgatgtggaggcccagactacaaatgaccagaagggcaacatccccgacgaaagccaggtcgaaaaactgaacgtctttctctcccccccagatgtgattaattatctggccctgactgaagcaactggcagaatctgtgtttcccaatgggagggcccaccccgcttgggctgcatattttgtcatggagaccatctgcttgctgtgaatgatcttaaaccacagagcctggaagaagtgagtctgtttcttacccggtcaatccagaaggagaagcttaaactcaccatcggaagaattccaaatagcgagacattccacgcagcttcatgcatgtgtccgtctaagtgccaaagtgccgccccgagccagctggacaagcctcgactgaatcgagctccaaaaaggtcaccagctattaaaaagtcccagcaaaaaggcgctcgggagtag

SEQ ID NO: 27434 - DNA, 1092 bp, Artificial Sequence
  Description of Artificial Sequence: Synthetic coding sequence
atggagccaaagccccaaaaatccccaggtaagcagtttactttcagctatgagaatgaagtttgcaagcaggattactttattaagagccccccatcccaattattttctagcgtgacctcttggaagaagagattctttatactgtctaaggctggtgagaagtcctttagtctgtcatattacaaggatcatcaccatcgcgggagcattgaaatcgatcaaaacagcagtgtggaagtaggcatctcaagtcaggaaaaaatgcagtctgtgcagaagatgttcaaatgccatcccgatgaggttatgtcgatccggaccacaaatcgcgagtattttctgatagggcatgaccgagagaaaatcaaggattgggtctcatttatgtcttccttccggcaggatataaaggcaactcaacagaacaccgaggaagagctgtcactaggaaacaagcgaaccctgttctatagctccccactgcttggtccttcttccacctccgaggctgtcgggtccagtagcccgcgcaacgggctgcaagataagcatctcatggagcagtcctctccaggcttccggcagacacacttgcaagacctgtctgaggcaacacaagacgttaaggaagaaaatcattatctgacccctaggtccgtgctcctggagttagacaatataatcgcctcttcagattccggagaaagcatagagacggatgggcccgatcaggtgtcaggacggatcgagtgccactacgagccgatggaatcctactttttcaaagaaacttcacatgaaagcgttgactcttctaaagaggagccccagaccctgccggagacacaagatggggacttgcacttgcaggagcaggggtccggtatcgattggtgcctgtcacccgctgacgtggaggcccaaacaaccaacgatcagaaggggtcagcctctctgacagtggtgcaactctcaattttgattaataatatccctgatgaaagccaggtggaaaagctcaatgtttttctgagtccccctgacgtgatcaactaccttgcattgaccgaggcaaccggccgaatttag

SEQ ID NO: 27435 - DNA, 849 bp, Artificial Sequence
  Description of Artificial Sequence: Synthetic coding sequence
atggaacagagctcccccggtttcaggcagactcatctgcaggatctttccgaggcaacacaggacgtgaaggaggaaaaccactatctgacaccccgatccgtgctcctggagctggataacatcatcgcctcttccgactccggggaatcaatcgaaacagatggacctgatcaggtctctggcaggatcgaatgccactacgaaccgatggagtcatattttttcaaggagacaagtcacgagagtgtggactctagcaaggaagagccccaaactctccccgaaacccaggatggtgatctccatctgcaggagcaaggaagtggcatcgattggtgtctgtctcctgcggatgttgaagcccagacaaccaatgaccagaagggatcagcgtctctcaccgtcgtgcagttatcaatcctgattaataacatccccgatgaatcacaggtggaaaagctaaacgtcttcctctctccccccgacgttattaattatctggctctaactgaagccaccggcaggatctgcgtaagccagtgggagggccctccccggctggggtgtatcttctgccacggcgatcatctgctcgcagtgaatgacctaaagcctcagtctctggaggaggtgagtttgtttcttaccagatctatccagaaggagaaactcaaactgaccatcggccgaatcccgaattctgagacttttcatgccgcctcctgcatgtgtccttcaaagtgtcagagtgctgcacctagtcagcttgataagcctaggttaaatagagccccaaagcggtcccctgccatcaagaagtcgcagcagaagggtgcccgagagtag

SEQ ID NO: 27436 - DNA, 1398 bp, Artificial Sequence
  Description of Artificial Sequence: Synthetic coding sequence
atggctggtgggaaacaattcaccttcagctatgaaaacgaagtgtgcaagcaggattacttcattaagtcaccaccgtcccagctattctccagcgtgacaagttggaaaaagcgattctttatactctctaaagcaggagaaaaatcttttagcctgtcttattacaaggaccaccaccaccgtggatctattgaaatcgatcaaaactcaagcgtggaggtgggtatttcaagccaagagaagatgcagtcagtacagaagatgtttaaatgtcatcctgacgaagtgatgagcatcaggacaacgaaccgtgagtacttcctgatcggtcacgatcgggagaagatcaaagattgggtgtcttttatgtcttcctttcggcaagacatcaaagcgacgcaacagaacacagaggaggaactgagtcttggaaacaaaaggacactgttctattcttctccgctgctcggcccctcctccaccagtgaggcggttggctcttcctctcctcgcaacggccttcaggataaacatttaatggaacagtctagcccagggtttaggcaaacgcacctgcaggatctaagcgaggcaactcaggacgtgaaagaggaaaatcattatctgactcctaggagtgtgctgttggaactggataatattatcgcaagttccgattcaggagaaagcattgaaacagatgggcctgatcaagtgtctggacgcatcgagtgccattacgaacctatggagtcttacttcttcaaggaaactagtcacgaaagtgtcgactcgagcaaggaagagcctcaaactctgccagagactcaggatggcgatttgcaccttcaggagcaaggttcagggatagattggtgcctgtcccccgcagatgtcgaagcccagaccactaatgaccagaaagggaatatccccgacgaatcccaggtggaaaagctgaacgtattcctctcaccaccagatgtcatcaactacctagccctgaccgaggccacaggcagaatctgtgtcagtcagtgggagggaccaccacgacttggatgcattttttgccacggggaccacctgctcgcagtcaacgacctcaagccacagagcctagaggaggtgagtctgttcttgaccagaagcatacaaaaagaagatagcttccgcatcctctcctatcaggtcgcatttggagaggggacggaactgagagatagagccccgggttttaggactagcgatcggcacgacgtggcaaagcgagcatgtatggaaagcgactggtgtcgtgactccaaaaccgccccctcaacaaacctctgcttgtctttccttttctgcaagatcatgactaatgacggtgccgggtgctggatcatcaaatag

SEQ ID NO: 27437 - DNA, 1101 bp, Artificial Sequence
  Description of Artificial Sequence: Synthetic coding sequence
atgcagagtgtgcagaagatgttcaagtgccatcccgacgaggttatgagcatccgcacgactaaccgagaatactttcttatcggtcatgaccgggagaagattaaggattgggtgagtttcatgtcatcattccgtcaagacatcaaggcaacacaacagaataccgaggaggagctgagtctgggaaataaacgcacattattctattcctccccccttctggggccctccagcaccagtgaggcagttggaagtagttctccccgtaatggcctgcaggataagcacttaatggagcagagcagccccggatttcgccagacccaccttcaggatttatcagaagcaacccaggacgtgaaggaggagaaccactacctgactcccaggagtgtcctactggaactcgacaatattatagcttcatcagattctggcgagagcatagagacagatggtcctgatcaagtctccggtaggatagagtgtcactacgagccaatggagagttatttcttcaaggagacaagccatgagagtgttgattccagtaaggaagagccccaaacgctgccagaaacgcaggacggagacttacatttacaagagcagggaagtggtattgactggtgtctgtcacccgctgacgtggaagcccagactacgaacgatcaaaagggtaacattcctgacgagagtcaggtcgagaaattgaatgtctttctgagtccgcccgatgtgatcaattaccttgcattgacggaggctactggcagaatttgcgtcagccagtgggaggggccacccaggctgggatgtatattttgccacggtgaccaccttctggctgtgaacgatctgaaacctcagagcttggaggaagtgtctctgttcctgactcgctcaatacaaaaagagaaattgaagcttacaatcggcagaatacccaattcagaaacctttcacgcagcatcgtgtatgtgtcctagcaagtgtcagagcgctgcacccagccagcttgacaaacctaggctcaacagagctccaaaaagaagtccagccattaaaaaatcccagcagaaaggggctagggagtag

SEQ ID NO: 27438 - DNA, 591 bp, Artificial Sequence
  Description of Artificial Sequence: Synthetic coding sequence
tagcaggagcaggggtctggcatcgattggtgtctgagtccagctgatgtagaagctcagacaacaaatgatcagaaaggaagcgcaagccttaccgtagtccagctgtccatcctaatcaataatatcccggacgagtctcaggtagagaagctgaacgtctttcttagccctccggatgtaataaactatctcgccctgaccgaagccacgggcagaatctgtgtgtcacagtgggagggaccccctcgactggggtgtattttttgccacggggatcatctcttggctgtgaacgacctgaaaccacagagcctcgaggaggtttccctattcctgacccgatccattcaaaaggaggatagctttagaatcctctcttatcaggtggctttcggggagggaacagagttgcgtgatagggcccccggcttccggacctccgaccggcatgacgtggcaaagcgtgcctgcatggagtccgattggtgtcgcgacagcaagacagcaccctccaccaacctgtgtcttagctttctgttttgcaaaatcatgactaacgacggagcggggtgttggataattaaatag

SEQ ID NO: 27439 - DNA, 465 bp, Artificial Sequence
  Description of Artificial Sequence: Synthetic coding sequence
atggaaccgagtaagacattcatgcggaatctgcctatcaccccgggctactcaggctttgtgccttttttgagttgtcagggcatgtcaaaggaagacgacatgaatcattgtgtcaaaacattccaggaaaagacgcaacgctacaaagagcagttacgcgaactctgctgcgcagtggctaccgcgcctaaactgaaaccagtgaactccgaggagacagtcctgcaagcccttcatcagtacaaccttcagtatcacccactgattctcgagtgtaaatacgtaaaaaaacctctgcaggaaccccctataccaggctgggccggatacctgcccagggccaaagtcacagaattcggatgcggtacccgatacaccgttatggcgaaaaactgctacaaagattttctggagatcactgagagagccaagaaagcccatctgaagccttacgaagaatag

SEQ ID NO: 27440 - DNA, 693 bp, Artificial Sequence
  Description of Artificial Sequence: Synthetic coding sequence
atggagccttccaaaacattcatgagaaatctgcctataacaccaggttactcaggtttcgtcccgttcctctcatgtcaaggcatgtccaaggaggacgatatgaaccattgtgtgaaaacgttccaagagaagacccagcgctacaaggagcaactccgggagctctgctgtgcggtggccactgcacccaagctgaagccagtaaactcggaggagactgtactccaagcacttcaccagtacaatctgcagtatcacccgttgattctagaatgtaagtatgttaagaagcccttgcaggaaccacccattcccggatgggctggctatctgccaagagccaaggtgacagaattcggttgtggcactcgctacactgtcatggcaaaaaattgctacaaagattttctggaaatcaccgaaagggccaaaaaggcgcacttaaagccttacgaagagatctatggtgtgagcagcactaagacgagtgccccgtcccctaaagtgctccagcatgaggaactgttgccaaaatacccggactttagcatccccgatggcagttgtcccgccctgggtcgacccctccgggaggaccccaagacccccctcacctgcggttgtgcgcaacggccctctattccttgtagcggaaagatgtatcttgagcccctgagcagtgcaaagtag

SEQ ID NO: 27441 - DNA, 387 bp, Artificial Sequence
  Description of Artificial Sequence: Synthetic coding sequence
atggcttggcgtgtccctggagtacggcctgcatcaaccttcttcccccaggtgctgagggcatccagtgagctgcccaatcgcctccccgaggggtccaccgttggaccaaaaccagactcatcctgggaggctggcagccagggtaactggggattaacatcatctggggccggccaggatagttccgcccagaagcttggcattttgtcggtgcagatctcattgaagatttggacatgggagaaaccttcaggctggggacacctgcatgccgccgtaaccggggcatcctgctgcagccccctgtctcaggggggtgcgatctgcctggtgaccgcaccacaagacaagccagattgcagcccctgtacctcaggtcactag

SEQ ID NO: 27442 - DNA, 1338 bp, Artificial Sequence
  Description of Artificial Sequence: Synthetic coding sequence
atggaaactcgtactgaggacgggggactgacgaggcggcctactttggctagttcctgggatgttgctggaggcgcccttacccactccctgctgttaacgcgcgcaggcttagggcccggcgactttgactgggaggagttattggctcctccggcccccggacaggacctcgtcatcctgaagcgcaatcacaataataaagatgagaacccttgcttcctttacctccggtgtgggccggacggtggcgaggagatagcatcaatcggcatcctcagtagtgcccggaatatggaggtgtatctgggcgaggaatactgcgggaccagcaggggaaagaatgtctgcaccgttttagatgatagtgaacacgaaaagatcattttgtacaagaaaaatctgaagcttgagtccagtactcacgcgtgcaaaatcaagcttctgtcattcggggaacgacagtgcgtgttcatctctaaggtggtggtccatatgaggagcgtgttcgccaattcttcgacatcttcccccgcgcttggttcacgcatcgacctggacaaagtacagacaatcatggagtcaatgggcagcaagctgtctcccggagctcagcagctcatggacatggtgcgatgccagcagagaaattgcattccgataggggaacagctccagtccgtgctcggtaatagtggatataagcacatgatagggctgcagtcaagtagcacacttgggacactgaacaaaagctctagtactccttttccattccggacaggactcacctctggaaatgtgacagagaacttgcaaacatacattgacaagtccacccagttgccgggtggggaaaacagcacaaagctggacgaatgtaaggtgatgccccagaatcatagtttcttggagaatgacctcaaaaatgcaatggcttctttcctgccgaaaaaggtctccgacaactctaacattccgaattctgaactcctccctttcttacagaacttatgttctcaggttaatcaccttcatgtgggcaataagactgaatgtcaggagaatataaccaagcatggggagaggatcctgggggtaggaatggaagagcagtcaatttgctcttatcttgaaaagatactgtccaaaaatatggagttgatggagaagaagctgatggattatattgaccagagaatccatgaattgcaggagcatatagatgacaagatcgcactgcttctggacttattgcaaaacccaaattctcccccgaccggaatcccactgagacactacgattcgggagaacgcttgagtaacggagaaaggtag

SEQ ID NO: 27443 - DNA, 438 bp, Artificial Sequence
  Description of Artificial Sequence: Synthetic coding sequence
atgtggagcttcctgccaggcgcagagagcgtaagcatggggccagtgcctggcgtgagcagcctgggtgcctgctggacacacgaccaagactccgggcgggccgaggaccggccgcaggctccaaggatcacacaatatacctgggttcttagttttctgttcactgagaagccacagacacgatccacctcgccaatttcacaccaggggcagccacagacgacaagagctctaagtctgaggcagccccagcacccctcggctccggctagcgggcgtccacggccccctcacagctctgggcccgatctggctgaagcagctcctgtcgtggaccaggcatcccaggctgccggcagagcttcttctggattgggactgtgggagcaagcttccgtgtctcagggattcaggaatgctgcttttgaagcttag

SEQ ID NO: 27444 - DNA, 438 bp, Artificial Sequence
  Description of Artificial Sequence: Synthetic coding sequence
atgtggtcttttctgccgggggctgagagcgtgtcaatggggcccgtcccaggggtgtcctcgctgggagcctgttggactcacgaccaggactccggacgtgctgaggataggcctcaggcccctaggataacccagtatacttgggttctttcattcctgtttactgaaaaaccccaaacacgcagtactagtccaatctcccaccagggacagccgcagaccactcgggctctttccctgcggcagcctcagcatccttcagcccccgcctctggtcgacctagacccccgcattcctctggccctgatctcgcagaggcggctccagtcgtcgatcaggcatcacaggccgctggccgcgcttctagcggccttgggctgtgggaacaagcatcagtctcacagggatttaggaacgccgctttcgaggcctag

SEQ ID NO: 27445 - DNA, 774 bp, Artificial Sequence
  Description of Artificial Sequence: Synthetic coding sequence
atggagcgctcgaatgctgcaacaaaatgcggcgaggagcctagaagcggatcccggcgtttgcccaaagccgagggggacaagtccggcagcgccggcgccccatcaaaaaatagctctcgtttgggcggacgcccatgcatgtgtactgccgggcggaggcccaatcgagcttcaggaagacgcagacgctcttgtagtcctgctcccacatggccacccctttgctgttacccccagagcaggcctacagcttctgctgcaggacccggagcttgtatgcgcgcatcaggaaggccccacggcaacacaacagcaagtaccgcgcccccgaggcacccccgcccaagaagacccggcggccctgccctcaggcccaccccaagaccgtgcgctggaccggcccccccccctgccagtcgagactgccggtgtagaaggccccggagatggcctagagcgggccggaggggccggagggccggggcctgtaagccgtcatgcgccggcgccgcgtggtccgcacgaggggcaccactctgctcctatagaacatcctgtgcgggaagttgtggcgcccggacagcccccacccccgcacccacctgcgctagtccgtccgcagcggcttcatcttgttgtagacgccgaagagcttgcagttcccctaccactgcgtggtccggagcttgcggtgcaggtccaactgcggccacggcggcccagcctggcaagcctcgatcagcagccgctccggggcgtgctcgtgcctag

SEQ ID NO: 27446 - DNA, 777 bp, Artificial Sequence
  Description of Artificial Sequence: Synthetic coding sequence
atgagtctcgaatctctgttccagcatattatcttcacagagcaccaggccgaggaaagcagacgactgatgagagaggttaggtctgaaattacacgctgtagagagaaaatcaaaaaggcgacagaagagctcaatgaagagaaaattaagctggagtcaaaagtgcagcagttctttgaaaaatcctttttcctccagttattgaaggcccacgaaaatgctctggaaaaacagtatagtgagatcaccaatcatagaaacatgctactgcagacatttgaagccatcaaaaagcagatgatagaagaggaggacaagttcatcaaggagatcactgacttcaacaacgactatgagattaccaaaaagcgcgaactgctgatgaaggagaacgttaaaatcgagatcagcgaccttgaaaatcaggcaaacatgcttaagtccgagatgaagagcatggagcacgattcaagccagctcaatgagctgcagaaacagaaaagcgagctgattcaggaattgttcacactgcagaggaaactgaaggtcttcgaggacgaggagaatgagtccatttgtacaacgaaatacctcgaggccgaaaagatcaaaatctcagagaaaccccaaaatgacacggagtgtctgcgcctgaagaaggagctggagttatacaaggaagacgatatggagtctgtgtatgaggcactccagacagagatcgagttcctggaactgacactggcccagaaagatctccaagaaagcaagtag

SEQ ID NO: 27447 - DNA, 543 bp, Artificial Sequence
  Description of Artificial Sequence: Synthetic coding sequence
atgtctctggagagcctcttccaacacatcatctttaccgaacaccaagcagaggagagccgcagactgatgagagaggtaaggtccgagattacccgatgtcgagagaagatcaagaaagcgacggaggaactgaacgaggagaagatcaaactggaatcgaaagtgcagcaattcttcgaaaagagcttctttttgcagctgttgaaggcccacgagaatgctctggaaaagcagtattcagagataaccaatcacaggaacatgctgctgcaaacatttgaagccattaagaaacagatgatcgaggaagaagacaaatttattaaagagattactgatttcaacaacgactatgagataacaaagaaaagagagctgttgatgaaggaaaacgtgaagatcgaaatatccgacctggagaaccaggctaacatgttaaagagtgaccggctgaagaaagagctggagctgtataaggaagatgatatggagtcagtatatgaggctttgcaaaccgaaattgagtttttggagctttag

SEQ ID NO: 27448 - DNA, 1404 bp, Artificial Sequence
  Description of Artificial Sequence: Synthetic coding sequence
atggagtctagcactgggcccaggatgccactcttgaaatactgctcagtagctacttcactgaaggcccctgggtgggacggcgcggcccctccctgggatctcagttttacatacccattcgcccttcaagcaccctggctgacaggacataagcccctggccagacacgcgtctagctgcccctgcctgcacgtcgccgatcctgcctggcaggggccaggatggctgggccgagccggagacgctgctaacacatgggtgttagccagacgggaggccgacggcttttactaccgcgcacaaattaaagccacacctgagctagagcgacaaggcgtcttgttggtcgagtttgaggcccccttggtggctgggccaaagcttcctgcccagcagcagcgcgtagtgttggaagaggacgttattcccctgagcccatcagttgggtatagtctgaggcctggagataaggtgcttgctctgtgggaacctgggcagcaacagtacggtcctggaaccgtgcttctgggacttgagatgcgagatcctcagcgcgcctccaaggagaaagagataacagtgcacttctggaacggcaaagctgccaaggttccactcggcggagtgcagtccgtaagcctgaccatttggaagaaggccgtggagcggcttcacaaaagctttacgcgggaacacccgcgccccctgcactgggccccctgttgtagcctgctcgggcctattactggaaggattactaatgagttgccgccagacgctcccttcctttgtccactttgtcatcaccacgcgtgctgccagctactctgccaggggtgtctgtgcggatgtcccccgtgcggcactacttggtggccactgacgagaacgtctgaagtgatggccagggagcttccggaactggagcccacagctcagctcctgcccctggagggaccaaaagaggagaaggttgcaatgcatgcccccctggcggtgtcttcaagctctagtagtagttgcgagcaggacggtgtcgaaaatgatttagagatggggccaccccagagactcatggttaactccgcggttaacaccgaccctatcttcctcgagatgcccctgaggcagtcaggcttgtgccaacctgaatggcgctattggaaacgtaatgggcctgaaccatgcctggggaaacctgggacccgctactccaacatttgtaaggaagagaaggatcacaaacagcagcgcgcccagactgctgtagtgggcacaaccaaggagttagtgtccaaggcaacccacatgaaacctcctaggacaccgcctggcgaggccgaacatcggaagcgatcacaatctctggcaatatgccagtggaataaaaatagtcgatag

SEQ ID NO: 27449 - DNA, 1215 bp, Artificial Sequence
  Description of Artificial Sequence: Synthetic coding sequence
atggagtcctcgaccggacctcggatgcccctcctaaaatattgctcagtcgcaacctcattgaaagctccaggctgggatggcgccgccccgccatgggacctttccttcacttacccattcgccctgcaggccccgtggttgactggccacaagccacttgcgagacatgctagctcttgcccctgcctgcatgtggccgaccccgcatggcaaggaccaggctggctgggtcgcgctggtgacgctgcaaatacctgggtcctggctagaagggaagcggacggattctactacagggcccagatcaaggcaaccccagaactcgagcgccagggagtgctgttggttgagttcgaagcgccacttgtggccggtcccaagctgcctgcccagcagcaacgcgttgtgctggaggaagacgtgatacctctatccccctctgtgggctattccctcaggccgggggacaaagtcttagccttatgggagccaggtcaacaacagtacggccctgggactgtcctcctgggtctggagatgagggatccccaacgagcctctaaagaaaaggaaattactgtacacttctggaacggcaaggcggcgaaagtccctctgggcggcgtgcaatcagtgtctcttactatttggaagaaagccgtggaaagactccacaaaagcttcactcgtgaacacccaagaccattacattgggcaccctgctgtagccttctcggtccgatcaccgggagaattaccaacgaactacctcctgatgccccatttctctgtcccctgtgccaccatcatgcctgttgccaattactttgccagggttgtctgtgtgggtgtccaccctgtggtacaacgtggtggcccctgacacgaacgtcggaagttatggccagagaattgccagagctcgaaccgacagcccagttgctgcctttggaggggcctaaggaggagaaggtggcgatgcacgcccccctggcggtgtcctccagctctagcagttcctgcgaacaagacggcgtggagaacgacctggagatggggccccctcagcggctgatggtgaattctgctgttaatacagacccgatcttcctggagatgcccctacgccagtctggattgtgtcagccagaatggcggtattggaagcgtaacgggcctgagccatgccttggtaaacccgggaaggagtag

SEQ ID NO: 27450 - DNA, 369 bp, Artificial Sequence
  Description of Artificial Sequence: Synthetic coding sequence
  Description of Combined DNA/RNA Molecule: Synthetic coding sequence
atggcaccaagggggagaaaaaggaaggctgaggctgcagtggtggccgtagcagagaagcgagaaaaactcgcaaatggcggagagggaatggaggaggctaccgtcgtgattgaacattgcacatctugaagagtctatggacggaatgccgctgccctgagtcaggccttaaggttagaagcccccgagctccctgtaaaagtgaatccaaccaaacctcggcgggggtctttcgaagtaacccttctcagaccggatggaagctcagccgaactctggaccggtatcaaaaaaggaccaccaagaaaattaaaatttcctgaaccccaagaagtggtggaggaactgaaaaaatatctgtcgtag

SEQ ID NO: 27451 - DNA, 285 bp, Artificial Sequence
  Description of Artificial Sequence: Synthetic coding sequence
  Description of Combined DNA/RNA Molecule: Synthetic coding sequence
tgaggtatggaagaagcaacagtcgtgatagaacattgcacgtctugaagagtttacggccgcaatgctgccgccctcagccaggccctaagacttgaggcgcctgaattgccagtgaaggttaacccaaccaagccccggaggggcagcttcgaagtgacccttttgcgtcccgatggcagttcggcagaactctggactggcatcaaaaagggacctccaaggaaactcaaattccccgaaccccaggaggttgtcgaggagttgaagaagtacttgtcatag

SEQ ID NO: 27452 - DNA, 369 bp, Artificial Sequence
  Description of Artificial Sequence: Synthetic coding sequence
  Description of Combined DNA/RNA Molecule: Synthetic coding sequence
atggctccacgtgggcgcaagcggaaggcagaagccgctgtggtggcagtggcagaaaagcgggaaaaactcgccaacggaggcgaaggcatggaggaggcgacagttgtgatcgaacactgcacaagtugacgtgtgtacggccgtaatgctgctgctcttagtcaggctctgcgactcgaggctccagagctaccggtgaaagtgaatcccactaagccccggcgcggatcatttgaggtgactctgcttcggcctgacggctcatccgccgagctctggactgggattaaaaaagggccgccgcggaaactgaaattccctgagccacaggaagtcgtggaagaactgaaaaagtacctctcatag

SEQ ID NO: 27453 - DNA, 1905 bp, Artificial Sequence
  Description of Artificial Sequence: Synthetic coding sequence
atgaggtggctgcgccctgctggcaggaggcgggaacaagaatctgtgtcggggcacttagggccgcccgccggagcccctgcagcgcccgagacgccaacctgtctgcccgacacaactccccatcctgcgccagtggtgtgttccgctgacccccagctagccttagaaagtctcgacccaagaacccttaggctcctgtggaggcagcgggaactggaaattcaggcactgaggtgggcaatccagaatggcgaagatgctagattgtgccacatcttggaggaggtcgcagggctacctcccaaaagatcatcgcattcccaggaaaaattactccaaaatcaggtgcagaaacttattcaagagcttaaggagcaaaaagagcgagcacagtgggaaaaagagcaccttgaagagcggcttcttcagacaacacgcaccttgcaggagatggaagcagaactccagaacctgcagaaatcatgtttgctgcagcttgcaaggtcatcttgggtgggcagaatgcttcgctctcagacgggcagtgtggaagtggttacagccgaaaccttaatggatccctcagatttaagcgagaatattcaagctccgacgggggagggctttaggctcgaagacgtggactggaacagcgtggcaaggcgctatcccaatttgttcaccaatatggagcccagttctaaacagaagcaaccacgaccctggccacaactggacacggggagcccagaaagctccggcaagcactctgagcgtcaccataaaaccgttgagtgggggtccctgccatgtctgaacacaagctcttcggggggcgccgactctgattctagttcctgccgcccagggctgcctagttttgttcaggtgatcgggcatccgccccgtgaccacagagccagcagcgagcaggccctcgtgcaggctggctcctactccagggacagcgaagacttgcagaagacccacagcccccggcacggggaaccagtactcagcccccaaccatgcacagatcccgaccattggtctccggagctccttcagagccctacaggtctgaagatcgtcgctgtctcctgccgagaaaagtttgtgagaatattcaatccttcccaggaatcaacagctgacctgagcgggatggttctgaagcagctggtacgcggttttcccgaacgattgtatcgattcccaccaggtaccctgctcgctcccagacaccatgtcacagtgtggggggaagctacccggagtgctaagaagccactcagagccagctcttcaagagagcctgtgcccctcctctcaattaggggatgcgcaactctgctgctgtcccccaagggggaagtgctgtcggagcaccgtataccacggcgtgaaactcctgccccccgggtttttgccgacggtacagacctatcgatcgaccggttccccctgcccgaggctggccctggggccgatacacggaaacctccaaggcctcctcgtcctttgcgcaagggccgcgtcagagagcccagggtgagtcggcggcgcccagggactaggggccttcttcctcccgtttccagcggcaaactctttcacgcacgcgagggtcccgctcgccctgagaaccccgaaatcccagcgccacagcacctccccgccattccgggggatcctactctaccatccccccctgccgaagccggcctaggcctggaggactgcaggctgcaaaaggagcaccgggttagagtatgccgcaagagcgtggacaggtcttgccctctggtcgctttgtccgtgcagaatacagccgagagccggttcgggttcagattcctctcctgtctgccagtcacagcagatacgtgtcgtggtgcctag

SEQ ID NO: 27454 - DNA, 477 bp, Artificial Sequence
  Description of Artificial Sequence: Synthetic coding sequence
atggaccttgcttccgaaatcacttctgccacacagacttccagcctatgtagctccggaagaggccacgctgggtaccctgcacctggtatcgtagcccatgggtttgagacacatgggaccgccagggttgcccagggccatcttctacctccctgccttcttccacctccccaaatgcccgtccttgcagccctcagggatcttagcaggaggggaagcacttcaagcagccgttcaccctcacgccccgtctctacttctgcctctaaaccgtgtcttcctgcctcttgcctgggcgagacatggtcaatttccatcaatctcgtgggatcatctggccaccttcaatctcccggagcacagagagacgcacaaagggagactggctgcctgggcccaagctggctccctcaccatcagggacgcgatgaagaactttccctcagtcacagtgcccaaggcgaagaattctag

SEQ ID NO: 27455 - DNA, 477 bp, Artificial Sequence
  Description of Artificial Sequence: Synthetic coding sequence
atggatctcgctagcgagataacatccgccactcagacttcgagcttgtgctcctctggacggggacacgctgggtatccagccccaggcattgtggcccacggctttgaaacccatgggaccgcgagagtggcacagggccacttgctccctccgtgtttactgccaccaccacagatgccagtgctcgctgctctgagggacctcagtaggagaggcagcacgtctagcagcagaagtccttcaaggcccgtgtccaccagtgcttccaagccctgccttccggccagttgcctgggcgaaacttggtccatatccatcaaccttgtcgggagttctggccacttgcagtccccaggcgctcagcgcgatgcccagcgagagacaggttgtctgggcccatcatggttaccccaccatcaggggcgcgacgaggaactcagcctgtcacacagcgcacagggggaggaattttag

SEQ ID NO: 27456 - DNA, 87 bp, Artificial Sequence
  Description of Artificial Sequence: Synthetic coding sequence
atggacctcgctagcgagatcacctcagccactcagacatcttcactatgctcaagcgggcgaggccacgccggctaccccgcctag

SEQ ID NO: 27457 - DNA, 477 bp, Artificial Sequence
  Description of Artificial Sequence: Synthetic coding sequence
atggatctggctagcgaaatcacctccgcaacccagacatcctcactctgctccagcggtcgtgggcacgccggatatcctgctcctggcatagtcgcccacggcttcgagacccatggaaccgccagggtggcccaaggccatctgctgcctccttgtctgctgcctccacctcaaatgcccgtgctggcagcactgcgagacctgagcaggcgcgggagcacctccagctcccggtccccttcgcggccagtgtcaacaagcgcgtccaaaccatgtcttccagcctcgtgtttgggtgagacctggtctatctcaataaatctggtggggagtagcggacacctacagtcccccggcgctcagagggacgcccagcgggagacaggctgcctgggtcccagttggctcccccatcaccaggggcgagacgaggagttgagcctatctcattccgctcagggtgaggagttttag

SEQ ID NO: 27458 - DNA, 423 bp, Artificial Sequence
  Description of Artificial Sequence: Synthetic coding sequence
atgaagggacaggaagggataagaggggagggctgtacagacccagagatcaaagcttcacctcagatgtgggctgcccggttccgcgggatgagaagcaggtttagtccgctctttagccaggctacagagatgggacccagagtctcagctgggtggtgcctctcgggaggaggcagaaaggtttcctccctgcaaggtgacttccctccgggcgggttttgggctctgtcaaacgactccgccctgtccctcccccccctgtctttaccccacccccaccctctgcggccacctgggctgggggtgaatgagttcacccagggacttcacccacccctccaccccgcggctagcgtgttccagacctgcttttatagaaaaccacactactgctccacactccgcccgacaaccacatag

SEQ ID NO: 27459 - DNA, 654 bp, Artificial Sequence
  Description of Artificial Sequence: Synthetic coding sequence
atggccctggtgcaggctcttgttcctcgggagcgcgagccgaaactgagtatactccaaatggacagaggtgatccgcagcactccagtcactggtgtcccgaaagggagaaagtgaagctgctaaccctgaagcctcgtgaaacatctaagaacatcttaatcaatttctatcgtgcctttaatctggacaaggacgtgtttattcaccaagcaaaccatcctctgaccgtcccaagctcagtggttatgggcgacaatgggcacaccttggccgaggatgacaaacggccctgtttcagggtactgccttgctacctggaacgggtatcctcgggaatctctatcagttggatttctgcacctctgcctgtcggcgctatgaaacaccagctattgtgtgatcttatggatctgatcaccctgagcttctggctggcagggcaatgcatgtccctgaaggcaacaaatatgcagcattgtaaatgttccatagccacctctgactgggcaatcgagctggatcgcacggactacaaaaccctcccaagcgaatacagtatcttagctctactgcaggtgtttgccgggaaaaattgtatggatagagtcctgttacacgtggacgtaaactacctgaagtcactcccatag

SEQ ID NO: 27460 - DNA, 1002 bp, Artificial Sequence
  Description of Artificial Sequence: Synthetic coding sequence
atgctcgttgggacacctaacctgctgacattggatgaggctgacgccacctggacgctcatcaaagataaggttatagaggagcatttcggccccaatgccgtagccgtccctttcctgtcagatgcagcctgctacgatctgctgggcgtgctggtaaaacagtcccggccggctcacacaaggctggcgctccccggcaggcagggccgtagggctttgaagcctgtcggtccgctgccctcattgctcgaacaagccggaagcgagggcgcatttgcacactgtacgcgggagtactccccaaatggcagggccgaacgagcatacgaggaaactagaatgctagatggacagccttgcaagattaggctgcatatgggagatcttagaaaaaaggttgcctttctcctgctccctcctggtcaggtttcgctgcagcagaccctgccctggttgaggtccacacactcaatttatgtgatctatcaggtgttctcttgttcttggctgcagctaggattgacttctaccgcccgggagcctcagcttctgaggctcttaaggtcgctgccggtggcattctcttgtctgaagttcagcctgcagagtaaaggggtgttgggccctcaaaagcccctgaccaaggaccctcttccacacggagcaaactgggtacgcccaaacctgagtataatgcctccccttgcccccacatctgctcctgctgatacgactgaagcagctgacgttcctccgcctgtgccagcccctcccacaccaccaccccaggagggacccgaagacaagccgacgaggttttcttacaagggccgcaatcctttttggcgtgggccccagatcctttcagagaattggctgttctctcctcgatcccccccccctggggcacaaggcggcggaccacgtgaccccgacggacactcgatgtcactgcccctgctgcaaggcctgtcatctgagttcgacagcgacgactag

SEQ ID NO: 27461 - DNA, 792 bp, Artificial Sequence
  Description of Artificial Sequence: Synthetic coding sequence
atggctttggtacctggaagatccaaggaggatggattgtggacgcggaattcccctgggtcatctcagcatccagagagcccacggctccccaaccccctttgggatcgaggtaaaattggaaaagtggaggggcaccagcacatccaagacttttctcagaaatcccacctgcccagcattgttgttgagtccagcgaagtgaacgaagaatctggagatctgcatctgccccatgaagaactcctgttgttgactgacggcgaagaagaggacgccgaggccttttttcaggaccagtccgaggagcccggttgggcatggtccccgcaggaccctaggagtcctctgcggacgttcaacgcaggactttcctggggacaagaccaagatgaggaggatgcctgttggatcctggaggataccgcttgcttagaggcaacaaatcactgcccattttgggactcaaccgggtctcgggtgtgtcgctctggcttcgttgaatactcacaccttctaccccctaactcttttgaaggggcagaagaggaggcagttcagactcctgccggcgttgagagcggggcggcttccgaggcccctggtggcaggggatgcgaccgaccaagggcagatcatgccgcccccccccaagaagccggggtgcagtgcacctgtcaacactacaccgtgcgagaagaggcccagaagacccctcccgccgaccctgcctgtcctgaacgggaagattcccatgggtccgggtcaccatttaaagccagccaggactag

SEQ ID NO: 27462 - DNA, 870 bp, Artificial Sequence
  Description of Artificial Sequence: Synthetic coding sequence
atggccctggtgccaggccggagcaaggaggatgggctgtggacccggaatagtcctggatcatcgcagcatccggaaagcccccgcctgcctaatccactttgggataggggcaagatcgggaaggtcgaggggcaccagcacatccaagtatccacgagctcagcctgcgtctggcaattggcctatcctcctgtgtggcctaacctgcctgctgtacccatccaggacttctcccaaaagtcccacctgccatctatcgtggttgagtcctctgaagtgaacgaagaaagcggtgacctgcacctaccacacgaggaactactcctgctgaccgatggcgaagaagaagacgccgaagcattttttcaggatcagagcgaggagccagggtgggcatggtctccgcaggacccgcgatccccgcttagaacgttcaatgctggcctgagctgggggcaggaccaggacgaagaggacgcctgttggatccttgaagataccgcctgtctggaggctaccaatcattgccccttctgggatagtactggaagtcgggtgtgtcgttccgggttcgttgagtattcgcatctgttgccaccaaactctttcgagggagctgaagaagaggctgtgcagactcccgcaggtgtggagtctggagccgcttctgaggcacccggcgggaggggatgcgacaggcctcgtgccgaccacgcagccccgcctcaggaagccggagtgcagtgtacgtgtcagcattatacagtccgggaggaggcacagaaaacacctcctgccgatcccgcctgcccagagagggaggatagtcacggatccggctctcctttcaaagcaagtcaagactag

SEQ ID NO: 27463 - DNA, 249 bp, Artificial Sequence
  Description of Artificial Sequence: Synthetic coding sequence
atggctctggtccccggacgtagcaaggaagatggactgtggacaaggaacagccccgggtcctcccagcatcctgagtccccacggcttcccaatcccctgtgggaccggggtaagatcggcaaagtagaaggccatcagcacatccaggacttctcgcaaaaaagtcatctgccatcgattgtagtggagagctctgaagttaacgaggagtccggggatttacacctgcctcatgaagagctttag

SEQ ID NO: 27464 - DNA, 792 bp, Artificial Sequence
  Description of Artificial Sequence: Synthetic coding sequence
atggcattagtgcctgggcgatcaaaggaggacggtttgtggactcggaattcacctgggagcagccagcatccagagtccccgcgactgcctaatccgttgtgggacagaggcaagatcggcaaggtggagggtcatcagcatatccaggacttctctcagaagtctcacctgcccagcatcgtagttgaatcaagtgaagtgaacgaagaaagcggcgacctgcatctcccgcatgaggagctgctcctcctcacagatggcgaagaggaggacgctgaggccttcttccaggaccagagtgaagagcccggttgggcctggtcaccacaggacccaaggagccccctgcggacatttaacgccggcctgtcatggggccaggatcaggatgaggaggacgcttgttggatactggaggacacggcatgtttggaggccacaaaccattgcccattttgggattcaactggcagtagggtgtgcaggagtgggtttgtggaatacagccacctcctgccacccaatagcttcgaaggggctgaggaggaggcagtgcagacgccagccggagtggaaagtggggcggcaagtgaagcccctggagggagaggatgcgataggcccagagctgatcacgctgccccgccccaggaagcaggcgtccaatgtacctgccagcactacacggtgcgggaagaggctcagaaaacacccccagctgaccctgcttgtccggaaagggaggacagccacggctctggcagtcccttcaaggccagccaggattag

SEQ ID NO: 27465 - DNA, 996 bp, Artificial Sequence
  Description of Artificial Sequence: Synthetic coding sequence
atgttgtcccccgaacgactagccctccccgactacgagtacttagcccagagacacgtgctgacctacatggaggatgccgtgtgccagctcctcgagaatagagaagatatctcccagtatgggattgctcgcttcttcaccgaatattttaatagtgtgtgccaaggtacccatatcctgttccgggagttctcgttcgtgcaggccacgccccacaaccgggtgtcgttcctccgagccttttggcgctgcttcaggaccgttgggaagaatggagatctcttgacaatgaaagaataccactgtttgcttcaacttctttgccctgatttccctctggagcttacacagaaggccgcaaggatcgtccttatggatgatgcgatggactgcctgatgagcttcagcgattttctgttcgccttccagatccagttctattatagcgagttcctggacagtgtcgctgctatttatgaggatctcctctctggcaagaatccaaatacagttatagtacccacaagcagttcggggcagcatagacagcgtcctgctctggggggcgccggcacactggaaggcgtcgaggccagcctgttttatcaatgccttgagaacctgtgcgatagacataagtacagctgccctccccccgccctggtcaaagaggccctgtcgaacgtgcagaggttgaccttttacggttttctgatggccctctcaaagcaccgggggatcaatcaggccttgggagccttaccagacaagggcgacttgatgcacgatccagcaatggatgaggaactggaacgcctgcttgctcaggtaccaggccttgttaattccgttacagccagtccagaggcctcctgtttaccctctagaaccccacctagagtgggaagtccctggaggcccctgcaccacagtcggaaagtagacggcgagagcgacggaagcaccgaagaaaccgacgagtccgaaacctag

SEQ ID NO: 27466 - DNA, 1014 bp, Artificial Sequence
  Description of Artificial Sequence: Synthetic coding sequence
atgctaagtcctgaaaggctcgccctgcctgattacgagtatctcgcgcagcgccatgtattgacatacatggaagacgcagtgtgccagctgcttgaaaaccgcgaagatatcagtcagtatggaattgcccggttttttacagagtattttaattctgtgtgccagggcacacacatattgttcagagagttctcgttcgtgcaggctacaccccataaccgcgtgtcctttctcagggccttctggagatgttttcggacagtaggcaaaaacggcgatctgctgaccatgaaggaataccattgtctcctccagctactttgcccggacttccctttggagctgactcagaaggccgcacgtattgtattgatggatgacgccatggactgcctaatgagcttttcagactttcttttcgcttttcagatccaattctactactccgagttcctggacagcgtcgctgcaatatatgaggatctgctgagcgggaaaaatcctaacaccgtaatagtacctacctcttcttccggacaacataggcagagaccagcccttggcggtgccggaactctggagggcgtggaggcctcactcttctatcaatgcctggaaaacctgtgcgatagacataaatatagctgcccccctcccgcattggtgaaagaagcactctccaacgttcagaggctgactttttatggctttttgatggcgctgagtaaacatagaggtatcaaccaagccctgggcgcactgcctgacaagggggacctgatgcacgatccagccatggacgaagaacttgaacgccttcttctgccatttttccggcttgcccaagttcccggcctggtgaacagtgttactgccagcccggaggcctcctgcctgccaagtcggaccccaccacgggtcgggtccccatggaggccactgcaccatagtcggaaggtggatggggaatccgatggttctacagaggaaaccgacgagagcgagacctag

SEQ ID NO: 27467 - DNA, 825 bp, Artificial Sequence
  Description of Artificial Sequence: Synthetic coding sequence
atgctttccccggaaaggctggccctccccgattacgaatatctggcccaacggcatgtactgacatatatggaggacgcagtatgtcagctgctggaaaacagagaagatataagccagtatggcattgctcgtttttttaccgaatacttcaatagcgtgtgccagggtactcatattctgttccgcgaattttcttttgtacaggcaacaccgcataaccgggtgtcattcctacgcgccttttggcgctgttttcggacagtgggtaaaaacggcgacctcctgactatgaaagagtaccactgtttgctgcagctgctgtgtcccgactttccgctcgagctgacccagaaagccgcccgcattgttctgatggatgatgcaatggactgtttgatgtctttcagtgatttcctgttcgccttccaaattcaattctattattcagagtttttagactctgttgcagcaatttacgaagatctgctctccggaaaaaacccaaatacggtaattgtgccaacttcaagcagtgggcagcaccgccagcgcccagctttaggaggcgcaggcactttagagggtgttgaggcttcactgttctaccaatgcctagagaatctctgtgaccgtcataaatactcctgcccgccacccgctttggtaaaggaggccctgtccaacgtccaacgactcacattttacggttttctgatggcattgtcaaaacatcgaggcattaatcaggcccttggcgcgcttccggacaagggtgacctgatgcacgatcccgcaatggacgaagaactcgaaagactgtag

SEQ ID NO: 27468 - DNA, 705 bp, Artificial Sequence
  Description of Artificial Sequence: Synthetic coding sequence
atgaaagaataccattgcctgctgcagctgctttgtccagacttccccctcgagctcacacagaaggctgcaaggatcgtgctcatggacgatgctatggactgtttgatgtctttcagtgactttctgtttgccttccagattcagttctattattctgaattccttgattccgttgccgccatctacgaggatttgctgagtgggaagaaccccaatactgttattgtgcccacttcctcatccggacagcatcggcaaagaccagctctgggaggcgccgggacactggagggtgtggaagccagcctcttctatcagtgtctagagaatctgtgcgatagacataagtacagctgccctcccccagcactcgtgaaagaagcgctgtctaatgtacagaggctcacgttttatggctttctgatggctctcagtaaacatcgaggaatcaatcaggctttaggagctttacccgacaagggagatttaatgcacgatcccgctatggatgaagaattggagcgcttgttggcacaggtccccgggctcgtcaactctgtgactgcttctcccgaggcttcctgtctgcctagccgtactcccccaagagtcggatccccttggaggccactccaccattcaagaaaggtggatggcgaaagcgatggtagcacggaggaaacagacgaatctgagacttag

SEQ ID NO: 27469 - DNA, 744 bp, Artificial Sequence
  Description of Artificial Sequence: Synthetic coding sequence
atggaacttccgggatcttcacttaacaacctcctcactatgaaggaatatcattgtttactgcagttactctgtccggactttccactcgagctcactcagaaagctgcacgaattgtgctgatggacgatgcaatggactgccttatgtctttctcagatttcctctttgcttttcagatccagttttattacagtgagttcctcgacagcgtggccgccatctatgaagatctcctgtccgggaagaaccctaacaccgtaatcgtccccacctcctcctctgggcagcaccgacaacgtccagctcttgggggggcagggactctggaaggagtcgaggcgagtctcttttatcaatgcctggagaacctttgcgatcgtcataagtactcttgtccaccccccgccttagtgaaggaagccttgtctaacgtccagcgtctgaccttctacggcttcctgatggctttgtctaagcatagaggaataaaccaggcgcttggagccttacctgataagggcgacctcatgcacgatcccgccatggacgaggagttggaacgcctcttggcccaggtccccggcctagtgaacagcgtcaccgccagccccgaagcaagctgtttgccatcacgtacacctccccgtgtaggatctccttggcgtcctttgcatcactctcgcaaggtagatggtgagagtgatggatccacagaggaaactgacgaaagcgagacctag

SEQ ID NO: 27470 - DNA, 981 bp, Artificial Sequence
  Description of Artificial Sequence: Synthetic coding sequence
atgctgagcccagaaaggctcgccctgccagactacgagtaccttgcacagaggcatgtgctgacatatatggaggacgctgtatgccagcttctggagaatagagaggacatttcacaatatgggattgccagattctttactgaatatttcaactctgtttgtcaaggcacacatattctctttagggagtttagtttcgtccaggctaccccacacaatagggtgtctttccttagggctttttggcggtgcttcaggaccgtaggtaagaatggagatctcctgactatgaaagaataccactgtctgctccagctactgtgccctgattttcccctggagttaactcagaaagcagccaggatagtgttaatggacgatgctatggattgtttaatgagcttcagtgacttcctgtttgccttccagatccagttctattacagcgagtttctggactcggtggccgcaatctacgaagacctgctgtccgggaaaaaccctaatactgttatcgttcctaccagcagcagtggtcagcacagacagcgaccagcacttgggggcgccggaacattggaaggggtggaagctagcctattttatcagtgcttggaaaatctctgcgataggcataaatatagctgtccccctccggctctagtaaaggaagctctctctaacgttcaacgcctgactttctatggtttcctgatggcgttatcaaaacacaggggcattaaccaggccttgggggctttgcccgacaagggcgatctgatgcacgacccggccatggatgaagaacttgaaaggttagtagtcaggtctaagctccacagaaccagtcggcagcatagagctaaggagcctggagcattcggattccagcgaagagagaaacaggaagctctggagcgagtttcgagtgccagcgtacccacaccctaccactaccgatgggaaccccgggagtag

SEQ ID NO: 27471 - DNA, 732 bp, Artificial Sequence
  Description of Artificial Sequence: Synthetic coding sequence
atggcagcgtcttccataagctccccatgggggaagcacgtattcaaggctatccttatggtcctggtggccctcatcctgttgcattccgccctggcccaaagtcggcgagattttgctccccccgggcagcagaaacgagaggcacccgtggatgtcttgacccagatcgggaggtctgtgcggggtaccctggacgcctggattggccccgagacaatgcacctcgtgtcagagtcaagcagtcaggtgctctgggcaatctcaagcgcaattagcgtggcatttttcgccttgtcgggcatagcagcacagcttctgaacgccctgggactcgctggtgattatctcgcccagggtttaaaactctcaccagggcaggtccaaacattcctgttgtggggcgccggagcgctggttgtttactggttactgagtctgctgctgggactagttctcgcattgttgggacgaatcctgtgggggctgaagctggttatcttcctcgctggctttgtggcactcatgcgttcggtgccagaccccagtactcgcgccctcctgctccttgcccttctcatattatatgcactgctgagtaggctcaccggatcccgggcatccggcgcgcaactggaagccaaagtgcgaggcttggagcggcaggtggaagaactgcgctggcgtcaacgccgggcagctaaaggcgcgcgaagcgtagaggaggaatag

SEQ ID NO: 27472 - DNA, 366 bp, Artificial Sequence
  Description of Artificial Sequence: Synthetic coding sequence
atgagcacgctctttccttcactgttcccccgagtcacagaaactctctggtttaatttagatcggccttgtgtcgaagagacggaactgcagcagcaagagcagcaacaccaggcttggctgcaatcgatcgctgagaaggacaacaatctggtgcccatcgggaagccagcgagcgagcattatgatgacgaggaagaggaagatgatgaggacgatgaagattcagaggaggactcagaggacgacgaggatatgcaagatatggatgaaatgaacgactacaacgagtccccggacgacggagaagttaacgaagttgatatggagggcaacgaacaagatcaagaccaatggatgatatag

SEQ ID NO: 27473 - DNA, 366 bp, Artificial Sequence
  Description of Artificial Sequence: Synthetic coding sequence
atgtcaacactgttcccaagcctgttccccagagtgactgaaacgctgtggtttaacttggatagaccctgcgttgaagagactgagctgcagcaacaggaacagcagcaccaggcctggctccagagcatcgccgaaaaagacaacaaccttgtgcccatcggtaagcccgcgtctgagcactacgacgacgaagaggaagaggatgacgaggatgatgaggattctgaagaagactccgaggatgatgaggacatgcaagacatggacgagatgaatgattacaatgagtcccccgacgatggcgaggtaaatgaagttgatatggagggaaatgagcaagaccaggaccagtggatgatctag

SEQ ID NO: 27474 - DNA, 366 bp, Artificial Sequence
  Description of Artificial Sequence: Synthetic coding sequence
atgagcactctctttccttctctgtttccccgagtcaccgagaccctgtggttcaacttggacaggccctgtgttgaggaaacagagctacagcagcaagagcaacaacaccaggcctggctgcagtctatagcggagaaggacaacaacctcgtgccgattggcaagcccgcctctgaacattacgacgatgaggaggaggaagacgacgaggacgatgaggacagcgaagaggattcagaggacgacgaggatatgcaggatatggacgaaatgaacgactataacgagtctcccgatgacggcgaagtgaatgaagtcgacatggaaggcaatgaacaggaccaggatcagtggatgatctag

SEQ ID NO: 27475 - DNA, 366 bp, Artificial Sequence
  Description of Artificial Sequence: Synthetic coding sequence
atgagcacactctttccctcactgtttcctcgggtcacagagaccctctggtttaacctggataggccatgcgtggaggaaacagagctgcagcagcaggaacagcaacatcaggcatggctgcagtcaattgcagaaaaggacaacaaccttgtgccaattggtaagccagcctctgaacattacgatgacgaagaggaagaggatgacgaggacgacgaagatagtgaagaagatagcgaggacgatgaagatatgcaggacatggacgagatgaatgactacaatgaaagccccgatgacggcgaggtcaatgaggtggatatggagggcaacgaacaggatcaggatcagtggatgatctag

SEQ ID NO: 27476 - DNA, 138 bp, Artificial Sequence
  Description of Artificial Sequence: Synthetic coding sequence
atgtccacactgttcccttcccttttcccccgggtcaccgaaactttgtggtttaacctcgaccgtccgtgtgttgaggagaccgagctccaacaacaggagcagcaacaccaggcctggctccagagtattgcctag

SEQ ID NO: 27477 - DNA, 366 bp, Artificial Sequence
  Description of Artificial Sequence: Synthetic coding sequence
atgtctaccctgttcccttccctgttcccacgagtcacagagaccctgtggttcaatctagacagaccatgtgtcgaagagaccgagctacaacagcaagagcaacagcatcaggcttggctgcagagtattgctgagaaggataacaacttagtccctataggaaagcccgcgtctgagcactacgatgacgaagaggaggaggatgatgaggacgatgaggactccgaggaagattctgaggatgatgaagatatgcaggatatggatgaaatgaatgactacaacgaaagccctgatgacggggaagtcaatgaagttgatatggaggggaacgaacaggatcaggatcagtggatgatatag

SEQ ID NO: 27478 - DNA, 198 bp, Artificial Sequence
  Description of Artificial Sequence: Synthetic coding sequence
atgtcgacattattcccctccctgtttccccgggtcacagagacgctgtggttcaacctggaccggccatgtgtggaggagacagaactgcagcagcaggagcagcagcaccaggcctggctgcaaagtatcgctgagaaggataacaatcttgtgcctatcggtaagcctgcgagtgagcattatgacgatgagtag

SEQ ID NO: 27479 - DNA, 366 bp, Artificial Sequence
  Description of Artificial Sequence: Synthetic coding sequence
atgtccactctgttcccaagcctatttccgagggtgaccgagactttgtggtttaatctggaccgtccatgtgtggaagagactgagcttcagcagcaggagcagcagcaccaggcatggcttcaatccatcgcagagaaggataacaaccttgtaccaattggaaagccagcctcggagcattatgatgacgaggaagaagaagacgatgaggacgacgaagatagcgaagaggactctgaagatgacgaggacatgcaggacatggacgagatgaacgactataacgaaagtccggatgacggcgaggttaatgaggtggacatggaaggcaacgagcaagatcaggaccagtggatgatttag

SEQ ID NO: 27480 - DNA, 372 bp, Artificial Sequence
  Description of Artificial Sequence: Synthetic coding sequence
atgggcaatcgcgtgtgctgcggaggatcctggtcttgtccctccacattccagaagaagaagaaaaccgggtctcagactaggcggacgttaaagcctcagccccagcaactgcagcaaaacctgcccaagggccatgagacgacaggccatacctacgagagagtgctgcagcagcagggatcacaggaacgcagccccgggctaatgagcgaggactccaaccttcactatgccgacatccaggtctgttctagaccccatgcgcgggaggttaaacatgtgcatctagagaacgcaaccgagtacgcgactttgagatttccacaagctacaccgagatatgactccaagaacggcaccctcgtttag

SEQ ID NO: 27481 - DNA, 135 bp, Artificial Sequence
  Description of Artificial Sequence: Synthetic coding sequence
atggggaacagggtgtgttgcggcggtagctggagttgcccctcaactttccaaaagaagaagaaaacaggttcgcagacacggcgtacactgaaaccccagccccagcagctgcagcagaacctgcccaagtag

SEQ ID NO: 27482 - DNA, 711 bp, Artificial Sequence
  Description of Artificial Sequence: Synthetic coding sequence
atgcccggtagccctgtgactagcggctattacggggttcgacgctcattcttgtctgattcggacttccataactccaaacagttttcaaatgacgtgtatactagcagtgtggggaaaccatttccatgtgagagctccgcgggccaaagtcacgctgccctgttggagccatatttccctcaggagccatatggggactaccggcccccggccctgaccccaaacgccggatcactcttctccgcctcaccacttcctcctcttctgccccctccattccccggcgaccctgcacattttctgtttcgtgattcctgggagcaaacccttccagacgggctgtcacagccggaccccgtgagtgccgatgcgctgttaactctgcctcctagtacttcctgcctgtcacagctcgaatccggcagcatcgctcagcacagggggagcagctggggtagctcactggccggtgcacaatcctatagcctccacgctttggaagacctgcatcacactcccggctaccccacacctccgccttacccttttacgccttttatgacggttagcaatgatctcccccccaaggttggtcccttgtcccctgacgaggaagctgacactggatcattgcatgatcctagcccctgggtaaaggaggatgggagcattgcttggggttcttacgaatgtaggagagcgtactag

SEQ ID NO: 27483 - DNA, 366 bp, Artificial Sequence
  Description of Artificial Sequence: Synthetic coding sequence
atgatgaggtccatttttctcccccataggaagctgatatgttcacggcgtgggcatttagatccaaggggttgggaggaggatgaaaagattcttgtccccgacgccatccccactcttcccccctacgtgttcatccggaccgatcaggcctgcgtgaaggtctaccctggctttgtcctcatccggaacgggaaaactcaccgacatcggggcgattgtcacgaagaggaagtgtgcgcacatagaactttagagacaggtgggatggcctgtcacgtggggccgcacggggaaggccccagcctctgggggttctggggtagctggaaacaggttctattttttctcccagtagaccactag

SEQ ID NO: 27484 - DNA, 879 bp, Artificial Sequence
  Description of Artificial Sequence: Synthetic coding sequence
atgtctcgcatcccactgggaaaggtgctgctgcggaatgtgatccgccacactgacgctcacaacaaaatccaggaggagtccgacatgtggaagataagggaactggaaaaacagatggaagatgcctatagggggacgaaaaggaaaatgctcccctccagttctagcaggatgagatcggacggctttgacgaggaaagccagcgttactattggagaccaaagaacgagattagtggcacattagaggatgacttcctcaaagccaaatcctggaacaaaaaattctacgactacgaagcgaatatgcccgaccgttggggtcacagtggttacaaagagctctaccccgaggagttcgagacagatagcgaccagcaagacattacaaacgggaaaaagacatccccacaggtgaagtctagtacccacgagagtcgtaagcataagaaatctaagaagtctcataaaaaaaaacagaaaaagcgctcgcataaaaaacagaagaagagcaagaaggaggctaccgatattacagctgatagtagtagtgagttttccgaagaaactggggcttccggaacccggaagggcaaacagcctcacaaacgaaagaaaaagtcacgaaagaagagcctgaaaaagcctgcactgttcctggaagccgagtcgaatacatcccactccgacgactcggcaagttctagctcagaggagtccgaagaacgcgacacaaagaaaaccaagcgaaaaaaaagagagaagaaggcccacacatccgtcgcgaacaatgagattcaagagcgtactaataagcgtacgaactggaaagtggccaccgatgagcggtcagccgagtcatcagaggatgactag

SEQ ID NO: 27485 - DNA, 882 bp, Artificial Sequence
  Description of Artificial Sequence: Synthetic coding sequence
atgtccagaattcccctgggtaaagtcttgcttagaaacgtcatccggcataccgatgcacataacaagatacaggaggaaagcgacatgtggaaaataagagagctggaaaagcagatggaggacgcataccgcggaaccaagagaaagatgctgccctctagtagctcacgaatgagatctgatgggttcgacgaagaatctcagcgctattattggcggccaaaaaacgaaatctctggcacgttggaagatgattttctgaaggccaaaagctggaacaagaaattctatgactatgaggcgaatatgccagatcgttggggtcacagcggctataaagagctttaccccgaggagttcgagacagatagctccgatcagcaggatattacaaatggtaaaaaaacctccccgcaggtgaagtcatccacacacgagtcccggaagcacaagaaaagcaaaaaatctcacaaaaaaaaacagaaaaagcgaagccacaaaaagcagaagaaaagcaagaaggaagccactgatataaccgctgacagctctagcgagttctcagaagaaaccggtgccagcggaactaggaaaggaaaacagcctcacaagcggaaaaaaaaaagccgtaagaagagtctcaaaaagccagccttattcctcgaggccgagagtaacaccagccattcagatgattccgccagctcttcttccgaagagtctgaggaaagggacacaaaaaaaactaagcgaaaaaagagggagaaaaaggctcacacctccgtagccaacaacgagatacaggaacggaccaataagcggacgaactggaaagtggcaacagatgagcgctcagccgagagttccgaggacgactag

SEQ ID NO: 27486 - DNA, 444 bp, Artificial Sequence
  Description of Artificial Sequence: Synthetic coding sequence
atgaaccccgcaaacactagaagccaaaggaaccctacaaaaaagcagaaaaagcgcagccataaaaagcagaaaaaatctaaaaaggaagctacagatataaccgcggacagctccagcgagttctccgaggagacaggcgccagtggcactaggaaaggaaagcaaccccataaacggaagaagaagagtcgcaaaaaatccttaaaaaagccagccctgtttctggaggccgagagcaatacaagtcactccgacgactccgcttcgagctcctcagaagagtctgaagagagagacacaaagaagactaaaagaaaaaagcgcgaaaaaaaggcccacacttcagtcgcaaacaacgaaattcaggagaggactaacaaacggacgaattggaaggttgcaactgacgagagatccgccgaatccagcgaggacgactag

SEQ ID NO: 27487 - DNA, 879 bp, Artificial Sequence
  Description of Artificial Sequence: Synthetic coding sequence
atgtcaagaatcccactcggcaaagtcttgctgcggaacgtgatccgacatacagacgctcataacaagatccaggaggagagcgatatgtggaagatacgagagctggagaagcaaatggaagacgcatacaggggaaccaaacgcaagatgttaccctcaagctcaagtcggatgaggtcagacggctttgatgaagagtcacaacggtattactggagaccaaaaaacgagatttccggcaccctggaggatgattttctaaaagccaaatcctggaacaaaaaattttatgattatgaggctaacatgcctgatcgatgggggcactccggctacaaggagctgtatccagaggagtttgagaccgactctgatcagcaggatatcactaatggcaagaagaccagtccccaagtcaagtcgtctacacatgagtcacgcaaacacaaaaagagtaaaaaatctcataagaagaagcaaaagaagcggagtcataagaagcagaaaaaatccaaaaaggaagctaccgacattacagccgattcttcttccgaattctcagaggaaacaggcgctagtgggacccgaaaagggaaacagcctcataaaaggaagaaaaagtctcggaagaaaagtctgaagaagcccgcgctgtttctggaggctgagtctaatacctcccactccgacgattctgctagcagcagttcggaggaatcagaggagagagacacaaagaaaactaaaagaaagaaaagagagaagaaggcccatacttcagttgcaaacaacgaaatccaggaaagaactaataagcggaccaactggaaggtcgctactgacgagaggtccgcggagtccagtgaggatgactag

SEQ ID NO: 27488 - DNA, 648 bp, Artificial Sequence
  Description of Artificial Sequence: Synthetic coding sequence
atgtggaagattagagagctggaaaaacaaatggaggatgcctatagaggcactaagaggaagatgttgcccagttcctccagccgcatgcgctcagacggcttcgacgaggagagccagaggtactattggagaccaaagaacgaaatatctggaacgctggaggatgacttcctgaaggctaagagttggaacaagaagttctatgactatgaagccaatatgccggataggtggggtcactctggctacaaggagctttacccagaggaatttgagaccgatagtagcgatcaacaggatatcaccaacggcaagaagaccagcccccaagtcaaaagcagtacacacgaatccagaaagcacaagaagagtaagaagtcacataagaagaagcagaagaagcgctctcacaagaaacagaagaagagcaagaaagaagcgacagacatcactgctgatagctcgagtgagttttccgaggagaccggggccagcggaactaggaagggaaaacagcctcataaacgcaaaaagaaatcacgcaaaaaatccctgaaaaagccggccctgttccttgaggctgaatcaaacacttcccacagcgacgattccgctagctcatcctccgaagaaagcgaagagtag

SEQ ID NO: 27489 - DNA, 276 bp, Artificial Sequence
  Description of Artificial Sequence: Synthetic coding sequence
atgtctagaatacctctagggaaggtcctgctccgcaacgtcatcagacatactgacgctcacaataagattcaagaggagagtgatatgtggaagatccgagaattggagaagcagatggaggatgcttaccgggggaccaagcggaagatgctgccatcgtcctccagtcgtatgaggtccgacggttttgatgaagagtcccagcggtattactggaggccgaaaaacgagatctccggcaccttggaggacgactttcttaaagccaaatag

SEQ ID NO: 27490 - DNA, 795 bp, Artificial Sequence
  Description of Artificial Sequence: Synthetic coding sequence
atgtggaagatcagggagctcgagaagcaaatggaggatgcctacagggggacaaagaggaagatgctgccgagctcctcatctagaatgcgcagtgatggctttgacgaagagagccagaggtactactggagacctaaaaacgagatttccggcacgcttgaggacgatttccttaaggcgaaatcctggaacaagaaattctacgactatgaggcaaatatgcccgatcgatggggacacagcggatacaaggagctttaccccgaggaatttgagaccgattctagcgatcagcaggatattaccaatggcaagaagaccagcccccaggtcaagagtagtacccacgagtctaggaaacacaagaagagcaagaagtctcataagaaaaaacagaaaaagaggtcccacaagaagcagaaaaagtctaagaaggaggccacagacatcacagcagactctagcagtgaattctctgaagaaactggtgctagcggaaccagaaaggggaaacagccacataagcggaaaaaaaagtcccggaagaaatcattgaagaaaccagctctgttcctggaagcagaaagcaacacttctcacagtgatgactccgctagttccagttccgaggaatctgaggaaagagacaccaagaagaccaagagaaaaaaaagggagaaaaaggctcacacctccgttgctaacaacgaaattcaggagagaaccaacaaaagaactaactggaaagtggccacagatgagagaagcgctgaaagctccgaggacgactag

SEQ ID NO: 27491 - DNA, 879 bp, Artificial Sequence
  Description of Artificial Sequence: Synthetic coding sequence
atgagtcgaatcccactgggtaaggtgctgctgagaaatgtaattagacataccgacgcacacaacaagatccaagaagaatccgacatgtggaaaatcagagaactggaaaagcagatggaagatgcatatagggggacgaagcggaaaatgctgcccagctcctcttccaggatgcggagtgacgggttcgacgaggaaagccagcgctactactggagacccaaaaatgagatctccggtacgctggaggatgacttcctaaaggccaagtcttggaacaagaagttctacgattatgaagcaaacatgcctgaccgctggggccactctgggtataaggaactgtacccggaggaattcgagacggactcagatcagcaagacataaccaatggaaaaaagacgagtcctcaggtcaaatcttccacccatgagtctcggaagcacaagaaatccaaaaaaagtcacaaaaagaaacaaaaaaagcggtcacacaagaaacagaaaaagagcaagaaggaggccacggacattacagctgatagctcttccgaattctctgaggagacaggcgccagcggtacaaggaaagggaaacagccccacaagagaaagaaaaaaagcagaaaaaaaagcctgaagaagcccgcccttttcctagaagctgagtcaaatactagccattccgacgacagtgcctcctcatcatccgaagaaagcgaggagcgagacacaaaaaaaaccaagcgcaaaaaacgagagaagaaagcgcacacaagcgtggccaacaacgagatccaggagagaactaataaaagaaccaattggaaagtggccaccgatgagcgatctgcagagagtagcgaagacgattag

SEQ ID NO: 27492 - DNA, 1167 bp, Artificial Sequence
  Description of Artificial Sequence: Synthetic coding sequence
atgaagaccctgattgctgcatattctggcgtactgaggggagaaaggcaggccgaagcagatcgtagtcagcgatctcatggagggccggcgcttagccgggaaggctccggacgatggggaacaggcagctccatactgtctgctctccaggacctttttagcgtgacttggctgaatcgcagtaaagttgagaaacagcttcaggtgatctccgtgctacagtgggtgttatcctttctggttcttggtgtggcatgttccgctattctgatgtatatcttttgtaccgactgttggctgatcgccgtgctgtattttacctggctcgtgtttgactggaacaccccaaagaaaggcggacggagaagtcagtgggtacgaaactgggcggtatggaggtacttccgcgattattttcccatccaactcgtaaagacacataatttattgactactcgtaattacatcttcggctaccatcctcatggaattatgggactaggagctttttgcaatttctccactgaggcgacggaggtgagtaaaaagttcccaggcatcaggccatatctagctacactcgcgggcaatttccgcatgcccgttctgcgagaatatctgatgtctggcggcatctgtcccgtcagccgggataccatcgactacttactctcaaagaacgggtcggggaacgcgattatcatcgtagtgggcggagccgctgagagcctctctagcatgccaggtaagaacgcggttaccttgagaaaccgaaaaggattcgtgaagctcgctctgaggcatggtgccgaccttgtacccatctactcttttggcgaaaatgaggtctacaagcaggtgattttcgaagagggcagctggggtcgctgggtgcagaagaaatttcaaaaatatatcggatttgcaccatgcatctttcacggacgcgggctgttttcttctgatacatggggactcgtgccttatagtaagccaatcaccaccgtggtgggggagcccatcaccatccctaaactggagcatccaacgcagcaggacatcgatttatatcatacgatgtatatggaggctcttgtcaagctcttcgataagcacaagacaaagttcggcctcccggagacggaagtcctggaggtcaactag

SEQ ID NO: 27493 - DNA, 420 bp, Artificial Sequence
  Description of Artificial Sequence: Synthetic coding sequence
atgggagccggcaaaaaggagcacacgggccgattggtgatcggggaccacaagtctacatctcacttccgtaccggcgaggaggataaaaaaattaacgaagagctcgaatcacagtatcagcagagcatggacagcaaacttagcgggcggtaccggagacactgtgggttaggcttttccgaggtcgaggatcacgatggagagggcgatgtcgccggtgacgacgatgacgacgacgatgactcacctgacccagagtcacccgatgatagcgaatccgattcagagagcgaaaaagaagagagcgccgaggaattgcaggccgccgaacacccagatgaggtggaagaccctaaaaacaagaaggacgcaaagtcaaattataaaatgatgttcgtcaagagcagcggatcttag

SEQ ID NO: 27494 - DNA, 1524 bp, Artificial Sequence
  Description of Artificial Sequence: Synthetic coding sequence
atggctgctccctgtggcagcgagctgcccgccaactcccctctgaaaatccctaagatggaagtgttatctccagcctcccctgggggacttagtgatgggaaccctagtctgagtgacccctccacaccccgcggggcctcacctctgggccctggatctgcggccggcagtggcgccgctgcctctggcggccttggtctgggcctggggggccgcagtgcagctagtagctccgtgtcattttcacccggaggaggtggcgggggagcagctgcggccgctgccgctgcctgtcgagggatgagttggacgcctgcagagacaaatgcccttatagccgtttgggggaatgaacggctcgtggaagcccggtaccagcagctcgaaggcgctgggacagttttcggctcaaaggctcccggccccgcaatgtatgagcgtgtgtcacgggctttggccgagcttggttacgagagaacaccctcacagtgccgcgaacgcattaaagaactcgagtctgatggctctaccatggaggattactcccaggaggactggggtaatcatagtcaggacttgcacggctacccaacggatcaggagctagatgagattccagtgaccaaacggacactaaagattaaacaggaaagctctgaagaggcccagaagcgcgacatcatgcaaaatatcgtccagatactggagtccgttcagttaaagtgggagctctttcagtcctggaccgatttctcccgcctgcatctgagcaacaagctcgctatttttggcatcggatacaacaccaggtggaaggaagacatacgttaccattatgcagaaatcagtagtcaagtgcctcttggcaagcgcttaagagagtacttcaattctgagaagccagaaggccggataatcatgaccagggtgcagaagatgaactggaagaacgtatactacaaatttcttgagattacgatcagcgaagctaggtgcctagagctccatatggaaattgattggatcccaatcgctcacagtaagccaactggggggaatgttgttcaatatctgctgccaggaggcatccctaagagccctgggctgtatgcgataggctacgaggaatgcatcgagaggccactatcccctcacatggagcagtcctctctggatccagggaaggaagggagggtcgatctggagaccctgtcagcgcaggcctctcttcaggttgagatcgaaccaacccgcataatctactgctacttaggtatcgccgaggttcgtaccctacaacagtgtctcttcctgcatttccaggctaacacaaagacattctctaaagattgggtgggtattaacgggtttctgtcccaaaactgcatcgtcgaccccggagtttcacccaaaagtatctacatcaagtttgtagaagtggaaagggattttctctcagcgggcagccttgtcgagtgcctggaaaaagccatcggctatccgctcaagttcaacaattag

SEQ ID NO: 27495 - DNA, 1680 bp, Artificial Sequence
  Description of Artificial Sequence: Synthetic coding sequence
atggcagctccatgtgggtctgaattgcccgctaattctccccttaagattcccaagatggaggtattatccccggcgagtcccggcggtcttagtgatggaaacccttcattgagcgaccctagcacccctcgcggggcaagtccgctgggtccaggatccgccgcgggaagtggcgctgccgcgtctggtggcctgggcctcggactcggcggaaggagcgccgcctcctcttccgtgtccttctcaccagggggaggaggcggcggcgcagctgctgccgcagccgccgcttgccggggcatgtcttggacccctgccgaaactaacgccttgattgctgtgtgggggaatgagaggctggttgaggctcgataccagcagctcgagggtgcaggcaccgttttcgggtctaaggcacccggtcctgctatgtacgaacgagtttcgcgcgccctggctgagctcgggtacgagcgtacgccctcccaatgtagggagagaatcaagactctccgcaggtgttattccagagtcaaggagcacggtgtaggaaagcgtaagtcctcatataccttcgagcagcttgagcaagttttcggccagggggggtgggacgcccagccttgccagcccgtcctgataaactcctctggactataccaggaactagaatccgatgggagtacaatggaagattattctcaggaggactggggcaatcatagtcaagacctccatgggtaccccaccgatcaggaacttgacgaaatcccagtcacaaagcgaaccctaaaaatcaagcaagaatctagcgaagaggctcagaagagagatataatgcagaacattgtccaaatcctggagtcagtccaattgaaatgggagctctttcagagctggacagatttcagtaggctgcatctctccaataaactggcaatcttcggaattggatacaatactcgttggaaggaagatattcgctatcactatgctgaaatcagtagccaagtaccccttggaaagcgacttcgggagtattttaattccgaaaaacctgaggggagaatcatcatgacgcgcgtgcagaaaatgaattggaagaacgtttattacaagttccttgagatcaccataagcgaggctcgctgtctggagcttcatatggaaatcgactggatcccgatagcacattctaaacccaccggtgggaatgtggtgcagtacctgcttcctggagggattcccaagagcccaggcctttatgccattggctacgaggagtgcatcgagcgtccactctcaccccacatggagcagtcatctctggatcccggaaaagagggaagggtcgatctggaaactctgtccgcccaggccagtctccaagttgagattgaaccaactaggatcatttactgttacctcgggattgcagaagtcaggacgttgcagcagtgcctgtttttacattttcaagcaaatacaaagaccttctccaaggactgggtgggtatcaacgggttcctgagtcagaattgtattgtagaccctggcgtgagcccgaaatccatttacattaagttcgtagaggtagaacgagactttctctctgctgggtccctcgtggagtgcctggagaaggctataggctaccccttgaaattcaacaactag

SEQ ID NO: 27496 - DNA, 990 bp, Artificial Sequence
  Description of Artificial Sequence: Synthetic coding sequence
atggaagactactcccaagaagactggggcaaccattctcaggacctacacggataccctaccgaccaagagctggacgagattcctgtgaccaaacgcaccctgaaaatcaagcaggagtcaagtgaggaggcgcagaaacgcgatatcatgcagaacatcgtgcagatccttgagtccgtccaactaaagtgggaactcttccagtcatggactgatttctcgcggctccacctgtccaacaagcttgccatattcggaatcggctacaatactagatggaaagaagacattcgatatcactatgccgaaatttcaagccaagtgcccctgggtaagagactccgcgagtatttcaacagcgagaagccggaaggaaggatcatcatgactcgcgtgcagaaaatgaactggaagaacgtctactacaaattcctcgaaataacaatttccgaagcccgttgcctggaactgcacatggagatagactggattccaatagctcattctaagcccacagggggaaacgtggtgcagtatctgctgccagggggcattccaaaaagtcccgggttgtatgcaattggttatgaggaatgtatcgaacgacccttgagccctcacatggagcagtcgtccctcgatcccggcaaagagggtcgggtcgaccttgagacactgtccgctcaggcaagcctgcaagtcgagattgagccaacacggataatttactgctacctggggatcgcagaggttaggactcttcaacaatgcttatttttgcatttccaagcaaataccaagaccttcagtaaggattgggtaggcattaacggattcctgtcacaaaactgcatcgtggatcccggcgtctctcctaagagcatttacattaaatttgtagaagtcgaaagggattttctgagcgccggttcgcttgtggagtgcttggagaaggccatcggttaccctctgaaattcaacaactag

SEQ ID NO: 27497 - DNA, 1182 bp, Artificial Sequence
  Description of Artificial Sequence: Synthetic coding sequence
atgtggtggagagtgttatctctattagcctggttcccactacaggaagcgagcctgactaaccataccgagaccattactgtggaggagggccagaccctgaccctcaagtgcgtgacttctctgcgtaagaacagttcgctgcagtggctcacccccagcggcttcaccatcttcctgaacgagtaccccgcccttaagaactccaagtaccaactgctccaccatagtgcgaaccagctctcgattacagtccccaatgttaccctccaggatgagggcgtttacaaatgcctgcactacagtgattccgtgtcaacgaaggaggtgaaggttatcgtgttagcgacaccctttaaaccgatcctggaggcttccgtaattcggaagcagaatggggaagaacacgtagtgttaatgtgctccactatgagatctaaacctccacctcagataacttggttgctgggaaacagtatggaggtatccggcggaacactccatgagtttgaaaccgatggaaagaaatgtaatacaacatccacgctaatcattcacacatatggcaagaactccaccgtcgattgcattatccgacaccgggggcttcaaggacgcaaacttgtggccccattcaggttcgaggacctggtgacagacgaggagacagcctcagacgccttggaacgaaactctttgtccagtcaggaccctcagcagcctacaagcaccgtctccgttacggaagactccagcacttctgagattgataaagaggaaaaggaacagactactcaggatcccgacctgaccacagaagccaatcctcagtatcttggtcttgctaggaaaaaaagtgggattctccttttgacacttgtgtcttttctcatattcatcttattcatcatagttcaattgttcattatgaaactgagaaaggcccacgttatttggaagaaagagaacgaggtgtctgaacacaccttagagagctatcgctcacggtcgaataatgaggaaacttcatctgaagaaaagaacggacagagcagccatcccatgcgctgcatgaactatataacaaagttgtattctgaagccaagacaaagcggaaggagaacgtgcaacatagtaaactcgaagaaaaacacatccaggtgcccgagagcatcgtgtag

SEQ ID NO: 27498 - DNA, 924 bp, Artificial Sequence
  Description of Artificial Sequence: Synthetic coding sequence
atgtctaagcgtaaactgattccaaagttaagtattcagagtcccgtgctacatacaaacctcaacgtgcaatctacccatccacccctgaaaaaggaagacctgcacagaatttctaaagattccctggagagcgactcggaatctctgacccaggagatcatgtgccattccgaattcgacgacaggattcgcggaaatggaatggagccagattcactggacgaagaggagagcccccgatggggatcgctgcacgaaatggaggaggaagcttccgggaaggctgcccagatggctcgcgaacagaatcatcatacctgggatcagggggcgaacaatagacagcaacccattgaggataaatactctgatcttcggtacgaccctaattggaagagcaaaaaagaagaaggacaactcctgtctgtggaagccttgcccgagtcaactgattcaagcctggagaacctcccactagctcccctgtacccctctcaggagacatctatggagctgagcggtggtaaaggcgaacaaaaggaatccccacaaagtgccgcttcattgctcgggtcagagtttctgtctcctaattatgagcacggagctcgacgctccaagccattttctgaactgtcggactctgacttggaagagaaatcatccagtctgagtccgtatgttaagagctcctcttcccacaatgaggtgttcttgcctggctctagagggccaagacgcaggaaatctaaacagcatttcgtcgaaaagaacaagctcacattaggcctgcctacacccaaaaccgatagctacttacaattgcacaataagaagcggggtgagtcgcaccccgagcaggttatcctgcgagttaactctctgcctagagatggcttcaagacattctggagccagtag

SEQ ID NO: 27499 - DNA, 2337 bp, Artificial Sequence
  Description of Artificial Sequence: Synthetic coding sequence
atgtcaaagcggaagctgatacctaagttgtcaatccagtccccagttttgcacacaaatctaaatgtccaatcaacccaccctcctctgaaaaaggaggacctccataggatatcaaaggattcactggaatcagactccgaatctttgacacaggaaatcatgtgccactctgagtttgacgacaggatccgcggcaacggtatggaaccagattctctggatgaggaggaatcccctaggtgggggtcactgcacgaaatggaggaggaagcgtcaggtaaagctgcgcagatggcacgtgagcaaaatcaccatacgtgggaccagggcgctaataaccgacagcagccaatcgaagataagtactctgatctgagatacgatcctaactggaagtcaaagaaagaggagggccaattactaagtgtcgaagccctgcccgagagcacggacagctcactggagaacctgcccctagctccattgtacccctcccaggagacgagtatggaactttccggcggcaagggggagcaaaaagagtccccacaatccgcagcttctctgttggggtcagagtttctgtctccaaattacgaacatggagctaggcgaagcaaaccgttctctgagctctctgattcggatctcgaagaaaagtcctcgtctttaagcccctacgtaaagagcagctcgtcccacaacgaggtctttctgcctggctcacgaggccctaggaggaggaagagcaagcagcattttgtggaaaagaataagctgacgctaggtctccccacccctaaaaccgattcatacctacagctgcataacaaaaaacgaggggagagccaccccgagcagatctcttaccctgtgagagtcacagataagacgtccattcaaaatgctaaggagatggagaatgccgcaattgatccagaggataaatggcatcagagggcacaacagctaaagaactatcaggagcactggtctcagtacgaatctaccaaatcatcaaatgttccaaggggccagccctctgatatggtaaatgatcaccagcccagcaggagacccgccaagctgaagatccgcaagcagtgtaagcaccagaacggcctcaaatcatcaacaacagaagaagtcaccgcctcgcagggaaaccaaaacaacccacccaggcagcagcagaatcagaataaaccactggacacaagcaccaagccggagagcatcgtgatcatgcacgcaagcaacaacgatgtgcaggcctcccgtgcactgaggtcccataatctcaaggagacctctaacactttcgccccacccaaacaggcctttgataaggtgctttcaaagaattcaaccggctgcgattctggcttaaatgttaataaagagcggggtcataaggaccaggaagagaagaggttctcttaccagcaactgcacactttgtcagacatggacctgaataacttgaacgagctgagcaaaaggcacgtactcctgtcacaaaagggatcgcaatttgtgtaccatattaacacccacggaagtacaaaaaacaaaaaacagttgaagcagccctacacggagacaaagtatcgaaacctcgaaatgctttggaaatttcacagtagcagtgattcccagactgtgcgggccagccccgattcctggcttacacagatcatggagcaacaccagcaggcattggtgcaactgacagacgtccagccctcggaaggggccctctcatctgttaccttgccccccattttgtctagagtggagagtgaatcacagctgagttcggaacgttcccagaggaaccaggtcaaaatcagccgttctaattctgaggggtatctgtttcagttggagaaaggtaagaagcacaaaaagaggtccagctcaaaaaatactaaactcaagggataccagaagagggacgtgaagcttggagggctgggtccagatttcgaatcaattagagataagactcagaagctcattcaacagaaggagtacgctaaacaagtcaaggagtacaacatgaagactttatccatccttagtaaaccacagacagagaagacacagaaaaaaagtgccatccccaggcaaaaggccctggaatatgctaagaccattccaaaacccaagccctctaatctgacccatcaggccagcaaagagcagaagaatcccacttatgctggtaaggaggaatcattaccggagatctctctcttagagatcctgcagaataggcacgagcgagaaaagcaggccgtcgcagccttcaaagtgcttcacatcgtctag

SEQ ID NO: 27500 - DNA, 942 bp, Artificial Sequence
  Description of Artificial Sequence: Synthetic coding sequence
atgccttggaaagaggagtcagagttcactaagcaggataaggctgcacgcgtgatccagcaagcctggaagtcctttctgaacgtcgccatttttcaacacttcaaatcactgattgacctccgacgccaaggcgagcctaggcaaatcgtgaaatacataaatcctaaagaggcagagctgctcgatgccgcagcaggaattcacgttaggtttaggcttggaggggtgaaatttcctccagacatctattataagattttcacccataggccgatagaagacctttgtgctaattctcctcgaaattacgcgaagctgccagccaagcacaccagtcataacaagaatgaccacctgcaggaggaagaccactccggttggtatcataggatagaaaataatggatggcggcccgtgtccgacactttctggctttccactgatggcatggtagtcgaggacaaaaaggagtcagagttccattttagtaaattgaagagaagacaggatctggaaaagaaacggaagttgcggaagatcgagtggatgaggcagatgtattacagtgggtcgctggaggccaaatccacccatcacgaaacccttggtttgatacacactgccactaaaggcctgatccgcgcattcgaggatggtgggatagactccgtcatggaatgggaggttgatgaggtgctgaattggactaacaccctgaacttcgatgagtacattgcatcgtggaaggaaattgccacatccaactcctcagccaactttaagggctttaggttcaaccaggctcagaagaacatctacaactatggcggagatatttccaagatgcagatggggatccctgacgacacttattatgaaaatgtttaccaggaacccaacgtgacccggctcacccccgactcgacttacggcttgtag

SEQ ID NO: 27501 - DNA, 942 bp, Artificial Sequence
  Description of Artificial Sequence: Synthetic coding sequence
atgccctggaaggaggagtccgagttcactaagcaggataaggcggctcgggtgatccaacaggcatggaagtcgttcctgaacgtcgctatcttccaacacttcaagtcactgattgatcttagacggcagggcgaaccaagacagatcgtgaagtacattaatcccaaggaagccgagctgctggacgccgctgcgggaatccacgtgagattcaggctcggaggggtgaagttcccccccgacatctactacaagatctttacgcaccggcccatcgaagatctgtgtgctaatagtccacggaactacgcaaagttaccagcaaaacacacatcgcataacaagaacgatcatctacaagaggaagatcacagcgggtggtaccatcgcatcgagaacaatggttggagacctgtgagcgacaccttttggctaagcactgacggtatggtggtggaagataagaaggaatcagagttccatttctctaagttaaaaaggagacaggatctggaaaagaagaggaagctccgtaaaatagaatggatgcgccagatgtattactcggggagtctcgaggcaaagtccacccatcacgagactctcggcttgatccatacggccaccaaaggtctaattcgggcattcgaagacggcgggatcgactctgtcatggagtgggaagtggatgaggtgctcaattggacgaataccctgaattttgacgagtacattgcctcttggaaggagatcgcaacgagcaattctagcgccaacttcaagggattcagattcaatcaggcacaaaaaaatatttacaattatggcggagacatctcgaagatgcagatgggaatccccgacgacacctattacgagaatgtctatcaggaacctaacgtgacccgcctgacccctgattcaacctatggcttgtag

SEQ ID NO: 27502 - DNA, 369 bp, Artificial Sequence
  Description of Artificial Sequence: Synthetic coding sequence
atgacgtctccagaaatcgccagcctgagctggggtcagatgaaggtgaagggctcgaatacaacctataaggattgtaaagtctggccgggcgggagtcgtacttgggactggcgcgaaacaggcacagagcactctcctggggtgcagccagccgatgtgaaagaggtcgtggaaaaaggagtgcaaactctggtaatcgggcggggaatgtccgaagccctaaaggtgccctctagcaccgtagagtatctcaagaagcatggcattgatgtccgcgtgttgcaaacagagcaagccgtcaaagaatacaatgccttagtcgcccagggtgtacgcgtgggcggagtgttccacagcacctgctag

SEQ ID NO: 27503 - DNA, 369 bp, Artificial Sequence
  Description of Artificial Sequence: Synthetic coding sequence
atgacctccccggaaatcgctagtctgtcttgggggcaaatgaaggtgaaaggatccaacacaacttacaaagattgcaaagtatggccagggggctcaaggacctgggactggagggagacaggcaccgagcattcgccaggcgtgcagcccgcagatgtcaaggaggtggttgaaaagggcgtgcagaccctcgtcatcggcaggggcatgtccgaagccctgaaggtgccctcctctaccgttgagtatttaaaaaaacacgggatagacgtaagagtgctgcagacagagcaggctgtgaaggagtataatgctctggtcgctcagggagtgagggtgggcggtgtattccatagtacctgctag

SEQ ID NO: 27504 - DNA, 882 bp, Artificial Sequence
  Description of Artificial Sequence: Synthetic coding sequence
atggcagccgccgccgctgccgccgtggcaggtgtcgggcggggcggtggtggggccgagcctagacaggagaggagcagagcccgcggttgggccggcgtggaacgctccgaagggcggtccaggatggagccaggagaggagctcgaagaagaaggatcgcccggtggccgtgaggatggattcaccgcggagcaccttgccgccgaagctatggccgccgacatggatccgtggcttgtgtttgatgcaagaaccacacctgctactgaactcgacgcatggttggcaaagtaccctccgtcacaggtcaccaggtacggcgacccaggcagtccgaacagcgagccggtaggctggatcgccgtctacgggcagggctattccccaaactccggggatgtgcagggcttacaggctgcatgggaggcactgcagacctcagggcgccctatcactcccggcaccctcagacaactggcaatcacccaccacgttctgagcgggaaatggctcatgcacttggccccaggtttcaagctggatcacgcttgggccggtattgcgagggccgtcgtggagggacaactgcaggtcgccaaagttagtccacgggcaaaagaaggaggacggcaggtgatttgtgtctacaccgacgattttactgatcgtctgggagtcctcgaagccgactcggctattcgcgctgccggaataaaatgcctgctgacttacaaaccagacgtctatacttaccttggcatataccgcgccaataggtggcacctgtgtccaacactctatgagtccagattccagctgggagggtcagcgcgcggtagtcgggtgcttgatcgtgctaacaatgtcgaactgacatag

SEQ ID NO: 27505 - DNA, 879 bp, Artificial Sequence
  Description of Artificial Sequence: Synthetic coding sequence
atggctgccgctgccgcggcagcagtcgccggtgtgggtagaggcggtggaggggcagaaccacggcaagagcgctcgcgcgcaagagggtgggctggcgtggagcgctcagaaggccgtcggatggagcccggtgaagagttggaggaggaaggcagtcccgggggtagagaggacggattcaccgcagaacacttggcggccgaggcaatggcagctgacatggacccatggctggtcttcgatgcacgaaccacacctgcaaccgagctggacgcgtggctggcaaagtatccccctagccaagtaaccagatatggagatccaggcagtcctaacagtgagcctgtcggctggatcgctgtttacgggcagggatactcccctaatagcggagacgtgcagggactccaggctgcttgggaagcgttgcagacatccggacgccctattacccctggcacgttaagacaactggccatcacccatcatgtgctgtcaggtaagtggctcatgcatctggcgcccggctttaagctcgatcacgcatgggccggaattgcccgggctgtggtagaaggccagttgcaggtggccaaggtatccccccgagccaaggaaggtggccgacaggtgatctgtgtgtacacagacgacttcacggaccgactgggagttctggaggctgattccgcgatcagggctgccggcattaaatgccttctcacgtacaagcctgatgtgtacacatacctaggaatataccgtgcaaacagatggcacctgtgccccactctgtacgagtccaggttccaacttgggggttcagcccggggctctagggtgctggatagggctaacaatgtagagttaacctag

SEQ ID NO: 27506 - DNA, 165 bp, Artificial Sequence
  Description of Artificial Sequence: Synthetic coding sequence
atgcttgggcggattaaagctcaggcatttggattcgatcagaccttccagagctatagaaaagacgacttcgtgatgggattcttccaaaggcctaagtgctattctcagttcgaggttacctttcgcttcttttggactatggaccatattaggttttgctag

SEQ ID NO: 27507 - DNA, 804 bp, Artificial Sequence
  Description of Artificial Sequence: Synthetic coding sequence
atggccacgggtgagctcggggatcttggcggatactattttcggttcttaccccagaagactttccagtccctgtcttctaaggaaatcacaagtcgcctcaggcaatggagtatgctcggtcggataaaggcacaggcgttcggtttcgaccaaacctttcagtcttatcgaaaggacgattttgtcatggctttctttaaagatcctaatgttatcccgaacctgaagctgctgtcagacagctcaggtcagtggattatccttggcacagaagttaagaagatcgaagccattaacgtcccatgtacacagttatctatgtcttttttccacaggctctacgacgaagacattgtgcgggactccggccacattgtgaagtgtctggatagcttttgtgacccctttctgatctcagacgagctgaggcgcgtcctcctggtggaagactcggagaaatacgagattttcagtcagcctgacagagaagaatttctgttctgtctgttcaagcacttgtgtcttggaggagcgctgtgccagtacgaggacgtaatttcaccctacctagagactaccaagctgatctataaggatctcgtgtctgtgcgcaaaaacccacagactaagaaaatccagataacaagtagcgtcttcaaggtttccgcgtacgattccgccggaatgtgttacccatccgccaagaaccacgagcaaaccttcagctactttatagttgaccctattcggagacacctgcacgtcctgtaccactgttatggagtgggcgacatgtcctag

SEQ ID NO: 27508 - DNA, 300 bp, Artificial Sequence
  Description of Artificial Sequence: Synthetic coding sequence
atggcgacaggcgaactgggtgacctcggaggctactactttagatttttaccgcagaagacttttcagtcactcagctccaaagagatcaccagcagactgagacagtggtccatgctgggaaggattaaggcccaggccttcggcttcgaccaaacctttcagtcatataggaaggacgacttcgtaatggcattttttaaggaccctaacgttatccctaatttgaagctcctgtcagattcaagtggccagtggattattctcggtttcgccagtggtcgcctgaggaaaatttag

SEQ ID NO: 27509 - DNA, 444 bp, Artificial Sequence
  Description of Artificial Sequence: Synthetic coding sequence
atggcgctgaacaatgtgagcttgtcctccggggatcagagatctcgcgtagcctataggtccagtcacggagacttgcgacctcgtgcttcagctctggccatggtgtcaggcgacgggttcctcgtcagtagaccagaggctatacatctaggcccgcggcaggcggtgaggccatcagtgcgggccgagtctcgacgcgtggatggcggcggaagatctcctcgcgaaccagacgggcgcggacgcagtcgacaggcgaggttttccccgtacccaattcctgcagtggaacccgacttgctgcggagtgtgctccagcagcggctgattgccctgggggtgaccacctggacactgaagttatcagaatccgctacccctgacctgaggtggtgttcaacatgcagccattccaacattttcgaaatactcgttatatag

SEQ ID NO: 27510 - DNA, 756 bp, Artificial Sequence
  Description of Artificial Sequence: Synthetic coding sequence
atgacacagttgccagagctggggttacgcagcccaaataataaatcacctaccgggccacacccactagagcatctgctcgcccggctgctgaaacggaggcgccgatctaccctaatgagttccccgcgatccctcctatgcagcatcagcggaccgggatcacatctcctgtctacccatcccatcctgtgtcactcagtgtaccagcccccgcagcccgcttcacgaccacaggccaaacggtatcagggccttcttcctgtccctctcgcaccacacccactctgcctctccgggcagttatacctgcccaacatcccatgcaccgtgatagacggatgtggccccgtgatctcccacttaaagcttacgatgtatccctggggcctccccccatcacacctcggcagctccagtcctttcagcgctaatatggaacagtgggactactacaaatcccaaactcgctttgccccattcttgccagagagtttttgtgggagcccgttgcccagcgaacagtcctcacgccctttcgggctcgcctttaaagttctgtgcgcagcaacatgtcagcctccacaatttcagctgctatggctctgcccatacaagctggatctacaccagcgtatatgtcttcctcccaatctggcactggtgttactgggagcgctgtggaccagtccacctccagggagcttccttcagccgccctataataggccttataaactctacaaaacaaattag

SEQ ID NO: 27511 - DNA, 756 bp, Artificial Sequence
  Description of Artificial Sequence: Synthetic coding sequence
atgactcaactcccagaactcgggcttcgttctcctaataacaagtctcctacaggaccacacccgcttgagcatttgctcgcgcggctgcttaaacgacggaggcgttccactctcatgagctcccctaggtctctactgtgctcaatcagcggcccggggagccaccttctgtccacgcaccctatcttatgccactcggtgtaccagccgccacagcctgcgtctagaccccaggcgaagcggtaccaggggctgctgccggtgccactagcccctcatccgctatgcctgtcagggcagctctatctgccaaacattccctgcaccgttatcgatggctgtggcccagtgatctctcatcttaaactgacaatgtatccctggggactccctcccagccacctgggttcttcctcccccttctccgccaacatggagcagtgggattactacaagtcccaaaccaggtttgctccctttctgccagagagcttttgcggatcgcctctgccatccgagcagtcttcccggcctttcggcctcgctttcaaggtactctgcgcagcaacctgtcagccgccacagttccaacttctgtggttatgcccttataagctggacctgcatcagcgaatctgtctccctcccaacctggcgctggtccttttgggggctctgtggacctctcctcctcctgggtcatttctccagcctccatacaatcgcccatacaaactctacaaaaccaactag

SEQ ID NO: 27512 - DNA, 666 bp, Artificial Sequence
  Description of Artificial Sequence: Synthetic coding sequence
atgagtgcccacatgagtgggctggagattatggacgaggaccagctgatcaaagatgtactcgataagtttctgaactgccatgaacaaacttatgacgaggagtttcttaacactttcacccatctttctcaggaagatcatgtttcaaaaagaggcgtctttggaactgacagctcagaaaacatctttaccagcgctaaagtgacgcacaagaacgaggctgatgactaccatctccgcaataaaaccatcttcctccgtaccagcagccagtgcttggaggagcaggtggataattttctggacctggaggacctggacatggacgaagagatcaagccccagatgagtgaggacctcttgctgttgcctggagaggtggagcaagacgtttccacctctattcctagctgtatcccattcgtagcccagcctccaacctgcgaagtaaaacctaagccttccgtaaagcgcatggacaaacagaccgaggaaatcctgggagacgaggttcagttgttttccctggacgaggagtttgactacgacaatgtgatgctgacttctaagttctcacctgccgaaatcgagaatattaaagagctttgcaagcaacagaagcgaaaggacacaagcccagatctggagaagtcatgcgactag

SEQ ID NO: 27513 - DNA, 444 bp, Artificial Sequence
  Description of Artificial Sequence: Synthetic coding sequence
atgagcgcccacatgtctggactggaaataatggacgaggaccagttgataaaagatgtactggacaaattcctcaactgccacgagcagacatatgatgaagagtttttgaatacgtttactcacctgagccaagatctgctgctactacctggcgaggttgaacaggacgtgtctacctccatccccagttgcattcccttcgttgcccagcccccaacctgcgaagtcaaaccaaagccctcagtgaagaggatggacaagcagactgaagaaatcttaggtgatgaggtgcagttattcagcctggacgaagagtttgactacgacaacgtcatgctaacatctaagttctcacccgcagagattgagaacatcaaagaactctgcaagcagcagaagaggaaggatacatcgcccgatctcgaaaagtcttgtgattag

SEQ ID NO: 27514 - DNA, 504 bp, Artificial Sequence
  Description of Artificial Sequence: Synthetic coding sequence
atgtccgctcatatgagtggacttgagattatggatgaggatcaacttatcaaggacgtgctcgacaaattcctaaactgtcatgagcagacttacgacgaggaatttctgaataccttcactcatctgtcccaggaagaccatgtctcgaaacgaggggtgtttggcaccgattctagtgagaatatcttcactagcgctaaggtcacacacaagaatgaggctgacgattatcatctccgaaataaaaccatcttcctcagaacctcctcccagtgcctggaggaacaggtggataatttcttagacctggaagatctggatatggacgaagaaattaaaccccaaatgtccgaagatctcttgctcctgcccggagaagtggaacaggatgtgagtacaagcattccctcctgcatcccctttgtcgcacagccacccacctgcgaagtaaaacctaaaccgtccgttaagcgcatggacaaacaaactgaggagtcctag

SEQ ID NO: 27515 - DNA, 273 bp, Artificial Sequence
  Description of Artificial Sequence: Synthetic coding sequence
atgagcgcacacatgtctggactggaaattatggatgaagaccagctcatcaaagatgtgcttgacaaattcctgaactgccacgagcagacctatgacgaagagttcctaaatacgtttacccacctgagccaggatctgctgctgctgcccggagaggtggagcaggacgtgagtacctcaatcccatcatgcataccgtttgtggctcaacctcccacttgcgaagtgaaacctaaaccctctgtgaaaagaatggacaaacagacctag

SEQ ID NO: 27516 - DNA, 252 bp, Artificial Sequence
  Description of Artificial Sequence: Synthetic coding sequence
atgtcagctcatatgtccggcctggagattatggatgaggaccagttgattaaggacgtgctggacaaattcctcaactgccacgagcagacctatgatgaagagttcctcaacacctttacacacctgagtcaggaagaccacgtgtctaaaaggggagtattcgggactgatagcagcgagaatatctttacctcagccaaagtgacacacaagaacgaagcggacgactatcaccttcgcaataagtag

SEQ ID NO: 27517 - DNA, 543 bp, Artificial Sequence
  Description of Artificial Sequence: Synthetic coding sequence
atgagtgcccatatgagcggcctggagatcatggacgaagaccagttgatcaaagacgtactggacaaatttctcaactgccacgaacagacatacgatgaagaatttcttaacacctttacacacttatcacaggaagaccacgtgtctaagaggggcgtgttcggaactgactcatcggagaacatctttacttctgctaaggtaactcataaaaacgaggccgacgattaccaccttcggaacaaaactatatttttacgaacttcttcccagtgtttggaggagcaagtggacaacttcctcgatctggaagacctggacatggacgaagagatcaaacctcagatgtccgaagaccttttgttattgcctggagaagttgagcaggacgtgtcgacatctatcccgagctgtatcccgtttgttgcacagccaccaacctgtgaggtgaagccaaagccaagtgttaagagaatggacaagcaaacagaggagatcctgggggacgaggtgcagttgttctccctcgatgaggagtag

SEQ ID NO: 27518 - DNA, 360 bp, Artificial Sequence
  Description of Artificial Sequence: Synthetic coding sequence
atgagcgcgcatatgagcggactggagatcatggacgaggaccagctgattaaggatgtcctcgacaagtttctaaattgtcacgagcaaacctatgacgaggagtttctgaatacattcactcacctttcacaggaggaccacgtctccaaacgaggcgtgtttggcacggattcctctgagaatatttttacgtcagcgaaagtgacacacaagaacgaggccgatgattatcacctgaggaataaaacaattttcctccgaacaagctcacagtgcttggaggagcaagtggacaattttcttgacctcgaggacttagatatggatgaggagatcaaaccccaaatgagtgaatag

SEQ ID NO: 27519 - DNA, 444 bp, Artificial Sequence
  Description of Artificial Sequence: Synthetic coding sequence
atgagtgcacacatgtctggcctagaaatcatggacgaagaccagctcatcaaggatgtgctagacaaatttcttaattgccacgagcagacatacgacgaagagttcctcaatacatttacccacctgtcgcaagatctgctcctcctcccgggcgaagttgagcaggacgtttctacatctattccctcttgtattcccttcgtggcacagccaccaacttgcgaggtgaaaccaaagccttcagtgaagagaatggacaagcagaccgaggaaattctgggggacgaggtgcagctattttccctggatgaggagtttgattacgataacgttatgctcacgtcaaagttctccccagccgagatagaaaatataaaggagctctgtaaacagcaaaaaagaaaagatactagcccagatctagaaaagtcttgcgactag

SEQ ID NO: 27520 - DNA, 1461 bp, Artificial Sequence
  Description of Artificial Sequence: Synthetic coding sequence
atggttgcctccgctggaagtttatttggaggtatggtgctcaaaaagtttctcaaggagatccaaagcatactgccagggatttcagcaaaactgacatggacctcggaggaaggcagctactcccaggacatgaccggagtcaccccttttcaaatgatttttgaagtcgatgagaaaccccgaacactgatgactgattgtctggtgatcaagcactttcttcgcaagatcatcatggttcacccaaaagtccggtttcacttctcagtgaaagtgaatggtattttgtccaccgagatttttggagtcgagaatgagccaaccctgaatctggggaacgggatcgctctcttagtcgattcgcaacactatgtctcaagacccaacttcggaacgattgagtcacactgctctcggatacacccggtgttagggcacccagtgatgctctttatccctgaggacgtggccgggatggatctcctaggggaacttatcctgaccccagctgctgctctctgtcctagtccaaaggtgtcaagtaaccagttgaacagaataagctccgtttctatctttctctacggccctctgggactgcctctgatcttgtccacgtgggagcagcctatgactacattttttaaggacactagctcgttggtagactggaagaagtaccacctgtgtatgattccgaatctggacctaaatttagacagggatctcgtattgccggacgtcagctatcaggtcgagtctagcgaagaggaccaaagtcaaaccatggaccctcaaggccaaaccctactccttttcctgttcgtggacttccatagcgcatttcctgtccagcaaatggaaatctggggcgtttacactctgctcactacacatttgaatgctatcctggtggagtcccactcagtcgtgcaggggtccatacagtttacggttgataaggtcctcgaacagcatcaccaggctgctaaggcagccgatacccaggagtttcggaccaaactccataaagtcttccgagagataacccaacaccaatttctacatcattgttcctgtgaggtcaaacagcagctgacgttagaaaaaaaagactcagcgcaagggacagaggatgcccctgataacagcagccttgaactgctggctgataccagcggtcaggctgaaaataagcggctaaagcgcggtagtcccaggattgaggagatgcgggcgctgcgatccgcgcgcgcaccgtccccgtctgaggctgcgccccgacgtccagaagccacagctgcacctctgacccccagaggccgggagcatcgtgaagcacatggcagggccctggcccctggacgtgcctccctggggtcccgcctagaagacgtcctgtggttacaagaggtcagcaacttaagcgagtggctgagtccgagtcctggcccttag

SEQ ID NO: 27521 - DNA, 2034 bp, Artificial Sequence
  Description of Artificial Sequence: Synthetic coding sequence
atggggagtagatgccgagcttgggcatggactcgcgcgtgggccctcgccgaattccaggcacgcgcagaggagggggcagccgctgcagctgctgcagctgggggctatcctagtacaggtcgttgccggtgctcccttcggggcatggaaggcacggccgtggccgttttcgagattttgcggttcctgattatccactggaagtgcgatattgatgtgagcaagggggcactcctcgagggccagctggtgattagtattgaaggcctgaatagcaaacatcaagccaatgccctgcactgcgtgaccacgcgctggtctctgactttgttgcctcgccctgaatgctctggagctgtgtcagcgcactgtaatcttcatctccctgggtcctcagatagtcatgcctcagtgccgagggtggcaggcattaccgacgcccaccaccacgcttggctgattatggtagcgtctgccgggtccctgtttgggggcatggtacttaagaagttcctgaaggagattcagagtatcttgccaggcatcagtgctaagttgacgtggacctctgaagagggaagctactcccaggacatgaccggggtcactccattccagatgatcttcgaggtcgacgagaagccccgaactttaatgacagactgcctggtgataaagcattttctgcgaaaaataatcatggttcatccaaaggtgagattccacttctctgtcaaggttaatggaattctctcaaccgagatatttggagtggaaaatgagccaaccctgaacctaggcaatggaattgcattgctggtcgatagccagcactacgtaagaccaaacttcgggacgatcgaaagtcactgttctaggatccatccagtcctgggccatccggtgatgttattcatccccgaggatgttgcaggaatggatctactcggcgaattgatcctcactcccgccgccgccctgtgcccatcccctaaagtttcgtcaaaccagctcaatcggatctctagcgtgtccattttcttgtacggccccctgggcctgcctcttattctcagcacttgggaacagcccatgaccacctttttcaaagacacgtcctccttggtagactggaaaaaataccacctatgtatgattcccaacttggacctgaacctggaccgggacctcgtattaccggacgtttcctaccaggtggagagctctgaagaagaccagagccagacaatggatcctcaaggccaaactctcctgctgttcttgtttgtggacttccacagtgctttccccgtgcaacagatggagatttggggagtctacacgcttctgaccactcatctcaacgccatactcgtggagtcccactcggtggtgcagggtagcatacagttcacggtggacaaagtcctcgaacagcatcaccaagcagcgaaggcacagcaaaaactgcaagcatccctctcagtggcggtgaatagcataatgtccatcctcactggttccaccagatcctcgttccgcaaaatgtgtttgcagacactccaggccgctgatacccaggagttccgtaccaagctgcacaaggttttcagagagataacacagcaccaatttctgcaccattgcagctgtgaagtgaaacaacagctgactctggaaaagaaggattccgcccagggtacagaagatgcgccagataatagttcgctagaattgttggcagacacatccggccaggccgagaataaaagactgaagcgcggttcgccccgaattgaagaaatgcgagctctgcgatccgcgcgcgctccatcacctagcgaggccgcacccaggcgcccagaggcgactgccgctccgttgacaccccgtggccgcgagcatcgggaagcacatggtagggccttagctcctggaagggcatccctgggctcacgactcgaggatgtcctctggctgcaggaggtgtctaacctgagtgagtggctgtcaccaagccctggcccgtag

SEQ ID NO: 27522 - DNA, 1536 bp, Artificial Sequence
  Description of Artificial Sequence: Synthetic coding sequence
atggtactcaaaaagttccttaaagagatccagtctatcctccccgggatttcagccaaactgacctggacctcagaagaaggaagctacagccaggatatgactggggtaacccccttccagatgatctttgaagtggacgagaaacccagaacattgatgaccgactgcctggtaatcaagcactttctgaggaagattattatggtacacccgaaagtgaggtttcacttcagtgtgaaagttaacgggattctctcaaccgaaatctttggagtcgagaatgagccgaccctgaacttgggcaatggaatagcactcctcgtggattctcagcactacgtttccagacccaacttcgggaccatcgagagtcattgctcccggatccatcccgtcctgggacatccagtgatgcttttcatacctgaggacgtggcaggtatggatctgctgggagagcttatcctaacgccagcagcagccctttgcccatcccctaaggtgagcagcaaccagctgaaccgaatttcctcggtctcaatatttctgtatggcccactgggccttccattgattctctcaacctgggagcaaccaatgaccaccttcttcaaagacactagttcacttgtcgactggaagaaataccatttatgtatgatccccaacctggacctcaatcttgaccgggacctggtccttcccgatgtgagttaccaggtcgaaagctcggaggaggaccagtcacagaccatggatccacaaggacaaacccttcttctgttcttattcgtcgactttcatagtgcattcccagtgcagcagatggagatctggggcgtctataccctgctaaccacccaccttaacgctatcttagtggagtcccattcagtcgtacaagggtctatccaattcacagtcgataaagtgttggaacaacaccaccaggcagcaaaagctcagcagaagctgcaggcaagcctgagtgttgcagtgaattccatcatgagtattctgaccggcagtacccgctcatcatttcgcaaaatgtgcctgcaaaccctccaggccgcagacactcaggagttccgtactaaacttcacaaagtgttccgggagatcacccagcaccaattcctgcatcactgcagttgcgaggtaaaacagttaaccctggagaaaaaggattcagcacaaggcaccgaggacgcccctgacaattcatccttagaactccttgctgatacttcgggccaggccgagaacaagaggctgaagcgcggctcgcccagaatcgaggagatgcgggcactcagaagtgcgagggctccttccccctctgaagccgctccgcgaaggccagaggctacagccgccccccttacaccaagggggagagagcatcgggaagcccatggtcgtgcacttgccccggggcgggcttctctcgggagtagactcgaggacgtgctttggttacaggaggtgtccaatctgtctgagtggctgtccccctcccccggcccctag

SEQ ID NO: 27523 - DNA, 1146 bp, Artificial Sequence
  Description of Artificial Sequence: Synthetic coding sequence
atggctctgaaggccgagggggccgctctcgactgtttcgaagtaactctgaaatgcgaggagggagaggatgaggaggaagcaatggtcgtcgcagtgatcccccggccagagccaatgttgcgcgtgacgcagcaggagaagacgccaccgccgcgtccaagccctttggaggcagggtccgacggttgcgaagaacccaaacagcaggttagctgggagcaggaattcctggtgggcagctccccaggcggatccgggcgagctctctgcatggtctgcggggcagagattagggccccaagcgcagataccgctcgttcacacatcttggaacagcacccccataccctcgatctgtccccctccgaaaagtccaacatcttggaggcatggagcgaaggagtcgccctgttacaagatgtgcgagccgaacaaccgtctcctcccaacagcgattcagggcaggacgcacaccccgatcccgacgccaatcccgacgctgcacgtatgcccgccgagatcgtcgttctcctcgactccgaggacaatccatcactccccaaaagaagcagaccccgggggcttcgacctctggaactgccggccgtcccagccacagagcccggcaacaaaaagccacgaggccagcgctggaaagagccacccggagaagagccagtgaggaagaaacgcgggagacctatgactaaaaacttggaccccgaccctgagcccccttctcctgatagccccacagagacttttgccgcaccagccgaagtgcggcactttaccgacgggtcgtttccagctgggttcgtgctgcaactcttttctcacacccaacttagaggccctgacagcaaagacagtccaaaagatcgggaagttgccgagggcggattgcctcgcgcagagtccccttcccccgctccaccgcccggcctgcgagggacactggacctccaggtgatcagagtcagaatggaggaaccccccgctgtcagcctcctccaagactggtcccgacacccacagggaacaaaacgcgtgggagccggggatacttcagactggcctactgtgctgtcagagagttcaaccactgtggcggggaagcccgagaaaggtaatggtgtctag

SEQ ID NO: 27524 - DNA, 651 bp, Artificial Sequence
  Description of Artificial Sequence: Synthetic coding sequence
atgagcctgaaaccttttacgtaccccttcccggaaacaaggttcttacacgcgggccctaatgtctacaaatttaagattaggtacggtaaatcaattaggggagaggagatcgagaataaagaagtgataacacaagaactcgaagactccgtacgggtggttctcggtaacctcgataacttgcagccattcgcaacagaacacttcatagtctttccgtacaagagcaaatgggaaagggtaagtcatttgaagtttaaacatggagagattatcctgattccctacccctttgtctttacactgtatgtcgagatgaagtggttccacgagaacctttcccctggtaagcccatttccgacagccctttgggtctcgtgccagtggagaagaaagcagtgggcgctgttatgcggaaacggaaacacatggacgagccctccagccccagcagacctggactcgacaggatagggaaggagaaaccaaacaaagactgccggcgactctggcctctcatctccctcatgagtagaaacaagatcctcagcggggataccgcatgccagggggaattgtcacacccttgcagcactacccatttacaccttaggtctgagcaaccgcccgcctctctgggcttctag

SEQ ID NO: 27525 - DNA, 651 bp, Artificial Sequence
  Description of Artificial Sequence: Synthetic coding sequence
atgtcgctcaagcccttcacttacccttttccagagactcgatttttgcatgcagggcctaacgtatacaaatttaaaatccggtacgggaaatcgatcagaggcgaggagatcgaaaataaggaggtcatcacacaggagttggaggactccgttagagtcgttctcggaaacctggataatctgcagccctttgccacggaacacttcatcgtcttcccttacaagtcaaagtgggaacgggttagtcatcttaagttcaaacacggggagattatcttaatcccttacccctttgtattcaccctttacgtcgaaatgaagtggttccatgagaacttgtcccccgggaagcccatttcggatagtcccttaggactcgtgccggtggaaaagaaagctgttggagccgtgatgaggaagagaaagcatatggacgagcccagctcaccatcccggcccggactggaccggattggcaaggagaaacccaacaaggattgtcggagactgtggccactgatttccctcatgagtcgcaacaagatccttagtggcgataccgcatgtcagggagagttgtcccacccctgtagtacgacccacctgcatctaagaagcgaacagccacctgcgtccctcggattctag

SEQ ID NO: 27526 - DNA, 447 bp, Artificial Sequence
  Description of Artificial Sequence: Synthetic coding sequence
atgaaatggttccatgagaatttgtctccaggtaagccaatctctgactctcccctgggattggtgcccgtcgagaaaaaagcagtcggagccgttatgagaaaaaggaagcacatggatgaaccttcctcgcctagtcggcccggcctggaccgtgcgaagatcggtacatcctctcagggcccctccaaaaagaagcccccagtagagactcgccgcaaccgggaaaggaagacgcagcaaggacttcaggaaaccctggcctcagacatcactgacgtgcagaagcaagactcagaatggggtcattccctaccgggtagaattgtgccaccccttcagcacaattcccccccccccaaggagcgggcagctaccggcttctttgggttccttagttctctcttcccttttagatacttcttcagaaaaagcagtcatagttag

SEQ ID NO: 27527 - DNA, 348 bp, Artificial Sequence
  Description of Artificial Sequence: Synthetic coding sequence
atggggacgggcctcagatcccagagtctgcgggaaccacggccctcctatgggaaactgcaggaaccttgggggaggccccaggaggggcagctgagaagggccttaagcctaagacaggggcaagagaaatcccgatctcagggactcgagagggggaccgagggcccagacgcgactgcccaggagagagtcccaggaagtctcggtgataccgagcaacttatacaggcccagcgcaggggtagccgctggtggctaaggcgctaccagcaggtccggcgcagatgggagtccttcgtggccatttttcccagcgtgacgctgtcacagccggcaagcccttag

SEQ ID NO: 27528 - DNA, 510 bp, Artificial Sequence
  Description of Artificial Sequence: Synthetic coding sequence
atggagaccggcccttccgaggagccaagcggtcgtaaggaatcacaggagatgtgcccaccaggacttctggtcttcgccggctcttccgagcaggatgccaacttggccaagcaattttggatcagtgcctccatgtatccaccttctgaatctcagttggtgctgcggcgagatagtagccaacggctacccgtggcaaggcctaggagaagtaggggaagcgagaattcacactcctcccagagtttccatctggcgtccaacaaaaatagggatattttcgctgaggccctgaagatccaggagtccgaggagaaggtcaagtacttacagaaggccaagacccgggaggaaatcttacagcttttgaggaagcaaagggaagagcgcattagtaaagagctgatctctctgccctataaacctaaggctaaagagcacaaagccaagaaggtagtgtccgaatcagacaaggaagatcaagaggaggttaagacactggactag

SEQ ID NO: 27529 - DNA, 537 bp, Artificial Sequence
  Description of Artificial Sequence: Synthetic coding sequence
atggagactgggccgagtgaggaaccaagtggacggaaggaaagccaggaaatgtgtccccccggcctgctggttttcgctgggagcagcgagcaggatgccaacttagccaagcagttttggatatccgcttccatgtacccaccgtcagagagccagctagtgctgaggagggattcctcacagcgcttgcccgtagctcggcctcggcggagtcggggctctgagaattctcacagctcccaaagctttcatctcgcatctaataaaaatcgagatattttcgctgaggcattaaagatccaggagagtgaagaaaaggtcaagtatctgcagaagacccgaagccactccgtaactcagaacgaggtgcagtggcacgatcatggaagcctgcagccccagctgtctcgaattcaagctaagactcgcgaagaaatcctgcagctgttaaggaaacagcgggaagaaaggatctctaaggaattgatctctcttccatacaagccaaaggcaaaggagcacaaagccaagtag

SEQ ID NO: 27530 - DNA, 1440 bp, Artificial Sequence
  Description of Artificial Sequence: Synthetic coding sequence
atgttgattagtgcagccagcatggcccccgaagtttgcggaccctctctgcaaggaacccctggacctccaccgcctttgctcccgaaaccagggaaagacaacctgcgactgcagaagctgctgcggaaggcagcacgaaagaagatgatgggtggcactcacttggctcccccaagagcctttaggacatcgctgagccccgtatctgaggctagtcatgaccaggaggtgacggccccacacgctgcagagggccctcaccctgcagaagctcctagattaccagaagctcctcggcctgcggaagcacctcgtatggtggccgctcttccccgcagccctcacacccctatcattcaccatgtagcatctccccttcagaaatccaccttctccattggtctgactcagagaaggattctcgctgcccagtttagggccatgggcccccaggtggtggcctctgcccctgagcccactaggcctccatctggatttgttcccgtatccggcggcggaggaacccatgtaactcaggtgcacattcaattggctccctctccccacaacgggacgccagagcccccccgaacggcaccagaagtgggtagcaatagtcaggatggcgacgccaccccctcgccccctcgcgctcaacccctcgtgcctgtcgctcacattcggccattgccaaccacggttcaggctgcatccccgcttcccgaggagccaccagtacctagaccaccaccgggattccaagcctctgtccctcgcgaggcatctgcaagggtagtcgtgcccatcgctcccacctgtcgatcactggagtctagccctcatagtctagttcctatgggcccggggcgtgagcatctagaggaaccacctatggccggccccgccgcagaggctgagagagtgtcgagtcctgcttgggcctcctctcctactccaccctcagggccccacccttgccccgtgcccaaagtggctccaaaacctaggcttagtggatggacttggctgaaaaagcaactgctggaagaggctcctgagcctccatgtcccgagccacgccaaagcctcgagcccgaggttccaacgccaacagagcaagaagtgcctgcacccacagaacaggaggtgcctgccctgacagcacctcgcgcacctgcttccaggacgtcaagaatgtgggacgcggttctgtaccgcatgtcagtggctgaggcccaaggacggctcgctgggcctagcggaggggagcatacccctgcgtctttaaccaggctccctttcctgtacaggccgaggttcaacgctcggaagcttcaggaagcaactcgacccccgcctaccgtaaggtcaatcctcgagctaagccctcaaccaaagaacttcaatagaactgcgacaggctggcgccttcagtag

SEQ ID NO: 27531 - DNA, 582 bp, Artificial Sequence
  Description of Artificial Sequence: Synthetic coding sequence
atgcccaaagggcgccggggttcccactcccctacaatgagccagcgaagtgctccgccactttactttccctctttgtacgaccgtggcatttccagctcgcccctgtctgattttaatatttggaagaagctgttcgtgcccctgaaggccggaggagcccctgtcgggggggcggctggcgcaaggagcctgtcccaggcactgccagccccagcacctccgccccccccacctccaggccttggacctagctcggagcgcccctggccttccccctggccaagcggactggcaagcatcccctacgaacccttgagattcttttacagccctccgccaggtccggaggtggtagcgagccccctggtcccatgcccatcaacaccgaggctggcttcagcttcacacccagaagagctatgtgaactggagatcaggattaaggaactcgaactgttgaccataacgggtgacggattcgacagtcagtcttacacctttttgaaagcgttaaaagacgaaaagctgcaggggttaaagaccaaacagcccgggaaaaaatcagccagtctgagttag

SEQ ID NO: 27532 - DNA, 555 bp, Artificial Sequence
  Description of Artificial Sequence: Synthetic coding sequence
atgcccaagggacggcgtggcagccactcacccaccatgtcccagaggtccgccccacccttatatttcccttcgttgtacgacagaggcataagtagcagtccactgagtgacttcaatatatggaaaaagctttttgtgccacttaaagctggcggcgctcccgtgggcggagccgccggagcccggtccctcagccaggctctgcctgctcccgccccacctcctcctcctcctcccggactgggtccttccagcgaaaggccgtggccatctccctggccatcggggctagcaagcattccgtacgagcctctaaggtttttctactccccccctcctgggccggaggtggtggcgagtcctctggtgccctgtcccagtactccgcgtttggcttcagctagtcaccccgaggagctgtgtgagctggagatacgaatcaaagaactcgagctgttaacaatcaccggcgatggctttgactcccagtcctttctggggctgtggaccacctgtgcggacgccggtcggatcccccagccaacctcctag

SEQ ID NO: 27533 - DNA, 375 bp, Artificial Sequence
  Description of Artificial Sequence: Synthetic coding sequence
atggagtcatgctctgttgcacaagcaggagttctgaccagcccgtttatgtggcgctggaccggtatggcaggggccttgtctgccctggacaacactattgaggacgacgccgacgatcaacttccgtgcggcgagggtaggccgggatgggtgcggggggagctcttaggaagccaaggcgtgtgcaaagatagcaaggatctctttgtaccaacctccagttccctctatggttgcttctgtgtcgggctggtttccggaatggccatatctgtcctcctgctcgcctccgattttcgcaaactggactttagtcgccccgagccatgcttcgaaaaagaggcctctttgtggtttgtggcgcaacattag

SEQ ID NO: 27534 - DNA, 375 bp, Artificial Sequence
  Description of Artificial Sequence: Synthetic coding sequence
atggaatcttgctcagttgcccaggctggagtgctgacgagcccctttatgtggagatggacaggtatggccggggcactgagtgcacttgacaacacaatcgaagacgacgccgacgaccagctgccatgtggagaagggcgcccgggctgggtgcgaggcgaactcctcggtagccagggtgtgtgtaaggactctaaggacctgtttgtgcccacctcctcaagtctgtatggatgcttttgtgtgggattggtgtctggcatggccattagcgttcttctcctggcgtccgattttcggaagttagatttttctcgtcctgaaccatgctttgagaaagaggctagcctatggtttgttgcgcaacattag

SEQ ID NO: 27535 - DNA, 375 bp, Artificial Sequence
  Description of Artificial Sequence: Synthetic coding sequence
atggagtcctgcagcgtggcacaagccggagtcctcacttcgccttttatgtggagatggacgggcatggcgggagcactgagcgccctcgataacacaatcgaagacgacgccgacgaccagctgccctgcggggaggggcgccctgggtgggtgaggggtgaactgcttggatctcagggagtgtgtaaggacagtaaggatctgttcgttccaacttcaagtagcctttacggatgtttttgcgtggggctggtttctggcatggcgatttccgtcctgctcctggcgtcagatttccgcaaacttgacttctctcgtcccgagccctgttttgagaaggaggccagcctgtggtttgttgctcagcactag

SEQ ID NO: 27536 - DNA, 465 bp, Artificial Sequence
  Description of Artificial Sequence: Synthetic coding sequence
atgcaccctgaacctctgctcaactccacgcagtcagcaccacatcacttcccggattcgttccaggctacacccttttgtttcaatcagtcacttatccccgggtcccccagtaattctagtattctctcaggttcgttagactattcttactcgcccgtccaactgccgtcttacgcccctgaaaactacaattcacctgccagtttggacaccagaacatgtggttacccaccggaggaccactcctatcagcacctgtctagccatgcccagtattcatgcttcagctctgcgaccacgagcatctgttattgtgctagctgtgaggccgaagatctggacgctctgcaggcggccgaatacttctatccatcgacagattgtgttgatttcgcgccctctgccgcagctactagtgatttttataaacgcgaaactaactgcgatatttgctactcctag

SEQ ID NO: 27537 - DNA, 465 bp, Artificial Sequence
  Description of Artificial Sequence: Synthetic coding sequence
atgcatccagagcctttgctcaacagcacgcaaagtgctcctcatcactttcccgattcatttcaggcaacacccttctgtttcaaccagtcacttattcccggatcgcctagtaacagtagtattctgtcaggctctttagattactcctatagccccgtgcagctcccctcatatgctcctgagaactacaacagtcccgcctcactggatacgcgaacctgcggttatccaccagaggaccactcttatcagcatctaagttcacacgcacagtattcttgtttttccagcgccacaacatcaatctgctattgtgcctcttgtgaggccgaggacctggatgctttacaggcagcagagtacttctatcccagcacagactgtgtcgactttgccccaagcgccgctgcaacttcagacttttataaacgcgagaccaattgtgacatctgctattcatag

SEQ ID NO: 27538 - DNA, 324 bp, Artificial Sequence
  Description of Artificial Sequence: Synthetic coding sequence
atgcacccagagcccctgttaaactctacccagagtgcacctcatcattttcctgactctttccaggcgacaccgttctgttttaaccaatctttgatacctggaagcccctctaacagctccatcctaagcgggtccctggactatagttattcaccagtgcaacttccatcatatgccccagagaactataattctcctgcctccctagatactagaacgtgtggatacccgcctgaagaccatagctatcaacaccttagcagccatgcgcagtatagctgcttcagctcagccacgacttccatttgttactgcgcgtag

SEQ ID NO: 27539 - DNA, 1308 bp, Artificial Sequence
  Description of Artificial Sequence: Synthetic coding sequence
atgggaaacaagcagccccaaaaggtgactgtacccactggcactgcgctgcagggcgtcgtcctcattgtctctaccctgcaccagcccggcggctggatttgtggtaaagatccctgctgttctcttcgaccgctttccaattcagtgcagaatgctctcgcctgcaagtcaaagcaagattaccaggctgggatcctgtttaaaacaagagccttcatcagccgagactgtggatcagacgcagccgaagattcagccagcaagggcgaaacctataccttaacattagagcataagggagctggggagggggacttgcgcccacgaggccagcccgggtggtgtaggctgggggaccccagacgagatagtgcgcgccccgtggccgctatagagggcccatgcccaggcgctgcccgtgcttctagagtgttgagagggcggggcttttctagaaaccctcgaggtcgaggactgcctagcggggcaggatggcggggcgctggcggggcaggcgagggcgcagtcaccttccctgagagacggggcgacgtgcggcgtaagggagctggacgtgctcgctttaagtggcactcgttatcatctgaattgagggccgtttgggcagccgccggctacatttcccgcgaaccaggccggcggggcgcagatggagacagttccggcggggaacggctgggggctaggagaaacagtgctcccagagccccttgccctccgacggggccccccgcccgccctccatctcgaggcgctcctgcgcgcgccagggaggggcgccggcatccagccgccgatctggacccaccgccgggtgaacctcccgccgccgccagcaggggagctccagcacagcgccccccatcagaaagccctggagccccccctccaggccctgccgatgccgggggcgctatggcggctaagcccggcgaactgatgggaatatgttcttcatatcaggccgttatgccccatttcgtttgtctcgctgatgaattccctcaaccagtgcggcccgcaaagctgcccaaagggaggggaagactgcgaagaccccggcaaagcaggtttaaaacccaaccggtgacctttgacgaaatccaggaggtggaggaggaaggggtatctccaatggaagaggagaaagctaagaagtccttcctacagagtttggagtgtctgcgccgatcaacccaaagcttaagcctgcagagggagcagttaagtagctgtaagcttcgtaattcattagattcctctgactcagattcagctttatag

SEQ ID NO: 27540 - DNA, 1254 bp, Artificial Sequence
  Description of Artificial Sequence: Synthetic coding sequence
atggccttcgctgtcatcagagctcagtctagggtaggatccagaggcctctacaaacctcgcgcatggccgcctcgcggtcgcaggcgacagcaaaggaggcgggctccccgaagcgccgcagagcagcgcccgcccagcccagtcccccctgacgggagtgctcggcctcccgctttaccgaggagcgcaggtcccggaccaagaggaccaccaccgccccggtctagatttgggtcccctgctcgccgggccccagggtgttgtttacctggcgggcccggcgctgccgcagctctaggagaacccaggcggcctgccgctcggccacggcgccgccgccgtcggcacggccggcaggcacgtagagcggacggccatcttctacagctgcctgggggcgacgctgctctgagggttcccggacgaagggtcccggccgcgagagcagcacgacaagcggcacagggaccaggccccgcggcagccgcagcgcctgtgtcacttcaggatgcagcaggcgacctaaggagagacccaggagggggtggagggggcggtgtgcctcacggtggcggcgaggggcaggaggttgtgccagctgaaccgggcgtgcccgccccccagcatgcggagcccgtagccgctgcaggggctgcccaacagctccagactgaggagcagcccggactccagcggttgcggctggggcctgtccggggtgccgcaagggggggcgatgccagggtccgcggcccccgcggagacaggcgagtaaaccccgaatccgctagagccctgctgcctggtgatccgcagggccctggcacggcagcacccagagctctcggcctgccgcctcggtgtgagccggtgggcgctccactggcagccttagccctggctagggaaagaagggagcggggcaggtttccgaggccatgcaagtgcttgtttttcaactccagtcagtgcgagttgtgttgtgagtgtgtgcggggcggcgcccctgcgctgagcagacgcagggtggccaccccttgtccctgtcctatggtgtgcaactcagactttgcccatcggtcgaccgttcccccctccgcccaccctttcaccctcacccccacactttccttgaacacatttatcattgtgagaaggggacggtgggactttgggcggtcggctgcagccactgcgagcgggggcctgatctttatcttcgccctgcgctggctgaaggcctttatatag

SEQ ID NO: 27541 - DNA, 822 bp, Artificial Sequence
  Description of Artificial Sequence: Synthetic coding sequence
atgctggggcagctgcttcctcacaccgctagagggcttggcgctgctgagatgcctggccagggcccaggttccgactggactgaaagaagctctagcgctgaaccgccagccgtggccggtactgaaggcggtggggggggtagcgccggatacagttgctaccagaacagcaaaggcagcgatcggatcaaggacggctacaaagttaatagtcacattgccaaactgcaggaattatggaaaacaccccagaaccagacgatacatctgagcaaatcgatgatggaagcttcatttttcaaacaccccgatctcaccaccggccagaaacgatacttgtgctcaatagcaaaaatatacaacgctaattatctgaaaatgcttatgaaacggcaatacatgcacgttttgcagcatagttcccagaagcctggggtgctcacccatcataggtcccggctgtcctcccggtacagtcagaagcagcactacccctgtacaacgtggagacaccaacttgagcgagaagattctgggtcttccgacattgcagcagcatctgcccctgaaatgttgatccagcactctctttggcggcctgtcaggaacaaagagggcataaagacaggttatgcctccaagaccagatgcaaatcgctgaagatctttagaaggcctaggaaactgttcatgcagaccgtaagctccgacgacagtgaatcccacatgtccgaggagaaaaaggaggaggacttgctcaacaacttcatgcaaagcatgtccattgaggaacagggagagcaccttatgctgacctag

SEQ ID NO: 27542 - DNA, 1812 bp, Artificial Sequence
  Description of Artificial Sequence: Synthetic coding sequence
atggctgcaagctgcccactgcctgtcacacctgatctccctactctccgtgcaaaactccaaggtctactgcaatttctgcgggatgctctgagcatttccaatgctcacacagtcgatttctacactgaatcagtgtgggaggaactcgttgacctgccacccgaaacggtcttggccgcacttcgcaaatccgcctccgagacagaagccctgccatctgagactagacccctggttgaagctgaatgggaagccggaatgacagactttccaaaaattttctgcgagacatcccagaagttagtatccgttgaggccttcgctctggctgctaaatattactcagtccagaatctcggaatctgcacaccatttgaacagctgctcgttgctttacgagggaaccagaatcagcggattggagagaaccaaaaggccgtcgaatttatgaacatgaaaaagtcacatgaggtgcaggctatgtctgaactgatttctagcatagctgactattacggaatcaaacaagtaatcgatctggggtcagggaaaggttatcttagctccttcttaagtcttaagtacggcctgaaggtctacggaatcgactcaagcaacacgaatacccatggcgccgaggaaagaaatagaaagctcaagaagcactggaaactgtgtcatgcccagtcaagattggacgtcaacggtttagccttaaaaatggcgaaagagcgaaaggtgcagaacaaggtcaagaataaggccgatacagaagaggtttttaacaattcacctaccaaccaggagaaaatgccaacatcagccattctgcccgattttagcggaagcgtaatttctaacatcagaaatcagatggagacactacacagccagcctcaccaagaagagaacctatgcttcgaaaactctttcagcttgattaatctgttgccgattaatgccgtggaacctacttcttcccaacagatccctaatcgcgaaacctctgaagcaaacaaagagcgacggaaaatgacctctaagtcaagtgaaagtaatatatactctcctctgacatcttttatcactgccgactccgagctccatgacatcatcaaggatctggaggattgtctgatggtaggattacatacatgcggagacttggcgcctaatacattacgtattttcacctcgaactcggagattaaaggcgtatgctccgtgggctgctgctaccatttgctgagcgaagaatttgagaaccagcataaggagagaacacaggaaaagtgggggttccctatgtgtcattacctcaaagaagaaagatggtgttgcgggcggaatgccaggatgtctgcgtgcttggcgctggagcgtgtagccgccggacagggactgccgacagaatcactgttctatagagcggtactgcaggacataattaaggactgctatggcattacgaagtgcgatcggcacgtcggaaaaatttattcaaagtgctcctcttttctagattatgtgaggcgatcactaaaaaagctcggcctggatgaatccaagctccctgagaagattatcatgaattattacgagaaatataagccacgaatgaacgaactggaagcttttaacatgcttaaggtcgtgttggccccatgtattgagaccttgattctgttggaccgcttgtgctacttgaaggaacaggaagatattgcatggtcagctctggtcaaattgttcgacccagttaagagcccaagatgttacgcagtgatcgcactgaagaagcagcaatag

SEQ ID NO: 27543 - DNA, 828 bp, Artificial Sequence
  Description of Artificial Sequence: Synthetic coding sequence
atggccttctgtgccctcacgattgttgccctgtacatactttccctgaaggatcaagataggcgggtccccaatctccccccttctaatatcaccagttctcaagaacccgccctgctgcccacggccagcagttccgcaccaaacacatccctggtcaccacaccagcaagcctacaggtgccagaaattactttctgcgagatcctgccatgccaggaaacctactgttgtccaataagggggatgaaggaagtgtcctcctctcccgtgcagcgccagagcgaagagaaggagttccaccaaaggaggtggtctgaagataagagtaagagtgtccttgcaaggaacgcactgtccggccctgattgggagtctgactggattgacaccaccatctcaagcatacagatcatggagatccagcagatcattgatcatcagtactgcattcagagcctacagtgcggatctggaaactataactataacatccctgtcaacaagcataccccaacaaacgtaaaattctccctggagataaacactacagaacccctgattgttttccaatgtaaattcaccctgggtaatatttgtttccactcaaagaggggaactaaaggcctggagagtcatagagaaatctctcaagaaatgactcagggctaccagcacatttggtcacttccagttgccccattttccgacagtatgtttcatttcagggtcgcagcccccgacttagcagactgttccacagatccatacttcgccggcatctttttcactgactactttttctatttttatcggaggtgcgcctag

SEQ ID NO: 27544 - DNA, 978 bp, Artificial Sequence
  Description of Artificial Sequence: Synthetic coding sequence
atgaagagactggggagcgtccaacggaagatgccttgcgtgttcgtgaccgaggtgaaggaggagccctcaagcaagcgcgagcatcagccctttaaagtgcttgcgacagagaccgtttctcacaaagccctggacgcagacatctactctgcaattcctacagagaaagttgacggtacatgttgttacgtcacaacatacaaggatcagccctacctatgggcacgattagatagaaaaccaaataaacaggccgaaaagagattcaagaatttcctgcactcaaaagagaatccgaaagaattcttttggaatgtggaggaagattttaagcctgctcctgagtgctggatccctgcgaaggaaacagaacagatcaatggtaaccccgtcccagacgaaaatggacatattccggggtgggtgccagtagaaaagaataataaacagtactgttggcattctagtgttgtgaattacgagtttgagattgctcttgtacttaagcatcaccctgacgattcgggcctgcttgagatctctgccgttccactgtccgacctgctggaacagactctagaactaatcggcacgaatatcaacggcaacccttatggtctggggagtaaaaaacaccctctgcatctgctgataccacacggtgcctttcagatccgcaacctgccgagtctaaaacacaatgatctggtctcctggtttgaggattgcaaagagggcaagatagaggggatagtttggcattgttccgatggatgtctgattaaagtgcacaggcaccacctgggcttatgctggccaatacccgatacgtacatgaatagcagacccgtcatcatcaatatgaatctaaataaatgcgattcagcattcgatattaaatgcctgttcaatcattttcttaagatcgacaatcagaaattcgtgcgcttgaaggacatcatctttgacgtgtag

SEQ ID NO: 27545 - DNA, 1359 bp, Artificial Sequence
  Description of Artificial Sequence: Synthetic coding sequence
atgctggcctgtctgcaaaggacccaaaacgcccccggacagcatctcgcctgtcccagcaagtccctggagctgcggaagtgcgaagccgtagcctcggccatgcacagctcgcgctaccccagccccgcagaactggacgcatacgcagagaaagtggctaacagtcccctgtctatcaaaattttccccaccaatatacgggtccctcaacacaagcacttgtctaggacagtgaatggatacgacacatccggccagagatacagtccataccctcaacacacggctggatatcaaggcctgttagcaatcgtgaaggctgcagtgtcgtcttcatccaccgcggcacccgccggacctgcaaaatcggtgctgaagtctgcagaggggaagcgcaccaaactgtcgcccgcggcagttcaggtgggaatcgctccctaccccgtaccgagcactctggggcccctggcctatcctaaaccccctgaggcccccgcaccccctcctggactgcctgccgcggcaaccgcggctagcgtgattccccttcccgggagaggcctgccactcccaccatcgaatctcccaagtatccattctctgttgtatcaactgaatcagcaatgtcaggctcctggtgctgctcctcccgcttgccagggaatggcgattcctcatcctagccccgccaagcacggacccgtgccttccttcccaagtatggcctacagcgccgccgccgggctacccgattgtcgaaaaggtaccgagttagggcagggcgcaacacaggccctgacactggccggcgctgccaaaccagcaggctatgcagattccggactcgattatctgctttggccccagaaaccaccaccaccgcccccacagccgttgcgggcctacagtggcagtaccgtggcctccaagagtcccgaggcctgcggtggtcgcgcttatgaacgagcctcagggagccctcttaattgcggagttggactgccaacatcattcacggtcggtcagtacttcgccgctccatggaactcagttctggttacaccaacgagtgattgctacaaccctgcagcagcagtggtggtgaccgagctcgggccaggggcagccagagagctggctggaccacctgcagacgcacttagcgggttaccttccaagtccgtgtgcaatacctcagtgctttctagttctcttcagtcattagaatacctgataaacgacattcggcccccatgtatcaaagagcagatgttgggcaagggatacgagactgttgctgtcccgcgcctgctggatcaccagcacgcccacatccgactaccggtttacagatag

SEQ ID NO: 27546 - DNA, 1359 bp, Artificial Sequence
  Description of Artificial Sequence: Synthetic coding sequence
atgctcgcttgcttacaacgaacccagaacgcacccggccaacatctggcctgtcctagcaaatcacttgaactgcggaagtgcgaggcagtcgcctcagccatgcactcctcccgttaccccagccctgcagagttggatgcttatgcagagaaagtggctaatagcccgctttccatcaagatcttccccactaacatccgtgtccctcaacacaagcatctctcaagaacagtgaatggctacgacaccagcggtcagaggtatagcccctacccccagcacaccgcaggctatcagggactgctcgctatagtgaaagcagccgtttcctcgtcaagcacagctgcgccagctgggcctgctaaaagcgtgctgaaatcagctgaaggcaaaagaacaaaactctctcctgccgctgttcaagtgggaatcgccccctacccagttccgtccaccctgggaccactcgcctaccctaaacctcccgaggctcccgccccacctcctggcctccccgcagctgccaccgcagcgtcagtcattccgcttcccggtcggggtctgcccctgccgccatcaaatctgccctcaatccacagtctgttataccaactaaaccaacagtgccaagcccctggcgccgccccacccgcttgccaaggaatggcgatcccgcatccttcccccgccaagcatgggccagtgcctagctttccgtccatggcctactctgctgcagcggggttacccgattgccgcaaggggaccgagctggggcagggtgctactcaagccctgactttagcgggcgctgccaagcctgctgggtatgccgattccggattagattatctcttgtggccgcagaagcctccaccaccccctccacagcctcttagagcctactccggtagtactgtcgccagtaaatctcccgaggcctgcggcggccgggcctatgagcgagcaagcgggtccccattgaattgcggggtgggacttcctaccagttttactgtcggacagtacttcgccgccccttggaactctgtgctggtgacccccacgagtgactgttacaatccagcggcagccgtggtggtcacagaacttggacccggagcggctcgagagcttgcaggccccccagccgatgcactgagtggactgccttccaaatccgtctgtaacacaagcgtgctctccagttctcttcagtccctggagtaccttataaatgatataaggcctccctgtatcaaagaacagatgctgggtaagggatacgagaccgtcgccgtgccaagacttcttgaccaccaacacgctcatattcggctccctgtgtataggtag

SEQ ID NO: 27547 - DNA, 5244 bp, Artificial Sequence
  Description of Artificial Sequence: Synthetic coding sequence
atgaactggaacgagaagcctaaatcagccaccttacccccattatatcccaagagccagccaccctttcttcaccagagcctcattaaccagatcacgacgacaagccagtctagcttctcataccctggctctaatcaggaggcgtgcatgtatcccggaaactctaatcctatctcccagcctctgctcaatatccagaattacccccaacagatctctgtttcggacatgcacaatggcaccgttgtcgcttctcatacatcagtggaacgcatcacctacgctaatgtgaacggaccgaagcaactgacacataacctgcagatgtctagtggcgtgacccagaacgtctggctgaacagccctatgaggaatcccgttcattctcatatcggggccacggtctcccaccagaccgactttggcgcgaacgtgccgaacatgcccgccctgcagtctcagctgatcacctccgatacttactccatgcagatgcaaatgattcccagtaacagtacaaggttgccggttgcctaccaaggaaatcagggcctgaatcagagcttttcagagcagcaggtagattggacccaacagtgcattagtaaaggcctcacataccctgattatcgacccccacccaaactgtaccggtattcaccacaatcatttttgccggattcaacaatccagaagcaaaacttcatcccccataccagcctgcaggtcaagaactcacagttgcttaactctgtattgacccttccatcaaggcagacctcagctgtaccctcacagcaatacgctacccagaccgacaagaggccccctccccctccctataattgtcggtacgggagtcagcccctccagagtacacagcatatcaccaagcatctctccatggaggtcccccaaagccgcgaaatgctgtcaagcgaaattaggacaagttttcagcagcaatggcagaaccctaacgagaacgtcagtaccatcggcaatttcaccaacctgaaggtgaacactaattctaaacaaccattcaactcacccattaggtcaagcgttgacggagtgcaaaccctggcccaaaccaacgaggagaagattatggatagctgcaacccgacatcaaaccaggtgttggacacgagtgtcgctaaggaaaagctggttagagacatcaaaacgctcgtggagattaagcagaagttttcagagctggcacgtaagatcaagatcaacaaggatctgctgatggctgctgggtgcatcaagatgacaaacaccagctatagcgagcccgcgcagaattccaagttgtccctgaaacagacagcaaaaattcagtcaggaccacagatcactccagtgatgcccgaaaatgcggagagacagactccaacggtagtggagtcagccgaaactaacaagacacagtgcatgcttaattcagacatacaagaggtgaactgcaggcgtttcaaccaggtggacagcgtcctgccgaatcccgtatattccgagaagcgtcctatgcctgattctagtcacgacgtgaaagtgctcacctccaaaacatctgctgtagagatgacccaggccgtcctgaacacccagctttcatctgagaacgtcactaaggtggaacagaactccccggccgtgtgtgaaactatatccgtgccaaagtccatgtcaaccgaggaatacaagagtaaaatccaaaacgagaacatgctgcttctggcactgttgtcacaggcgcgcaagacacagaaaacagtgctgaaagacgctaaccagacaattcaagattcaaagccagatagctgtgaaatgaacccgaacacccagatgacagggaatcagctgaacctcaagaacatggagaccccttccactagtaatgtgtccggacgcgttctggataattctttctgcagtggacaggaatctagcacaaaagggatgcccgcaaagtcagacagctcgtgtagtatggaggtcctggccacatgcctttctctgtggaaaaaacagccctccgataccgccaaggagaaagagtgcgataagttgcggacgaatacaactgccgtgggtatcagcaaaccagccaacattcacgtcaaaagtccatgctccgtcgtaggcaattcaaatagccagaataagatctctaatcccagccagcagaccgcgctgagcatggtgatgcacaattacgaaagtagtggtatcaacatcaccaaaggaactgaactgcagattgccgtggtctctcccttggtattgtctgaagtaaaaaccctgagcgtgaagggcattacacctgcagtcctgccagaaaccgtgtacccggttattaaggaaggctccgtttgcagcctgcagaatcagctggctgagaatgctaaggccacggcagccctgaaggtcgacgttagcggcccggtagccagcaccgcgacaagtaccaaaatcttccctctgacccaaaaggaaaaacagaatgaatcaactaacgggaattctgaagtcacccccaatgtgaaccagggaaaacacaataaactcgaaagcgcaattcattcacctatgaacgaccagcagatctcgcaggagtcccggaactccactgttgttagtagtgatacactacagatcgacaacatttgtagcctggtcgagggagacacaagttataactcccagatcgctaagatttttagcagcctgccattaaaaatggtggagccacaaaagccatctctgcctaaccagcagggcatcggatcgcgcgagccagagaagcagttagacaacacaacagaaaataaagactttggcttccagaaggacaaaccagtgcaatgtactgacgtctcacacaagatctgtgaccagtcaaagtcggagcctccactcgagtcctccttcaacaatctcgaaactaaccgcgtcatcctcgagaagagcagtctggagcacgccactgagaagtccaccgccaacgacacatgctcctcagctgcgattcaggaggatatttacccccaggagatcgatgccagctcaaattacaccccacaagaccccgcgagaaatgaaattcacagtgataaggcaccagtgttgtatcttcatgatcagctctctgagctcctgaaggagtttccgtacggcatcgaggcagtcaacacccgggagggatccgttggacagcaaaccacttaccagaccagcgaggaccaaactgcggataagacgagcagtgacagtaaggaccctgcagatcagatccagataactattctgtcaagcgaacagatgaaggagattttcccagaacaggacgatcagccgtatgtggtggataagttagcagagccccagaaagaagagcctatcactgaggtggtctcccagtgtgacttgcaagctccagccgccggccagagccgcgactcggtaattctggactccgaaaaggatgacatccactgttgtgccctggggtggctttccatggtgtatgaaggggtacctcaatgccagtgcaactccatcaaaaacagctcgtccgaagaggagaagcaaaaggaacagtgtagccctctggatactaacagctgcaagcagggcgagagaacaagtgatcgcgatgtcactgtcgtacaatttaagtcattagtcaacaatcccaaaacaccaccagatggtaaatctcattttcctgagctgcaggacgactcaagaaaggacacaccaaaaaccaagcacaagtctctgcctcgcaccgaacaggaattggtcgccggtcaattttccagcaagtgcgataaacttaacccactgcagaatcacaaacgtaagaaactacgcttccatgaggtaactttccactcatccaataagatgaccgcctcttatgaacaggcctctcaagagaccagacagaagaagcatgtaacgcagaacagccgcccactgaaaactaaaaccgccttcttgcctaacaaagatgtgtacaaaaaacactccagcctcggacagagtctatcaccagagaaaattaaactaaagcttaagtcggtatccttcaaacaaaaacggaagctggatcagggaaatgtcctggacatggaggtaaaaaagaaaaaacacgacaagcaagagcagaaaggctccgtgggcgctacgtttaaattgggggactctctgtccaaccctaatgagagagcgatcgtcaaagagaagatggtatccaacactaagagcgtcgatactaaggccagttcctccaaattcagccgtatacttaccccaaaggagtacctccagagacagaaacataaagaagctcttagcaacaaggcttctaaaaagatttgcgtcaagaatgtgccttgcgatagcgagcacatgaggccaagtaagctagccgttcaggtggagtcttgtgggaaatcgaacgaaaaacatagttccggcgtccagacaagcaaggagagcttgaatgggctgacaagccacggaaaaaacttgaaaattcatcattctcaagagtctaagacgtataacattctgcgcaacgtcaaggaaaaggtcggtggtaaacagcccgataagatctggatcgacaagacgaaactggataaactgacaaacatatccaatgaggcccagttctcacaaatgcccccccaggtaaaagaccagaaaaagctttacttgaatcgcgtcgggtttaaatgtacagagcgagagtccatttccctcacaaaattggagtccagtcccagaaaactgcacaaagataagaggcaagaaaataaacacaaaaccttcctgcccgtgaagggaaatacggaaaaaagcaatatgctcgagttcaagctctgccctgacattctgcttaaaaacaccaacagcgtcgaagaacgaaaggatgtaaagccccaccccagaaaggagcaggcccctctgcaggtctctggcattaagtcaacgaaggaggattggttgaaatttgttgcaactaaaaaaaggacacaaaaggactctcaagaaagggacaatgttaatagccgtcttagtaagaggtccttcagcgccgatggctttgaaatgctgcagaaccctgtgaaagacagtaaggagatgtttcagacatataagcaaatgtatctcgagaagcggtctaggtcacttggatctagcccagtaaagtag

SEQ ID NO: 27548 - DNA, 2028 bp, Artificial Sequence
  Description of Artificial Sequence: Synthetic coding sequence
atgaattggaacgaaaagcctaagagcgctacattacctcccctttatccgaaatcgcaacctccctttctccaccaaagcctgattaaccagattaccaccacaagccaaagtagcttctcctaccccggctctaaccaggaggcttgtatgtacccaggcaatagcaacccaatctctcagcccctgctgaatattcagaactacccacagcagatctccgtctctgatatgcataacgggaccgtggttgcttctcatacaagcgtagagcgtataacctacgccaatgttaacggtcccaaacagctgacccataaccttcagatgtcttctggcgtaacccagaatgtgtggttgaacagcccgatgaggaatcctgtccacagtcacatcggtgcaactgtttcccaccagaccgatttcggagcgaacgtgcccaatatgcccgccctacagtctcagttgattaccagtgacacctattctatgcagatgcagatgattccttctaattctactcggctacccgttgcctaccaaggtaatcagggcctgaaccaatccttttccgaacagcaggtcgattggacgcagcagtgcatctctaagggcctcacttaccctgactacaggcccccgcccaagctgtatcgttactctccacagtctttcttacccgattcgaccatccagaagcagaactttatcccacacacgtccttgcaggtaaagaattcccaactgctcaactccgtgctcacgctgccctctcggcaaacatctgccgtaccgagccagcagtacgcgacccaaaccgacaagcgccccccccctcccccatacaactgcagatacggttcacaacccttacaatccactcagcacattacaaagcatcttagcatggaagtcccccagagcagagaaatgttgtcttccgagatacgaaccagttttcagcagcaatggcagaatccaaacgaaaacgtcagcacaataggaaattttaccaatctcaaagtcaataccaattcaaaacagccttttaactctcctatccgttcctctgtggacggcgtgcagaccctagcccagaccaatgaggaaaagataatggactcctgcaatccgacttccaaccaagttcttgacaccagcgtcgctaaggagaagctcgtaagagacatcaagaccctggttgaaattaaacagaaattttccgaactcgctcgtaagataaaaatcaacaaggatcttctcatggccgcaggctgcatcaagatgaccaatacgtcgtacagcgagccagctcagaattccaaattgtcgctgaagcagacagccaaaatccagagtgggccgcagattactcccgtgatgccggaaaatgctgagcggcagacacccaccgtagtggagtctgccgagaccaataaaacacagtgtatgttgaattcagatattcaggaggttaattgccggaggtttaaccaggttgatagtgtcttacctaaccctgtctattctgagaagaggccgatgccggacagtagccatgacgttaaagttctgacctccaaaacctcagctgtggaaatgacgcaggctgtgcttaacacacaattgtcctccgagaacgtgaccaaggtggagcagaactcccctgctgtctgtgaaactatttctgttcctaaatcaatgagcacggaggagtataagtccaaaattcagaacgaaaacatgctcctgctcgccctgctctcacaggcaaggaaaacccagaagaccgtgctcaaggatgctaaccagacgatccaggatagcaaacccgacagctgcgagatgaacccaaatacccagatgaccggcaaccagctgaacctgaagaacatggagactccttccacatccaacgttagcgggcgggttctggataactcgttctgcagcggtcaggaaagctccacaaaagggatgcccgctaaatcagacagcagctgctcaatggaggttctcgctacttag

SEQ ID NO: 27549 - DNA, 108 bp, Artificial Sequence
  Description of Artificial Sequence: Synthetic coding sequence
atgaactggaacgaaaaacctaagtccgccaccctgccccctctctaccccaaatcccaacccccctttcttcaccagtctctaatcaatcagatcactactacctag

SEQ ID NO: 27550 - DNA, 417 bp, Artificial Sequence
  Description of Artificial Sequence: Synthetic coding sequence
atggaaaggttcttgaactccaaagccaggaggctgggttcatgttcccacccagcgttctatctgctctgtgtacccgatgaagatacctcgtgttctaccatttatctaccactgaagcgccgggctgatccagatcagctcttctctgacctgcttggcggaacacagcggttatggagtaataggtttggaaatgaggagtcctttccaggcagggtacgggccctggtggataccttctgctggatcgccagagctccccctttgggtaatcctcttcggctggaagagagaattgcttggcggatccagcgccttaagagcggacagacagccctgatcgagaagaagaagcagaagattgaggaggatgtgaggcaccaatgtcaacagactacatgcgatcgctgctag

SEQ ID NO: 27551 - DNA, 417 bp, Artificial Sequence
  Description of Artificial Sequence: Synthetic coding sequence
atggagcgcttcctgaactcaaaagcccggcgcctcggaagctgttcacaccccgctttttacctgctgtgtgtgcctgatgaggacacgtcatgctcaactatataccttcccttgaaaagaagagccgacccggaccaactcttctctgatctccttgggggcactcagcggctctggagcaacagattcggaaatgaagaatctttccccggcagagtgagagcgctcgttgatacattttgttggatcgcacgcgctcctcccctgggtaatcccttacggctagaggaacggatcgcatggcgcatccagaggttgaagagcggtcagactgcactgattgagaagaaaaaacagaaaatagaggaagacgtaagacaccaatgccagcagacaacgtgtgacaggtgttag

SEQ ID NO: 27552 - DNA, 1659 bp, Artificial Sequence
  Description of Artificial Sequence: Synthetic coding sequence
atgaaaaaaaacagagaacgcttctgcaacagagagagggaattcgtctataagttcaaggtgggcagccagtgcctagagctgcgtgttcccctgaaattcccggtacaagagaatgcttcacatctgcacggtcgactcatgctgctacactctctgccttgtttcatcgagaaggacctcaaagaagcactcacccagttcatcgaagaggaaagcctgtctgattacgacagagatgcggaggcttctctagccgccgtcaagtccggtgaggtggatctgcaccaactagcgagtacttgggccaaggcatatgctgaaaccaccctggaacacgccaggcccgaggagccttcttgggacgaggactttgctgacgtgtaccacgacctgattcactccccagcttcggaaactctccttaatttggaacacaactattttgtctccatctctgaactgatcggggaaagagacgtcgaactaaaaaaactcagagaacgtcagggcatagagatggagaaagtcatgcaagagctcggcaaatcgctgaccgatcaggacgtgaactctctggctgcccagcacttcgagagtcaacaggaccttgaaaacaaatggagcaacgaactgaagcaatctactgccattcagaaacaggagtaccaggagtgggtaatcaagctgcatcaggaccttaagaaccctaataattcctccctgtcagaagagataaaggtgcagccttcgcagttccgggaatcagtggaggctattggacggatctacgaagaacagaggaagcttgaggagagctttaccatccacttgggggcacaattgaagaccatgcacaatctgcgactcctgcgcgcagatatgctggacttctgcaagcacaagagaaaccaccggtccggggtgaaattgcatcgcctccaaacagccctttccctgtattcaactagtctttgcggcttggtccttttggttgataacaggattaacagctattccgggatcaagcgggactttgccaccgtgtgtcaggagtgtacagattttcatttcccacggattgaagagcagttggaagtggtgcagcaggtggtactctatgctaggactcaacgcagaagcaagttgaaagaaagtttggatagcggaaatcagaatggtgggaacgatgataagactaagaacgctgagagaaattacctaaacgtcctccctggggagttttatataacaagacactccaatctttcagagatacacgtggccttccacctttgcgtggatgatcacgtgaagagcgggaacatcaccgcgcgcgatccagctatcatggggctcaggaatatcctgaaagtctgttgcacgcatgacatcaccaccataagtatccccctgctgctcgtgcacgacatgagtgaggagatgacgataccctggtgtctccggcgtgccgaacttgtgttcaaatgtgtaaaaggattcatgatggagatggccagttgggacggcggcatatctaggacagtgcagttccttgtcccgcagtcaatcagcgaggaaatgttctaccagttgtcaaatatgttgccccagatcttccgagtctcaagtacattaacactgaccagcaagcattag

SEQ ID NO: 27553 - DNA, 1659 bp, Artificial Sequence
  Description of Artificial Sequence: Synthetic coding sequence
atgaaaaagaatcgagaacgcttttgcaatcgagagagagaattcgtctacaaatttaaggtcggcagccagtgcctggaactgagagtgcccctcaaattcccggtgcaggagaacgcaagccacctacacggaagacttatgttgttacatagtcttccatgcttcattgagaaagatctgaaagaggcactgacgcagttcatagaggaagaaagcctgtctgattacgaccgcgatgctgaggcttctctcgccgcagtgaagagcggggaagttgaccttcaccagctcgcctctacatgggccaaggcctatgctgaaacgaccctcgagcacgcccggccggaagagccatcctgggatgaggattttgccgatgtctatcacgatcttattcatagcccagcctccgagacccttctgaacttggaacacaattattttgtgagcatttcagaactgatcggagagcgggatgtcgagttaaagaagttaagggagagacaaggtattgaaatggaaaaagtgatgcaggagctgggcaagtcattaaccgaccaagacgtgaactcactggcggctcagcatttcgaaagtcagcaggacctggagaataagtggtctaacgaactcaaacagtctaccgccattcaaaaacaggagtaccaggaatgggtcatcaaactgcaccaggacttgaaaaatccgaataatagttccttgagcgaagaaatcaaggtgcagccatcccagtttcgtgagagtgtggaggccatcggacgtatttacgaagagcaaaggaagctcgaggagagcttcaccatccacctgggtgcccagctgaaaacgatgcataatttgcggctgctccgggccgatatgttggacttctgcaaacataaacgaaatcatcggagcggagttaaactccacagactgcagaccgcactctctctgtattcgacttctttgtgcgggcttgtgcttctagttgataataggatcaacagctattcaggcattaagagagacttcgcgactgtgtgccaggagtgtacagatttccatttccctaggattgaggaacagttggaggtagtgcaacaagttgtgctgtacgcgcggacacagagaaggagtaaactaaaagagtccttggactccgggaatcaaaatgggggtaatgacgacaagactaagaatgctgaacgtaactaccttaatgtgttaccgggggaattttacatcactagacatagtaatttatccgaaatacacgtggcgttccatctgtgtgtagatgatcatgtaaagagcggtaacatcactgccagggacccagctattatgggtctgaggaatatccttaaagtatgctgcacgcatgatataacgacgatatccatcccgctcctgctggttcatgacatgagtgaagagatgaccattccctggtgtcttaggcgggcggaactcgtatttaagtgcgtcaaaggtttcatgatggaaatggcaagctgggatggcggaatctcccgaactgtccagttcctggtgcctcagtccatctcggaagaaatgttttatcaactcagtaacatgctaccacaaatctttagagtgagcagcaccctgacccttaccagtaagcattag

SEQ ID NO: 27554 - DNA, 1959 bp, Artificial Sequence
  Description of Artificial Sequence: Synthetic coding sequence
atgaattgggtcggcggtagtagatcacgagttctcatcaaacaggagcgccgcaaacagaaagagtattttgagaaacatcggctcaaaagtaagatgaagtccttgggggtcctgtccccagtgaaaaactcagcagtgtccctcgatatccttaatctgtatatggttaaccagatctcttgcaagaaaaaaataccagagacagtacgcaagcctacacacgtgaatatgaaccgtgatatcaagatgcctttgcgtaaacacaacctagaactcacaatgagccctcattgtgtgccaagcaaattatgcctggatgacacggagaccaacgtcaactgccaacggttaagctctaaggaagatttagggcccgtacaatcacaaggtatggacagttactcaatgcttcatcctcaattcagcaagatcgaaaattgttctttcacccccagcagcttcagcgtggagctgccctccaaccgtcatatctcaaagttgaatttcactagcgggatcgcacctacccctcagaaactcgcctatgagaagaagcagaacgatcagagatctaccgtgaattgttcagactctcttctttcaaagctgaataaaagccaggatgtgttctctccctcccacaagacgactagattcggaacgctatttgaaaggttgaactcgttgggcaacaggaaccttttaacaaagtctcctgccgtcattatggacgaggattgcagatccacggatgagatccgacaatcagattacatcactgaaaaacactccatccagcatatatgggggaaaaacgggaaggaggtgagtaactttctggaggacgtgaaccagtctaccccgaatcttctgtcagaaaactgcgactcctttgtgtcacaaaacatgattaacgtgttaaacatcgatgagcaacgcataaagaaaactttcaacaagtgtgattacgactctatgggagatacatgcgtggtcacttcctctgacaaaaaccacgtaactgaccgttgcattagaaatatttttaccgtgcccgaactgacgttcagcaattccaccctgaacaagacttcttacccagaaaaatgccagccaaacaagaaatatcagagagaatataacaagaacgaaaggaatgatttgagcacctctttcgagaacgactattaccccagttccagcgaaaggaaggaaaaatttgagaacgattatcaggaaaagacccctcagaagagtattcagaagtatcctgcgaattccatggggaacataccgagtgaagagttgcactctaaacagtcttgggactttggactagatgagattctgatggaagaaggaggcatttacagcttaaagtccaagcgtatcagcaccaaaaaaatatcccttgattcagcgcagtcttcccgaagtacgtcctactctccacggcctactgattcttgcttctcatctagcagcgatctgccatccgaagatgaagaccagatatctcaacaaatcgaggactccaacaggatgacgataaaaacgaaggagaagatgaacaatttttacgtggaaaggatggcaaagctatccggagatcgcattgtgaaaaatgacgacaaaatccacaagcaaaacgagaacttctaccagttcagtgtcaaaaataacacagatcagtttccacagctgcagtgcaactcggcacacatccttcagaacaagaccaatgacaactgcgttctccaagctgctcggtgtgatgctgggattcagacagaatcagagtccgtcatggaagagaaactcgacgtggcaattcagtgcgatttgattagcaagtgcacctgccgcagcgatgtgtctttgtgcaaccttgaaagatgcagtggaaatattaaagcagacaccaccggcgggcaggagattcacaaaaacaactag

SEQ ID NO: 27555 - DNA, 1185 bp, Artificial Sequence
  Description of Artificial Sequence: Synthetic coding sequence
atgaacagagacattaagatgcccctcaggaagcacaacctggaactcacaatgtctccacactgcgtgccatccaagctttgcctcgatgataccgagacaaacgtaaattgtcaacgactgtcctctaaggaggatctcggacccgttcaatcccaggggatggactcttactcgatgttgcaccctcagttttcaaagatagagaattgctcattcacaccctccagtttcagtgttgaattgccatccaacaggcacattagcaaattgaacttcacttctggaattgcacctacgccgcagaaactggcctatgagaagaaacaaaatgatcaaagatcaacagtgaactgtagcgatagccttctgagcaagctgaacaaatcacaggacgtgttctccccctcacacaaaactactcggtttgggaccctgttcgagcggctcaactcgctggggaaccggaatttgctaactaagagtccagcagttatcatggacgaggattgcagatcaaccgacgaaattaggcagtctgactatatcactgaaaaacactctatccagcatatttgggggaaaaacggcaaagaggttagcaactttttggaggacgtgaatcaatctacacctaatctgcttagcgaaaactgtgacagtttcgtatcccagaacatgattaatgtgcttaacatcgacgaacagcggatcaaaaagacttttaataagtgcgattacgacagcatgggagacacttgtgtggttacctcctcagacaagaaccatgtgacagatcgttgcatccgcaatatatttacagttcctgagcttaccttctcaaattcaactctaaataaaacgagctaccctgaaaaatgccagcccaataagaagtaccagagagaatacaataagaacgagaggaatgatctctcaactagcttcgagaatgactactatccatcctccagcgagagaaaggagaaattcgagaacgattaccaggaaaagacacctcaaaaatctatacagaagtatccagctaactccatctggtgcaccaaatgctcagaattcaaggtaatctttaccctgatccactatgttctgatgcttaatctctttctcaagagcctgagaaccgccttccaggccttcttaaataacgatttgcagctgtag

SEQ ID NO: 27556 - DNA, 324 bp, Artificial Sequence
  Description of Artificial Sequence: Synthetic coding sequence
atgtcaacagtcatatgcatgaaacagagagaagaagagttcctactgaccatccgcccctttgcgaacagaatgcagaaatccccctgttacattccaatcgtgtcttccgcaacactgtgggacaggtcaacaccatctgccaaacacattccctgctatgagaggactagtgtgccctgctcgcggttcatcaaccatatgaagaacttctccgagtcccctaaatttagaagcctgcactttctgaactttcccggctcacaccacgggcaggctacccagaagctgcagggcgcaatggtcctgcacttagaagagtag

SEQ ID NO: 27557 - DNA, 1083 bp, Artificial Sequence
  Description of Artificial Sequence: Synthetic coding sequence
atgagtacagttatctgcatgaagcagcgggaagaagagtttttgctgacaattagaccctttgctaatagaatgcagaagagtccctgttatattcccattgtctcaagtgccactttgtgggataggagtacaccttctgctaagcacattccatgttatgagagaacgagtgtcccctgtagtcgcttcatcaatcacatgaaaaacttctccgagagtcctaaattccgttcgctccatttcctaaactttccagtgtttcccgagagaacgcagaacagcatggcgtgtaagcgcctgctgcatacatgccagtatattgtcccaaggtgctctgtgtcgaccgtgtcattcgacgaagaatcctacgaggagttcagaagctctcccgcaccaagttctgagacagacgaagccccacttatatttactgcgcggggtgaaacagaagaacgagcgaggggggctcctaagcaggcctggaatagcagctttctcgaacagctggtgaaaaagccgaactgggcccactcggtgaaccctgtacacttggaggcccaggggatccatatctcacggcacactcgcccgaaaggccagcctctgagtagccccaagaagaactcagggagcgcagccagacccagcacagctatcgggctgtgccgtcgctcacagacaccaggtgcgctgcagtctacagggccaagcaatacggagctggagcccgaagaacgtatggccgtgcccgctggcgcccaggcccatccggatgacatccagtcccggctactgggtgcatcagggaatccggtgggtaaaggtgccgttgccatggccccagagatgcttcctaagcacccccacactccaagggacaggcgcccacaggccgacacgtccctccacggaaacctggcaggcgccccactaccactactcgccggagccagtacccactttccctccaaaagattgatcaaggtatgtagtagcgcccctcccaggccaacgcgcaggtttcataccgtttgttcccaggccctgtcccgccctgtcgttaacgctcatcttcactag

SEQ ID NO: 27558 - DNA, 1083 bp, Artificial Sequence
  Description of Artificial Sequence: Synthetic coding sequence
atgagtaccgtgatttgcatgaagcagagggaagaggagtttctgcttaccattaggcctttcgcaaatcgtatgcagaagtcaccatgctacatccctatcgtgtcatccgccacactgtgggacagatcaaccccctctgccaagcatatcccttgttatgaaaggaccagcgtcccttgctcccgttttattaatcatatgaagaatttctctgaatcccccaagttcaggtcgctgcactttctcaacttcccagtgttcccagaacggactcagaatagtatggcctgcaaaagattgctacacacttgccaatatatcgtccccaggtgctcagttagtaccgtgtcttttgatgaagagtcctacgaagagtttaggagctccccagccccatctagcgaaacagacgaggccccgctgatctttaccgccaggggagagacagaggaacgcgcccggggtgcgccaaaacaggcctggaactctagtttcctagaacagctcgtgaagaagcccaattgggctcactctgtcaatcccgtgcatttagaagctcaggggatccacatttcccgacacacaaggccaaaaggccaacccctatcaagcccgaagaagaactccggcagcgcagctcggccttccacagctattggcctgtgcaggagatcccaaactcctggagccttgcaatcaacgggaccttcaaacacggaattagagcccgaggagcgcatggctgtccccgccggcgcccaggcacaccccgacgacatacagagccggttactgggagcttctggaaatcccgtcggaaaaggggccgtagctatggcccctgagatgctgccaaagcatccacacacgcccagagaccgaaggccacaagcagatacttctttgcatgggaacctggcaggagcccctctgccactgttagcaggcgcgtcaacacactttccgtccaagaggctgataaaggtgtgctctagtgctccccccagacccactaggaggttccataccgtctgctcccaggctctctcgcgtccggttgttaatgcacatcttcactag

SEQ ID NO: 27559 - DNA, 624 bp, Artificial Sequence
  Description of Artificial Sequence: Synthetic coding sequence
atgtccaccgttatttgtatgaagcagagggaagaggagttcctgctcaccatacggccattcgcaaaccgaatgcagaagtcaccgtgctacattcctatagtctcctccgccactctctgggatcgctccactccaagcgctaaacacattccttgttatgagaggacttccgtcccttgttctcggttcattaatcacatgaagaatttcagcgaaagccccaaatttaggtcactgcacttcctcaatttcccagtgttcccagagcgcactcagaatagcatggcatgcaagcggctcctgcacacatgtcagtatattgtacctcgatgtagcgtatccaccgtatctttcgatgaggaatcttacgaggagttcagaagctctccggcccctagttccgagactgacgaagccccactcatcttcactgctagaggggaaaccgaagagcgcgcaaggggtgctccaaagcaggcctggaatagtagtttccttgagcagttggtcaagaagcccaattgggcccacagcgtaaatccagtccacctggaggcacagggtattcatatttctcggcatacacggcctaagggccagcccctgagctccccgaaatag

SEQ ID NO: 27560 - DNA, 558 bp, Artificial Sequence
  Description of Artificial Sequence: Synthetic coding sequence
atggaggtccatggcaagccgaaagcctcaccttcctgctcatcaccaacaagagactcctccggtgtgcccgtatccaaagaactcctcacagcgggatctgacgggcgcggcgggatctgggatcggctgcttattaactctcagccaaagtctaggaagacctccaccctgcaaacagttcggatcgagaggagccccctcctggatcaggtgcaaaccttccttcctcaaatggcccgggctaacgaaaagctgagaaaggagatggcagccgcaccgcccggaagatttaatatcgaaaacatcgatggaccccatagtaaggtgatccagatggacgtggcactcttcgagatgaaccagtccgactcaaaggaggttgatagttccgaggaaagtagccaggatagcagtgagaattcaagcgagagtgaagatgaggacgactctattccctctgaggtgacaattgacaacatcaaattgcccaattccgaaggggggaaggggaagattgaggtgctcgactctccagcctcgaagaagaaaaagtag

SEQ ID NO: 27561 - DNA, 1245 bp, Artificial Sequence
  Description of Artificial Sequence: Synthetic coding sequence
atggagatgcaacagaactgtagtatctcttgcttttgggaaacacagcctctgggttgcgttaagatttcatgcatattttatcacagcaagccacgaaatattaacggactatttctacctccctcctccaacataaccctgcaaaaggaaatccaagagggtatccctttgcagtcccaatcccaggagccgctcaagccccaggagaatatcagccgtcccatccaccacccacttgtgctgaagacgaatttcgaagaggaggaggaagtagatgagcaaaacgacgcgtctagtctctggacgaaaacccctgaagaaatcgaagagaagagagccattaaagaaatgtgttataaatctggcgagtactatcggttccatacccctcccgatattctgagttccaagagtatgaccccaacagcagagaaacaactagaaaagcctttagaaaacggaagcgagctccaggaaggagattccctaactgtaccaactaaactgtcacagtatgagcgccagggtgaaatcaaaacctccctccacggtaagcctaagactgatattgccgccttcgaaaatggcgggggggactgttatgtgccgcagcgcgtgatattcctgggagtggatgagtcagaagctttgactgaagaaaaagagattacaatcagtaagtgtagcaacactaaggacaataaggacagtccacaccctaagcacagtctgaccacacggctggtaccaaccacccatgtcctgaacgctacagagaacatctcgatgaaatgcagagaggacccatccagtatgaacgatgtacagccagtcaagaagccccatttcaagggggtgaaaaagagaaagtggatctatgacgagccacagaactttccaaattccgggatgcagcgggctgttcaggccccacgcccgcagaacaaaatgagttaccatcggaacaacaagaacagaaacgccgaaaacgcatcttatattcacgtacagcgcgatgcggtgcgtaccgtagcactcaatgcgccctctcggtctagacctacgcacggctcatacaataaagtccacgccaaccgggagccaaaaccgaacctaagtcctgataagtacacatctactagctacaacgattcggcttggcgcaagcgcatacctttttcaaaaacctactctaagtcagagaagatctatccggagccccggcgaaatggatctaaatag

SEQ ID NO: 27562 - DNA, 294 bp, Artificial Sequence
  Description of Artificial Sequence: Synthetic coding sequence
atggaaatgcagcagaattgcagtatcagctgcttctgggaaacccagccgttgggctgtgttaagattagctgtatcttttaccatagtaagccccgcaacatcaatggattgttcctgcccccatctagcaacatcaccctccagaaagaaatccaggagggtatcccgttgcagtctcagagtcaagagccgttgaagcctcaggaaaatatcagccgccccattcatcaccctttagtactgaagacaaactttgaagaggaggaggaggtggatgagcaaaatgggtag

SEQ ID NO: 27563 - DNA, 384 bp, Artificial Sequence
  Description of Artificial Sequence: Synthetic coding sequence
atggcccagcacccttgtcaggaccaggagcagaaggtcgagatgactagcaagcagcaacgctcaacgtccatcgaagagaccatgaggcctcaggaaaaacaggttacaattaccgagaccctatgggatcaggtgctcacggtcttcaaggatattcagaaggaactacaggaagacgcccgcatcagggggatgagtaactgtagtatgaccccaatgacttcggctccacggacaggctctatcagaccaccagacagcttgatgaccccaaagctgagaagactgcaattttcaagcggtgaacagccttcaggtggtagaatccacaatttgaagactcagctattctcccagagcgcctattaccccgggccttag

SEQ ID NO: 27564 - DNA, 384 bp, Artificial Sequence
  Description of Artificial Sequence: Synthetic coding sequence
atggcgcagcatccttgccaggaccaagagcaaaaagtagaaatgacgagcaagcagcagcgcagtaccagcatcgaagagaccatgcggccccaggagaagcaagttaccattaccgagaccctgtgggaccaagtgctcaccgtgtttaaagatatccagaaagaactccaggaagatgctcgcatccgaggtatgtctaactgttctatgacccccatgacctccgctccccggacgggatctatcagaccgccggatagcctgatgacacctaagctacgtcggctacagttttccagcggcgaacagcccagcggaggcagaatacataacctgaaaacacaactgttcagccagtctgcgtactatccggggccctag

SEQ ID NO: 27565 - DNA, 1389 bp, Artificial Sequence
  Description of Artificial Sequence: Synthetic coding sequence
atggcctccccattgccctccgggtttcccgcccgccgaaacagtagattagatgttttcctgcggcggcacctgccacccgaagtgtacgacgcagttcgggcttatgagccatgtatagtcgtcagcaattcggaaaatcatattcttaagtatgtagtgctcagtgatcgactcgtgtatctgaccgagaacccccctaagtccatcagacgcgtggttgccttgagagatgtggtggccattgacttaatcgatgactaccccgaatttttgtctagcccagaccgggagatctcccagcacatccggataatctatagcagtaccgtgctgaagaaagaatgtaagaagtcaaactcggtgcggaaatttctgttcccctttcatcataccaaggcaaacaacaaaaaggtgaaagaggagaaaaatggtctggcattttggcgcagtaaggaatcccggtccctcaaagaaagccccctgcgatccgaggagaaaatcaagcatttcagccagctgaagagcgagctgttcctgaaagacaacagcttaagacgcattttaagcttgctcatggagcttaaggtcgccgctcagaagaattttattctcaaacgcctgttctggaagacttctgacctgttctattttatagtgaacaagctgcacgagtacttaccagagtcaagagataagaacgccctgcagaatcagtctcagagggttgatgaactggtggcttgcattgagattatacagacattagtgctaatgttccgggagacggagactgagagttcaaggttgaacacacttgctgctaagaagggcgccctcttcaatcttttggtgattttaatctcggagcctcaaatacccaagagctgccctgtcttcgatatccagctggtggcggattccgcacttgtgcggatgagctttgacgcggaactccagaagctgatccttgaatataccaacactgcaactgcgctgctgtacgaaatcctgctggttttccaacaagggaatctaggcttgggctccacaaaattcgccatttcctggattatgagctttcttcagagctgtcctccaattatcaccttcgttgcctcaattgtgaaacaggtggtccgggggttaagcgcgagcttccaattgctgtccccttgccaggccgttctgctgtatcaacagttctatatccttaaatcctgtcttagacactcccgcaccttagctgagtatataaggaacaattatcgagaggagtttcggtactttattcatatgcccgctctccagaagaggttacccctgtgctacccaatcacacaaccaacaatccagctgttccacgaggtattaaagctggtggagtag

SEQ ID NO: 27566 - DNA, 1878 bp, Artificial Sequence
  Description of Artificial Sequence: Synthetic coding sequence
atggcttcccctctgccctctggattccccgcccggcgcaactccagacttgatgttttcctccgacgccacttacctccagaagtatacgacgccgtccgagcgtacgagccctgcatcgtggtgtcaaacagtgagaatcatatcctaaaatacgtggtgctgtctgatagactggtttacctcacagagaatcctccaaagagcatccgcagggtggtggcactgcgggatgtggtcgccatcgacctgatcgatgattatccagaattcttgagctcccctgaccgggagatctcccagcatattagaattatctactccagcaccgtcttgaagaaggagtgtaaaaagtccaactcggtgcgcaaatttctattcccatttcatcacacaaaagccaacaacaagaaagtaaaggaggaaaagaatggtctggcgttttggagatctaaggaatctcggtccctaaaggagtcaattctaccagaccgcgaccagcaagaatccagcacccctagtaaggactcaacactttgcccccgcccgggattgaagaagctgtccctgcatgggcaaggggccttccgtccgctgcctagtccatcccgcagatctagtcagtcagctcccactacaggaaaggccgtatccgaaccctcatgtaccacaaataccaaagaaccacagggccttccagaccacaattcgatcagcgagatcccgttcaagtgcaatggtaacggaaatgaattctacctgggtaatagcctcttggattctccctctcagtccaacagcaacctggagaagaaagaatccgagctccatctgtatgttatctctaccaccagttccatctttctgcaccttaagtcatcttggaacaattacattatcgtcaaagccactctgctgcaggaccctttttatgcatccgagttcagccctgcaatcggctctcagaaaccatataggtcagaagaaaagatcaaacatttttcccagctaaaaagcgaactcttcctcaaagacaactcactcaggaggatcctctccctgctgatggaactaaaggtagcagcacagaagaattttatccttaagaggctgttctggaaaaccagcgatcttttttattttattgtaaataagttgcacgagtatttgccggagtcaagggacaagaatgctctccagaaccagagccaacgtgtcgatgaattggtggcttgcatagagattatccagactctcgtcttgatgttccgtgagaccgaaactgaaagtagtaggttaaacaccctcgccgcaaagaagggtgcgctatttaatttgctggtaatcttgattagtgagccacagattccaaagtcctgccccgtctttgacatccagttggtagccgacagcgctctggttcgaatgagtttcgacgcggagctacagaaactcattctggagtatacaaatactgcgactgcactgctgtatgagatcctgctcgttttccaacaaggcaatctcggactcgggtctacaaaatttgccatcagctggataatgtcattcctacagtcatgccctcctatcatcaccttcgtggcgtctattgttaaacaggtggtccgtggcctttccgctagctttcagcttttgagcccttgtcaggctgtgcttctgtatcagcagttctacatccttaagtcctgcctcagacactccagaactctggccgagtacatcaggaacaactatagggaagagttccgctatttcatccacatgcccgccctgcagaaacgcctccccctgtgttacccgataacccaacctacaatccagttgttccacgaggtcttgaaattagtggagtag

SEQ ID NO: 27567 - DNA, 2328 bp, Artificial Sequence
  Description of Artificial Sequence: Synthetic coding sequence
ggtttccttattcaccccctcgtggtggcactacaacagcccccactgccagtcctgccacccttgcccctgccccccccccctccccctccaccctatggcagactcctggctaattctaacgcccaccccggaccattcccccctagcactggcgcccagagtaccgcccacccgccagttagcacccatcaccaccatcaccagcaacagcagcagcaacagcagcaacagcagcagcagcaacagcagcagcagcagcatcatggaaacagcgggcctccacctcccggcgctttccctcaccctctcgaggggggaagttcccatcacgcccatccctatgccatgagtccttctctgggctcactgaggccttatcccccggggcctgcccacctgccccctccgcactctcaagtatcctactcccaagcgggccctaacggaccacccgttagttcttcctctaactcctccagctctacttctcagggctcttatccatgctctcacccttctcccagccagggacctcaaggggccccctatccgttccccccagtccccactgtaacaacctctagcgcgaccttgagcaccgttatcgcaacagtggcaagcagccccgcggggtacaagaccgcatctcccccagggcccccgccttatggtaaacgagccccaagccctggtgcatataaaacagccaccccacctggatacaagcccgggtctcctccctctttccggaccggaacgcctcctgggtatcggggtacttccccgccggcaggaccggggacattcaagccagggtcacctactgtggggcctggacctctaccccccgcgggaccctccggtttaccctctctgccaccgccaccagctgcccccgcctctggaccccctctatcggccacacagattaagcaggaacccgccgaggaatacgaaacgccagaatcacctgtcccacccgcgaggtcgccctccccacccccgaaggtcgttgacgttccgtcacacgcctcccagtccgctagatttaacaagcatctcgatagagggtttaacagctgcgcacggtcagacctttatttcgttcctcttgagggcagcaaactcgcgaaaaagagggccgacttggttgagaaggttcggcgcgaggctgagcaacgtgccagggaggagaaagaacgggagcgagagagggagcgagagaaggagcgcgagagagagaaagaacgcgaattggagcggtctgtaaaattagcacaggagggcagggctcccgttgagtgtccttctttaggacccgtgcctcatcggcccccttttgaacccggaagcgcggttgccacagttccaccatatctgggccccgacacaccggcactcagaacacttagtgaatatgcaagaccacatgttatgtccccgggcaaccgaaaccatcccttttatgtgccactcggagccgtagaccctggtttgttgggctacaacgtaccagctctgtattcttcagaccctgctgcgcgggaaagggaaagggaggccagagaaagggatttgcgcgataggctgaaacctgggttcgaagtgaagcctagcgagctggagccactgcacggcgtaccaggaccaggtcttgatccatttcctcggcatggcgggttagcccttcagcccgggccaccaggactgcacccatttccatttcacccttccctgggtcctctagaacgggaacgcctagccttagcagcagggccagccctacggccagatatgagctatgctgagaggctggcggcagagaggcagcatgcagagcgcgtcgctgctctgggcaatgaccctctcgctaggctgcagatgctgaacgttaccccccaccatcatcagcacagccacatccactcacacttgcacttacatcaacaggacgcaattcacgctgcatcagccagcgtgcatccattgatagatcctcttgccagcggctcacatctaaccaggatcccttacccggcgggtaccctacctaaccctctcctacctcaccctttacatgagaatgaggttttgaggcatcagctgtttgccgcaccctacagagacctacctgcctcgctttctgccccaatgtcggcggcacatcagctccaggccatgcacgctcaatcagccgagctccagcggttagctctggagcagcagcagtggctgcacgcccaccatcccctacacagcgtgcccctgccggcccaggaggattactatagtcacctgaagaaagaatccgataagccactttag

SEQ ID NO: 27568 - DNA, 738 bp, Artificial Sequence
  Description of Artificial Sequence: Synthetic coding sequence
atgtcatcagagtcagagaaagacaaggagcggcttatccaggccgccaaaatgtttttttttcacgttcaggacctcgccagcgtgatcaataccttgaccgagctattttctcggagtatgaatacacaaatactgctgatggcggtgaagaataacagttacatcaaggacttcttcgagcagatgttgaaaatcttcaaagagatgcagagcgtggttgatgccagacacgataaaattcagaaagaatctttatgttcaaaggtggccatggctatgtgctctgtggtccagaagagcacgaacgtggaagaactccatcagagcgccaaggaagtttttaaaagcgctcataccccagttatcatatccgtgttgaactcttctaatattctcgggagtctggagtcatccctatcacaccttatgaaatttccaataatgaatctgcaacttagtgatttttataccgaagacaccaaggagcagagtgatgtcactacctctgagcgtacacggtcccctccgggctcaagtaaaaccacaatgattgacaccctgaagaagctgcaggatgttctcaaaacggaggacagtaagaatccaaccaaaagtgcagccgacctgttggagcagatcgtcaaagccatgggtcccatcctcgagatcctccagaaggccatcaaaaccatggaaatgaatattagcgtcttcaagaaggccagcgataaatag

SEQ ID NO: 27569 - DNA, 396 bp, Artificial Sequence
  Description of Artificial Sequence: Synthetic coding sequence
atgggaggcaagagcgcagtgaggcaccagctcgtgttggattgcccgcgggaggctgcctcttcagcgcccgccctgagaccccttggtgccgctgccacctccagggcagcccccctggcacctctcccggcaccatctcctcggtggggactcgggtgcggccgggtgcgctaccccggcccgcatccccgacgggccgttgaacctgctgctgggcccctaagtgctcccatcatagcgggggggcatcctgcagaagccgccgctggaagtgcgaagcagcaaccccgtcactcacgagaggtgcctagacctccagtgcctcaacaccccagcggcaatagtcgctccgccttgcaggaagccaagaccgagcagaccaaaacaccatag

SEQ ID NO: 27570 - DNA, 2418 bp, Artificial Sequence
  Description of Artificial Sequence: Synthetic coding sequence
atggccgcacagggtagccctagttctagtccctccgatgacagtaccacatctgggtctctgccagagttgccccccacctccaccgctacatcacggtctccccccgagtccaagggttcaagccggagctccctgctgcagtggacgtgtccagaggacagccttccactggccgtattctatgggccattggacgccaaaaatcctttgctggcgtcatgcgaaaaggaaattcaggaactgctgggcttcatgagaaaaaaaaaagcccttgccactacagaagaagaaaaacacgagtttcgccgacgctgtgccaccagtctgttcaacatttggactaaatacgcaccccgactgccagctgactactataacgaaaaactgctgaaagttggggatagtctgtgtcagatgaaagaatataaacttgccttgctacaatgctacggccgctacctacaacagtttaatactaacttcgatgagaataaggtggacgtcacccaattcaaggccacctttttccccaaagggtttaaggacaagactgctgggttgacatttcatgctctgtccgggaagaacatgtgtaactatcaactggtgtgtgacagcgacgagaacttaaaaaataaagaaagcgtcgttcagtgtctgcatatcctctcatcgctaagactgatcatgcaggtggccttaccacaggagcatctgtgctggattatatttaacggaaccatttacatttacactatatgccggaagctgatggtaatcgggcaaagttctaaagctctggaatacttgttgtgggcttccatgtgtatggagtccctcgtgccactgctctctctgaggtacctgacttggcgtgcaactctgtataccgcggtatgccagtgttgttacgattgccatgctggtatccacggagaggccttcgcacgaagggcactcgccaaaatcgatgagctgagacagctggaacttatgtcctcgagtaagtctcaggaagagtcccgccgatacttcagggaagccacaatgaagatggccgtgatgatcttcaagcgaggagtgtttgaatctcgacggaagaacaaggcagtttttcgtcccaagataagaatcaacttaagagaagtgcagacactgagttggcctcgcaccgttacagaacgcctgcttgacgagatgttcgattcaacagcctctcagtttcttgccgtgctcgaggccctgtctgattccaaccgccggattttgcaaacgggtcctatcgtgaccgacgaggtggaaattcatgacgtggtgagcgagctattcatggccggcaaagagctgctgattatgagcaatataggcgcagatggaatgctggatttcccaaagacttctctgctcgaactgatgattggccgaaaggatgttatcagcgtggacgccgccgtgaagttcatcaagctggccttcacttatgaagaatggtctctgttcgaatcctccgcggtccacctgatctacttcctccaaagacaagatgaccccgaaagcaaaaaggctgagaaggatctgacgctcctgatcgctatggagccattgatcaacgttaaacgcaacaaggggttaatcttccccctcgagaactataaagagggtcagagcactcagatctacctgaaaaagatagctgtgcatgatacctgcctgaagacctgtgggtattcagaggatattttccacctggcagccacgctatatgtgtgcgtctgcaccgccccgcaggacgtgcagcccgataaagagatcgtcgtcgatactatcatgtttttgtggcagaagtgtaagctgggcatacagaggctgaacatcagtagaaacgactacgccaagttcacccaaaagatcagtactaacaagtggatctatctgctttggcagatcaacgaagttatccactgctacaagatggaggatatcgacatcgtagtggtggccgaagtgactctgcggctgagcgaaatcctggagtctttgggctcccccggcaggaagtttaaacaaagcctcgatgtgccgctgagggagggaaccaacaaattccctggcgcaccaaaaggaataacagagatactgcctattctccagaagaatcccgttgagcagctgttgttcgcatataagctgctcgatagggcgataggcgggatcaacctgaactgcatgcttactagcctcccaaacggttccagcgttatcgaccattgctatgcgaagagaactcaccatatcgatggagatacatacaaacctctagcttctaatagcttcatgatggatctgcacttggagctgatccaggcacagcacagaatcgctgttgtcctgctggataagctgcaaggatcttag

SEQ ID NO: 27571 - DNA, 3594 bp, Artificial Sequence
  Description of Artificial Sequence: Synthetic coding sequence
atgtccgatgagaatatgtcaaaaacccaaacagtttacgactcggactctcagagcgggagttctgcgaaggagaaagacaggggggcaaatttatgcgtcatggaccacttcatgaagatctttttgtattgtcggcgtgctatggtattggctcatagaggcggatactggaccctgttgcaaaactgctgccgagccctgtggaacttcacacaggagctacagatcctgttaaaacaagctgtagatctggacaagacctttccaattagccaggatggcttcttatgtacgagcgtgctccccttttacttaggtgcagaactgctgatcgatatgttaattcagctgcagaacacctcttccatcaagccaatagaggacaagggagaattcagcgttcctagttgctatgggaacatcaagaacgataacggaggatcaagtctgacattcgagcaccccttagacgatgtcaacgttgtggaccttaagtggatccacgacttcgttctgaaaagcctagaagtgctgtatcaggtcgaaaagtgggagactttagtgtctctggcgatccaatttaataccgtctctcatgagcggtatacagaacaagtgacgcccttattagtttatgcgcagagacaattactcctcaggatccagaagttcaaggggcccgatatcacacagcagccatgtgcgagatacgaggcagaatacggcgaaaaaatcacatgcaggaactttatcggcaagcagcttaaaattaattcctctaccatcgaagccacctccaattgcactgacctcttaaagatgctgatcagttccgagtatagtcgcgctaaagccctagtttgtgtcccagtggacgtcacggatacattacgctgttttcgcgagacactggagaaaagcaagtaccacaatcgctcgattcgccattcccgaaagcttttatccttgttcctggcacagacacaagatgttctgcaggcatcgaaccagcgtagcctgaaagttcaggccctccacagcctcgggagtctgctgatctttgcagagaaaaagcgcgcagctttcaagtgctggtgtcaggccctggacgacattttcaggaagccggacgtgctacacacctggaaggagttcggcccttccctcactaacgttaccaacagccattcacctcctggattcaaggattactctgaagagtttctcagccgcgtgggcatatggggctgtctgcagggcgccgtgatcagcgctaagatcgcacagttcattaagtcccttaatgttgagaagaagaccgattgttgcatcctgagtgcgcttctctttcagggtctccttcgcacaaccctgcctcatccaaaggccgagaggtgctacgctcagtatgaaatcactcagctgttgccaggaatcgagctgttcagtgatcgttaccgggccgacatttgttcagtcatcgcaagtctttattatatcatcagggagctacatttcgtccggcaaaacctgatcgttcttccacttctagctctgtatcaatactttgttagtgggatatgccaggatatcacgaggaatctggaagcgaggattttgaagattgaagtgctcatagatttgcgattctttagtgaagcattttacgagatctcccagattttctacggcaaaaatatgccctgcccaatccctgcagggtacaaggccaccggtaaaatgaagattttccagtcattcgattctggaaagcttctaacaagtaaggagaacatacaggccatcgacgagctgcgaaataagggattgcctgccgtcctggtaacaatagggcagccccacctgctcaataagttcaactttgttaaagcgtatttcttcctgtccgtagctgctacgatcaattgcgtgccagaaaataagtttaaaaccgtgatcacaaacaagagtaagcctaatctgcccaacctggaggagatttatagtaaagacgatggcagctctttctataacttgaccaagctcaaggacgagataaccctttccatgctcaagagcatgctgttgatggaggcagaggatcgattaaactttctattgtctgaagtcgagcaaaagaccctctcccaatgtagtgccggcgaactagaaatagttgttgaggcccgattacagctggccgcagtggcactccagcgccaccgagccgcttacagtgccgcaatagtcttcagcacccttacactcctccaggattccaagctctttgagaagaaagtggtgcaggatgatactgagaaccctgttagcccgggcacaagcgttacagaaaataaggatgactcagaatttctggaccccattagccttaacgcaagagaatacttcaatattcatctctggttgcgctgtaggcttgctctggtaactgcttttgtggctcagatccatggtatcggcatcgttaaggaggacgacatgaccgattgcctgtcccttataaacgaggtatgtatggaggctaaatcagccggagacactgagctgcaagctgagtttttgactcaggctgtcattctcgggttacaggaaaaacatctgaaggctgatattatgacaaatctgcaggatattattcatttactggagggcaatgagtttatcagcccacaatctcgtctcaccttagccagaagtctggtgttgctggacgacctcaccaaggcagagaagtttaaggagtctccctcctcgaagacaggcaagttaaatctgctaacacgcgcccattccattctaacagaacagatgctggcctttggggagactatagagttcaggtccagcaatacaaaatatgctaatccactgcagcccctgaaaaatatttaccttcctcacgtgatgcttctggcgaaaatcaaaatgaggatcggccacactgtagctaaacaagtctattataaaaacaagcgcaaagacccttctaaatggctgcccgcactccaccttttcgacgttgccttgaagctctgccgaaccaccgccgttgaggagcatgaggtggaggcggagattttgttccaaaaaggaaagatcgaacgccagatcttgatggaagagaaatctccctcctttcagctcgaaagcctttatgaggccatacaattgagcctgaaaaacgaccaaaacagcggcttaatccgggactcatatctggagatggccctgttgtactttcatttaaaaaaacccaaaatcaagatctcaggctcacccctcaccctcaagccacccctccggagaagctcttctgttaaagagacgtctgccaataaatttgagatgtatagcagcttagcctggattgctatccgggctgcggctcaggtttctgaggcagtcctggcaataaatctgttgataggtaagaaaaatacgaggatgcataaggttaaccaagtcgcactgcctaatatccccgaattcgccgcgctggatttactaagtagttacacagactacttgctgggtatgttcggctgcttgcatattatgcagaaaaactag

SEQ ID NO: 27572 - DNA, 1338 bp, Artificial Sequence
  Description of Artificial Sequence: Synthetic coding sequence
atgggtgagtccattcccttagctgcgcctgtgcccgtggaacaggccgtgctggagacgttctttagtcaccttggaatcttctcctacgataaggccaaggacaacgtggaaaaagaacgtgaggcaaacaagtctgctgggggcagctggctttccctgttggctgctctcgcccacctggcggccgccgaaaaggtttatcactcgctcacctacctcgggcagaaactgggggggcagtcattcttcagtcggaaggacagcattagaactatttacacgagcctccataatgagctaaagaaggtggtcacaggaagaggtgctctcggaggcacagcaccccatgttgaggaactgctgagccatctcagcgaacaattatgcttctttgttcaggcaagaatggaaatggctgacttctacgagaagatgtacacattgagcacacagaaattcattaatgccgaagaactcgttgggctgctggacgcaatcatgaagaagtacagtagcagattccatcaccctattttgtcccctctagagtccagttttcagctggaggtcgacgtcctgtgtcaccttctaaaagcccaggcccaggtttctgagtggaaatttctgccttctctcgtaaatttgcactccgcacatacaaaactccaaacctggggacaaatctttgaaaaacagcgcgagacaaagaaacaccttttcggtgggcagagccagaaagcagttcagccccctcacttatttctttggctcatgaaattgaaaaacatgttgctggccaaatttagcttctactttcacgaggctctctcaaggcagacgacagcatcagagatgaagaccttgacagccaaggctaaccctgacttctttggcaaaattagtagttttatccggaaatacgatgccgctaatgtatctctcatttttgataaccgaggcagtgagtcattccagggtcacggctaccaccaccctcactcatatagggaagcccccaaaggagtggatcagtatcccgccgtcgtctctttgccatcagaccgtccagttatgcactggcctaacgtgattatgatcatgacggatcgtacttcggatctgaattccctggagaaggtcgtgcatttctatgacgataaggtgcagtccacttacttcttgacccgccccgaaccacatttcacgatcgtgataatatttgaatccaaaaagagcgagagagactctcatttcatctccttccttaatgaggtgtcacttgctttgaagaatccaaaggtctttgccagcttaaagcccggcgcgaagggatag

SEQ ID NO: 27573 - DNA, 1032 bp, Artificial Sequence
  Description of Artificial Sequence: Synthetic coding sequence
atggccttaacaccaacaaacctgaacaataaaatgtcactccaaatgaagatggattgccaggaacagcagctgacaaagaaaaacaatggtttctttcaaaagctcaacgtcactgagggagccatgcaggacctgctaaaggagatcatcaaagtcgaccacatcctcgatcgaagcgacgatgaagatgatatctcctcagagaacccacaaaccgactttcttcacaaaggaatgctcgaactagaggcagagcacgaccaggacctgagcaagcaggataaacaggagacagatgtcgatgaggatccacaagcatcgacgtccttacagttcagtaagaaaaacttgttagaactttgcctgaagggcatgttcttaaagttgaactactggaacacaaaaattggtctccaggtcaaagagcttggcgcagactatatcgatggcacagagaaaatcgacaatattattaagaagattaacgtcaccgagaatacagtgaagtcgctgttgaaggatatgttgacgctaaagggacagatagaaaagcttgaggatcgggggctagacctggaccagggtactagcaccgaggttaacacctgtaacgaggtctatgaattgaagaagaaggtaatcgaacggcttgaggacctgtgtaagaacgtcgaattgctatctgcgaaactgcgaatgtaccagatggaggctgaggataccgatagccactcgagtgaagaaatcgacacagaggaaatggaggcccttctcccgcaggcccctgcatcgttcttagtccagaaatcgccgccgcgcaatacagcctggaagagggcactgcgcattttcataatgtttgatgtgcttaccgtgaccgggctgctgtgctacatcctgtttttcggggcaacttttttgttcgaacgagttctactgcggatgctcggatgtaggaccacttgggatctccgggaaatgcgagaacctttcttaaacttggaggtggaggccctactgcccagctag

SEQ ID NO: 27574 - DNA, 1032 bp, Artificial Sequence
  Description of Artificial Sequence: Synthetic coding sequence
atggccctgacccctacaaatctcaacaacaaaatgtccctgcagatgaagatggactgtcaagagcaacagttgaccaagaaaaacaacggcttctttcaaaaactcaacgtgacggaaggagcaatgcaggatttgctaaaggagataatcaaagttgaccacatcctcgaccggtcagacgacgaggacgatatcagctccgagaatccacaaacagattttctgcacaaggggatgttggagctggaggccgagcacgaccaggacctgtcgaagcaggacaagcaagagacagatgttgacgaggatccacaagcctctaccagcctgcaattctccaagaagaacctccttgagttgtgcctgaaaggaatgtttcttaagctgaactattggaacactaagatcggtctacaagtcaaagagttgggcgccgattatatagacgggaccgaaaaaattgacaacataattaaaaagatcaacgtgacagaaaacaccgtaaaatctttgttgaaggatatgctgacactgaaagggcaaatcgagaaactcgaagatagaggtcttgacctggaccagggcacaagtacagaggtaaacacctgcaatgaagtttacgagttaaaaaagaaggtcatcgagcggctggaggacttgtgtaagaatgtggagctgttatctgccaagctgcggatgtaccagatggaggctgaggacacagattcccactcctccgaagagatcgacaccgaagagatggaagcacttcttccccaggcccctgccagttttcttgtacagaaaagccccccaaggaataccgcctggaagcgcgcgttgcgtatcttcatcatgtttgacgttctcaccgtgaccggactgctgtgctatatcctcttctttggtgctacgtttctgttcgagagagtgctcctgagaatgctgggttgcaggaccacctgggacctgagggaaatgcgagagccttttctgaacctggaagtggaagccctgctccctagctag

SEQ ID NO: 27575 - DNA, 906 bp, Artificial Sequence
  Description of Artificial Sequence: Synthetic coding sequence
atggcttacagctcatccaactcagacatcgaggatgattccagcaaatctaacagtaacctgtcactatccgttggctactttccttgtgaggacaccccttgcgaagacaccacgagttgggaggacgctcccagcaaaggcccttcaatccatttcctacctccagtgcagggagcgtggggcaccgagcggattggaagaagaatgaagcggcaggaccagattcaagatgagcccgagcagttttgtaaactgtccattttcctggcgtgggacgtcgacatcggaagcgataacactgacagtcgggcaaaccggctgttgaacggggacaacctttggattgataagttacccaaagaaaggactaagcttagtgttggcaaacttaataacctagtgcaggagttccagattttcttggaaaacctgaaggatgacgacgccgtgttcccggaaactgcgcagcaggactttcagctgtcaagcggctccccccccgagatggtgcaggtaagtcatcaggagtacgatgcttgccaggacctgcccaagtgtaagcccccagaaaacaaagacgtgatgctgaaagggcatgaactggcggaaatgatcagtcaggccaccgcatcacagcgcacgagtgctcctgaaatatcatccatcctgagcgaacagcctgaaaaggacgacacacccagtcatacccaggctcagtgttgtttgaacttcgggtgggcgtttagctggctccggcagcggatccttccttctctcctgagaagagaccacccagtgaacgcaactaagagtccccaccgttccgcccccaccaagaggctcttccaccgggggaaacggattcagccccaggagacgctggaactgggacatccaatctag

SEQ ID NO: 27576 - DNA, 810 bp, Artificial Sequence
  Description of Artificial Sequence: Synthetic coding sequence
atggcatatagcagctcaaattcagatatcgaagatgactccagtaagagcaactctaatctgtcactttccgtggggtactttccctgcgaggacactccttgcgaagacactacgtcctgggaggacgcacccagtaaaggaccaagcattcacttcctgccacctgtccagggtgcctggggtactgagcggattggccgccgtatgaaaagacaggatcagatccaggatgagcccgagcaattttgcaaattatctatctttttggcttgggacgtcgatatcggaagcgataacaccgattcaagagccaatcggctattaaacggcgataatctgtggattgacaaactccctaaggagaggacgaaactatccgtgggaaagctgaacaacttggtgcaggaattccagatctttctagagaacctcaaggacgacgatgcggtgttcccagagactgcccaacaggactttcagctttccagcggctcaccccccgagatggtgcaaatgattagtcaggccacggcctcccagaggacttcagccccggagatatcctctatactgtcagagcagcccgaaaaggacgatacgccgtcccatactcaggcccaatgctgcctcaatttcggctgggccttctcctggttgagacagcgcatactgccatcacttctgagaagggatcacccggtgaacgccaccaagtctcctcataggtctgctcccactaagcgcttatttcacagagggaaacggattcagccccaggaaactctggagcttggtcacccaatttag

SEQ ID NO: 27577 - DNA, 573 bp, Artificial Sequence
  Description of Artificial Sequence: Synthetic coding sequence
atggaaaagacggaatctttttgcccagaggtgcccccacaggattgtggagcttcccctaggccctcactccggtctctccccaagaatcaggggagcctgctgcagtttgaccgacaggcccccggccgcatttccacaagtcctacactacgccggctgagaacaagaggatgtgggacccgtcaggatgcttggcaagttacaacatgggggtcctggggggccccggtgggatttccttgctatttatctaagtccctgcctggttctcctaaggacagttcgcacctcctgtcacctttgaggctgcatagcaggttgacctcagagccggagcgggcacttaacgcagccgattcactggaaccacagacccggcctaccgacaaatacctgcctcccgagctgcaacctgtgaacgaaggatctctgcaccaggctagcctcaggcagcaggaagggcactttctcccttcacctaccctcaggcacccttctcctcaaggcgaggaactccacccgtcgcgctgcgtgtgtatctacttcctacgatgttatgacatctgctag

SEQ ID NO: 27578 - DNA, 522 bp, Artificial Sequence
  Description of Artificial Sequence: Synthetic coding sequence
atggaaaaaacagaaagcttttgtcctgaagtccccccacaggactgcggcgcaagccctaggccttccctgcggtctctcccgaagaaccaggggagcctactgcagttcgacaggcaagcccccggaagaatctccacttcacccactctccgcaggctgaggacgcggggttgtgggacaaggcaagatgcttggcaagttacgacctggggttcctggggagcccccgtcggatttccatgttacctctctaagtctctaccaggtagtccaaaggattcttctcacctgctgagccccctccgcttgcacagcagattgacaagcgagcccgaaagggcccttaacgccgccgactctctcgagcctcaaacaagacccacagacaagtacctgccaccagagctgcaaccggtaaacgagggcagccttcaccaagcctcacttcggcagcaggagggtcactttctgccctcccccacccttcggcatccgtcacctcaggtgactcagctatag

SEQ ID NO: 27579 - DNA, 192 bp, Artificial Sequence
  Description of Artificial Sequence: Synthetic coding sequence
atggggtgtggcaacagtactgccacctcagcaggcgccgggcaaggcccagcaggagccgccaaggacgtgacagaggaaagtgtgaccgaagacgacaagaggcggaattacggcggagtctacgtgggtctgcccagcgaagctgtcaatatggtatctagccagaccaagacagtccggaagaattag

SEQ ID NO: 27580 - DNA, 408 bp, Artificial Sequence
  Description of Artificial Sequence: Synthetic coding sequence
atgttccagaatctccagggaacgttcgagaaggaaattggcaagatcattccctttaccatcgcattcaagagggcagaagccgtcgagcctgacggctgcgtgcagtcctggcgatgctgcctgccatgcgatctgggtcaagcttcccgcttcatccacacaaccgtctgctctgccattcgctggcgcagttgtaagggcgagagaaatttcgcagaacgacacatcctcccagccgagttagaagaacagagcaaccatgccggcatggggccaatcctgcctgccatgccatctgtcgacggcaatcattttcaacacccagccggagattgtcacccctacggtattttgtgccttcaggcacattctgcaagtgtgacagcgaggcaagtgttgcagtag

SEQ ID NO: 27581 - DNA, 438 bp, Artificial Sequence
  Description of Artificial Sequence: Synthetic coding sequence
atgatccccaaacttgcaactccgagggatatcagtctattagttatcaaggaggcctcctctagagcgcggaacaatatccagatcctcgatccgctcgatcatatagcgagactcacgaattatactctgacatcgtgcttcagttcgaataaagtgcctaccatgcctggctcacttcctacaggatcgaaacagggaaatgtacagacattggattcaatccgctggatgcccgccactcccgtgcctgcccccgaatgccaccagaaatatgccatcagcacagagactgcctttcctactctctccacttttatgaataccgagaagagcgtgaagggatccaatgctgacttcaccaaaaggaacccgcgctggcgcttcctcctgggcatctattgctccctgcatcacgctatgactattttcatctag

SEQ ID NO: 27582 - DNA, 870 bp, Artificial Sequence
  Description of Artificial Sequence: Synthetic coding sequence
atggaacagcccgggcccagagccccagacccatcgctgtgccaccacaacctgcaacccacagatgaccccaactgggatagttatgctacgactatgcggacagccttcacccccaaaactggcgctgtgccggctttgatacgtcagaatggaatccgccgacttggatacacctactcactctccgaccccattctcaaccagactcagtattccgatgagtatacctggaagtcacactcgaaggaagacctcattaaaacagagacaagtcgtggcatcaagagccacaaatcccacctcaacgaagatatatttctgtggacgttgcctcattgtcagcagactggtactcttaagaattgcctcccttggaaaatccctgctagcatgaaggaagtcaataaagcactatcaaaccaattcatcagtctgacaaaaagggactttgtggaccgctctaaagcccagaaaatcaaaaagtcgtcccatctgtccctggaatggaagaagcttttgcctcagccacccgacacagaatttaggagaaactatcaaataccggccaaaattcccgagttacaggatttctctttcaagtatggttgctatagttccttacctgtcgcatcacagggcctcgttccttccgtgttgcactcttatttacgcaaccaggagcacacgaaaaagcagactacctaccagtcggattatgataaaacatacccagacttcctgatgctgctaaacagctttaccagcagtcaggtgaaggagtatctccagtcactgagctacaaggaccgccagattatcgatcgttttattcgcacacactgtgataccaacaagaagaagaaatag

SEQ ID NO: 27583 - DNA, 561 bp, Artificial Sequence
  Description of Artificial Sequence: Synthetic coding sequence
atgaatctaccacatctgatgagcctggcaagccaccttgcctcccatggatttttctgccttcggttcacctgtaagggcctgaacatcgtccatcggataaaggcatataaaagtgttctgaactacctcaagaccagcggtgaatataagttagcgggcgtgtttctgggcgggaggtcgatgggatcaagagctgccgcttcagtgatgtgtcatatcgagccagacgacggagacgatttcgttcggggcttgatttgtattagctacccactacatcaccctaaacagcagcataagctgagggacgaagatctcttcaggctgaaagagcccgttctctttgtgtctggaagcgctgatgagatgtgtgagaaaaacctgttggaaaaagtggcccagaaaatgcaggcgcctcacaagatccattggattgaaaaggccaaccacagcatggccgtgaaaggtaggtctactaatgacgtgtttaaggaaataaacacacaaatactgttttggattcaggaaattacagagatggataagaaatgtcactag

SEQ ID NO: 27584 - DNA, 561 bp, Artificial Sequence
  Description of Artificial Sequence: Synthetic coding sequence
atgaatttgcctcacttaatgagtctggcctcccacctggcttcccacggctttttctgtttgaggttcacctgcaaagggttgaatatagtgcaccggatcaaagcctacaaaagcgtccttaattatctgaaaacaagcggcgagtacaagctagccggcgtgtttctaggagggaggtctatgggctcaagggccgccgctagcgtgatgtgtcatatcgaaccagatgatggagatgatttcgtacgcggcctgatttgtatttcgtaccctctgcaccaccctaagcagcagcataaattacgggacgaggatctcttcagacttaaggagccagtcctgttcgtgtccggatctgctgacgaaatgtgtgagaaaaatctgttagaaaaggtcgctcagaagatgcaggcaccacacaaaatacattggatcgagaaggccaaccacagcatggcagtcaaaggccggtcaaccaacgacgtttttaaggaaattaatactcagattctgttctggattcaggaaattactgaaatggataagaagtgtcactag

SEQ ID NO: 27585 - DNA, 684 bp, Artificial Sequence
  Description of Artificial Sequence: Synthetic coding sequence
atgagtcatactgaagtgaagttgaagatcccgttcggaaacaaactcttggatgccgtctgtctcgtgcctaacaagagtctgacttacggcattattctgactcatggagctagcggagatatgaatcttcctcacttaatgtctttagctagccacctggcgtctcatggattcttttgcctgcggttcacatgtaagggcctgaatattgtacatcgcattaaagcatataagagtgtgttgaattatcttaaaacttccggagaatataaactggccggcgttttcctgggtggccggtctatggggtcccgagctgcagcctccgtgatgtgccacatcgaaccagacgacggcgacgactttgtccggggactcatttgcatatcttacccactccaccaccctaagcagcaacataagttgcgggacgaagacttattcaggctaaaagaacccgttctgtttgtctctggctcagccgatgagatgtgtgagaaaaacctgctggagaaggtcgcccagaaaatgcaagctccccataaaatccattggatcgaaaaagccaaccatagcatggccgtgaaaggcagaagcacgaatgacgttttcaaggaaattaatacgcagatcttgttttggatccaagaaattactgagatggataagaagtgtcactag

SEQ ID NO: 27586 - DNA, 420 bp, Artificial Sequence
  Description of Artificial Sequence: Synthetic coding sequence
atgggacagaattggaaaagacagcagaaactgtggaacgtaccacagctgccttttatccgagttcccccctcaatatacgacacctccctcctgaaagcactgaatcagggacagcaacgatatttttatagcatcatgaggatctataacagccgcccgcagtgggaggctcttcaaactaggtacattcactctctccagcatcaacagttgctgggttacattactcagcgggaggctctgagttacgctttggtattgagggattccacgaaacgcgcctcagcgaaggtggcaccacaacgtaccattccgcggaaaacgtccgccatgacaaggcggtgtccttccgtccttcccgtgtcggtagtgctgcccagagcccagagtaagcgcaggcaggtcctccggaactag

SEQ ID NO: 27587 - DNA, 420 bp, Artificial Sequence
  Description of Artificial Sequence: Synthetic coding sequence
atgggtcagaattggaagagacagcagaaactatggaatgttccccaattgcccttcattagggtccccccttcaatttatgatacatccctgctgaaggctcttaaccaaggacagcagcggtacttctactccatcatgcggatttacaacagcaggccacagtgggaggccctacagactaggtatattcatagcttacaacatcaacagctcctcggctatatcactcagagagaagctctctcttatgcactcgtgcttagagacagcacaaagagggcgagtgcgaaagtggcgccccagaggacaatcccccgtaagacatccgccatgaccaggcgctgtccatcagtgcttcccgtgagcgttgtgctgccacgcgcccaatcaaaacgtcgccaggttctccggaattag

SEQ ID NO: 27588 - DNA, 912 bp, Artificial Sequence
  Description of Artificial Sequence: Synthetic coding sequence
atggccggcgccgcatgcgagccagtggccaggccatcgctgactagcatctcaagcggagaactcagaagcctctggacctgtgattgcgagctagctctcctaccactagcccagctactcaggctgcaacctggcgcctttcaacttagtggcgaccaactggtagtggcgagaccaggagagcccgcagctgcccgtggaggttttaacgtttttggagacggactcgttcgcctggatggacaactgtatagactgtccagctacatcaaacgctacgtagaactgacaaactactgcgattataaagactacagggagactattctctctaaaccgatgcttttcttcatcaacgtccagaccaagaaggataccagtaaagagcgcacgtacgccttcttggttaacacacgtcaccccaagatcagaagacaaattgagcagggaatggatatggtaatcagcagcgtgatcggcgagtcctaccgcctacagttcgacttccaagaggccgtgaagaattttttcccaccgggcaacgaagtcgtgaacggagaaaacttaagcttcgcatacgagttcaaggctgatgccctgtttgactttttctactggttcggcttatccaactcggtggtcaaagtcaatggcaaagtccttaatctgtcttcaacgagtcccgaaaaaaaggaaaccatcaagctgtttctggaaaagatgagtgagcccctgatcagacgatcatctttctccgatcgtaaattctctgtcacttcgaggggttccatcgacgatgtttttaattgtaacctcagccctagatcaagccttaccgagcccctgctagccgagctgcctttcccctcagtcctggagtccgaagaaaccccgaatcaatttatatag

SEQ ID NO: 27589 - DNA, 366 bp, Artificial Sequence
  Description of Artificial Sequence: Synthetic coding sequence
atgaattcccccgaagctagactctgtgtcgcacagtgcagggattcctatcctggctgccagccactaaaagataccagggcatgggcttcttcgctcaaaatggatccagccgggctggaaggaggtccacgcgacgagagcagagatgaacctcccatccgtgcgcaagccgccagctgggaccagcctcaagggtgcctcacatacaaaggccgccgctctgccagcggcacacagaagcaactccagttgccagatacattaagctcccttctgtgctggagaggggccataatggtgtatataaaagttactgtgcagacagatgattccaataagctgctgtctctgctgtaccgatag

SEQ ID NO: 27590 - DNA, 3495 bp, Artificial Sequence
  Description of Artificial Sequence: Synthetic coding sequence
atggcacttttccccgccttcgctggccttagcgaggcccccgatggtggctctagtaggaaagaacttgattggttgagcaaccccagcttttgcgtcgggtccattacgtccctgtcgcagcaaacagaagctgcccctgcgcatgtgtcggaagggttaccactgacgagaagtcacctcaagagtgaatccagcgatgaatccgacactaacaaaaaattaaaacagaccagccggaagaaaaaaaaagaaaaaaagaaaaagcggaaacatcagcaccacaagaagactaagcgaaaacatggacccagttcttcatctagatcagagactgatacagacagcgaaaaagacaaaccctcccggggcgtgggcggctctaagaaagagtcagaggaaccaaaccagggcaacaacgctgctgccgacacagggcaccgcttcgtgtggctagaggacattcaggccgtgaccggcgagaccttccggaccgacaaaaaaccggaccctgctaactgggaatacaagtcactttacagaggagatatcgcgcgatataagaggaagggagattcgtgtctggggatcaaccctaagaaacaatgtataagctgggagggcacatccacagaaaaaaaacattcgaggaaacaggtggagagatactttacaaagaaatccgtagggctcatgaatatcgatggagtggccatctcttctaagacagaaccaccatcctccgaacctattagttttatccctgttaaagatctcgaggacgccgctcccgtgactacttggcttaatcccttggggatctacgaccagtcaaccacgcactggttgcaggggcaggggccccccgaacaggaatccaagcagcccgacgctcaacctgatagcgaatctgctgcgcttaaagctaaagtcgaggagttcaataggcgcgtgagagagaacccacgcgatacccagctatggatggccttcgtggctttccaggatgaagttatgaaatcaccaggactgtatgccattgaggagggagagcaagaaaaaagaaagaggtcgcttaagttaatacttgaaaaaaagcttgccatccttgaacgggctatcgaaagtaatcagtcgagcgtagaccttaaattagctaagttgaagctttgtactgagttctgggagccatctacattagtcaaggagtggcagaagctgatctttttacatccaaacaatactgcactgtggcagaagtacttgctgttctgccagtcgcagttctccactttttcaatcagcaagatccacagcttgtacggaaaatgtctgtctaccctgagtgccgtcaaagacggaagcattctctctcaccctgccctccctggaacagaagaggccatgtttgcactcttcctgcagcagtgccacttcctgagacaggccgggcacagtgagaaagctatttccctcttccaagcgatggtggattttactttctttaaacccgacagcgtgaaggatctgcctaccaaaggtcaggtggaattcttcgagccgttctgggattctggcgaaccccgtgctggagagaagggtgccagggggtggaaggcatggatgcatcagcaggagcgcggtgggtgggttgtgattaaccccgacgaggacgatgacgagcctgaagaggacgatcaggagatcaaggacaagaccttgccacgctggcagatctggctcgccgccgagcgctccagggaccaaaggcactggagaccatggcgccctgataagactaaaaagcagactgaggaggattgtgaggatccggagaggcaggtgctttttgatgacatagggcaaagccttatcagactgagctcacatgatcttcagttccagctggtggaagcgttcttgcagttcttaggagtccccagcggctttaccccccccgctagttgtctgtaccttgccatggatgagaattccattttcgacaacgggctgtatgatgaaaaaccacttacattctttaatccactgttcagtggagcctcttgtgtgggaagaatggatcgactgggctacccaagatggacgcgcggccagaacagagaaggagaagagttcattaggaacgtattccacctggttatgccactgtttagtggcaaggagaaatcacaactgtgtttcagctggttgcagtacgaaattgccaaggtgatctggtgtctccacaccaagaacaagaagcgcctaaagagccaggggaagaactgtaaaaaactggcgaagaacttgctaaaggaacccgaaaactgcaacaatttctgcttatggaagcagtatgctcacctggagtggctcttaggcaacactgaggacgctcgcaaagtgttcgacactgccctgggcatggcaggaagtcgggaactgaaggactccgatctgtgtgaactatcacttttgtatgcggaactggaagtggagctgtcccccgaagtccggcgggcagcaacagctagggcagtacatatccttaccaagttaaccgaaagttcaccctacgggccatatacaggacaagtgctcgcagtgcatatcctgaaggcgcggaaagcctacgagcacgccttacaggactgtcttggcgactcttgcgtttctaacccggcgcctactgattcatgctcaagattaattagcctcgcaaaatgttttatgctgtttcagtacctgactatcggcattgacgccgcagttcaaatttatgaacaagtctttgctaagttgaacagctccgttttccctgagggcagcggggaaggagacagcgcaagttcccagagttggaccagcgtgttggaggcgatcacgctgatgcacacttctctgctgaggttccacatgaaggtcagcgtctaccccctggcccctcttcgcgaggctctgagccaggctcttaaactctaccccggcaaccaggtgctctggcggtcctacgttcagatacagaacaagtctcatagcgcatctaaaacaaggagattttttgataccataacacgctcagcaaagcccctggagccctggctcttcgctatcgaagcagagaaactgcggaagagactcgtcgagacagtgcagcgtcttgacggacgtgagattcacgccactatcccggagacaggccttatgcaccgtatccaggctttatttgaaaatgccatgaggtctgattccggatctcagtgccccctgttatggcgtatgtatcttaactttctggttagcctgggcaataaagagagatcaaagggcgtgttctacaaagcactgcagaactgtccctgggctaaagttctctatctggatgccgttgagtacttcccagatgagatgcaagagatactggaccttatgactgaaaaagaactacgcgtgagactgcccctggaggaactggaactgctgctcgaggactag

SEQ ID NO: 27591 - DNA, 2802 bp, Artificial Sequence
  Description of Artificial Sequence: Synthetic coding sequence
atgaacatagacggcgtggccatctcttccaaaaccgaaccaccaagctccgagcccatatcattcattccagtaaaggacctcgaggacgccgcgccagtaactacatggctcaacccgctcggcatttatgaccaaagcacaacccactggctccagggacagggtccaccggaacaggaatctaagcagcctgacgcccagccggactctgagtccgcggcgctcaaggctaaggtggaggagtttaaccgccgcgtacgcgagaacccacgcgatactcagctttggatggcattcgtggcttttcaagatgaggttatgaagagccccggactttatgcaatcgaggaaggagagcaggagaagcgtaagcgctcgcttaagctgatcctggagaagaagttagcaatactggaacgtgcgatcgaatcaaatcagagttcagttgacctcaagctcgccaagttaaagctgtgcaccgaattctgggagcctagtaccttagtcaaagagtggcagaagctgatcttcctgcatcctaacaataccgccctgtggcaaaaatacctgctgttttgtcagtctcaatttagcacctttagtataagcaagattcattccctctacggtaagtgcctcagtacactgtctgcagtcaaggatggcagcattctgagtcaccccgccttacccggcactgaagaagccatgtttgcccttttcctacagcagtgtcactttctccgccaggcaggacatagcgaaaaagccatatctctcttccaggctatggtcgactttaccttttttaagcccgatagtgtgaaggatcttcccacaaagggccaggtcgaatttttcgagcctttctgggactctggcgagccacgggccggcgagaaaggcgccaggggatggaaggcctggatgcatcagcaggaacgaggtggatgggttgttattaatcccgacgaggatgatgatgagcccgaagaggatgatcaggagattaaggacaagaccctcccgcgctggcaaatctggctagcggctgaaagaagtagagaccagagacactggaggccgtggcggccggataagacaaaaaagcagactgaggaggattgcgaggaccctgagaggcaagttcttttcgatgatatcggccagtccctcattcgcttgtcctcacacgatctgcaattccaacttgtcgaagcgtttttacaattcctgggcgtaccatctggattcacccctcctgcttcatgcctatacctggctatggacgagaattcaatctttgataatgggctgtatgacgaaaaacctctgaccttcttcaaccctcttttcagcggagccagctgcgtgggtcgcatggacaggttgggatacccccggtggacacgaggtcagaaccgcgagggtgaagagtttatccgtaacgtattccatttggtcatgccactcttctctggtaaggaaaagagtcagctgtgtttttcttggcttcaatacgaaatagcaaaagtcatctggtgtcttcatacaaagaataaaaagagactgaaatctcaaggcaagaattgcaaaaagttagcgaaaaaccttttgaaagagccagagaactgtaataatttctgtctgtggaaacagtatgcccacctggagtggttactaggcaatacagaggatgcccggaaggtcttcgacaccgccctggggatggccggatcccgtgagctgaaggactctgatctgtgcgaattgtccctgctttatgcagagctagaggttgaacttagtcctgaggtgcgccgcgccgccaccgccagggccgtgcacattttaactaaactgaccgagagttcaccatacgggccatataccggacaggttctggccgtccacattctcaaggctagaaaggcgtacgaacatgctctgcaggattgtcttggagattcgtgtgtgagcaatcctgcaccaacagactcatgttcccggctgatctccttggctaaatgttttatgctcttccagtatcttactattggcatcgacgccgcagttcagatttatgagcaggtgtttgccaagttgaattcctccgtgtttccagaaggctctggggaaggtgattcggcctccagtcaaagctggacgtctgttttggaagcaattactctgatgcatacatctctcttgaggttccacatgaaggtgtcagtgtacccgctcgctccactcagggaggctctttcacaggcgttgaaactatatccagggaaccaagtgctgtggaggtcgtatgtccagattcagaacaaatcgcacagcgcctccaagactaggcggttcttcgatacgatcacaaggagcgctaagccactcgaaccctggttattcgcgatcgaggcagaaaaacttagaaagcgtctggttgagacagtgcagaggttggacggccgggagattcacgcgacgatcccagagacaggtcttatgcataggattcaagcgcttttcgaaaatgcgatgcgatccgatagcggcagccagtgtccgctgctatggcgcatgtacctgaattttttggtgtcgcttggaaacaaagagcgctccaagggagtcttttacaaagctctgcagaactgtccatgggcgaaagtcctgtatttagatgccgtcgagtacttcccagacgaaatgcaggaaattctggacttgatgaccgagaaggaattacgcgttaggctgcctctagaggagctcgaactccttctggaagactag

SEQ ID NO: 27592 - DNA, 744 bp, Artificial Sequence
  Description of Artificial Sequence: Synthetic coding sequence
atgagtggaaaggaccgaattgagattttccccagtaggatggcccagactattatgaaggcccgactgaagggagcccagaccggcagaaatctactgaagaaaaaatctgatgccctaacactgcggttccgtcagatccttaagaaaatcattgaaaccaagatgttgatgggagaagtaatgcgcgaggctgccttcagcctggccgaggctaaattcacggcaggcgatttttctacgaccgtgattcagaatgtgaataaggcacaagtgaagatccgcgcgaagaaggataacgtcgctggggtcacactgcctgtatttgaacactaccacgagggcaccgacagttatgagcttacaggactggctagggggggtgagcagttggccaagcttaagcggaattatgccaaggctgttgaactgcttgtggagctagcatcactccaaacttctttcgtcaccctggatgaagcaatcaaaatcactaacaggcgggtcaacgccattgagcacgtgatcatcccccgtatagagcgaaccctcgcttatatcatcactgaattagacgaacgggagcgcgaggagttttatcgactcaagaagatccaggagaaaaaaaaaattctcaaagagaagtcagagaaggacctggagcagagacgggcagccggggaagttctggagcccgccaatcttctcgctgaggaaaaggacgaggatcttctgttcgaatag

SEQ ID NO: 27593 - DNA, 1449 bp, Artificial Sequence
  Description of Artificial Sequence: Synthetic coding sequence
atggatgagctcgtgcatgatttagccagcgctctagaacaaacatcagaacagaacaagctgggtgaactctgggaggagatggccctcagtcctcgtcagcagaggcggcagctccgcaaaaggcgtggccgaaaaagaaggagtgacttcacccatctcgctgagcatacttgttgctattccgaagcttccgaaagctctctggacgaagccactaaagattgtcgggaggtggcccccgttacaaactttagcgatagcgatgacacgatggtcgccaagcgacatcccgccctcaatgccatcgtgaagagtaagcagcactcctggcacgagagtgatagttttacggaaaacgcaccttgtcgccctctccggcgacgccggaaagtgaagcgggtaactagtgaggttgccgcatctctgcagcagaaactgaaagtctctgattggagttacgagagggggtgcaggttcaaatcggccaagaagcagcggctgtctcggtggaaggagaacaccccgtggacctcatcaggccacggcctctgtgagagtgccgagaataggactttcctgtctaagaccggaagaaaagaacggatggagtgtgagacagatgaacaaaaacaaggatctgatgaaaatatgtccgagtgtgagacctcatccgtgtgctctagcagtgacaccggcctattcacgaatgacgagggaagacaaggtgatgacgagcagtcggactggttttacgaaggtgagtgtgtccccggatttaccgtgccaaacctgcttcccaaatgggcgccggatcactgtagtgaggtggaaagaatggactccggcctggacaagttctccgattctacgtttctcctgcccagcagaccagcacaacggggctatcacacccggctgaacaggttgcccggagctgccgcaaggtgtttaagaaagggccggcggcggctagtaggaaaagaaacttccatcaacaccctgggcactgagcgtatatcccacattatttcagaccctcgacagaaagagaagaacaaggctctggcgtcggatttccctcacatatcggcgtgtgctcacgaattcaatcctttgtctccgctgtattctctggatgtcctagccgatgccagccaccgccgttgttccccggcccactgctctgcccgacaggctaacgttcactggggccccccatgctctagagatattaaaagaaagaggaagcctgtggccaccgcctcactctctagtccatcggctgtgcacatggacgctgtggagcctactactccagccagccaagctccaaaaagtccctcctctgaatggctcgtacgaaccagcgcggctgagaaagctaccgacgctaccactgcaacttttttcaagatgccccaagaaaagtcacccggctatagttag

SEQ ID NO: 27594 - DNA, 1434 bp, Artificial Sequence
  Description of Artificial Sequence: Synthetic coding sequence
atggatgagctggtgcacgacctggcctctgcactcgagcagacctcagaacagaataaactcggggaactttgggaagagatggctctatctcctagacaacaaaggcgtcaactgcgaaagcgtagaggaaggaagcggcggtcagacttcacccacctggccgaacatacctgctgttattcagaagccagcgagagttctctagacgaagcgactaaggactgccgagaggttgccccagtgaccaacttcagcgactctgatgacacaatggttgccaagcggcatcccgcattgaatgctatagtgaaatctaagcagcatagttggcatgaaagcgattctttcacagaaaacgcgccctgtagaccgctccgccgaaggaggaaggtcaaacgagttaccagtgaggtggctgcttcgctacagcagaaactgaaggtaagcgactggagctatgagcggggttgccggttcaaatcagctaagaaacaacgcctttcaagatggaaggaaaacacaccctggacctcctccgggcacgggctctgcgagagcgccgagaacagaactttcttgagcaaaaccggtcgcaaggaacggatggaatgtgaaaccgatgaacagaagcagggcagtgatgaaaacatgagcgagtgcgaaacgtcctcagtctgcagctcgtcggacacgggcctgtttacaaatgacgaaggaaggcagggcgatgatgaacagtccgactggttttacgaaggagagtgcgtcccaggattcactgtcccaaaccttctgcccaagtgggcgccagatcactgctcagaggtcgagagaatggactccgggctggataaattctccgatagcaccttcctccttccttcaagacccgcgcagagaggctatcacactaggttaaacaggctccctggcgccgccgcccgctgcctgaggaaaggccgccgcagacttgtggggaaagaaactagcatcaataccctggggactgaacgcatttcgcatatcattagcgacccacggcagaaggatttttggctcccttctgctgggaaacgtgagagaaatcagttcaatccacttagtccactgtactccttagatgtgctggccgatgcctctcaccggaggtgcagccccgcccactgctcggccagacaagccaacgtgcattggggccccccatgcagtcgtgacattaagcggaaaagaaagcccgtggctacggcctcactaagctctccgtccgcagtgcacatggatgccgtcgagcccaccacccccgccagccaagcccccaagtcacccagttccgaatggctggtgagaacctctgcagcggagaaggcgacagacgccacaactgccacattcttcaaaatgccacaggaaaaatctcctggatacagttag

SEQ ID NO: 27595 - DNA, 1344 bp, Artificial Sequence
  Description of Artificial Sequence: Synthetic coding sequence
atggacgagctggtgcacgacctggcttccgctttggaacagacatcggagcagaacaagcttggggagttatgggaggaaatggccctgagtccgaggcagcaacgtcgacagttgcgaaagcggagaggcagaaaaaggcgatccgacttcacgcacctggccgaacatacatgctgctatagcgaggctagtgaaagttcgctagatgaagcaacgaaggactgtagggaggtcgctcccgtgacgaatttctctgattctgatgacacaatggtcgccaagcgccatcctgccctgaatgcaatagtgaagagtaagcagcactcttggcatgagtccgattccttcacggaaaacgccccttgtcgtcctctccgtagacgccgaaaagtgaagagagtgacctcagaagtcgcagctagccttcagcagaagctgaaagtgtccgattggtcatacgaaagaggctgccgctttaagagcgcaaagaagcagagattaagccggtggaaagaaaacaccccttggacatctagtgggcatggcctgtgcgagagcgcagaaaatcgcacctttttgagtaagaccggccggaaggagcggatggaatgtgaaacggatgagcagaagcagggcagcgatgaaaacatgtctgagtgcgaaacttcttcagtctgttcttcctcagataccggattgttcacaaatgacgaaggtcggcagggggacgacgagcaaagtgactggttctatgagggtgaatgtgtgccaggatttaccgttcctaacctgctgccaaagtgggctcccgaccattgctctgaagtcgaacggatggatagtgggctagacaagttttccgactcaaccttcctgttaccatccagacctgcccaaaggggttatcatacccgcctgaatagattaccaggtgccgcggcccggtgtctacggaagggacggcgccgtttggtcggtaaggagacgtccattaacaccctaggcaccgagcgaattagtcatataattactttgggtcgcaaaatctctggctaccatcaattggggaaagagaacgaaattagtagtatcccgtgtttaccattcactccgtggatgtttctgccaatgttactaacagagggggtgcatcagcatacagctcttcctgaccgtcagatgtacacgggagaccatcacgtgcatgtgacatcacggggctccggcaaccagtggccacagcatttgtgtctggctcctgtacagtttacatggatgcagtggtctcagccacatcagcatcataaaccaccaaaccaccctgcactttcaggctggtag

SEQ ID NO: 27596 - DNA, 1056 bp, Artificial Sequence
  Description of Artificial Sequence: Synthetic coding sequence
atggatgaactcgtccacgacctggccagcgcgctggagcagaccagcgaacagaacaagcttggtgaactgtgggaagagatggctttgagcccaaggcagcagcgcaggcagctgcgcaaacggagagggcggaagaggcgctcagacttcacacacctggccgagcacacatgctgctactccgaggcttcagagagcagtctcgatgaggctacaaaggattgccgggaggtggctcctgtcactaactttagtgacagcgacgacaccatggttgctaaacggcaccctgcactgaacgcgatcgttaagtccaagcagcattcatggcacgaatccgactcatttaccgagaatgcgccctgtcggccgcttcgccgcagacgtaaggtcaaaagggtcactagtgaggttgccgccagtctgcagcaaaaactgaaagtgtccgattggtcctacgaacggggatgccgattcaaatccgccaagaagcagagactgtcccgttggaaagaaaataccccgtggacaagctctgggcacgggctatgcgagagcgcagagaacaggacatttctgagcaagacaggcaggaaggagcgaatggagtgtgagaccgacgagcaaaaacagggttccgacgagaacatgtctgagtgcgaaacatcaagcgtatgctcctcctctgatacagggctgttcacaaatgatgaaggcaggcagggcgacgacgagcaatctgattggttctatgaaggcgagtgtgtccccggcttcacagttcccaacctgctgcccaagtgggcccccgatcattgtagcgaagtcgagcggatggactcaggtttggacaaattctctgactccaccttcctgctgccaagcaggccagcgcagagggggtaccacaccaggttgaatcggctgccaggagccgcagccaggtgcctgcggaaggggcgacggaggctggtggggaaagtaatcccacttacggttagtctagcccaatggggggataacattccatatggaagttgtgtgtcttactag

SEQ ID NO: 27597 - DNA, 1056 bp, Artificial Sequence
  Description of Artificial Sequence: Synthetic coding sequence
atggatgaactcgtgcacgacctggcctctgccctcgagcagacctccgagcagaataaacttggggagttgtgggaagagatggcgctgagtcctcggcagcagcgcaggcagttgcgtaaacgacgggggaggaagcgcagatctgacttcacccacttggccgaacatacatgctgctacagcgaggcttctgagtcctctctggatgaagccaccaaggactgtcgcgaggtcgctcctgtcacgaatttcagtgattcggacgacactatggtcgccaaaagacacccagctcttaatgccattgttaagagcaagcagcatagttggcacgaatccgactcttttacggaaaatgcaccatgtagacctctgcggaggcgccggaaagtaaaacgtgtgaccagcgaggttgctgcatccctgcagcaaaagcttaaagtaagcgactggagctatgaacgtgggtgccggtttaaaagtgctaaaaagcagagactcagtcgctggaaagagaacaccccttggaccagctccgggcatggcctctgtgaatcagctgagaatcgcacatttttgtccaaaactgggcgaaaggagaggatggaatgcgagacagacgagcagaagcaggggtcagacgaaaatatgtcagagtgcgagacctctagtgtctgttccagttcagataccggcctgttcaccaacgacgagggccgccagggcgatgacgaacagtcggactggttctacgaaggtgagtgtgttccggggttcactgtgcctaatcttctcccaaaatgggctccggatcactgctctgaggttgaacgaatggactccggcctggataagttcagcgactctacttttctccttccgtcccgacctgctcagcgggggtatcatacaagactgaacagactgcccggggctgcggcccgttgtttacgaaaggggagaaggcgcctcgttgggaaagttattccactcactgtgtcacttgcacaatggggggacaatatcccatacgggagttgtgtgagctattag

SEQ ID NO: 27598 - DNA, 423 bp, Artificial Sequence
  Description of Artificial Sequence: Synthetic coding sequence
atgccgctcgagagcagcagctctatgccattgtcctttcctagtctgctaccctctgtgccgcacaatactaatccctctccccctctcatgagttatattaccagccaggaaatgaaatgcattctgcattggttcgcgaattggtccggaccccagagagagcggttcttagaagacctggtcgccaaggccgtgcctgagaagcttcagccactactcgactccctcgaacagttgagcgtttctggagctgaccgcccaccctctatattcgagtgccagctccacttatgggatcaatggttccggggctgggccgagcaagagcggaatgaattcgtccgacagcttgaattcagcgagcccgacttcgtagccaaattctatcaggcagttgcggccaccgccggaaaggattag

SEQ ID NO: 27599 - DNA, 423 bp, Artificial Sequence
  Description of Artificial Sequence: Synthetic coding sequence
atgccactggagtcctcatcaagcatgccactgtcatttccatcattactgccaagcgtgccgcataacacaaaccctagcccccctctgatgagctatatcacaagccaggagatgaagtgcatcctccactggtttgcaaattggagcgggccgcagagggagagattcctcgaagaccttgtggctaaagccgtccctgagaagctccaacccctcctagattccctggaacagttaagcgtcagcggggctgaccggcccccttctattttcgagtgccagttgcatctgtgggatcaatggtttcgtggctgggccgaacaggagcgaaatgagttcgtgagacagctagagttctctgagccagattttgttgctaagttctaccaggccgtcgcagcaacggcgggtaaagactag

SEQ ID NO: 27600 - DNA, 303 bp, Artificial Sequence
  Description of Artificial Sequence: Synthetic coding sequence
atggaactcttaggcgagtacgtgggccaggaaggcaaaccccagaaactgcgggtctcctgtgaagctccgggagacggggatccatttcaggggttactgtcaggggtggcgcagatgaaggacatggtgacggaactgtttgaccccctcgtacaaggggaggtccagcatcgtgtggcagccgcccccgatgaagacctagatggagacgatgaggatgatgctgaggacgagaataatatcgataataggactaattttgatgggccttcagccaaacgcccaaaaacaccctcgtag

SEQ ID NO: 27601 - DNA, 1065 bp, Artificial Sequence
  Description of Artificial Sequence: Synthetic coding sequence
atggagtccgcactggcagttccccggttgccccctcacgatccagggaccccagtccttagtgttgtcgacatgcacaccggtggcgaacctctgcggattgtcctggccggatgccctgaggtctctggtccaacgctactggccaagcggagatatatgaggcaacatttagatcacgttcgccgccgtctcatgtttgagccccgagggcatcgcgacatgtatggagccgtgttggttcccagtgagctgccagacgcccacctgggagtgctgtttctgcacaatgagggatacagctctatgtgcggccacgccgtgttagccctgggccgttttgccctggactttggtctggtgcccgcaccccctgcaggcacgagagaagcccgagtgaatatacattgtccttgtggactggttacggcctttgtggcatgtgaagatggcaggagccatggtcccgtgagatttcactctgtgccagccttcgtcctcgctacagaccttatggttgacgtgccaggccacggcaaagtcatggtggacatcgcatacggtggagctttctatgcctttgtgaccgccgaaaaactggggctggatatctgtagcgccaagacaagagacctcgtcgatgctgcttctgcagtgacagaggccgtgaaggcccaatttaaaattaaccatccagatagcgaagaccttgcattcctctacggaacgattctgactgatgggaaggacgcatatacaaaggagcctaccactaatatctgcgtgtttgctgatgaacaggtggaccgcagtccgacaggctctggtgtgacagcccgcatcgctttgcagtatcacaagggcctccttgaattgaatcaaatgcgcgccttcaagagttccgccacaggctctgtgtttaccggcaaggccgttcgggaagctaagtgtggcgattttaaggcagtaattgttgaagtgtcaggccaggcccactacacaggcacggcctcgtttatcatcgaagacgacgatcccctgcgggacggatttctgctcaaatag

SEQ ID NO: 27602 - DNA, 267 bp, Artificial Sequence
  Description of Artificial Sequence: Synthetic coding sequence
atggccagctgcaccaaccgtggcggccttcccgagaagcactcaagctccaaagtctcgtctcatgcccagatgatccaaaaggctgtcgattttctggatctcctcattgggcacctgtctaaattcagtcccgtgctgatcgtgttccagtttagtcccctgggtttcctcgtcagacaatcaagcgctgacaatgtgcagttcctttcttttgctccatctttgatcttgccttcaggcacgggaaattggctcgtttggtag

SEQ ID NO: 27603 - DNA, 903 bp, Artificial Sequence
  Description of Artificial Sequence: Synthetic coding sequence
atggattggttccattgtaaccagtgttttcggaaagatggggcacatttttttgtgacctcctgtgggcatatattttgtaaaaaatgcgtgacgttggagaagtgcgccgtgtgtgggaccgcatgtaagcatcttgccttgagcgacaacctgaagccccaggaaaagatgttttttaagagtcctgtggagactgccctccagtacttttctcatatttcccaagtgtggtcgtttcagaaaaagcagaccgaccttctcatagctttttacaaacataggatcacgaaactcgaaaccgcaatgcaggaagcccagcaagcgttagtgtctcaggataaggaattatccgtgttgaggaaggagaacggagagttaaaaaagttcctggcgatcctgaaggagagcccaagcaggtaccagggaagcaggtcgattactccccggccagtgggtatcacttctccgtctcagagcgttacaccgcgccctagctttcagcactccagccaggtcgtgtcccgtagctccagtgcagaaagtatcccctaccgcgaggcgggctttgggtccctgggacagggaggccgaggactgcaaggtcggcgaacacccagagacagctataacgagacaccaagtccagcatcaacgcactcgctttcatataggactagctctgcctcttccgggcaaggcatcttcagtttccggcctagtccgaacggtcattcaggacacactcgggtcctgactccaaataactttgcccagagagaatcaacaactacactggagtcattacccagctttcaactccctgtgctgcagacattgtatcagcagcgtagacacatgggcctcccgtctggacgagaggcgtggactacctccagatag

SEQ ID NO: 27604 - DNA, 567 bp, Artificial Sequence
  Description of Artificial Sequence: Synthetic coding sequence
atggaagacgaacgcagctttagcgatatctgtggcggccgcttggcccttcagaggcgttactacagtcctagctgtcgcgaattttgcctgagctgcccacgtttgagcttacgaagcctcactgccgtgacttgcacagtatggctagcagcgtacggcctgtttaccttgtgcgagaacagtatgatcctaagtgctgcaatttttattacgctgctggggctcctgggttatctgcactttgtgaaaattgaccaggaaaccctgctgatcatcgatagtttaggaatccagatgacctctagctacgcgagtgggaaggagtcaaccacctttattgaaatgggcaaggttaaagatattgtcattaatgaggccatatatatgcaaaaggtgatctactatctctgtatcctgcttaaggaccccgtcgagccacatggtatttcccaggtggtgccagtgttccagagtgccaaaccaaggctggactgcttgatagaggtttatcgatcatgtcaagaaattctcgcccaccagaaagccacatccacatctccttag

SEQ ID NO: 27605 - DNA, 1467 bp, Artificial Sequence
  Description of Artificial Sequence: Synthetic coding sequence
atgcacatccagttccccagtaagccgacccttcccagagcctgctgggaaggccgcatcactgctgggtccccgggcatgccgcctgacgagattgagattgaacccgtacgtcagtcatcagacaagatgctgtattgcgaggcagagtcaccccccacagttgaaaaagtcaaaccagccagagaaaactcagaaaccgacctggaaattgaagatgatgagaaatttttcaccacaggtcaaaaggaactgtaccttgaggcgtgtaaattaatgggggtcgttccagtctcctacttcatccgcaacatggaggagagctacgtgaaccttaatcatcacggcctcggcccccgaggcactaaggcaatcgcaatcgccctcgtctccaatatggcggtgacaaagttggaactggaagacaactgcattatggaagaaggagtcctgtccctcgtcgaaatgctgcaggagaactactacttgcaggaaatgaatatctccaataaccacttaggactggagggtgcccggattattagcgattttttcgaacggaatagttcctctatttggagccttgaactctccgggaacgattttaaggaggacagcgcagctctgctatgccaggccctttcaacgaactaccagatcaagaagctagatttgtctcacaatcagttttcggatgtgggaggcgaacatctggggcagatgcttgctatcaacgtgggcctaactagcctggacctcagttggaataacttccacacaaggggcgcggtagcgttgtgtaacgggttgcgagggaacgtgaccctgacaaagttagacctcagtatgaatgggtttggtaatgaggtagccctggcgcttggcgaggtactcagactcaacaggtgcctggtctacctcgacatcggggggaacgatatcggcaatgagggagcaagcaaaatcagtaaagggctggagtctaacgaaagcttacgcgtcttaaaactttttctcaacccaattaacatggatggagctatcctcctgattctcgcaatcaaacgcaaccctaagagccggatggaagaactggacattagcaatgtgttagtttctgaacaattcatgaagacattggatggagtctacgctgtgcacccccagctggatgtcgtgttcaaagccgttcaggggttgagtcctaagaagactatctttctcttaaccaacccaatgaagttaatccaatcttacgctgaccagcataaaatcacgatcgtggatttcttcaagtctctgaacccgaccggcactatgaagatgtccgttgatgaattccagaaggtgatgatagagcaaaacaaggtccctctgaatcagtaccaagtgcgggaagtgatcaagaaacttgacgagaagaccggaatggtaaatttctctttcttgaatacaatgaagccttag

SEQ ID NO: 27606 - DNA, 561 bp, Artificial Sequence
  Description of Artificial Sequence: Synthetic coding sequence
atggataatgacaagccccttcagcccgaaacagaggatgagattgagatcgaacccgtaagacagtctagcgataagatgctctattgtgaggccgagagccccccaaccgtcgagaaagtcaaaccggcccgagagaactcagaaacagatctggagattgaagatgacgagaaatttttcactactggtcagaaggaactctacctggaagcctgcaaactgatgggcgtcgttcccgtgtcctactttattagaaatatggaggagtcttacgttaatctgaatcaccatggccttggccctcgaggcacaaaggccattgctatcgcattagtgagtaacatggccgtcacaaaattagagcttgaagacaactgtatcatggaagaaggggtactaagtctagtggagatgctgcaggagaattattatcttcaagagatgaatatttccaacaaccatttaggcctggagggcgccaggatcatttctgatttcttcgagagaaactcctcttcgatctggagccttgagctgagcgaccagctgcccaactag

SEQ ID NO: 27607 - DNA, 654 bp, Artificial Sequence
  Description of Artificial Sequence: Synthetic coding sequence
atggaggatagggccggagagcaggagcaggagagacactcacttcggcttgagaaactgcaacactgggcccgccatcgtcaaagcggccatctacttgtcctcgccgtatcacagctgtggctggccgtagtagtggtaccgctcgccgtctcggtcgcctgtctcaactcagactgccacatggcaacagcattgccgctagggcccggagcgagcggattactaactgggacggtgaccctggagctgcgtcgagcaccaaggctgtggaaggttagagctatgatgatcttcaacacgttcaatcttatactgggctttatagttgtggttgtcgaggtcatgaagaccgccctgggtccagccccaacagcctcgtctcagcatgcaggcctcctggtgttggagctctctgccgaagcattcaccttaggcggcgtgctggtaagcgttcacgccttgttccttttgtcacaacgcaaacccggttgctgtagatcccaaagtctgcactaccaggaacttcaggaaggattttcggaactggaagaagttcctgggctggagaatggtccaaccgtagcctccaccggcgcaaatgagagagtggggcagcgcgagcaaacaagagcagctctgttaccaccttag

SEQ ID NO: 27608 - DNA, 654 bp, Artificial Sequence
  Description of Artificial Sequence: Synthetic coding sequence
atggaagaccgggccggagaacaagagcaggagcggcactctctgcggctcgaaaagctgcagcattgggcacggcatcgccagagtggtcacctgttagtcctcgccgtgtcccagctctggctggccgtcgttgtcgtgcctcttgccgtgagtgtggcttgcctgaatagcgattgccacatggccactgccctgcctctcggccccggcgctagcggcctactgaccggcactgttaccttggagctgcggagggccccccgcctatggaaggtccgggccatgatgattttcaatacctttaatctgattctgggctttatcgttgtggtagtcgaagtgatgaagacagctctaggacccgcaccaaccgcaagctcgcagcacgctggtttactggtactggagttgtctgctgaagcgtttactcttggcggcgtgctcgtaagtgtccacgccctgttcttgctgtcacagaggaagccaggctgttgcagatctcagtcactccactatcaggaactccaagaaggcttctccgagctagaagaggtgccaggcttggaaaatgggccaacggtcgcctcaaccggagcaaatgagagggttggccagcgggagcagaccagggcagccctcctccctccatag

SEQ ID NO: 27609 - DNA, 378 bp, Artificial Sequence
  Description of Artificial Sequence: Synthetic coding sequence
atgcaccggaaggaacccggagcgcgtttagaggccacaagaggggcagcacgcccccacaagcagggcacgaaacccatgatcacgaggccatcagtgtctcagcttggagaagggaaatgcccgtcttcccagcatcttcaaagtctacggcataataaacaacacgccctcactctgacgaaggccaggtgctgtggtgagtgctcgacatgcttctgtacagaggaaaagagcgagtgtcagcgccacgaagagacatcccctggatcctgtaatcaccagatcatgtccgcatccactatctctgctttctgtgcaactcctaggttcaagcagctttttaaaggtaccgtcgagcagatgtctcagatgtag

SEQ ID NO: 27610 - DNA, 228 bp, Artificial Sequence
  Description of Artificial Sequence: Synthetic coding sequence
atgcatcgaaaggagcccggcgctaggttggaggccaccagaggggctgccagaccacacaaacaggggaccaagcccatgatcactcggcctagcgtgtcgcagcttggtgaaggtaagtgtccatcatctcagcacctgcagtctctcaggcacaacaagcagcatgcgctgaccttgacgaaagctcggtgttgtggagagtgctccacatgcttttgcacctag

SEQ ID NO: 27611 - DNA, 369 bp, Artificial Sequence
  Description of Artificial Sequence: Synthetic coding sequence
atgggccgggagatgaaaaagactggtacaccgcgtccattccggatagaggaccccaaccagcaacccacatggcacgatcagcccgaaatggggtctcattatttcgctcaggccggactcgagctcctgggcagctccaacccgcccgcgtctgcctcccaatccgctggtataaccggtgtctcacactgtgcgagacccggcgaacacgacctgaaccataccgtgttccaagttaaggacagcactttcctgaggcatcttgaatctgacaggcctgaattcaaatcatgtttgccaccacacttcacagaacctagcgtgtctctaagcacttccgaagggtgcgaagacgctatgggctag

SEQ ID NO: 27612 - DNA, 279 bp, Artificial Sequence
  Description of Artificial Sequence: Synthetic coding sequence
atgggctctcactactttgctcaggctgggctcgagttattgggctcttcaaacccgcctgccagcgcaagccagtcagccggaattaccggggtgtcccactgtgcccggccaggagaacatgatctaaatcacactgtgtttcaggtgaaggattccacgtttctgcgtcatctcgaatccgacaggcctgaattcaagtcgtgcctccccccccactttaccgagccttccgtgtccctttcaacttcagagggatgcgaggacgcgatgggctag

SEQ ID NO: 27613 - DNA, 114 bp, Artificial Sequence
  Description of Artificial Sequence: Synthetic coding sequence
atggggcgggaaatgaaaaagacaggaactccaagaccattccgaatcgaggaccctaaccagcagcctacctggcatgaccagccagggactgagtctgtcttttggctatag

SEQ ID NO: 27614 - DNA, 324 bp, Artificial Sequence
  Description of Artificial Sequence: Synthetic coding sequence
atgacaggccggatggctactctggagaagtctcacagctctgcctgttggaggaagcggagctcacggacttgtgtggaacccgatcggactcaggatgccatccacgaacccaggggtttaagtcggtcccacactgtcctgcggcacaggcactttgtgtttctccccttgtcctccggggcacacccaagtgtccctcctaggcgaaaaaattgtgctatgaaaaacgggaagcttctgaggtcatgttcttctgttagaagagccgcggacaagcttgactggggacggttttttctgcaggatctgcaaagtgtgtag

SEQ ID NO: 27615 - DNA, 1911 bp, Artificial Sequence
  Description of Artificial Sequence: Synthetic coding sequence
atgggacagggaccgagatcaccacacaaggtggggcggcgcttccctgccggcggcaaacggggccgtggggcaaagggttcgggacggccgctacctggacgcaaacgtcagccctggccaccacccgacggccggagcgagcccgcacctgacagccatccacacttatcccccgaagccctgggctactttcggcgggcgttatcggcactaaaggaggctccggagaccggcgaggagagagacctgatggtccataatataatgaaggaagtagagacccaggctctcgccctgtcaacaaacaggacaggctccgagatgttacaagagctgcttggattttccccactgaagcccctgtgcagagtctgggccgccttgaggagcaacctgcggacagtcgcatgtcataggtgcggggtgcacgtcctccaatctgccctactccagctcccgcgcctgttggggtccgcggctgaggaggaggaagaagaggaggaagacgggaaggacggccctactgagactcttgaagaactggtccttggcctggctgcagaggtgtgcgatgacttcctagtctattgtggagacacacatggatcgttcgtggttcggaccctgttgcaggtgttaggcggcacaatcctcgaatcagagagagccaggccccgcgggtcccagagctccgaggcccagaagaccccggctcaggagtgcaagcctgccgattttgaagtgcctgagacattcctgaacagactacaggatctctcttcaagctttctgaaggacattgctgtcttcatcacagacaagatctcttcattctgcctgcaagttgcactgcaggtgcttcacagaaaattgcctcagttctgcgctcacctctgcaatgctgtgattggctatttgagtactaggggctcgtccgttgacggctccccgctgcttcttttcttgcgcgaccaaacatcgtctaggcttctggagcaggtccttctcgtgttggagccccctcgcctgcagtctttatttgaggaacacttgcagggccagctccagacgctggccgcccatccaatcgcaaactttcccttgcagcggctgctggacgccgtgaccacccccgagctcttgtctccagtgttcgaggagctgagtcccgtattggaggccgtcctggcccagggacaccccggtgtggtaattgcgctggtaggggcctgtcggagagtgggggcatatcaggccaaggtcctgcagctgctccttgaagcgtttcactgcgccgaacctagcagcagacaggtggcttgtgtcccgctgttcgcaaccctaatggcttatgaggtttactacggcttaaccgaggaagaaggtgccgttccggcagaacatcaggtggcaatggcagccgcgagggcgttgggcgacgtcaccgttctcggttcactgttactgcagcacttactacattttagcacccccggcctcgtcctgagaagtttgggtgctctgactgggccccagctgttgagcttggcacagtcgcctgccggctcacacgtccttgacgctattttgaccagccccagcgtgactagaaagttgagacgtagagtgcttcagaatcttaaggggcaatacgtggcactggcctgcagccgacatggctctagggttcttgacgccatatggtcaggcgccgccctgcgtgccagaaaggagatagccgccgagctcggtgaacagaatcaggaactcatccgggatccgtttggacaccacgtcgctagaaacgtggccctcacaacattcctaaagcgtcgggaggcctgggaacaacaacagggtgcagttgccaaaaggagaagggcgcttaactccatattagaggattag

SEQ ID NO: 27616 - DNA, 564 bp, Artificial Sequence
  Description of Artificial Sequence: Synthetic coding sequence
atggcttatgaagtgtactatggacttactgaggaggaaggggccgtaccagccgagcatcaggtagccatggcagctgcgagagctctgggagacgttacagtgcttggcagcctgctgttgcagcatctgctgcacttctccacaccggggttggtgctgaggtccttgggcgcgttaaccggtcctcagctgttatctctggcgcagtctcccgcaggcagccacgtgttggatgccattctcaccagtccgagcgttacccgcaaactaagaaggcgagtcctgcagaacttgaagggccaatatgtcgccttggcctgttcacgtcacggctcaagggtgctcgacgccatctggtctggggccgctctgagagctcgaaaggagattgccgctgagttgggcgaacaaaaccaggagctcatccgcgaccctttcggacaccacgtggcaagaaacgttgcactgactaccttcttaaaaagaagggaggcctgggaacagcagcagggcgccgttgcaaaaaggcggagagccttgaatagcatcttagaggattag

SEQ ID NO: 27617 - DNA, 504 bp, Artificial Sequence
  Description of Artificial Sequence: Synthetic coding sequence
atggagctgagtagtatgaagatttgtgcggcaattcccaccagccgggccctaccggaggtcgtgcgccgcatgccccggaaaagaataagcgggttagaatggcttctccaacaggaccctggattcagtctggtgaacacagtgaaggctgggatgatcatttctttccccagtaataacatctattcaagtgtgtgctgctgccagagtgagatttttaagtacgagttcagcaactcaaagaaatctagttggatccaggaagaacgccatttgggcaagaacaacgtgctatatagcgcacacgacgtgtcacccgaaaaggtgacttctgccctcaagaagacaaataaacagactaccaccataaataacttccctttgcagtatctgcccggcagcaagctgctggatcgattcctctctctaagcaggtcactcctctgcttgaactcttggtcctctagtctgcccctggcccctcaggtcaagaagaaatag

SEQ ID NO: 27618 - DNA, 933 bp, Artificial Sequence
  Description of Artificial Sequence: Synthetic coding sequence
atgaagacactttttgaggaaatcaaggcctctatcaagaacaattacaaccaggataggtccttctgcaggcctgtgctgccatggggcggcgtgtttacgatcaaggccggtcgaaaagcagtgagttgtacacctctgtacgtagagattagactcaaaaatacctgtaccatcgatggttttctgatgctcctgtacgtgatactgaacgaaaatgaaaacttccccagagagctaagtcttcatttcggccgcgagttcgtggattgttttctgtatctcatggatacctatagcttcacgaccgttaaactcctgtggatatgggacaaaatggaaaaacagcagtataaatcagaggtgcataaagcaagcctcatcatcgatctgttcggaaacgaacatgacaatttcactaaaaacctggagaatctgatgtcgacaattcaggagagctactgttctaactggcggtgtcctacgcgagtgcaggaagatcaacagaggaccatcaacattaatcctccccaggagattcctcacggcaatttaatcagattggccgtcaacgaattattttgcagcaaaatcgaattgtgtgaagagcacgggtgcggcgggttgagggagttctcacagaggattttttgccacggcgcgccccctttcgttgttctgaacatgcagcattggaaaagcgaagatctggcttacgtcccttactacctggacctctccgatcacaaatacctcctggagggcgccaccctgtttaataaggaggagcaccattactccgctgcctttcaaataggaggacattggatgcattacgatggacttcgaaacgtgaatctgatccttctcaataaaccgccggagtttctgctgttgtcctctcttgtttatattagagccaccgaaaagtag

SEQ ID NO: 27619 - DNA, 2487 bp, Artificial Sequence
  Description of Artificial Sequence: Synthetic coding sequence
atggcgttgtccccgtggaccccggggctgggagccggcgagaagctggtgcaagccgccgccgtgtcaaccggaccttctttagagttatgtactctgccgtccactctaggatcaagcgtcgcggtggaggccctggaacagctctttgtggtagaacagtctttgcagagtgactactttaagtgtaacgaagaagccaagatcttcctaaaggacatagctgtggctgtcaaaaagctggaagaaatgaggaaggcgacaattgatctccttgagatagagagcatggaactaaataagttgtattatttactggagacactgcctaactcgatcaaacgggaacttgaggagtgcgtccgggacgccagaaggttaaatctgtttgaaattaacacgattaagatgcgaatcaccagaactgagaatgaaattgagctcctgaagaaaaaaatcaccgatctaacaaaatacaatgaagctttaggcgagaagcaggaggagctggcgcggaaacacgcaaggttcgtgttgtctcttaatcagaccatggaaaagaaagccacaacaacggtgtacattaacgagacatacacaaaaattaacctcaaacgcgaagacatcgctttacagaagaagtgtatccaagaggccgaagagctgatggagaaggagagagctgagtacctcatcagaaaacaagaactgaccgctcaaatcaacgagtttgagaacacacgcgaagtgaagaggatggagacatatcagaagaaaaaggaattggataagctgcaaacaaagatgagtaagatcaaagaaactgtcactgtgtccgcagccgtgcttagtgatcataatctggagattgcccggctccacgaatcaatcaggtactgggaacaagaggtcagcgaactcaagaaggacttggccatcctggaagctaaattgtgctttttcaccgacaataaggagaagctggatgacatcagtaacgacgagaagaacgagtttcttaacaagattaagcagcttgtggagacactgcatgcagctcggatggagtataaggacctgagggagaaaatgaaaaccctggccagacagtataagatcgtgctgagcgaggaggagaaagcgttcctgcaaaagcagaagatccacgatgagaatcagaagcagttgacattcatcagccagaaagaatacttcctgtctcagaagcgtgtggatatcaaaaatatggaggagggacttattaccctccaggagctccaacaggccactaaaactgtataccagcagcagattaagattctgtccgcaaatctcgagagagaaagccaaagatgtgtaatcactcagtggaaaatggcctgtctcagaaagaagcatgcacgctggacagctaaaatcaaggccgagatccaagctattaccgaaaagatccagaatgcagaggtacgtcgtatcgaactgctcaacgaaacctccttccggcagcaggaaatttcaggctttgtggcccagattgagaagctgacaacggagctgaaggaggaggaaaaggcattcgtgaacaaagaaaagatgctaatgaaagagctgtcgaaatacgaagaaatcttcgtgaaggaaacccaaatcaataaagagaaagaggaagaactggtcgaatatctccctcaattgcaggtagcggagcaggaatataaggaaaagcgccgcaaattggaggagctgtctaatatcattacagcccagcggcaggaggaggatctcctcaacaatcacattttcctcttcaccagagatttttcccgatatatttctaatatggaagacgtcaaacaggagctacaacagctgagagatcaggaaagcaagaaaaacaaagatcactttgagaccctcaagaatctagaaaacgggttctacatcaacgatcaaaaggccgacttattactcttggaaaataagaagctgaaagagtacattctctatcttaagaataatatcgaaaagtatcgggagggacaagaagcactgatgcatacaagctcagatctgagtaggcagctgattgctcaggaggcccagtataaggatctgtgggccgaattccagaccaccgtgaagatcctggttgacaatggcgaagagaccctgcaggatattaataatctgacagataaactccgcgagagggacgaaaagatgcagcacgtgtcaacatggctccgcggtagcctggaaggtttaaggctcctggttgagcaggaatcaccgatggatctcctcagcaagcagcagttgagggctttactagttacgtctaaggaagagaaaacctgccaactgtcagacctggtgatccctaattacgccaccaatattcaactcaatatagacacatacttgggactcaacaccctggtggtactgtccaatagcgcattccacctgagagagttttcccgatag

SEQ ID NO: 27620 - DNA, 2382 bp, Artificial Sequence
  Description of Artificial Sequence: Synthetic coding sequence
atggccttgagcccctggacgcctgggttaggtgccggggagaagctggttcaagcagcagccgtctccacaggcccctcactcgagttgtgtactctcccatctaccttaggttcttcagtcgcggtggaagcattagagcagttgttcgtcgtggaacaatcgctgcagtctgactatttcaaatgcaatgaagaggctaagatcttcttaaaggatatcgctgttgccgttaaaaaattagaagaaatgagaaaggcgacaatcgacttgcttgaaatcgaatccatggaattgaacaagctgtattatctgctcgagaccctgcccaactccattaagcgagaactggaagagtgcgtgagagatgcgcgcagactcaacctcttcgaaatcaacaccatcaaaatgagaattacacgtaccgaaaatgaaatcgagttgctgaaaaagaagatcactgacctcacgaaatacaacgaggccctgggcgagaagcaggaagagctggcccgtaagcacgccagattcgtgttatcccttaaccaaacgatggagaagaaagccacaaccacagtatacattaatgagacgtacactaagattaacttgaagagggaggatatagcacttcagaagaagtgtattcaggaggccgaagagcttatggagaaggaaagggcagagtatcttattagaaagcaggaattgacagcccagataaatgagttcgagaatacaagagaggtcaagaggatggagacctaccagaaaaaaaaagagctcgacaaactgcagactaagatgtctaagatcaaggagactgtgaccgtgtcggccgcagtactgagcgaccacaacctggaaattgcacgacttcatgaatccattcgttattgggagcaggaagtgagcgaactcaaaaaggatttggccatccttgaggccaaattatgtttctttaccgataataaggagaagctggacgacattagtaacgatgagaagaatgagtttttgaataagattaaacagctggtggagactctacacgccgctcggatggagtacaaagatttgagagagaagatgaaaaccttggctcggcagtacaaaatcgtgctctctgaggaggaaaaggcattcctccaaaaacagaagattcacgacgaaaaccagaagcagctgaccttcatttcccagaaggagtacttcctcagtcagaagcgggtggacataaaaaatatggaggaaggcctcatcacactgcaggagctccaacaggctaccaagactgtgtatcaacaacaaattaagattttatctgctaatctggaacgagaatcacaacgttgcgtgatcactcagtggaaaatggcttgcttgcggaaaaaacatgcaaggtggacggccaagattaaggccgaaatacaggcaatcaccgagaagattcagaatgccgaggtgcggagaattgaactcttgaacgagacttctttcagacagcaggaaatctcagggttcgtagcccaaatcgagaaactgaccaccgaactgaaggaagaggaaaaggcatttgtcaacaaggagaaaatgttaatgaaggagctcagcaagtatgaggaaatcttcgtcaaggaaacacagatcaacaaggaaaaagaggaagagctggtggagtatctgccccaacttcaggtggctgagcaggagtacaaggaaaagagaaggaaattagaagagctctcaaacatcattaccgcccagagacaagaagaggatcttctgaacaatcacatattcctcttcacgcgagacttcagtaggtatatcagcaatatggaagacgttaagcaggagcttcagcagctccgtgaccaggagtccaagaagaataaggaccatttcgaaaccttgaagaatttagagaacggcttttatattaacgaccagaaagcagatcttcttttacttgagaataagaagctgaaggaatatattctatacctgaagaataacattgaaaagtatcgtgagggacaggaggccctaatgcacacatcgagcgacctttcgcgccagctgatagctcaggaagcacagtataaggacctttgggctgagttccaaaccacagtcaagattctcgtcgataacggcgaagagactctgcaggatatcaacaacctgaccgataagctgagggaacgtgatgaaaaaatgcagcatgtatccacttggctacgtggctctcttgaaggtctgcgtctgcttgttgaacaggagagtcccatggacctgttgaagaagaagaaacacataaggaccagagtacatttcccggttgtgaaatgtacagaaaaaaacacattaactaagtag

SEQ ID NO: 27621 - DNA, 1764 bp, Artificial Sequence
  Description of Artificial Sequence: Synthetic coding sequence
atgaacgatagtcttttcgtgtcgcttgatagattgctgctggaatttgtattccagtacgaacaggacattagcaccaaagaggagatgattcaaagaatcaacaaatgctgtgaggatatcaaggagaacaaggtgacaatctgtcgcatacatgagaccatcaacgcgacagacgaggaaatagatcactattgtaaacacagtgaagagattaaggataactgccggaattggaagcccacatgtgacgtatttcgaaagcacgaagattatatgcaggatcagtttaccgtttatcagggtactgtcgaaaaggacaaggaaatgtatcatgattacatttgccagtataaggaggtgttaaaacagtaccagctgaaatacagtgagactcctttttcccgcgagtattacgaaaagaaaagagaacacgaggaaattcagtcgcgagtcctggcctgcacagaacagcttaaaatgaacgaaactattttcatgaaattccgagtcccagcgccttttcccagcttaactaagtggaccctcaatatcgtaaatctgcgatgcgagactcaggacattctgaaacatgcatctaacttgactaagagctcatcagaactcaagaaggaagttgacgaaatggaaatcgagatcaactacttgaatcagcaaatctcccgccataatgagactaaggccttaagtgagactcttgaagagaagaacaagaatactgagaatagaaaggagttgaaggagcgaattttcgggaaagacgaacatgtcttgaccctcaataagacccagagcagtcagctgttccttccctacgagtcgcagaaactcgttcgtccgattaagatgcacagctctgagccccgtgtggctgacattaaagaggagtcctcggccaagcagtccaagttggccaatatcgattttaggcaaaaggagaatgatacacagattttcaatgatagtgcagttgacaaccacagcaaatgtagccacatcaccacaataacatccagtcagaagtttatgcaggttcgcctccttacaccacagaaacagagtaacagtaaccagtggtcagaaaagggggacaaagatgcggaatatggcgataaagggacggtacggcaagtccgcgaatctaaatgcacctcccaggctatatacaccgaacactttggcaagagcgtggaaaatgactccgatgaggtggaggagagagctgaaaatttccctcggacatcagaaattcctatctttctgggaacgccaaaggcggtcaaagctcccgaatctttggagaagatcaagtttccaaagacgcctcccttcgagatcaatcggaacaggaacgctgtgcctgaggtccagactgaaaaggagagccctgggctgagcttcctaatgagctatacctccagaagccccggattaaatctatttgattcctctgtttttgacacagagatttcttccgatcagtttaatgaacactattctgctcggaaccttaaccccctctcctccgaacaggaaattggcaacctcttggaaaaacccgaaggcgaggacggatttaccttctcattcccctccgataccagtactcacacgttcggagctggtaaggatgattttagtttcccatttagctttggccaaggccagaattcgattccgtccagctcgcttaagggcttctccagcagctctcagaatacaacccaatttacctttttctag

SEQ ID NO: 27622 - DNA, 267 bp, Artificial Sequence
  Description of Artificial Sequence: Synthetic coding sequence
atgaacgacagcctgttcgtatctttagatcggctccttctcgaattcgtctttcagtacgagcaggatatcagcaccaaggaggaaatgatccagagaatcaataagtgctgcgaagatattaaggagaataaagtgacaatatgcagaattcatgagacaatcaacgcaactgacgaggagattgatcactattgcaaacatagtgaggagataaaggacaactgcaggaattggaaaccgacatgcgacgtatttcgtaagtag

SEQ ID NO: 27623 - DNA, 1590 bp, Artificial Sequence
  Description of Artificial Sequence: Synthetic coding sequence
atgccatctaaaggtaaggataagaaaaaaggaaaatctaagggtaaggataccaagaagttaatcaagaccgatgagagcgtggtggatagggccaaggctaatgcgtcactgtgggaagctcggttggaggtgactgagctgagtaggattaaatatcgggatacctcacgcatcctcgccaaatcaaatgaggacctgaagaagaaacagtgcaaaatggaaaaagatatcatgtctgttttgtcctacctgaagaagcaggaccaagagaaggacaatatgatcgaaaagttgaaacagcaactcaacgagactaaggaaaaagctcaggaagagaaggacaagcttgaacagaagtatacaaggcagatcaacgagttggaaggacagttccaccaaaaggccaaggagattggaatgatccacaccgaactgaaggccgtgcgacagtttcagaagagaaagatacaagttgaacgggagctggacgacctgaaggaaaacctgagaaatacagagcggatccaccaagaaaccttgaggagactagagagtagatttttcgaagagaaacacagattggaacaagaggctgaaaagaagattattatgctagcagagagggctcaccacgaggccatagtccaactgaatgacgcagggagaaatgtcttcaaagaaaacgactacctgcagaaagccctggcctaccatcttaaagagaccgacgcactgcagaagaactcccagaaactgcaggaatcacacacccttctgcttcatcagaaggaaattaatgaccttctggttaaggaaaagatcatgcagctcgtgcaacaacgatcccagatccagaccctccagaaaaaggtggtcaatttagaaactgcactgagctatatgacaaaggaattcgagagcgaggtactgaagctacagcagcacgccatgatcgaaaaccaggccggacaggtcgagattgacaagctccagcatctgctgcagatgaaagaccgagagatgaacagggtcaaaaagctcgccaaaaatatcctggacgaaagaaccgaggtagagcggttcttcttggacgccttgcatcaggtgaagcaacaaatcctcatatcccggaagcattataaacagattgcgcaggcggcctttaacctgaagatgcgtgcggcttgtaccggaaggaccgagtaccccaaaatacgcacctttgatggaagagaacactccaccaacagcgtgaaccaggacctcttagaggcagagaaatggacgcatatcgaaggcaacgtcgatatcggcgatctaacatgggagcagaaagaaaaagtgctgagacttcttttcgctaagatgaacggctgtccttcaagaaagtataaccagagcagccgaccaccagtaccagattatgtggtcagcgattcaggagaaactaaggagttcggggatgaatccaagctgcaagataaaatattcatcactcagcagatcgcaattagcgactcaagcggagaggtggtgctccccacaatacccaaggagcctcaggagtcagacacaggaacattttag

SEQ ID NO: 27624 - DNA, 798 bp, Artificial Sequence
  Description of Artificial Sequence: Synthetic coding sequence
atgcaacttgtgcagcagcgatcgcagattcagacgctgcagaaaaaggtggtcaacctggaaactgctctctcatatatgactaaggagttcgaaagcgaggttctgaaactgcagcaacacgccatgattgagaatcaagccggtcaggtggagattgacaaactccagcacctgctgcaaatgaaggatcgcgaaatgaatcgtgttaaaaaactcgctaaaaatattctcgatgaacgtacagaagtggaacggttttttctggacgctctgcatcaagtaaagcaacagatcctgatctctcgtaagcattacaaacagattgcacaggccgcgtttaacctgaagatgagagcggcatgcactggccgtaccgagtacccaaagattcgtacctttgatgggcgtgagcattccacgaacagcgtcaaccaggatctgctagaggccgaaaagtggacgcacattgaaggaaacgtcgatatcggggatcttacctgggagcaaaaagagaaagttctgagattactctttgcaaaaatgaacgggtgcccttcacgcaagtataatcagtcatctagaccccccgtcccagactacgtggtgagcgactctggagagaccaaggagttcggcgatgagtcaaagctacaggacaagattttcataacccagcagattgcaatttctgatagttcaggcgaagtggtgctgcctacaatccctaaagaaccccaagaatctgatacgagcacgcagaaaccctccgatgaaaacttttccacttcatactag

SEQ ID NO: 27625 - DNA, 384 bp, Artificial Sequence
  Description of Artificial Sequence: Synthetic coding sequence
atgcctacgatgtggcggatgttacatcaggctctgaagctgcgcagacggaccgtgcttgccggacaggagatatcgtacgttctccccgtcatgttcgtcgtgagtgaggaggatagcaaccgggacgtgtttctggttgctggatatagacatctcgaattcggtgaacggatcgctatatggggttcaagcatgcagcatgtggaaagacgacgctggcccctggacagcatccagaaaagaatgggacagtccttcactggttgggctgaagaggccgctcctggcatgaaaacaaagaaggagtatgccgagataggagtgaagccaaggcagaacgcttgcgaaatgtgccccggcatgatcctcagcactacttag

SEQ ID NO: 27626 - DNA, 978 bp, Artificial Sequence
  Description of Artificial Sequence: Synthetic coding sequence
atgcagggccgcagagagctgggaggcgaaccgctctctgacctccaagaagaagccgcaagcgctagccttagagtagcgcctgaacggctgagcgacgactcattagaatggaggagaacatgccccgatctcctattatcggacggcaaagcatctatcagcatgccccgcgaaggggggtccacttgtaccgccagatgccccgatcccggcgaacattctagcacatggggtgaatttgagggattcagagagtctagcgctaagagtggacagttcagccaaagcttggaacttctagagggtcctacggagcctcaaccaccaagaactacttccgctccgaaggaatgctcatcccatcagccttgtcagggggggccctgggtgacaggaactagcgcggttccacctagcgaacccatccttagttacgagaatatcttaaaatgcgccttccaagaaatcacagtacaacaagccgccgaggacgtcagtacaattgatcattttttggagatctcctccgaggagaaaccaggggtggagagagtgcacaagctgtgcaatgagtcccgtaagctgtggagggccctgcagtccatccataccactagtacctcccagaggctctggagcgagagccgctgtcaggaaaacttctttctggttcttggtatcgatgccgcccagaagaatcttagtggcggacaaggccacattatggaagattgcgaccttaaggagcctgaggggcttctcaccgttagttcgttttgcctccagcactgcaaagcccttattcagactaaactgtctggcccgccggggtccaagcagggacgccttatgacttgctccaggtttctgaagacccctagttgtggaggagggcaacacatcactatacctagaaaaaggatgttcactccccgcaagcttaagctaaccctctttaattcagacgtctgttag

SEQ ID NO: 27627 - DNA, 1065 bp, Artificial Sequence
  Description of Artificial Sequence: Synthetic coding sequence
atgtctgggcagcgaggagactgggtgcagacatcggctctgtggcagctgctctttagggtgctgagccctctgcccgccggtaatgctctagcctccctcgctttggaagtacaggcgagactggtaaaaagtgccctgtgttcacagggatatcctcgtctagctttagcacagcttccagaggacgggagtcagggctctagagaattattattggccctgagctggctgctggcgcggggtcccgtccccgagcagatgctcgcccaggccagagtacctctgggagatgagatgacagtctgtcagtgcgaggctcttgcaagccctgggcctcctgccccccatatggaggcagaaggtccagtcgatgtgaggcacgtccagtggctgatgggcaagctgagattccgatggagacagctcgtatccagtcagcaagagcagtgcgcacttcttagcaaactactcaggactctggaacgggaaaaccagagactggaggccgtcctcgcctggaggcgctctgagcttgtgttttggaggtggatggacacggttttagggacatgtgccccggaggtgcctgcagccgcaagtcagcctaccttcctgccctgggtcccagagaggggaggaggcgagcttgacctggtggtgagagagctacaggcccttgaagaggagcttagagaggccgcagaacgcagacgggctgcatgggaagccaaagctggcggatgcggcaggggccccgagtggtctgcagctcgtcgggccagcagggaggccgtagagaaagagctcggtgcgctgcagcagtgttgggaaagggatggcggaccagctcaaccgcacggaccccatcgtctggtgagaagagaagatggcgcagccggggacagggacctgagagcagcagtcgttatccggacgttgcgttcccaagaggcgtgtcttgaagccgtgctgcggagattacagggacagtgtcgccaggaactcgcccggcttgtgggcgccagacctggacttatatggattccaccgcctggccgttag

SEQ ID NO: 27628 - DNA, 1059 bp, Artificial Sequence
  Description of Artificial Sequence: Synthetic coding sequence
atgtcagggcagcgaggcgactggacaagcgccctgtggcagttattgttcagggtgctaagcccactgcccgccggaaacgcactggcgagcctggcactcgaagttcaggcgaggctagtaaagtctgccctttgttctcagggttatccaagactcgccctcgcccaacttcctgaagatggaagccaagggtcaagggagctgctacttgccctctcctggctgctagctcgaggccccgtgcccgagcagatgctagcgcaagcgagggtcccattaggggacgagatgacagtctgccagtgcgaggccttagcgtcccctggtccacctgccccccacatggaggctgagggtccagtggatgtgcgccacgtgcaatggctaatgggcaagcttaggtttcgctggcgacagctggtgagctcccagcaagagcagtgtgccctcctcagtaagctactgagaacactcgagcgcgaaaatcagcggctggaggctgtgctcgcgtggcgtaggagtgaactggtattttggcggtggatggataccgtgctgggcacctgtgctcccgaggtcccggcagccgcctctcagcccacgttcctgccttgggtccccgagcggggcggaggagaacttgatttggtggttagggagctgcaggctctggaggaggagctacgggaggccgcggaacgaaggcgcgccgcatgggaagcaaaagcggggggatgtgggcgaggtcccgagtggtcagcagcacggcgggcatcccgggaggccgtagaaaaagaactgggagccctacagcaatgctgggaaagagatgggggccctgcccagccccacggccctcaccggttagtgcggcgcgaagatggtgcggccggcgatcgggacctccgggccgcagtggttataaggactctaagatcccaagaggcatgtctcgaagctgtattgaggaggctccagggccagtgccggcaggagctcgccaggttagtgggggcacgcccgggactcatatggattccgccaccaggcagatag

SEQ ID NO: 27629 - DNA, 1182 bp, Artificial Sequence
  Description of Artificial Sequence: Synthetic coding sequence
atgggtcggcgtcgccaaagagtggatcccgcagccggggccagagccggcgccctcccggaggccatcgccgcgctgtcccgaagcctcccctctggtccctccccagagatctttcgccgggccaaatttgaccggcccgaggccacatctgctctctggcagctgctcttcagggtgctttcacccttacccgccggaaatgccctcgcctctctggctctcgaagtgcaggcccggttggtcaaaagtgccctctgttcacagggctaccccaggcttgcgctggcacagctgcccgaggacggaagccaaggctctcgggaactcctgctcgcactttcatggctgctggctcgcggcccagtacccgagcagatgctggctcaggcccgcgttcccctcggcgacgaaatgacggtctgtcagtgtgaggccctggcaagtcctggaccaccagcccctcacatggaagcggaaggcccagtcgatgtcaggcatgtccagtggctaatggggaagttgagattccgatggagacagctggtctcatctcagcaagaacagtgcgctctgttgagtaagctcctacggaccctcgagcgggagaatcagagactcgaagcagtgctcgcttggagacgatcagagctggtgttctggaggtggatggatacggtactggggacttgcgcacctgaagtccccgctgcagcttctcagcccacattccttccttgggttcccgaacggggaggcggtgagctggacctggtggtacgcgaacttcaagcactggaagaggagttgagagaggctgcagaaagacgaagggcggcttgggaggccaaggcggggggctgcggacgcggccctgaatggtcagcagcccgacgagcctcaagggaggctgtggaaaaagagctgggtgctttacagcagtgttgggagcgggacggtggacccgctcagccacacggaccccaccgtctggtgaggagagaggacggcgcagctggggaccgtgacctcagagctgctgtggttattagaacactgaggagccaggaagcctgtctggaggctgtgctgagacgactgcagggacagtgcaggcaagaactagctcgcttggtgggggcccgtcctggacttatttggatccctccccccggtcgctag

SEQ ID NO: 27630 - DNA, 1281 bp, Artificial Sequence
  Description of Artificial Sequence: Synthetic coding sequence
atgggcagacgtcggcaaagggtggatcctgctgctggagccagagcgggggctttgccagaggccattgccgctctgtcccggagtctcccaagcgggccgtctcccgagattttccgccgggcaaaattcgatcggcctgaagcaacttccgccctctggcagctgctcttcagggtcctgtccccccttccagccgggaacgccctggccagcctggcactcgaagtccaggcacgcttagtgaagtccgcattgtgcagccaggggtatcctagattagcattagcgcaactcccggaggatggatctcagggctcgagagagctcctactcgctctttcttggctgcttgcccggggcccggtgcccgagcagatgctggcacaggcgagggtgcccttaggcgatgagatgactgtgtgtcagtgcgaagcgctcgcatcccccgggccgcccgctcctcacatggaggcagaggggcccgtcgacgtacgccatgttcagtggttaatgggcaaactacgtttcagatggcggcaactcgtgagttcacagcaggaacaatgtgctttactatcaaagattcatctttacacacgcggttgccactctgaccagtccctgtctcatctatcagtgacagaggcggagatgcttcgtgatcccgaaggcgggcaacagctgctcaggaccttagaacgagagaaccaacgcctcgaggccgtgctggcatggcgtcggagcgagctagtgttctggaggtggatggatacagtcttagggacctgcgcgccggaggtcccagcggctgcctctcaacccacattcctgccatgggtgccggaacgcggggggggggaactcgacctcgtagtcagggagctacaggctctggaggaggaactgcgcgaggcggcggagaggcgcagggcggcttgggaagccaaggccgggggttgcgggaggggtcccgaatggtccgcggcacgacgagcatcacgagaagcagtggaaaaagagctcggcgccttgcagcagtgttgggagcgagacggagggccagcccagcctcacgggccccatcggctggtgcggcgagaggatggggccgcgggggacagagacctgagggccgctgtggtcataagaacattgaggagccaggaggcttgtctcgaggcagtgctgcggaggctccagggccagtgtcgccaggaacttgctcgattggtcggcgccaggcctgggctgatttggatcccgccgccaggccgttag

SEQ ID NO: 27631 - DNA, 1488 bp, Artificial Sequence
  Description of Artificial Sequence: Synthetic coding sequence
atggggaggaggcgacaacgggtcgaccccgccgccggcgctcgagctggagctctccctgaggctattgcagcactgagccggtcccttcctagtgggccgtcacccgagattttccgccgcgctaagtttgacaggcccgaagctactagtgccctgtggcaattgctgtttagggtcctgtcgcccttgccagccggcaacgccctggcaagtctagcactggaggtccaggcccgcctggtgaagtccgcattatgttctcagggatacccgagacttgcgctggcacagctgcctgaagatggctcacaaggctcccgagaactgctgctcgccctgagttggctgctggccagaggccccgtgcctgaacaaatgttggcgcaggcccgggtaccgcttggcgacgagatgacagtttgtcagtgtgaagctttggcatctccaggtccacctgcccctcacatggaagccgaagggcccgtggatgtccgtcacgttcagtggcttatggggaaattacgcttccggtggcgacagctggtctcctctcagcaggaacagtgcgccctgctgtctaagatccacctgtacaccaggggatgccactccgaccagtcgctgtctcacttgtctgtgacagaggctgagatgctccgtgatccagagggcggccaacaggtgagcggggcaggcgcagcccagaatctggatttagcttacccaaaatgtctgcactctttttgcactcccgggatgggtcccagaactttttggaatgacctttggctggtttgtgagcagcctggtctgcttccgggagactgggccgctccactggatcctggcggagccagcgcctgtagcctactttcacccttccgggccctcctcaggaccctggaacgggagaaccagcgcttggaggccgtgctggcttggaggcggtctgaactggttttttggcgctggatggatacagttctcggcacatgtgctcctgaggttcctgcagccgcttctcaacccacctttctgccttgggtgcctgaacgagggggcggggaactggatctcgtcgtcagagaactccaggcgttggaggaggaactgagagaagcagctgagcgccgaagggctgcttgggaggccaaagccggcgggtgcggcaggggtcctgagtggagtgccgcgagaagggcttcccgtgaagccgtcgaaaaggagttaggggcactgcagcagtgttgggagcgggatggggggcctgcccagccccacgggcctcatcgcctcgtgagacgggaagacggggcagctggggatcgggatctgagggccgctgtagtcataagaacattacgaagtcaggaagcttgcctcgaagccgttttgagacgtctgcagggacagtgcaggcaggagttggcccgtcttgtaggagcccggcccggactgatctggatcccacctcctgggcgctag

SEQ ID NO: 27632 - DNA, 1059 bp, Artificial Sequence
  Description of Artificial Sequence: Synthetic coding sequence
atgtctggccagcgtggagattggaccagcgcgctgtggcagctgctgttcagggtgctgtcccccttgcccgcaggcaacgcactggcatccctggcgctggaagtacaggcccgtcttgtgaaatccgccttgtgtagtcaggggtatcctcggctggccttagcacagctgcctgaggatggctctcagggctctagggaactgctcctcgcgctgagctggctcctggccagaggcccggtgccagagcaaatgctcgcacaggcacgcgtcccattgggcgatgagatgaccgtttgtcagtgcgaggctctggcctcccctggaccgcctgccccacacatggaggccgagggaccagtcgatgtgcggcatgtgcagtggctgatggggaaactgcggttcaggtggcgccagctcgtcagctcacagcaggagcagtgtgccctcctgtcaaagctgctgcggactctcgagcgtgagaaccaaagactagaggcggtgttagcttggaggcggtccgagctggtgttttggcggtggatggatacggtgctgggcacatgcgcaccagaagtgcccgccgccgccagtcagcctactttcttgccttgggtacccgagcgcggcggaggggaactcgacctggtggtccgggagctgcaggcgctggaggaagaattgagagaagcagccgaaaggcgccgtgctgcctgggaagccaaggcaggcggctgcggccggggccctgagtggagtgctgctcgccgggcctcccgcgaggctgtggaaaaggaactgggagctctgcagcagtgttgggagagggatggcggccccgctcagccacatggtccccacagactggtccgtcgcgaagacggagcagctggcgaccgcgacctgagggctgcagttgtgataaggaccctacgatcccaggaggcttgtttggaagcggtcctccggcggctgcagggccaatgtaggcaggagctcgctcggcttgtgggcgcaagacctggactgatttggatcccaccgccaggtcgatag

SEQ ID NO: 27633 - DNA, 474 bp, Artificial Sequence
  Description of Artificial Sequence: Synthetic coding sequence
atgctggcccaggcacgcgttcccctgggagatgaaatgacagtctgccagtgcgaagcacttgccagtcctggcccccctgctccacacatggaagccgaagggcccgttgatgtcagacatgttcagtggctgatgggaaagttgcgctttcgatggagacagttggtctcttcacagcaagagcaatgcgcccttctttctaagatccatctgtataccaggggatgtcattctgaccagtctttgagccacttatccgtgacagaggcagaaatgttgagggaccccgagggcggccaacagctactgcggaccctcgaaagggagaaccaacggctagaagcagttctggcctggcgcagatccgaattggtgttctggcgctggatggatacagtgttaggaacctgtgcgcccgaagtccccgcagcagcctctcagccaacttttttaccatgggtccccgaatag

SEQ ID NO: 27634 - DNA, 243 bp, Artificial Sequence
  Description of Artificial Sequence: Synthetic coding sequence
atgagcggtcaacgcggcgattggacctccgcgttgtggcaattgctgttccgagttctgagcccgttgccagcaggtaacgccttggcatctctggcgctggaagtacaggctcggctagtaaagagcgctctttgttcacaaggctacccgcgccttgctcttgcacagctcccggaagatggatcccagggcagtagggagctcctgctggcactgtcttggctgctggcccgcggctag

SEQ ID NO: 27635 - DNA, 333 bp, Artificial Sequence
  Description of Artificial Sequence: Synthetic coding sequence
atgtctggtcagcgaggcgattggactagcgcactttggcagctgcttttccgggttctgtctcccctccctgctggaaacgcccttgccagcctggcgttggaagtgcaggctcggttggttaagagtgcactgtgtagtcaaggttatcccagactggcgttggcccagctgcccgaagatgggtcccaaggtagtcgcgaacttctgctggcacttagctggctcttggccagggggccagtccccgaacagatgctcgcccaggccagggtgccacttggagatgaaatgactgtgtgtcagtgcgaagcactagcatctcccggatag

SEQ ID NO: 27636 - DNA, 747 bp, Artificial Sequence
  Description of Artificial Sequence: Synthetic coding sequence
atgttagcacaggcacgggtgccactgggcgacgaaatgacggtttgccagatacacttgtacaccagagggtgtcactcagatcagtctttgtctcacctcagtgtgactgaggcggaaatgctgcgggacccagaaggtgggcagcagctcttgcgtactttggaacgggaaaatcagagactagaagccgtccttgcctggaggcggtctgagcttgttttttggagatggatggacacagtgctcgggacttgcgctccagaggtcccagcagcggcttcccaacctacttttcttccctgggttccagaacggggcgggggtgagttagatttggtggttcgggagttgcaggctttagaagaggagctgagggaagctgcagagagacgtcgggctgcttgggaggccaaggccgggggatgtgggagaggtcccgaatggtccgccgcaagacgtgcttctagggaggcagtggaaaaggaactgggcgcactgcagcagtgttgggaacgggatggcggccctgcacaacctcacggaccgcatcggctggtgcgtcgagaggacggcgcagctggagacagagacctgagggcagctgtcgtgatccgaaccttgcgctcccaggaggcgtgcctagaggccgtgctgaggagattacagggacagtgccggcaggaactggcacggttggtgggcgctcgtcctggcttgatctggattccccccccgggccgatag

SEQ ID NO: 27637 - DNA, 165 bp, Artificial Sequence
  Description of Artificial Sequence: Synthetic coding sequence
atgttagctcaggcccgagttcccctgggggatgaaatgaccgtgtgccagtgtgaagctttggccagtccaggcccaccggcaccacatatggaagcagaaggaccagttgacgtgagacacgtgcagtggcttatgggcaaactgcgatttagatggagatag

SEQ ID NO: 27638 - DNA, 597 bp, Artificial Sequence
  Description of Artificial Sequence: Synthetic coding sequence
atggctaccgctgagcccagcggcagggccctgaggttgtcgacaccaggccctaggccctccggagcccgtgacagagcccccggggctgccggcccacccagtggacaaatcggcaatcgcgctttgcgtctgggggagagaacacctgcagcagtggagaagcgcggcccgtacatggtaacaagggccccctctatccaggccaaactgcaaaagcaccgggatcttgccaaggccgtgttgcgcagaaagggcatgttgggggccagcccaaaccggcccgactcctcaggaaagaggagcgtgaagttcaataaaggatacactgccttgtcccaatcccccgatgaaaatctggtttccttggattctgacagtgacggcgaattgggatcaagatacagctctgggtactcttccgccgaacaggtgaaccaagacgtaagtcgccaattattgcaagatggttatcatctggatgaaattccggacgacgaggacttggacctcatcccgcccaaaccaatggcctcgtctacctgttcctgttgctggtgctgtctcggcgactcatcctcctgcaccctgcaatag

SEQ ID NO: 27639 - DNA, 447 bp, Artificial Sequence
  Description of Artificial Sequence: Synthetic coding sequence
atggctacggcagaaccctctgggcgcgccctccggctttcaacaccagggcctcgaccgtccggcgcaagagacagggccccgggcgcggccggacccccatctggccaaatcggtaaccgggcattacgtctcggagaaagaacgccagctgccgtggagaaacgcggcccctatatggtcacacgggccccgagcatacaggctaaactgcagaagcacagggaccttgcaaaggccgtgctgaggcgcaaaggcatgctgggggcctccccgaaccgacctgatagcagcggcaaaagatccgtgaagtttaacaaagggtatactgccctcagtcagtcccccgacgagaacttagtttctctggactctgacaggcctttcatgtatatcccaggccccttttcttcggaacagtacccttttccgggctggttggggtag

SEQ ID NO: 27640 - DNA, 906 bp, Artificial Sequence
  Description of Artificial Sequence: Synthetic coding sequence
atggcacaaaatgtctatgggcccggtgtacgcattgggaactggaatgaagatgtgtacctggaagaagaattgatgaaggatttcctggaaaagcgtgataaaggaaaactgctcatccagaggtcacgcagactgaagcaaaatctgctccggcccatgcagctgagtgtgaccgaggatggatatatccattacggcgacaaggtaatgctcgtgaacccagacgatccagatacagaggccgacgtgtttctgcggggagatctgtctctgtgcatgactccagatgaaatacagtcacacctgaaggacgagctcgaggtcccatgcggcctttccgccgtgcaggctaagacccccatcgggaggaatacgttcataattcttagcgttcatcgggacgcaaccggacaggtcctgcggtatggtcaggatttttgcctgggcatcacaggtggatttgacaacaagatgctctacttaagtagtgaccacagaactctgctgaagtcctctaagcggagctggctccaggaggtgtatctgaccgacgaggtgtctcatgtcaattgttggcaggccgcatttcccgatccgcaacttagactcgaatatgagggctttcccgtcccagcaaatgccaagattctgatcaaccattgtcacaccaacagagggctggctgcccaccgacacctgttcctaagcacctactttgggaaagaagccgaagtagttgcccacacatacctcgatagccacagagttgagaaacccaggaaccattggatgcttgtgaccggaaatcccagagatgcctcgtccagtatgttggacttgccaaaaccaccgacagaagacaccagggctatggagcaggccatggggcttgacacccagtag

SEQ ID NO: 27641 - DNA, 600 bp, Artificial Sequence
  Description of Artificial Sequence: Synthetic coding sequence
atgaaggacttcctggagaagagggataagggaaagcttctgatccagcgatctagaaggcttaaacaaaaccttctgaggcctatgcagctgagcgttaccgaggacggctatatccattacggggataaggtcatgctggttaaccctgacgatcccgatacagaggccgacgtgttcctccgcggagaccttagcctttgtatgaccccagatgagatccagtcgcacctgaaggatgaactggaggtcccctgtggactcagtgccgtacaggccaaaacccccataggacgcaacactttcatcatcctgtcagtccatcgcgacgccacggggcaggttctccgctacggccaagacttttgcctgggtatcacagggggatttgacaataagatgctgtatctaagttctgaccatcgcaccttactgaagagctctaaacgtagttggctccaggaggtgtatctgaccgatgaggtgtcccacgtgaattgttggaacatgaaagcaagcccgtccaggcaaatgttgaagttctcctctattacggtgacacagattggcgattggcaaccaactgggatcttcagctag

SEQ ID NO: 27642 - DNA, 537 bp, Artificial Sequence
  Description of Artificial Sequence: Synthetic coding sequence
atgaacaaacgcacatccgtagacgcatctaaagaggacctgcatccagctgatccacagagcggtgaaggcgtgcctcccaaccggaagaataccaagacctctccccggggcgagggcacagccccccctttcagcgcccggccttgcgtttggaccctctgcgaaatgctctctatccttgcactggtaggcgtgttgcaccccttctaccggagtaataatcaagtttatcagaagctcaagacacacctgagatgtcagtccagccgtgtggatggcctgatgctaaagccaacactactgaccccctcacagctcaagtctccagaggggcacctcatcctgcccactttcaaccacctggtaattaggcacattctcgaccccaagcagattttctgcgtggctgacgtctgcactgattgcaagtttaattgtggctccattgagaggcatcagaaacgccacttaatgcgcgtgtcccaggactgggagcacctcatccgctatcggaatcagatatgtctcagttag

SEQ ID NO: 27643 - DNA, 1527 bp, Artificial Sequence
  Description of Artificial Sequence: Synthetic coding sequence
atggcaggtcagagaacctgccaacggcgttctagtcgggctggccccggcaagatgcaggaacctcctaagagcattgaagaattcctaaagtttcaaaactgggattattggcctcgcgagatacatttcagggacgacgataagtggtcttgcacactaaagaagattaaagaggatagtagtttcgtgagcatctacacccacctatgggagaacgtgccccggatttttgaggccctgttgattatggagtctaagttaaaggaatactctctgattctgcagaaccacaccagcgaaatattcaagtggaaaagcatgatctctgagacaagctcctataggaaattggagcgatacggggagtttctgaagaagtatcataagaagaaaaagatcatgttatctgatgagatggaaaccgagaagaatatcgaggggtgctccttcaccggcttcaaggccaacgagttgactcagctcccccggcacctcgacgccgaacagatctatctatttattttaaaagcccataactttgatgagcgggtgtttaagatatggaagacgcatttcctgtcggaggcatctattgcgttgctccacgactccttttggtggtggttcttgcataagttccgccctgaccgcgagaatcaggactgtttatttgaccgaatttctgagagttatgtgacactgtttatgtctatacccctcagccgcaaagacgccttttttcagatatatcctgattgcctcgcacaggcgatatacgccacatttcatgaagcgttcccggagtccagctatctgttcaatgacgaattcaaagaggacctgggaaataacatctttctgtggtgcagtgggttgaagccccagaagggcttttggatccattggaaactcaaagagttatcgaccaccacaattcatggatcaaaaaaggcccctgccaagtccgtcaaggagcgtatcgctgatagtcaggagcatataagcacaagtattgatttcaatataattaaaatcctgaataaccccagggcatatacgctgcctattagcaaggaagagagccggctatcacgcctggccaccaagagtcactactcttctacgggacccgagttcaatcgggttttattcaactttggcggtcagtcgcctctcatactatattatctcaaaatgcatgaactggccgggatcagcaaagcgcccaagaagacaaaaattaagttaaccaagatatttcaggaacctttgcccgccccaacctacagggacgttatcaaggaggccaaaaggcagttcgctcgtaaccagaaggacttcagaatactgcaggcaaaagccactaagaagccccatgaggtaaagcaagactttgagaaattccttcataaactgcgctctgaggcagaaatagaacgtgaatgtgtggcttccttaagcagctccagctcaagctccccttcaagtaccgataactacaactttgaagaggaggagtattag

SEQ ID NO: 27644 - DNA, 912 bp, Artificial Sequence
  Description of Artificial Sequence: Synthetic coding sequence
atggcaggccagaggacgtgccagaggagaagctcccgcgccggacctggcaagatgcaggaaccacccaagtctatcgaagagttcctgaagtttcaaaactgggactactggccccgggaaatccactttagggacgacgataaatggtcctgtacccttaagaaaatcaaggaggactcaagcttcgtgtctatttatacccatctgtgggaaaacgttccaagaatcttcgaggctttgctaatcatggagagtaaactgaaagagtatagtctcatcttgcagaatcatacctctgaaatatttaagtggaaaagcatgatctccgagacttcatcctacagaaagcttgaacgttatggggagttcttaaagaagtaccataaaaaaaaaaagattatgttgtcagatgagatggaaaccgaaaagaacatcgagggttgctctttcacaggcttcaaagctaacgagctcacacagctgccgcgccacctggatgctgagcagatctacttgtttattcttaaagcccacaattttgacgaaagggtattcaagatttggaagactcatttcctgagtgaggcttccatcgccctcctacatgatagtttctggtggtggtttctccacaaatttcggatttatcccgattgcctcgcccaggctatttatgccactttccatgaagccttccccgagtcctcatatttgttcaatgacgaattcaaggaagacctggggaacaacatattcctttggtgtagcggtctgaagccacagaaagggttctggatccactggaagttgaaagagttgtccacgaccacaatccatggctctaagaaagcccctgccaagtcagtgaaggagagaatcgcagattcccaggaacacatatcgacgtag

SEQ ID NO: 27645 - DNA, 549 bp, Artificial Sequence
  Description of Artificial Sequence: Synthetic coding sequence
atggccggccagcggacatgccagagaagatcctctagggccggaccggggaaaatgcaggaacctcccaaatccatcgaggagttccttaagtttcagaactgggattactggccgcgggagatccatttccgagacgatgacaaatggtcatgcacactaaaaaagatcaaagaggactctagcttcgtcagcatttatacacacctttgggagaacgtgcctaggatttttgaggctctcttaattatggaaagcaagttgaaggaatacagtctgattctccagaaccatacttcagaaatattcaaatggaagtcaatgatttccgagacttcatcttaccgtaagcttgaacggtacggagagttcctgaaaaagtaccataaaaagaaaaaaattatgctttcagacgagatggagaccgaaaagaacattgagggttgtagttttaccgggtttaaggcaaatgaactgacacagctgcccagacacttggatgccgaacagatttacctttttattctgaaggcccataacttcgattag

SEQ ID NO: 27646 - DNA, 915 bp, Artificial Sequence
  Description of Artificial Sequence: Synthetic coding sequence
atggcaggacagcgaacgtgtcaacgccggagttccagagccggaccaggaaaaatgcaggaaccccccaaatctattgaagaattcttgaagttccagaattgggactactggccccgcgagattcacttccgggacgacgacaagtggtcctgtaccttgaaaaagattaaggaagactcctcatttgtcagcatctacacacacctgtgggagaatgtgccgcgaatcttcgaggctctgctaattatggagtctaagctgaaagagtacagtctgattcttcagaatcataccagcgaaatcttcaagtggaagagtatgatcagcgaaacctcttcctaccgaaagctggaacggtatggcgaatttctgaaaaagtaccacaagaagaagaagattatgctgtcagacgagatggaaactgagaagaacatcgaaggttgcagcttcaccgggttcaaggccaacgagctaacgcagttgccaaggcatctcgacgcagaacagatttatctcttcattctgaaggctcacaattttgatgagcgagttttcaaaatctggaagactcactttctttccgaggcgtccattgcactccttcatgacagtttttggtggtggtttcttcacaaatttcggatctatccagactgcttggcgcaagcaatttacgccacctttcatgaagcctttccagagtcaagctatctgttcaacgacgagtttaaggaggacctgggcaacaacatattcctatggtgttccggcctcaagcctcagaagggattctggattcactggaagttaaaggagctctccacaacgactattcatgggtccaaaaaggcgcccgctaagtccgtcaaggaaaggatagccgacagtcaagagcatatctcaaccagctag

SEQ ID NO: 27647 - DNA, 393 bp, Artificial Sequence
  Description of Artificial Sequence: Synthetic coding sequence
atgccaaggcccgccagtgagagctggagccccatccaaagcaggattcccgcttacaaagctgttagtcatctgagactgctcccgactgcaaacagtcccagcggttcaaatcagcctactaaccccaaccgagcccagcaccctgagggcccacaaagccgcgagggtgccacttcccctgtgctggcctctctggaaccccccactccaactgacctgcccagcgccagggccagacccagggtgccggctgagtccgggcctggctggcttcacaaagctaggcgccctaccagaggcatcctcagagatgtactccgtcacagaggagtgcccgcacagcctagacccgcccctggggcgcaccaactgagtagtccttcaagctag

SEQ ID NO: 27648 - DNA, 681 bp, Artificial Sequence
  Description of Artificial Sequence: Synthetic coding sequence
atgagccgaatataccacgacggggctttgcggaataaggctgtccagagtgtcaggctgcccggagcctgggatcctgcggcccatcagggtggcaacggtgttctcctggaaggagagctgatagacgtctccaggcattcgatcctggacacccatggtagaaaagagagatactacgtcctgtacattagaccaagtcacatccatcggagaaagttcgacgctaaggggaacgagattgagcctaatttttcggcgaccagaaaggtcaacaccgggtttttgatgagcagctacaaagttgaggctaaaggggatacagaccgcctgacgcccgaggcactgaagggattggtgaacaagccggaactcctggccctgacagagagcttgactccggaccacactgtcgctttctggatgcctgagtctgagatggaggtaatggaattggagttgggtgctggcgtgagactaaaaacccgcggtgatggacctttcctggatagcctagccaagttggaagctggaaccgtcacaaaatgcaacttcacaggcgacgggaaaaccggcgcatcctggacagacaacatcatggcccagaaatgctcaaagggtgccgccgctgagatccgtgagcagggtgatggagccgaagatgaagagtgggacgattag

SEQ ID NO: 27649 - DNA, 3144 bp, Artificial Sequence
  Description of Artificial Sequence: Synthetic coding sequence
atggcggaaaagcgtccgctgcggaccttaggtcccgttatgtatggcaaactcccgcgcctcgaaacagacagcggtctggagcactctctccctcattcagtcggaaatcaggacccctgtacttacaaagggagttacttcagttgtccaatggctggaacgcctaaggctgagtcagaacagttggccagctggacaccctatcctccactgtacagcacaggcatggctggtccccctctccaggcggacaacctgctcaccaattgtcttttttaccgctctcccgcggagggccctgagaaaatgcaggacagctcccccgtggagctcctaccattttcacctcaagcccattcctatcctggtccacccctagcagctcccaagccagtctatagaaatcccctgtgctacggtctctcaacctgtctcggtgagggtgcggttaaacgccctctggacgtggattggaccctggcgaccgggccactcttaccatctgctgacccaccatgcagcctcgcccccgcaccatcaaaaggccagactttagatggaaccttcctgcggggcgtgcccgccgagggcagcagcaaggacagcagtggttcatttagcccatgtcaaccgtttctggagaagtaccaaacaatacactccaccggcttccttgctagcagatacaccggcccataccctcggaactctaaacaagctatgtctgagggcccttcttccccatggacccagctagcacagcccttggggccaccatgccaggacacgggacccacccactacccgcccccccaccatccgcctccacaccccccacaggctctaccatgccccccagcctgccgacaccccgaaaaacagggaagctactcaccagcactgccactgcagcccttaggtggccacaagggtacgggttaccaggctggagggctcgggtcgccctacttgaggcagcaggccgcccaggctccctacatcccgccgctgggccttgacgcctacccatatccatcagcccccttacccgcgcccagcccggggctgaaactagagccccccttaacaccccggtgcccgttggactttgcacctcagaccctcagttttccctatgcgagagatgacctgtccctgtatggcgcctctcccggtctcggggggaccccacctagtcagaacaatgtgagagcagtcccacagccgggagctttccagcgggcatgtcagcccctccctgctagccagccgtgttcagaacccgtgaggcctgcccaggaggctgaggaaaagacctggttgccatcttgcaggaaagagaaactgcagccacggttaagtgaacactctggcccacctatcgtaataagagactcacccgtcccttgcactccaccggccctgccaccttgtgcgagagagtgtcagagtctgcctcagaaagaaggagccagaccaccgagctccccaccaatgcccgtgatagataatgttttctctctggccccctatagggactacctcgacgtccccgctcccgaggccaccacggagcccgacagtgctaccgccgagcctgactccgcccccgcaacctcagagggacaagataaaggctgccgcggcactttgcccgctcaggaaggtccctctgggtcgaagcctctcaggggctcactgaaggaagaggtcgcactggatttgagcgtacggaaaccaaccgcagaagctagccccgtgaaagcctcgagatcggttgagcatgctaaacctacggccgccatggatgtgcccgatgtcgggaacatggtcagtgacctcccgggattgaaaaagatcgataccgaagcgcccggcctgcctggggttcccgttaccaccgacgccatgcctagaactaatttccactcatctgtggctttcatgttccgcaagttcaaaattctgcggcctgcgccactgccggccgctgtagtcccttcaacaccgacatcagctcctgctccaactcaaccagctcccactcccacaagcggaccgattggactgcgtattttggcgcaacagccactcagcgttacttgtttctctctcgcgctgcccagcccgccagcggttgctgttgcctctccagcccccgcccctgccccttctccagctcccgctcgagcacaagctccagcctccgccagggaccccgctccagcgcccgctcccgtggccgggcctgcccccgcctcaaccagtgctcctggcgattctttggagcagcactttactgggttgcacgcaagcctgtgtgatgcaattagcggcagcgttgcccattcccctcctgagaagctgagggagtggctggagacagcgggcccctgggggcaggctgcttggcaggactgccaaggggtgcagggactcttggcaaagctgttaagtcaacttcagaggttcgacaggacccacagatgccctttcccacacgttgtaagggccggagcaatctttgtgcccatccacctggtgaaagaacgcctcttcccgaggctcccccccgcaagtgtggaccatgtgctgcaggaacatagggtcgaacttcgaccaacaacactgtccgaggagcgcgccttgagggaattggccctacccgggtgtactagccgcatgctgaagctcctggctctccggcaattaccagacatttaccccgatttattgggtttgcaatggcgggattgtgtccgtagacagctgggagacttcgacactgaggccggggcagtctccagctcagagccaactgtcgcgcggggtgagcccgaatctctggcactggctcagaagagccccgccccaaaagttaggaaaccgggacggaagccccctacaccgggtcccgaaaaggctgaggctgctgctggggaggaatcatgtggtgcctctcctacccctgctacctctgccagcccacccggtcccaccttaaaggcgaggtttagatccctcctcgagaccgcatggctgaatgggctcgctctcccaacatgggggcataagtcaagtagaccggaccagccctccccctgccctcagctgctcgattcgcaatcacatcacctgtag

SEQ ID NO: 27650 - DNA, 3144 bp, Artificial Sequence
  Description of Artificial Sequence: Synthetic coding sequence
atggctgagaaacgcccactgcgcacactggggccggtgatgtacgggaagctcccccgcttggagacagacagtggactcgagcattcactgcctcactctgttggcaatcaggacccatgcacctataaaggctcatacttcagctgccctatggcgggcacccctaaggctgaaagtgagcagctggcctcctggactccttatccgccactatatagcacaggtatggccggtccaccgctccaggccgataacctcctcaccaactgtttattttacaggtcgcccgctgagggacctgaaaagatgcaggacagctccccggtcgagctgctgcctttttcacctcaggctcacagttacccgggacccccactggcagcccctaagcccgtttacagaaatcctctgtgttatggcctatccacatgccttggtgaaggcgcagtgaagcgaccgctcgatgttgactggactctggcaactggaccattgttacctagcgcagacccaccctgttcactggcccccgccccttcaaaaggacagacgcttgacggtacattcctgaggggggtacctgccgagggatcttccaaagattcaagtggcagctttagcccgtgtcagcccttcctggaaaagtaccaaacgattcattccaccgggttcctggctagccgatacacgggtccatatccacggaatagtaaacaggccatgtctgaaggtccttcatccccctggacgcagctagcccagccactggggcctccctgccaggacaccgggcctactcattatccacctccacaccaccctccaccacaccctccccaggccctgccctgcccccccgcttgtcggcatcccgagaagcagggcagctattctcctgctcttcccctgcagccactcgggggccataagggcactggctatcaggccggggggctcggttccccatacctgaggcagcaggcggcccaagcaccatacattccacctctgggattggatgcatatccatacccctccgctccattgccggctccgtcacccggtcttaaactagagcctccgctgactccacggtgtcccctagacttcgcccctcagaccctaagtttcccatacgctcgggacgacctgagcctgtacggtgcgtcacccggtctcggagggacaccaccttctcagaataatgtcagggccgtgccacagccgggagcatttcagagagcctgccagcctttaccagcctcgcagccctgctcggaaccagtgcgcccggctcaggaggccgaggagaagacctggctgccctcctgccgtaaggaaaagctacaacctcggctgtccgagcattcaggtcccccaatcgtgattcgcgactcccccgtcccatgtaccccccctgcccttccgccttgtgctcgggaatgccagtcgcttccacagaaagagggggcacgtcctccatctagccctccaatgcccgtgattgacaacgtgttctcgctcgccccatatagggattacctggacgtccctgcacctgaagccaccacagaaccggatagcgctactgcagagccggatagcgcacccgcaactagtgaagggcaggataaaggctgccgaggaaccctccccgctcaagagggacccagcgggagcaaacccctccgcgggagcctgaaggaagaagtggccttagacctctccgtaaggaaacctaccgccgaggcatcccctgtcaaggcctcacggagtgttgagcatgctaagccgacagcagccatggacgtcccagatgtgggtaatatggtctcagatttacctgggctaaaaaaaattgataccgaggcccccgggcttccaggtgtacccgtgacaactgatgctatgccgcggacaaacttccatagcagtgttgcctttatgtttcgcaagttcaagattttgagaccggcacccttaccggccgccgtagtgccttctacgcctacctctgcccctgcacccactcagcccgctcctactccaacatccggaccgatcgggttgcgtatcctggcccagcagcccctctctgttacctgcttcagcctggccttgcccagtcctcctgctgttgcggtggcatcccccgcacctgctccagctccctcgcctgccccagctcgtgctcaagcaccggcgtcagctagggaccccgcccccgcaccagccccagtcgcaggcccagctccggcctccacctcagccccgggggacagcttggagcagcactttaccggtctgcacgcaagtctttgcgatgcaatatcaggctctgtggcccattcacctccagagaaactccgggagtggcttgagacagctggaccctggggccaggcagcgtggcaagactgtcagggcgtgcaaggattgctggccaagctgctgagccagttgcaaaggttcgatagaacacatcgatgcccctttccccatgtcgtgagggccggagccatatttgtgcccatacatctggtcaaggaacggttatttcctcgacttccacccgcctccgtggatcatgtgttacaggaacatcgagttgagctgaggccgactacactgtccgaagaacgagccctccgcgagctcgccctcccaggctgtacctcacggatgttgaagcttctggcactgcgtcaactcccagacatttatcctgatctgctggggctacagtggagagactgcgtacggcgccagcttggcgacttcgatacagaagctggcgcggttagctccagtgagcctactgtggctcggggggaacccgagtcgctggccttagcccagaagagtccggcgcccaaggtacgtaaacccggtagaaagccacccacgcccggccccgaaaaagccgaagcggctgccggcgaagaatcctgtggcgcatctcctacgcccgcgacctccgcctcaccacccggacctactctgaaagcccgctttagaagcttattggagacagcttggctaaatggtctggcgttgcccacttggggccacaagagcagcaggccggatcaaccgtccccctgtccacagttactggacagtcagagtcaccacctgtag

SEQ ID NO: 27651 - DNA, 1338 bp, Artificial Sequence
  Description of Artificial Sequence: Synthetic coding sequence
atggatgtccccgatgttgggaatatggtgagcgacctgcctgggttaaagaagattgacaccgaagctccagggttacccggggtgcccgtgacaacagatgcgatgccgcggaccaacttccactcatctgtggccttcatgtttcgcaagttcaagatactgagacctgcaccccttcctgctgctgtggtgcccagcacgcccactagtgcacccgccccgacgcagcctgcccccacaccaactagcggccctatcggcctcagaatcttggcccagcagcccctgtccgtgacctgcttctccctggccttaccctctcctccggcagtggcagtggcctcgcccgctcctgctcctgccccatccccagcccctgctcgcgctcaggcccctgcgtctgctagagatccagccccggcccccgcacccgtcgctgggcccgcacccgcttccacctcagcccctggggacagccttgagcaacattttacagggctgcatgctagcctgtgtgacgcaatcagtggaagcgtggcccattcccctcccgagaagttaagagagtggctggaaactgccggtccctggggccaggctgcctggcaagactgccagggggttcaaggcctgctcgcaaaattactgtctcagctgcaacgatttgacagaactcataggtgtccttttccccacgttgtaagagcaggcgccatattcgtgcctattcatctcgtcaaagagcgcctcttccctcgcctccctcctgcttctgtggaccatgtcttgcaggagcaccgggtcgagctgaggcctactactctcagcgaggagagagccctgagggagcttgcactccccggttgcacctccagaatgttaaagcttctcgctttgaggcaactcccggatatttaccccgatctgctcggccttcagtggcgggattgtgtccgaaggcaactcggcgactttgatacagaggcgggtgccgtgtcatcatctgagccaaccgtcgcccggggggagcccgagtctctggccttagcccagaagtcacctgcgccaaaggtgcggaagcctgggcggaaacctcccacccccggccccgaaaaggcagaggcagcagccggcgaagaatcctgcggtgcctcacccacgccggccacgagcgctagccccccgggtcctacgctcaaagctagatttaggagtctgctggagactgcctggctgaatggactcgccctaccaacctggggccacaaatctagccggccggaccagccttcaccttgtccccaactcctagattctcagtcacatcacctatag

SEQ ID NO: 27652 - DNA, 381 bp, Artificial Sequence
  Description of Artificial Sequence: Synthetic coding sequence
atgcccaaaaaagcaggcgccactaccaagggtaaatctcagtcaaaagagccggagcgacccctacccccgctgggtccagtggcagtagacccaaaaggttgtgtgacaattgccattcatgctaagccaggatcgaaacaaaacgcagtgaccgatctgacagccgaggcggtgaacgtggccatcgctgccccccccagtgagggcgaggccaacgccgagctttgcaggtatctgtccaaagtgctggagctgcgcaaatctgatgtggtacttgataaaggtgggaagtctagagaaaaggtggtgaagctgctagctagcaccacccctgaagaaatcctggaaaaattaaagaaagaagccaaaaagacctag

SEQ ID NO: 27653 - DNA, 504 bp, Artificial Sequence
  Description of Artificial Sequence: Synthetic coding sequence
atgttaagactccgatccggactgcggcacctacgtgctacccccaacacgagaggatcagccagattactttgtgctgagatgcctaagaaggctggagccacaactaaaggcaagtcacagagtaaagaaccagagaggcccttaccacccttaggccctgtggcagtagaccctaaaggctgtgtgacgatcgccattcacgcgaagcccggctccaagcaaaatgcagtgacagacctgaccgcagaggccgttaacgttgcaatcgccgcgccaccttccgagggggaggccaatgccgagctgtgtcgatacctttccaaggttttggagctccgcaaatctgatgtggtgctggataaaacagggtcctgctacattgctcaagcggggctggaactgctggcttccagcgatctccccgcctctgcctctcagtccgccggcataacaggggtatcacaccacacacagcccgcattattactcatttccctctag

SEQ ID NO: 27654 - DNA, 462 bp, Artificial Sequence
  Description of Artificial Sequence: Synthetic coding sequence
atgttaaggctgcggtccggacttcgccacctcagagccacacccaatacacgcggctccgcccggctgctctgtgctgagatgccaaagaaggcgggggctactacaaaggggaaatcacagtcgaaggaaccagagagacctctcccgccgctgggccctgtggccgtcgacccaaaaggttgcgtgacaattgcaatacatgcaaaaccaggatcaaaacagaatgccgtcactgacctcactgccgaagccgtcaacgtggcaattgccgctcctccttcggagggggaggccaacgcagaactgtgtcgttatctttccaaagtcctagaattgcgaaaatccgatgtggtgctggacaagggggggaagtcacgggagaaggtggtcaagctgctcgccagcacgacccccgaagagatccttgagaagcttaagaaagaagccaagaaaacgtag

SEQ ID NO: 27655 - DNA, 450 bp, Artificial Sequence
  Description of Artificial Sequence: Synthetic coding sequence
atgctgcgattgagatccggcctgcgacatcttcgagctactcctaatacccgcgggtcagcacgcctcttatgcgccgagatgcccaaaaaggccggagcgaccactaaaggtaagtcacagtcgaaggagcccgagagaccactgcctccactgggcccagtggcggtcgatccgaagggttgtgtcacaatagctattcacgcaaagccaggaagcaaacaaaacgccgtcactgacctgacagcggaggccgtgaacgtggccatagccgctccccccagtgagggcgaggccaatgccgagctgtgtaggtatctgtcaaaggtgttagagctgcggaagtctgacgtcgtcctggataaactctgctattctattccccagcaacttgaggagacccaggagggggtgagtgggattccagacacaccatgtcacttcctttag

SEQ ID NO: 27656 - DNA, 552 bp, Artificial Sequence
  Description of Artificial Sequence: Synthetic coding sequence
atggccaggctcatactggaaaggttcttgcaagagcatgaagaaacacccccttctaagagcattataaattccatgctgagggacccaagccagatccctgacggagtgctcgcaaatcaggtgtaccaatgcatcgtcaatgactgttgctatggccccctagtggattgcattaagcatgcgatagggcacgagcatgaggtgctcctgcgagatctgctgctcgaaaaaaatcttagctttctcgacgaggatcagttgcgggccaagggatatgacaaaaccccagacttcatcttgcaggtgccggtggctgtggagggacacatcatccactggatcgaaagcaaagcctcttttggtgacgagtgctctcatcacgcctacctgcacgatcagttctggagctattggaataggttcgggccaggcctcgtaatttactggtacgggttcatccaagagctagattgtaacagggagagaggaatcctgctgaaggcatgtttccctaccaacatcgtcaccctgtgccactctattgcatag

SEQ ID NO: 27657 - DNA, 846 bp, Artificial Sequence
  Description of Artificial Sequence: Synthetic coding sequence
atgattctgaccaaagctcaatatgacgagatcgcacagtgtctggtcagcgtaccacccacgagacagagcctacgcaaactcaaacagcgtttcccatcgcagagtcaagccaccctgctttctatcttcagtcaggaataccagaagcacattaaacggactcatgccaagcaccatacctctgaagcgatcgaatcttactaccaaaggtacctcaacggcgtggtaaagaacggcgcagcgccagtgctgctggaccttgcgaatgaagtcgattacgccccttccctcatggcccgcctaattttggaacgtttcctgcaagagcatgaagaaactccccccagcaaaagcatcatcaactcaatgttacgggatccttcccagatccccgacggtgtgctcgctaatcaggtatatcagtgcatcgtcaatgactgttgctacggaccactggtggattgcatcaagcacgctatcgggcacgaacacgaggttctactgcgggacttgctgcttgagaagaacctgagctttctggacgaagaccaactcagagctaaaggttatgacaaaactcctgattttatattgcaagtgcccgtagccgtggagggccatattattcactggatagagtccaaagcctcctttggggatgaatgcagtcatcacgcatacctgcatgaccagttttggtcgtactggaacaggttcggccctggcctcgttatttactggtacggcttcattcaggagctggattgtaacagggagcgtggcatactgctgaaagcttgctttcccactaatattgttactttatgccattcaattgcgtag

SEQ ID NO: 27658 - DNA, 552 bp, Artificial Sequence
  Description of Artificial Sequence: Synthetic coding sequence
atggcccgactgatcttagagcggtttctgcaggaacacgaggaaactccaccaagcaagtctatcattaactctatgctcagagacccatcccagatccctgatggagtactggccaatcaggtgtaccagtgcattgtcaacgactgctgttatggacctttagtggattgcattaaacatgccatcgggcatgagcatgaggtacttctgcgtgaccttctgctggaaaagaacctgtcgttcttagacgaggatcaactgcgcgccaagggctacgataagacccctgatttcatcctgcaggtccccgtggcggtcgagggacacattatacattggattgagtccaaggcgtcgtttggggatgagtgcagtcatcacgcctatctccatgaccaattttggtcttactggaacagattcggccctggcctggttatctattggtatggattcatccaggagctcgactgtaatcgcgaaagaggcatactgttaaaggcgtgttttccaactaatattgtgactctgtgtcacagtatagcgtag

SEQ ID NO: 27659 - DNA, 663 bp, Artificial Sequence
  Description of Artificial Sequence: Synthetic coding sequence
atgtttcaaggccagcgtggttggttctgtggcagtgttagtcaggatttacggcagttctgggtagccgagggtggcacaatttcggatccccgggccgctgatttcctcttctcatgcgatgcttctcatcctgacacactgcgtatttaccagtctctggattacattgaagacaatgccaccgtgtttcatgcttactacctgtccgctgtggcaaacgctaaaattaagaacagcgtcgctcttggacatttcattttgccgccggcctgtctgcagaaagaaatacggcggaaaattggatctttcatctgggagcaggaccagcactttctaatcgagaagcatgacgaggtgacacccaacgagattaagacgctgagggagaattctgaactagcgaccgaacacaagaaggagctcagtaagtcgccagagaaacacttcattcggaccccggtggtggagaagcagatgtatttcccactccagaattatccggtgaacaatatggtcacggggtacatttctatcgacgccatgaagaagtttctcggcgaactgcacgatttcatccctggcaccagtggatacctcgcttaccacgtccagaacgagatcaatatgtccgcaatcaagaacaagctgaagcgaaagtag

SEQ ID NO: 27660 - DNA, 1557 bp, Artificial Sequence
  Description of Artificial Sequence: Synthetic coding sequence
atgccaactgtggtggtgatggatgttagtctctcaatgacacgccccgtgagcatcgaggggtcagaggagtatcagcgcaagcatctggcagcccatggcctgacaatgctattcgagcacatggccacgaactacaagctggaattcaccgccttggtcgtgttttccagcctgtgggaacttatggtgccatttaccagagactataacacacttcaggaagccctgtccaatatggatgactacgacaagacttgtcttgagtcagccctggttggggtgtgcaatatcgtccaacaggaatgggggggagccattccctgtcaggtcgtgctggtaaccgacggatgcttgggaattgggcgcggatccttgcgacactccctcgctacgcagaaccagaggtcagagagtaaccgctttccattgcccttcccgttcccatccaaactttatatcatgtgtatggccaatctggaggagttgcagagcaccgacagcctggagtgcctcgaaagattgattgatctgaataacggggaaggacagatattcaccatagatggcccgttatgtctgaaaaatgtgcagtccatgtttggcaaactcatcgacttggcatataccccgttccacgcggttttaaaatgcggtcacctcactgcagacgtgcaggttttccctagacctgagccatttgtggtcgatgaagaaatcgatccgattcccaaggtcataaataccgatctggagattgtcggctttatcgacattgccgatatctctagccccccggtgctgtccagacatctcgtgctgcctatagcactgaacaaagaaggggacgaagtgggtaccggcatcacagacgacaacgaagacgagaatagcgctaaccagatagcagggaagatccccaacttctgtgtgctcctccacggatcgttaaaggtcgaaggtatggttgccatcgttcaactcggccccgagtggcatggaatgctttatagtcaagctgatagtaagaaaaaatccaatcttatgatgtctttgttcgagcctggtcctgaacccttaccatggcttggcaaaatggcgcaactaggccccatttcagatgccaaggagaatccgtatggggaggacgacaacaagtctccattccccctccagcccaagaacaagaggtcctatgcgcagaacgttaccgtgtggatcaaaccatcaggtctgcagaccgacgtccagaagatcttgcgcaatgcgcggaaactgcctgagaaaacgcagaccttctataaggagctgaatcggctgcggaaggccgccctggcattcggctttttggacctgctgaaaggagttgcagacatgttagaacgagagtgcactctcctgcctgaaactgctcatccagacgccgcattccaattgacccacgctgcacagcaactcaaattagccagcaccggcaccagcgagtatgctgcttacgatcagaatatcacacccctccacaccgacttctcgggcagctcaacagaaagaatttag

SEQ ID NO: 27661 - DNA, 1557 bp, Artificial Sequence
  Description of Artificial Sequence: Synthetic coding sequence
atgcctaccgtggtggtgatggacgtgtcactgtctatgacacgacctgtttcaatcgaggggtccgaggagtaccagcggaagcaccttgctgcacacgggttaactatgctttttgagcacatggctaccaattacaaattagaatttacagccctggtggtgttctcttcactttgggaattgatggtgccctttactcgtgactataacactctgcaggaggcactctctaacatggacgactacgataagacctgtctggagtccgctctcgtcggcgtgtgcaatattgttcagcaggagtggggcggtgcaatcccctgtcaggtggtgttagtgactgatggatgtctcgggattggcagaggttctttgcggcacagcttggcgacgcagaatcagaggtctgaatcgaatcggttccctctcccttttccttttccatcaaagttgtacattatgtgtatggccaacctggaagaacttcaatctaccgattcactcgagtgcctagaaagactcattgacctgaacaacggggaaggacagatctttactatagacgggcccctttgtttgaagaacgtacaatccatgttcggcaagcttatcgacctcgcatacactccattccacgcagtgctaaagtgtggccacctgaccgccgacgtgcaagtgtttcctagaccggagccatttgtggtcgatgaggagatcgatcccatcccaaaggtgattaatacagacctggaaatagtgggatttatcgacatcgcagacataagctcccctcctgtattgtcgcgccatctggtgttaccgatcgccctgaacaaagaaggtgacgaagtcgggaccgggatcacagatgataacgaggatgaaaacagtgctaaccagattgcgggtaaaatcccaaatttttgtgtgttgctgcacggctctctcaaagtggagggaatggtggccattgtgcaactcgggccagagtggcacggcatgctctattcgcaagccgacagtaaaaaaaaatctaatctgatgatgagtcttttcgaaccaggacccgagcctctgccctggcttggcaaaatggctcagttgggccccatctccgacgcaaaggaaaacccatatggcgaggatgataacaagtctcctttccctctgcaaccaaaaaacaagcggagttatgcgcagaacgtaacggtttggatcaaaccgtcagggctgcagactgatgtccagaaaatactccggaacgcgagaaagctgccggaaaaaacgcagacgttctacaaggagttaaaccggttgcggaaggctgccctcgcctttgggttcctggatctgttgaagggggtggccgacatgctggagagggaatgtacactcctccccgagaccgcccaccccgatgccgcgttccagttgactcacgccgcccaacagttaaaactggcttccacgggtacttcagaatatgctgcctacgaccaaaatatcacccccctgcacactgacttttccgggtcaagtactgaaaggatatag

SEQ ID NO: 27662 - DNA, 1386 bp, Artificial Sequence
  Description of Artificial Sequence: Synthetic coding sequence
atgccgacagagtccctgtgtcggcggacagtctcaggcgacgggcatggggaggcattaagtaacatggatgactacgataaaacatgcctggaaagtgcactagtgggcgtgtgcaacatcgtgcagcaggaatggggtggagctatcccgtgtcaggtagtgcttgtcaccgacggatgcctggggataggacggggctctctccgccacagtcttgcgacgcagaaccagagatctgagagcaacaggttccctctgcctttcccattcccatcgaagctgtatataatgtgtatggcgaacctggaagagctgcagtcaacagactctttagagtgtctggaacgtctcattgacctaaataatggggagggtcagatctttaccatcgacggccccctgtgtctaaaaaacgttcagagcatgttcggaaaactgatcgatctcgcttacacacctttccatgccgttctgaaatgtgggcatctgaccgccgacgttcaagtctttcctaggccagaaccctttgttgtggacgaagagatcgacccgatcccgaaagttatcaatacggatttagagatcgtggggttcatcgatatcgctgatatcagcagtcccccggttctaagccgtcacttggtgctccccattgcactgaacaaggagggagacgaggtagggaccgggataacggatgacaacgaagacgaaaactcagctaatcaaatcgcgggaaagatccctaatttttgtgtgttactgcatgggagtctgaaagtcgaaggcatggtggccatcgtccagctgggacctgaatggcacggtatgctttacagccaggcagattctaaaaaaaagtctaacctgatgatgtcattatttgaacctggacctgaaccactgccctggctcggaaagatggctcagctgggccccatcagcgatgccaaggagaacccttacggcgaagatgataacaagagcccctttcctcttcagcccaagaataaaagaagctatgcacagaatgtcacggtatggatcaagccctcaggcctgcagacagacgttcaaaagattttacgcaacgccaggaaactaccagagaaaacacaaactttttataaggagcttaataggctgcgcaaggcggctcttgccttcggatttttggacctattgaaaggggtcgcagacatgctagagagggaatgcaccctgctgcccgaaaccgcacatcccgatgccgccttccaactcacgcacgccgctcagcagctgaaattggccagcaccggcactagcgagtatgccgcttatgaccagaacattacacccctacataccgatttttccggcagcagtaccgagcggatctag

SEQ ID NO: 27663 - DNA, 1320 bp, Artificial Sequence
  Description of Artificial Sequence: Synthetic coding sequence
atggacgactatgacaaaacctgcctggagtctgctctcgtgggcgtctgcaatatcgttcagcaggaatggggtggtgctataccttgccaggtggtccttgtcacagatggatgtctagggattggcagaggatcccttcggcactccctggcaacacaaaatcagcggtccgagtccaacagattccctctgcccttcccttttccttccaaactatacattatgtgtatggcaaacctggaggaactccagtcaactgattctcttgagtgtttagaaaggctaatagacctgaataatggcgaggggcaaatcttcacaatcgacggaccactgtgtctgaagaacgtgcagtccatgttcggcaaactgatcgatctggcctacacaccttttcacgctgttttgaaatgtggacatctgactgccgatgttcaggtatttccacgtccagagccttttgtggttgacgaggaaatagaccccatcccaaaagtgattaacacagaccttgagattgtgggatttatcgatatcgcagatatctcgagccctccggtgttatctaggcaccttgtccttcccattgctcttaacaaggaaggcgatgaagtcggcaccggtattacagatgacaatgaagatgaaaacagcgctaaccagatagccggaaagatccctaacttttgcgtgctcctccacggtagtctgaaagtagaaggcatggtagccattgtccagttgggccccgagtggcatggtatgctgtattcccaagcggattctaagaaaaaatctaacctgatgatgtccctctttgagcctggccccgagccacttccttggctgggtaaaatggcccagctgggccccatttccgacgcaaaagaaaatccctacggggaagatgacaacaaatctccattccccctgcagccaaaaaacaagagaagttatgcacagaatgtcacagtttggattaagccatctggcttgcaaaccgatgttcagaagattcttagaaacgctcgcaagctccctgagaagacacaaacattttacaaggagttaaaccgcctccgcaaggcagcattggcttttggcttcctggacttactgaagggggtggccgacatgctggagcgggagtgtacactgctgccagaaaccgcccatcccgacgcagcatttcagttaacacacgctgcccagcagctgaagcttgccagcaccggaacatcagagtatgccgcttatgatcagaatatcaccccgctgcatacagactttagtgggtctagcacagagagaatatag

SEQ ID NO: 27664 - DNA, 1449 bp, Artificial Sequence
  Description of Artificial Sequence: Synthetic coding sequence
atgcccaccgtcgtggtgatggacgtgagcctcagcatgacccggccggtgagtatcgaaggaagcgaggagtaccagcggaagcacctggcagcgcacgggctcacgatgctctttgaacacatggcaactaactataaactggaattcacagcactggtcgtgttcagctccttatgggagctgatggtgccgtttacacgggactataacaccttgcaggtcgtgctggtcacagatgggtgcctagggataggccggggaagtctcaggcattcacttgcaacccaaaatcaacgcagcgaatccaacagattcccccttccatttcccttcccaagcaagctgtatattatgtgcatggcgaacctggaggagctgcaatccactgatagtctcgagtgtcttgaacggctgatagatcttaacaacggtgaaggccagattttcacaattgatggtccgctgtgccttaagaacgtccaaagtatgtttggaaaactgatagacctggcctataccccttttcacgccgtcctcaaatgcgggcacctcactgccgatgtacaggtattcccccggcccgagcccttcgtcgtggatgaagagatcgacccgattccgaaggtgataaataccgacctggagattgtggggttcatcgatatcgcagacatcagttctccccccgtgctatcgcgacatctggttctacccatcgcgctgaataaggaaggggacgaagtgggtactggcatcacagacgataacgaagatgaaaatagcgccaaccagattgcaggcaagatcccgaacttctgcgtgctgctgcatgggtctctcaaagtcgaagggatggtggccatcgtgcagctagggcctgagtggcatggcatgctttattctcaggcagattccaagaaaaagagtaatctcatgatgagtttgttcgagcccgggccagagcctcttccatggctgggaaaaatggctcagctcggccctatttccgatgctaaagaaaatccctacggcgaagacgataataaatcgccttttcccctgcaacccaaaaataagagaagctacgctcagaacgtgactgtgtggataaagccaagcggattgcagaccgacgtgcagaaaatactccgcaacgctaggaaattaccagaaaagacccagactttctacaaggaactcaatagattgcggaaggcggccctagcattcgggtttttagacctgctcaaaggagtcgccgatatgctcgagagagagtgcacactactcccagaaaccgctcaccctgatgcagctttccaactcactcatgcagctcagcagctgaagctggcgtccacgggaacatccgaatatgccgcctacgaccagaacatcacaccgttgcataccgatttcagtggaagttcaactgagagaatctag

SEQ ID NO: 27665 - DNA, 774 bp, Artificial Sequence
  Description of Artificial Sequence: Synthetic coding sequence
atgcctctggcctgtgagcaccccgtgggagtgtcatccagtgtaggcaatgcagggagagccggcgtgggcacccaggcttggggcactaccgaacgcacccagcaccccggcccagcccagcactgcccatgcggcttgcgggtcttcgtgcttcaggagaaaagggtcgtttcgaggaactgggcccgcggtacttgtggacccagggtgactaacgagatgctggaggacgaagacgcagaggatcacggaggcaccttttgcttgggagagttagtcgagctagccgtgaccatggaaaacaaggccgaggggaagcgcatagtgtcagagaagccaaccagagcaaggaatcaaggaattgagggaagtccaggcggaagagtgacccgctcccctccaactcaggtagccattagctccgattcagccaggaaagggtcttgggagccatggagccgtcccgtcggagagccccctgaggccggctgggattatgcacagtggaaacaggagagggagcaaatcgacctggctagactagccaggcacagagatgcgcaaggagactggagacggccatgggacctggataaagcaaaatcgaccctacaggattgcagccagctgcgcggagaaggtccagcccgggccgggagccgccgcggagaacctactcctaccagctccttgcccagtcttgcgctgttcatcttccatccactggtactctctttcctgtgtctgctagtctcgtattttcagtcctag

SEQ ID NO: 27666 - DNA, 975 bp, Artificial Sequence
  Description of Artificial Sequence: Synthetic coding sequence
atgcggcaccgggaagggtcttgggaaccttggtctagaccggtaggggaacctccagaggcagggtgggattacgctcagtggaaacaggaaagggagcagatcgatttagctcgactggcaagacacagagatgcccagggcgattggcggagaccctgggatctggataaagcgaaaagcacactccaggactgtagtcagctgcgcggagagggaccagccagagctgggagcagaagaggcccacgtagccaccagaagctgcaaccccctcccctccttcccgacggaaaaggaagaggtgggcaggcaagtagacctagtgttgctcccgctacaggaagtaaggctcgcgggaaggagaggcttaccggaagggccaggcgctgggatatgaaagaggataaggaggagctcgaagggcaagagggctctcagtctacgcgagaaacaccaagcgaggaagaacaggcacagaagcagtccggtatggagcaggggcgactcggttcagctcctgccgcgtccccggccctggccagtcctgaagggccaaaaggcgagagtgtggcttccactgcaagtagcgtgccctgcagcccccaggagccggaccttgccccccttgatttatcgctggggggagctggaattcctggcccgcgagagtccggatgcgtgctcggtctgcggcccggagcccaggaatcccctgtctcctggcccgagggctccaagcagcaacccttaggctggagcaaccatcaagctgaattagaggttcaaacctgccccgagccccagagaggggcgggacttcctgaaccgggcgaagaccggtcaggcaagtcaggggcccagcaagggctcgccccacgatcacggcccacacgcggcggtagccaaagatcaagaggcaccgctggagtgagaagaaggactgggagacctggcccagcagggaggtgttag

SEQ ID NO: 27667 - DNA, 1605 bp, Artificial Sequence
  Description of Artificial Sequence: Synthetic coding sequence
atgatttcttgtgctgaacagagaagccgtcagggtgaagccgggaggggcccagcccctgtggcacccgctttcctgccactgtggctgcctcgaggttgcagcggtattctgtccgtacccgcagtggccatgcacagcgctggcactccccgcgcagagtcacctatgagcaggcaggagaaggatgccgagctggatagaagaattgtcgctctgaggaagaagaaccaggctctcttgcgaaggtatcaggagattcaggaggacaggaggcaggccgaacaaggaggcatggccgtgacaacgcctgctctcctgcagcctgatggtctgacagttacaatttcccaggtcccgggcgagaagcgggtggtatctaggaactgggcaagaggcacatgtggtcctagggttaccaacgagatgctcgaggacgaagatgccgaggatcatggggggactttctgtctcggcgaactggttgagctggccgttaccatggaaaacaaagccgaaggcaagcggatcgtaagcgaaaagccgaccagagcaagaaaccaaggtattgagggatcccctggcggtcgtgttacccggtcaccccctactcaggtagcaatctcctcagattcagcccggaaaggctcttgggaaccttggtcccgtcccgtgggcgaaccccctgaagccggctgggattacgcccagtggaagcaggagcgggaacagatcgatttggcccgcctggccagacacagagacgcccaaggcgactggcggagaccctgggacttggacaaggccaagtcaacactccaagactgttcccagctcaggggtgagggacctgcccgagctggaagccgacgagggccaaggagccatcagaaattacagccaccccctcttctaccagatggcaaggggcgcggaggccaagcttctagaccgtctgtcgcccctgcaactggatccaaagcgcgaggcaaagagcggcttaccggccgagcccggagatgggacatgaaggaagataaagaagagcttgaagggcaggaggggagtcaatctacccgtgagactccttcggaagaggagcaggctcaaaaacaaagcggcatggagcagggacgactcggaagcgccccagctgcaagcccggctttagcgtcacctgaggggcccaaaggggaatccgtggcctccactgcttcatcagtgccttgcagtccgcaagaaccagatctagcccccctggatttgtccctcggtggtgcagggatcccaggtcctagagagtcaggatgtgtgctcgggcttagacctggcgcccaggaatcgcccgtcagttggcccgaaggatcaaagcagcaacccctggggtggtcaaatcaccaggcagagttagaggtccagacttgtcctgaaccacagagaggcgctgggctgcctgaaccaggtgaagatcgctctggaaaatcaggcgcccagcagggacttgcacccaggtcacgccctactcgcggaggctcacaaagatcccgcggcacggctggggtgcgccgcaggactggacgcccgggtcccgctggtagatgctag

SEQ ID NO: 27668 - DNA, 540 bp, Artificial Sequence
  Description of Artificial Sequence: Synthetic coding sequence
atggagctgcagggcgcacaggaggatctgggtattagcttgtcgagccctcgcaggaatcacgaaactcgccccggctctaaggccaagggaagaagtagtatctgtcttcaggcatcagtgtggatggcggggggcaaactgcggttgcgggctagtgagcatctgacccagggacaccagcaggagctccgggactggaacctcggtgaagacgctagtctgcttttttccaaatcacccttcggagccggcaaactgatccaggcccccgcccacgtgtttaggcaatgctgggtccagggcaacgcctggataagttgcattacaaagtttgattccaaaaggagcccagaagtggcctcttcgccgagctatctgacagttccaaggagatcaccgcttccagtgtttctcagaccttctgaccgatgcgtgtgcgggggttgttaccttgggaaatctacaaggcgccgggcctgtcagtctctgctttccgaccccctgggggttacatttccgacacagaccaggccttag

SEQ ID NO: 27669 - DNA, 552 bp, Artificial Sequence
  Description of Artificial Sequence: Synthetic coding sequence
atggaagtcaagttcataacgggcaaacatggcggccggagacctcagagagcagagcctcaacgcatctgtcgagcactgtggttaactccttggccctccctgattctgaaattactgagctggattatcctctcgaatttatttctgcacctcagagctacccatcacatgaccgagttacctttgaggttcctgtacatcgccttgagtgaaatgacatttcgcgaacagacttcccatcaaattattcagcaaatgtccctctccaacaaactggagcaaaaccagctgtacggcgaggtgattaacaaagagacagacaatcccgtcatttccagcggcttgactctgctgttcgctcaaaaaccccagtcacctgggtggaagaacatgtcatcgacaaagcgcgtatgtactatcctcgccgatagctgccgtgctcaggctcatgccgctgatcgaggtgaacgtggtcacttcggcgtccagattctacatcacttcatcgaagttttcaatgtgatggccgtacgatcaaacccattctag

SEQ ID NO: 27670 - DNA, 552 bp, Artificial Sequence
  Description of Artificial Sequence: Synthetic coding sequence
atggaggttaagtttatcacaggcaagcacggaggtagacggcctcagcgggcagagccacagaggatctgccgcgctctgtggctaaccccctggccatccctaattctgaaactcctttcctggattatcctgtcaaatttatttcttcacttgcgtgcaacgcaccacatgactgaacttccactgcgcttcctttacatagcactgtccgagatgacgtttcgagagcagactagccaccaaataatccagcagatgtcactctcgaacaaactggaacagaaccagctgtatggcgaagtcattaacaaagagacggacaacccagtgatcagcagcggcctgactctgctctttgcccagaagcctcaatctccaggctggaagaatatgtcaagtaccaagagggtgtgcacaattctggctgacagttgtagggcccaggctcatgccgccgaccgaggcgaacgaggccattttggggtgcaaatccttcaccacttcatcgaggtgtttaatgtgatggcagtaagatccaaccccttttag

SEQ ID NO: 27671 - DNA, 486 bp, Artificial Sequence
  Description of Artificial Sequence: Synthetic coding sequence
atgccaagagcagggcgcgcccctgctgagggtggacccgccccgggcactcggagctctcggtgcctgcgcccacggcccctggcctggcggcgcctcgtgccaaatttcggcgcctgggcacctagaaaaggagccgcgagagtgggaagacctgtgttgagcccccggacaagcggtgcagccggcgaaccaacttgtggggccggctccccgggcacactggaggaaggcgttgcctctggacgtacgaggcgacgcactcagtctgccggtgaagtggctaaatgtcggtggggtctgggacaggagcctttatgccctagaggcgctgtgcttctgaatagttttagtcctcccgcatggccacagttccctccagccttgcggctgcgggctctggcttggccgcagccccgtggaccagcgtgtggaagcacagctcaatggcctccaaggggggatcctacttggcgtatttcctag

SEQ ID NO: 27672 - DNA, 558 bp, Artificial Sequence
  Description of Artificial Sequence: Synthetic coding sequence
atgaagatgttcgaatcagccgacagcacagccacccgctctgggcaggatctttgggccgaaatttgctcatgcctgccaaatccagagcaggaagatggtgcgaacaatgcttttagtgactctttcgtggacagttgccctgaaggggaaggccagcgggaggtggccgacttcgcggttcagcctgccgtgaagccctgggctccgttacaggactctgaagtgtatctcgccagtcttgaaaaaaaactcaggcggatcaagggactgaaccaagaggtgacctcaaaagacatgttgagaaccttagcccaggctaagaaagaatgctgggaccgttttctgcaggagaagctggcttccgagttttttgtggacggcctcgattctgacgaaagcactctcgaacacttcaaacgatggcttcagccagacaaagtggccgtaagcacagaggaggtgcagtatctcattccaccggaaagccaggtggagaagcccgtggctgaagacgagcccgccgctggagacaaacccgccgcggccgaacagtag

SEQ ID NO: 27673 - DNA, 558 bp, Artificial Sequence
  Description of Artificial Sequence: Synthetic coding sequence
atgaaaatgttcgagtcggcagatagcactgccacacgcagcggccaggacctgtgggctgaaatttgttcctgcctgcctaacccggaacaagaggatggtgccaacaatgcttttagcgatagctttgttgattcttgtcccgaaggtgagggacagagggaagtggccgacttcgctgtccagcccgcagtgaagccctgggctcctctgcaagacagtgaagtgtatctcgcctccctggagaaaaaactacggagaattaaaggattgaatcaagaagtaactagtaaggatatgcttcggaccctggcccaggccaaaaaggaatgctgggatcgctttctgcaggaaaaactcgcctccgagttcttcgttgacggtctggactctgacgaatcaaccctggaacacttcaaacggtggctgcaacccgataaagtggcggttagtacagaagaggtgcagtatctgattccacccgaaagccaggttgaaaagcccgtggcagaagatgaacccgcagccggcgacaaacccgccgcagcggaacaatag

SEQ ID NO: 27674 - DNA, 585 bp, Artificial Sequence
  Description of Artificial Sequence: Synthetic coding sequence
atgagaggaagcggcctgcgattccaaatgaaaatgttcgaatccgcagacagcactgcaacaaggtccggacaggatctttgggctgagatatgttcctgtcttcctaatccagagcaggaggatggtgcaaacaacgcattttccgatagctttgttgacagttgcccggaaggggaaggtcagagagaagtggccgattttgctgtgcagccagcagtaaaaccatgggcacccctacaagacagcgaagtgtacctggcctctctggaaaagaagctgaggaggataaagggtctcaatcaggaagtaacctcaaaagatatgctgcgtacattagctcaggccaagaaggagtgttgggaccgtttccttcaggaaaagcttgcgagcgagttctttgttgacggcctggactcagatgagtctacactggagcactttaagcggtggctgcagccagataaagtcgccgtgagcactgaggaagtgcagtatctcatcccgcccgagtcccaagtggagaagcctgtcgcagaagatgaaccggcagcaggggataaaccagccgccgctgagcaatag

SEQ ID NO: 27675 - DNA, 405 bp, Artificial Sequence
  Description of Artificial Sequence: Synthetic coding sequence
atgaaaatgttcgaatccgctgactcaaccgccaccaggtctggtcaggacctgtgggccgaaatatgctcgtgtctgcccaatcccgaacaagaggacggggcaaacaacgccttttcagattctttcgtagattcctgtcccgaaggcgagggccagagggaggtggccgactttgccgtccaaccagccgtgaagccatgggcccccttgcaagactctgaggtttatctggccagcctggagaaaaaactgagacggataaaaggcctgaaccaggaggttacctcgaaggatatgctgaggaccttagcccaagcaaagaaggagtgttgggaccggtttcttcaggagaaactggcttctgagtttttcgtggacggcctggattcggacgagcgttag

SEQ ID NO: 27676 - DNA, 513 bp, Artificial Sequence
  Description of Artificial Sequence: Synthetic coding sequence
atgaaaatgttcgaaagcgctgacagtaccgctacacgaagcgggcaggatctgtgggccgagatttgttcctgcctccccaatcctgagcaggaggacggtgccaacaacgcctttagcgacagtttcgttgatagctgcccagagggcgaggggcagagggaagttgccgacttcgctgtccaaccagccgtcaaaccatgggcccccttacaggacagcgaggtttacctggcgagcttggaaaaaaaacttcggcgtatcaaaggtctgaaccaagaggtgacatctaaggatatgctgaggacattggcgcaagctaagaaagaatgctgggaccgctttctgcaggagaaactggccagtgaatttttcgtggacggtctggattctgatgaaagcacactagaacatttcaagcggtggttgcagcctgacaaagtcgctgtgagtaccgaggaggtacagtatctgattcctccagaaagccaagtggagaagcccgtcgcctag

SEQ ID NO: 27677 - DNA, 882 bp, Artificial Sequence
  Description of Artificial Sequence: Synthetic coding sequence
atgaacatcaggggcgctcccgaccttggacagccctcagatgaccccagttcagggggagagcgggagaggatccggcagcggatgaagatggtgatcgggcaactggaaggcatactgcgcgagctgaaagaggtcgccaaggagctgcgcgaggtggtgtcccaaatcgataaactcacttctgatttcgatttcgagctagagcccgacgactggacaaccgccacggtctcaagtacatctagctcagacaaggcaggcatgggcggtccattcgacttaggccatctcgacttcatgacagccgacatcctttccgacagctgggaattctgctcattcctggatgtgagcacgcccagtgactccgtggacggtccagagtccacccgaccgggggcaggccctgattacaggctcatgaatgggggaacccccatccccaatgggccgagggtcgaaaccccagactcttcttccgaggaggctttcggtgctgggcccaccgtgaagagtcagctcccccagcgcaccccagggaccagagagcgtgtcaggttttcagataaagtcctgtaccacgccctctgctgcgacgacgaggagggagacggcgaacaggaggtggaggaggaagaggtagggcttccacctgagcctgcccacacagaagcccacgcgggaccacataagccctccccggccccctataagagcagaagaagcccactgaccagcagacactccggatctaccctcgcaccagagcaaacccgtcgagttacaagaaactcttctacacaaacagtctccgacaaatcgacacagacagtccttccctatacggctacgcggcagaaagcccgcggtaaaaattag

SEQ ID NO: 27678 - DNA, 882 bp, Artificial Sequence
  Description of Artificial Sequence: Synthetic coding sequence
atgaacatccgcggcgcccctgacctcggtcagccctccgatgatcccagcagcggtggtgaaagggagaggatcaggcagaggatgaaaatggttattgggcaactggaaggaatcctgcgcgagcttaaagaggtggccaaggaactacgcgaggtggtttcccagatcgataagctgacttcagattttgattttgaactcgagcctgacgactggactactgcaacggtttcaagtacaagctccagcgacaaggccggcatgggcggtccgttcgatttgggccaccttgattttatgaccgcggatatactctccgattcatgggaattctgcagtttcctcgatgtgtccacacccagtgattcagtcgacggccccgaaagcacccgccccggtgccggtccagactaccgcctcatgaatggaggcacacccatcccaaatggcccaagagtggagacacccgacagcagtagcgaggaggcctttggagctgggcccactgtgaagtctcagctgccacagaggactccagggaccagagagagggtgcgtttctcggacaaagtcctctaccacgccctttgctgtgatgacgaagagggggatggagaacaggaggtcgaagaagaggaagtggggctgcccccagaacccgcgcatacagaagcccacgctggacctcacaagccaagtcccgcgccgtataaatccagacggagtcccctgaccagccgacattctggttctacactggccccagaacagacacgcagggtgacgcggaacagcagcacgcaaaccgtgtccgataagagcacgcagactgttctcccttataccgccacgcgacagaaagcgcgcgggaaaaattag

SEQ ID NO: 27679 - DNA, 801 bp, Artificial Sequence
  Description of Artificial Sequence: Synthetic coding sequence
atggcggaggctgggaaagtgcccttgtccctcggcctcactgggggagaggctgcagagtggcctttgcagcgctatgcccgctgcatcccttccaacacaagagaccctcccgggccatgtctggaggcagggacagcaccctgtccaacgtggaaagtcttcgattccaatgaggagagtggttacttggtgctcactatcgtaatttctggacattttttcatattccagggacagaccctcctcgagggattctccctcattggtagtaaggactggctgaagatcgtgcggcgggtggactgtttgctcttcggtacaacgattaaagataagtctcgtctgtttcgcgtgcaattcagcggcgagtcaaaggagcaggcactcgagcactgctgctcgtgcgtgcagaaacttgctcaatatatcactgttcaggtgcccgatggcaacatccaggagctccagctgattcctggcccaccccgggcaactgagagtcaggggaaggacagtgcaaaatccgttcccagacagcctggttctcaccaacattccgaacagcagcaggtgtgtgtaacggccggcactggcgctcctgacggcaggacgagcctgacgcagctcgcccaaacacttctggcaagcgaggaattgccccacgtatacgaacagtcagcttggggcgccgaagagctaggaccttttctgcgcctgtgtctgatggatcagaacttcccggcgtttgtcgaggaggtcgagaaggagctcaagaagttggccggtctccggaattag

SEQ ID NO: 27680 - DNA, 390 bp, Artificial Sequence
  Description of Artificial Sequence: Synthetic coding sequence
atgcgcagacggggtgaaattgacatggcgaccgagggagacgtggaactggagctggagacagagaccagtggccccgagcggccaccggaaaaacccagaaagcacgattcgggggcggccgatctcgaaagggtgacagattatgccgaggaaaaagaaatacagtcctccaatctggaaacggcaatgagcgttatcggggaccggaggtcacgggagcagaaggcgaaacaggagagggagaaggagctggcaaaggtgactatcaaaaaggaagacctcgaactgatcatgacagagatggagatttcacgagccgctgcagaacggtccctgagagagcacatggggaacgttgtggaggctctaatcgcacttaccaattag

SEQ ID NO: 27681 - DNA, 390 bp, Artificial Sequence
  Description of Artificial Sequence: Synthetic coding sequence
atgaggagacgaggcgagattgacatggcaaccgaaggcgacgtggagcttgagctcgaaaccgaaacgtcaggcccagagaggcccccagagaagccaaggaaacacgatagcggagcagctgacctggagcgggtgactgattacgctgaggagaaggaaatccagtcatcaaatttagaaaccgcaatgagcgtgataggggacagaaggtctcgggagcagaaggccaagcaagagcgcgagaaagagttggccaaggtgactataaaaaaagaggatctggaattgatcatgacagagatggagattagcagggcagccgctgagcgttcgctccgggagcatatgggcaacgtggttgaggcgctcatcgctttaaccaattag

SEQ ID NO: 27682 - DNA, 1716 bp, Artificial Sequence
  Description of Artificial Sequence: Synthetic coding sequence
atgagccgggaggccggctcctgtagagtgggcaccggcgctcgagccagatcgcggaaacccaagaaaccccactatattcccaggccatggggtaaaccctacaactacaagtgttttcagtgccccttcacatgtctcgagaaatcacacctgtataatcacatgaaatattccttatgtaaggatagtttgagtctgctcctggactccccggactgggcttgccggagagggagtactacccctagaccacatgctcctacgccagaccggccaggagagtcggacccaggaagacagccccagggtgctcgcccaacaggagcagctccagcgccagatctcgtggtcgctgatattcacagtctgcattgcgggggtgggccaaagtcccgggccaaaggtagccctggtccccccccaccggtggcaagagctacaagaaaggggccaggtccttctggcctcctcccagaatcatggaaacctggcatggggggggaccctcgcggtgttggagcaggagatatggcctcagcgggcccagagggctcggttccatgctaccctccgccggcccctggggaatttccagaagctcactctttgcatctttccttgctgggtgtgaactacccactatctccgggacttttctcttacttggggccctccctggcggccgccgctcacgttcccttcctcgcctcagctagtccactcctcccacccgcaacagcgttccctgccgtccagccccctcagcgtcctacccccgccccccgcctctattacccactgctcctcgagcacacattgggcttgcctgcagggaaggccgccctggctaaggctcccgtgtccccgagatcccctagtggaactcctgcacctgggttgctgaaggtgcccgtgccgggcctgggaccttggcctagggttactccccgcgaccctgggcaggaaggcgaattggaaagagccgcccaatcggatcctaggcgacgtttaagcttagggtctcggttggaactgccaaaagctagcccttccctcacgaggttttgttccaggagctccttacctacaggcagtagcgtgatgctgtggcctgaggacggggatcccggcgggccggagactccgggcccagagggcccattaccgctccagcctcgtggcccggtgccaggctctcctgagcatgtgggggaagacttaacaagggccctcggtgattatgcaagggttgaacaaaggcttggccaactgggtcccgccggagggttggcccccaggcctttgcgcgagcaactcggcaagatcaggcttgagctgcttactattcaccaggctctagagcaggccgttcggccccctgatgcaccactcgacctgagtgtgaaaagagcgcccgcaaaaggaccacaagcactgggcgaagcctggggcagaccagaactcgggccagtcctgactgggggaacccctgagcccccaggcatgctggggcccgcggcgccgcagccatttagcggtcataccacaaaatgcgaagccgactcctctgtgccccctcccggcctgcccctagctgcccccgacgaccccgtgatccccgggagtgggtgggggacatgcgtggcaactcggagttcacagactccagaggctgtctgcgggctgcagtcaccacagggggctgaggtctag

SEQ ID NO: 27683 - DNA, 615 bp, Artificial Sequence
  Description of Artificial Sequence: Synthetic coding sequence
atgctcgtcgcagcggccgccgagagaaacaaggaccctattctacacgtccttagacaatacttagatcccgcacaaaggggggtacgcgtcctcgaagttgcttccggaagtggtcaacatgctgcccatttcgctcgcgcctttccattggctgagtggcagccttctgacgtggaccagagatgcctcgattctatcgcagctacaacccaggctcagggccttactaatgtgaaggcgcccctccatctggacgtaacttggggatgggagcattggggcggtattctgccgcagagcctggacctgctgttgtgcatcaacatggcacacgtgagccccctgcgatgtacagagggattgttcagagcagccggacatttattaaagccacgcgctcttctgattacgtacggtccatacgcaatcaatggtaagatctcaccccaaagcaacgttgatttcgatctcatgttaaggtgtaggaatcccgaatggggtctgcgggacaccgcactgcttgaagacttgggtaaagctagcggcctgttgctggagcgcatggtggacatgccagcgaacaacaagtgcctcatttttaggaaaaactag

SEQ ID NO: 27684 - DNA, 324 bp, Artificial Sequence
  Description of Artificial Sequence: Synthetic coding sequence
atgctcgtcgctgcagcggctgagcggaataaggatcccatcttacatgtacttagacagtacctggacccagcccagcggggagtgagagtgttggaggtggcgtccgggagtgggcagcatgcagcacatttcgctagagccttccccttggctgaatggcagccttcggacgtggaccaacggtgcctggatcggaatcctgagtggggcctgcgggatacagcactgctagaagaccttggcaaagctagcgggctgctgttagagaggatggtggatatgcccgccaataacaagtgcttgatcttccggaagaattag

SEQ ID NO: 27685 - DNA, 384 bp, Artificial Sequence
  Description of Artificial Sequence: Synthetic coding sequence
atgctcgtagcagccgctgcagagcggaacaaagaccccattctgcatgtgctgaggcagtacctcgatcctgcacagcgaggtgttagggtcctcgaagtcgccagcgggtctggacagcatgctgcgcatttcgctcgggcttttcccctagccgaatggcaaccgtctgatgtggaccagcgatgtctggaccggggatcctccgaacagcaggacacgtgttccaacccaggtccttgctcctcccccactgggaaccccgaatggggcttacgcgacactgccttactcgaggacctggggaaggctagcggtctgctgctggagagaatggtggatatgcccgcaaataataaatgcctaattttcagaaagaactag

SEQ ID NO: 27686 - DNA, 558 bp, Artificial Sequence
  Description of Artificial Sequence: Synthetic coding sequence
atgctggtggctgcggccgctgagcggaacaaagacccgattctccacgttctaaggcagtatttagaccccgcccaaaggggcgttagagtgctggaagtcgcctctggttctggccaacacgcagctcatttcgcacgtgcattcccacttgctgaatggcagccttccgacgtggaccagagatgcctggactcaatcgccgctacaacacaagcccaggggctgactaacgttaaggctccactgcacttggacgttacatggggatgggagcactggggaggcattctgccacagagccttgatcttcttttgtgtatcaatatggcccatgtgagtcctctccgatgtacggaagagcctcgcatgggcgcatccggacattcgcctccaggcgggccaggtaaggggcagtggcccgctccaggcgaagatggagggcatgcctcccaacagcagatgcccgatctgcctgaaaaactgtcaccctcttttacccccgcgcatttgcacccctgcagacgtctgtgtgaggcccgaacactgcccccatag

SEQ ID NO: 27687 - DNA, 618 bp, Artificial Sequence
  Description of Artificial Sequence: Synthetic coding sequence
atgctggttgccgccgctgcagaaagaaacaaggatcctatcttgcacgttttacggcagtacctggacccagcccagcggggagtgcgcgtgctggaagtggccagtggatctggtcagcacgcagctcattttgcccgcgccttcccccttgctgagtggcagccctctgatgtcgaccaacgctgtctggatagcattgctgcaacaacgcaggcacagggcctaaccaacgttaaagcccccttgcacctggacgtcacatggggatgggagcactggggcggcatcctcccacagagcctggacctgctgctgtgtataaacatggcacatgtctcccctctgagatgcactgaagggctttttcgcgccgccgggcacttattgaaaccccgcgccttgctgatcacgtatggagagccaagaatgggcgcgtctggccactcgccccctggggggcctgggaaaggtcagtggccagctccaggggaagacgggggccacgcttctcaacagcagatgccggacctccctgagaagctgtctcccagttttactccagcgcacctgcacccttgcaggagactgtgcgaggcaagaaccttgcccccgtag

SEQ ID NO: 27688 - DNA, 939 bp, Artificial Sequence
  Description of Artificial Sequence: Synthetic coding sequence
atgggcagacgtcgagcagctaggggccctggggcggaaggagggcggccaaggcatcttccaacccgatcactggaggcttttgcagaggaggtgggagctgctcttcaggcctccgtagagccaggtgctgcagacggtgaagggggacctggccccgctgcactgccatgcacccttgctatgtgggaattgggtcactgtgatccacgccgctgtaccggccggaaactggcccgtctgggcctagtgaggtgcctaagacttggccacaggtttgggggcctggtgctgtctccggtgggtaagcagtatgcctcgccagccgatcggcagctagttgcccaatctggtgtggctgtgatagattgctcttgggcgagactcgatgagacaccatttggcaaaatgcgcgggtcccacctgagactcctgccatatcttgtcgctgccaaccccgtgaactacgggcggccctaccgtctgtcatgtgtcgaggcttttgcagctactttttgcatagtgggttttcctgatctggccgtaatcctcctcaggaagttcaaatgggggaaggggtttcttgatttgaacaggcagctgttggacaagtacgccgcgtgcggttctcccgaggaagttctgcaggccgagcaggagttcctggctaatgccaaggaaagcccgcaagaggaggagatagatcccttcgacgtcgacagcggtcgcgaattcggaaaccctaacaggcctgtggcaagcacccgcctgccctccgacacagacgactctgacgcaagtgaggaccctgggcccggcgccgaaagaggcggggccagtagctcttgctgcgaggaggaacagacgcagggtaggggcgcagaggcacgggcccccgccgaagtgtggaagggaattaaaaaaaggcagcgggattag

SEQ ID NO: 27689 - DNA, 615 bp, Artificial Sequence
  Description of Artificial Sequence: Synthetic coding sequence
atggagcttaagcagagtttaagtacccatctggaagccgaaaaacctcttaggcggtacggtgccgtcgaggaaactgcctggaagacagagagactaggcaggaatcagttagacatcattagcatggccgagacaaccatgatgccagaggagatcgagttagaaatggcaaagatacaacggttgagggaagtgctggttcggagagagtccgaattgcggttcatgatggacgatatccagctctgtaaagatataatggacctgaagcaagaattacagaacctggtggccattcctgagaaggagaagacgaaattacagaaacagagagaggacgaactcatccaaaaaattcataagctggtgcagaagagggatttcctggttgacgatgccgaggtggagaggctgagggagcaggaagaagacaaggaaatggctgattttctgcggattaagctcaaacccctggataaagtcacaaagtcaccagctagcagtcgagcagagaagaaggctgaacctcctccatcaaagccaacagtggcaaagacggggctcgccctcattaaggattgttgtggggccactcaatgcaatattatgtag

SEQ ID NO: 27690 - DNA, 564 bp, Artificial Sequence
  Description of Artificial Sequence: Synthetic coding sequence
atgtggggggacctcactgaaactgggtgtatggggcgacgcagtgccaagaaggatcaattggacattatctccatggctgaaactaccatgatgccagaagaaatcgaactcgaaatggccaaaatacaaagattgcgggaggtcctggttagaagggagtccgaactccggttcatgatggacgacattcagctgtgtaaggatattatggatcttaagcaggagctccagaatttggttgccataccagaaaaggagaaaacaaaactgcagaaacaacgagaagacgagcttatccagaagattcacaagctggttcagaaaagagactttctcgtggatgatgccgaagtcgagcgcctacgtgagcaggaggaagataaagagatggctgacttcctccgcatcaagcttaagcctttggacaaggtcacaaagagcccagcatcatcaagggccgagaaaaaagcagagccaccaccatccaaacccaccgttgccaagactgggttggcccttataaaggactgctgcggcgccacccaatgcaatatcatgtag

SEQ ID NO: 27691 - DNA, 1188 bp, Artificial Sequence
  Description of Artificial Sequence: Synthetic coding sequence
atggacctgtgccagaagaatgaaacagatctggagaacgcagaaaataatgagatccagtttaccgaagagaccgagccaacctacacttgcccggatgggaagtccgagaaaaatcatgtgtattgcttgctggatgttagcgacattacactggagcaggacgaaaaggctaaagaatttattattgggacagggtgggaggaagctgttcagggatggggaaggacctcacccgctgcttgtatttggccaaggaagattccaaagaaagcccgggtaggtgaaggcgcctgttcggactgtttagtctgcgtgaacttgagccattggagcctgcagaccaagcctcctaccgagggcggacctgagaaggatcaaagctctccttcccagactcaggcagcaccccagggcccctccaccgccagtcgagctatctccgatatatgttttcccacctatttcagggccgagaagaaaagtttgcagattaaggagttcatctggtgcaataaggactgggctatccctggaactaacagaggcaaggctagcggcaatccttccggcggcgctcatcgagggctctctattccgggccccctgaccagtagggcgcttctggtcctgccgcccttaaaggcgtctctctctaatgccctggacgtgctggggaaaaaatccaagaactcgttcctacagtcggaggagaaggtactggacgtcgagaaggatggctgcgtggcctatgcctacggactgaagacagcagacggaaagggagagaaaagagcgagtgagctcgccaagcatcctatggtgaacgatacccccagctcaccatctcccgctgctcagattagcctgttaactgatccagagcagagatgcctccactggagtctgttaagcgagaagaatctggcatgcccccctgacccaagcaacgtgaggtacttggccgctttacaactccttcagaaacgtggcgtgcagtcctataagagtaagtttaaagccaaggagccgcgatcaccggtcattacacggaagcacgttctgcctaaagcgaaacaggaaaatagaccccagatgctagagacaaaggttttcccacgcccagttctgccgtctcttaccgtctctcgggttatcattcccgttagtactcacaggattctgtag

SEQ ID NO: 27692 - DNA, 1167 bp, Artificial Sequence
  Description of Artificial Sequence: Synthetic coding sequence
atggatttatgccagaagaatgagactgatctggagaatgccgagaacaacgaaattcagttcaccgaagagactgagcctacatacacgtgtcctgacgggaaaagcgaaaagaaccacgtctattgcctgctggacgtctccgatatcaccttggagcaggacgaaaaagccaaggagtttatcatcggtactggatgggaagaagcagtgcagggttggggacggaccagtcccgccgcctgtatttggccacggaagatcccgaagaaggctagagtgggagaaggtgcctgtagcgattgcctcgtgtgtgtcaatctatctcactggagcctgcaaacaaagccgccaaccgaaggcggaccagagaaagaccagagctctccgagccagacccaggcagccccccagggccccagcaccgcaagcagagccatcagcgacatttgcttccccacttacttcagggccgagaaaaaatcccttcagataaaagagttcatctggtgtaacaaggattgggccataccggggacaaatcgcggcaaggcttccggtaacccaagtgggggagctcaccgcggcttgagtatcccgggccccttgaccagtagagcgctgcttgttcttccgcccctcaaagctagtctgagcaacgcgctggacgttctgggtaaaaaatccaagaattcctttcttcaatctgaggagaaagtgctggatgtggaaaaggatggctgcgttgcctacgcgtacggcttgaagactgcagatgggaagggagaaaagcgggcatctgaactggccaagcaccctatggtcaacgatacaccatccagcccctcacccgcagcgcaaatttccctcttgacagaccccgagcagcgatgcctgcattggagcttgctaagtgaaaagaatctggcttgtccccctgatccatcaaatgttcggtacctagctgcactgcagcttttgcaaaaaagaggggttcagagctacaaatccaaatttaaagccaaggagcctaggtctccggtgattactcgtaagcatgttctgcccaaggctaagcaggaaaaccgcccccagatgctcgagactaaagtgtttcccaggcccgtacttcccagtctgacacataggaagaaaaagataaaatag

SEQ ID NO: 27693 - DNA, 369 bp, Artificial Sequence
  Description of Artificial Sequence: Synthetic coding sequence
atggtcaacgatacaccatccagccctagtccagctgcccagatcagcctgcttacggatcctgagcaaaggtgcctccactggagcctgctctccgaaaaaaatctggcttgtcctccggatccatcaaacgtgagatatctggccgctctccagctcttgcagaaaagaggcgtccagagctataagtctaagtttaaggcaaaggagccgcggtctccagttataacccggaaacacgtgttgcccaaggccaaacaggaaaaccgtccccagatgctagagacaaaggtttttcctcgccccgtgctgccgagtctgaccgtctccagggtcataattcccgttagtactcaccggattctctag

SEQ ID NO: 27694 - DNA, 504 bp, Artificial Sequence
  Description of Artificial Sequence: Synthetic coding sequence
atggacaagcttacaattatttccggatgtctgttcctagcggctgatatctttgctatcgccagcattgcaaatccagactggataaacactggcgagagcgcaggagctttgaccgttggactggtgagacaatgtcagacgatccacgggagggatcgcacttgtattccaccacggcttccacccgaatgggtgaccaccctgttcttcattatcatgggcatcatctccctgacagtaacgtgtggcctgttagtggcctcgcactggcgcagggaagccaccaaatacgcacggtggatcgctttcaccggcatgattttgttctgcatggcagctctaatctttcccatcgggttctacatcaacgaggtgggaggccaaccttataagctgccaaacaacacagtcgtcggaagctcttatgtcctgttcgtgctcagtatctttttcaccatcgttggcttactgttcgccggtaaggtgtgcctccccggctag

SEQ ID NO: 27695 - DNA, 420 bp, Artificial Sequence
  Description of Artificial Sequence: Synthetic coding sequence
atggtcacgcatgccgccggcgcaaggacattttgcgaggagcagaagaagggatctacatactctgtgcccaaatccaaagagaaactgatggaaaagcactcacaagaagctagacaggccgaccgcgagtccgagaaacccgtggattctttgcatcctggcgcggggacagcaaaacatccgccaccagctgcttccttagaggagaaacctgatgtgaaacaaaaatcaagccggaaaaaggtggtcgtgcctcagatcatcataaccagggcgagcaacgaaacactggtgtcctgtagtagctcagggtctgaccagcagcggaccatcagagagcccgaagactggggtccttatcgccgccatcgaaaccccagcaccgccgacgcttataactctcacctcaaagagtag

SEQ ID NO: 27696 - DNA, 423 bp, Artificial Sequence
  Description of Artificial Sequence: Synthetic coding sequence
atgggattgagcaagtctaaggaaaaacctcgaaaaggggaggaacagaagaaaggaagcacctatagcgtgccaaaatcgaaagagaaactcatggaaaagcactcccaggaagcaaggcaggccgatcgggaatccgagaagccagtggattcacttcacccaggtgcaggcaccgctaaacacccccctccggctgcatctctcgaggagaaaccagatgtaaagcaaaaatctagcaggaaaaaggtggtagtgcctcaaattatcatcacccgcgcatccaacgaaacgctagttagttgcagttcaagcgggagtgatcagcagagaaccatccgcgaacctgaagactggggcccgtatcgtcgtcacaggaatccatctacagctgatgcttacaactcccacctcaaggagtag

SEQ ID NO: 27697 - DNA, 1302 bp, Artificial Sequence
  Description of Artificial Sequence: Synthetic coding sequence
atgctccccgcgggctgtagccgtcgtctcgtggctgaactgcaaggtgccctggatgcatgtgcacaaaggcagttgcagctcgaacagtctctgagggtgtgcaggagactcctgcacgcatgggagcccaccgggacaagagcccttaaacctccacctggacctgagactaacggagaagatcccctgccagcgtgtacaccttccccacaagacctcaaggagctggaattcctcacccaggctctagaaaaagcagtgcgtgtgaggcgggggataacaaaagcaggtgaaagggacaaggctccctccctaaaatcccgatccattgtgacatctagtggaactaccgctagcgcccccccccactcacccggacaggccggcggccacgctagtgacactcgaccaacaaaaggactccgacagactaccgtgccagccaaaggtcacccggaaaggagactgctgagtgtcggcgacggtactcgggttggcatgggcgcacgaactcctagaccgggggccggcctcagagatcagcaaatggcaccttcagcagctccacaggctccagaggcctttacccttaaggaaaaaggccatcttctgagactccctgccgctttccgcaaggcggcctcccaaaacagcagcctgtgggctcagctcagctctacccagacttcagattctaccgatgctgctgctgccaagacccagtttctccaaaacatgcagacagccagcgggggtccacagccccgcctcagtgccgtcgaggtggaggccgaagctgggagacttcgaaaggcatgctcgctacttaggctcaggatgcgcgaagagctgagcgctgcccccatggactggatgcaggagtatagatgccttttgacgctggaaggactacaggcaatggtcggtcagtgcctgcatcggctacaggaactgcgagccgccgttgctgagcagccgccgaggccatgcccggtcgggcggccacccggcgcatcgccttcctgcggcggccgggctgagccagcctggtcacctcagctcttggtctattcttcgacccaggagcttcaaactttggccgcgctgaagctcagagtcgctgtgctggaccagcagattcatcttgagaaagttttgatggccgagcttctgccactcgtctccgctgcgcagccccagggcccaccctggcttgctctgtgtagggccgttcactcgctgctctgtgaaggcggcgcacgggtgctaacgattctcagggacgagccagcggtgtag

SEQ ID NO: 27698 - DNA, 1119 bp, Artificial Sequence
  Description of Artificial Sequence: Synthetic coding sequence
atggcaccagcccccccgcctgccgcaagcttcagcccttcagaggtgcagcgcagactagccgccggtgcttgctgggtgagaagaggagccagactctacgacctctcgtctttcgtcaggcaccatcctggaggcgaacaactgcttagagcccgagcaggccaggacatcagcgcagacttggatggaccaccgcacaggcacagcgccaacgccaggaggtggctggaacaatactacgttggtgaacttcgaggcgaacagcagggatcaatggaaaacgaaccagttgcactggaagagacccaaaaaacagacccagctatggaaccccgctttaaggtggtggattgggataaagacctcgtagactggagaaaacctctgctgtggcaggtcggccacctcggcgagaagtacgatgagtgggtgcaccagccagtaacaagacccatccgtctttttcactctgacttaattgaaggcttgtctaagacggtttggtatagcgtccccattatctgggtgcctctggttttgtatctatcctggagttattaccgcactttcgctcaaggaaatgtgagactgttcacctcctttacgacggaatataccgtcgcagtgccaaaaagcatgttcccaggcctctttatgcttggaacattcctgtggagcctgatcgaatatttgattcacaggtttttatttcatatgaagccgccttctgacagttactatctcatcatgttgcattttgttatgcacggccagcatcataaagcgccatttgacggctctaggctggtgtttcctcccgtgcctgcctcccttgttattggcgtgttctacctgtgtatgcagctgatacttccggaagctgtcggggggaccgttttcgctggtgggttactgggctacgtgttgtacgatatgacacattactatctgcacttcggcagtccacacaaggggagctatctctacagtctcaaagcgcatcacgtgaagcatcatttcgcccatcagaaaagtggctttggtatcagtactaagctgtgggactactgtttccacaccttaactccagaaaagcctcatttaaagacccagtag

SEQ ID NO: 27699 - DNA, 1317 bp, Artificial Sequence
  Description of Artificial Sequence: Synthetic coding sequence
atgctgttgtgccccgcacaaaagacggtgtttaggctgcagctaactacggccgcccaatgcctgtgggtgtacctgcgcgacaagcaggtggtggtctttctggcctatccaacacgggcacctggccgcaacaacggtgttacctctcttcattggcccgatccaaccctgtcattatcctggacccaagaggcatataccgagtacttgcggtccattcactacatctcccaggttctgctcgaggaagtggagaccactaaagaggcaggggaaaccgtgcctcctgatacatccaagatgcttaagctcgcgcagcagtgtctggagcgggcacaatcaactgcagctaagctgggcaagactcggctgaaacccactatgccagccgctgcaccaatcccccagccagctggaaggcaccggagagtctacagcgacgaaggagggaagctgtccccttttctgcctccagaaattttccagaagctacagggggccgagagtcagtcctgtaaaaaggagctaacgcccctggaggaagccagcctccaaaatcagaagctcaaggctgcctacgaggctaggatggctcggctggacccgtcacaggccatgcagaaaacctctctgacactttctctgcagcgtcagatgatggagaatcttgtgatcgctaaggcgcgtgaggagaccctgcagcgtaaaatggaggaacggcgtctcagactgcaagaggctgcgaatcgtaggttttgctcccaggtcgcactgactcctgaagaacgggaacagagagccctatacgccgcgattctggaatatgagcaagaccacgactggcctaaacattggaaggctaaactgaaaagaaatcctggggatcttagcttagtgacgtctctggtctctcacttgctttccctccccgatcatcctatcgcacagcttctcagaagactccaatgctctgtctatagcgcgttgtaccctgcggtatctagggctgctgcacctgcaccgggttgttgtcccccaaccccaaacccaggaagccgacggctaagacccagccagtcactccattgcatgcttagtccccccgagccttctgccgctccaaggccacaagacagcccacccacccctcccctccagcctggcccatgggggctgccccacccatggggaacaccccatctcgattgccaaactcgtaccgccagaagtaggacctggtcaagctcttgggggcggttgtccggcagggctggagccgttggatattctcgttcaccttcctgcagctcatag

SEQ ID NO: 27700 - DNA, 1896 bp, Artificial Sequence
  Description of Artificial Sequence: Synthetic coding sequence
atggccgctgcagcgggggatggcactgtgaagcctctgcaatccgccatgaaactggccaacggggctatcgagcttgataccggcaatcgtcccagggaggcctatacagaatatctaaggagtatccattacatcagccaggtgctgcttgaagaggtagagactacaaaggaggccggagaaaccgtgcctcctgatacgagtaaaatgctgaaactcgcgcagcagtgccttgaacgtgctcagagtacggctgccaaacttggcaaaactagactgaagccaaccatgcccgctgccgcccccatcccccagccggccgggaggcaccgcagggtgtactctgatgaggggggaaagctaagtcctttcctgccccccgagatttttcagaaattacagggtgccgagtcccagtcatgcaaaaaggaactgacacctctggaagaggccagccttcaaaatcagaagctgaaagcagcttacgaagctcgcatggcccgactagatccaagccaggcaatgcagaagacatctctgacattgtctctccaacggcaaatgatggagaatctcgtgatcgccaaggcccgcgaggaaacactccagaggaaaatggaagagcgtcggctccggctgcaggaggccgctaaccggagattttgcagccaggtggctctgactcccgaagagagggaacagcgcgccctgtacgcggctattttggaatacgaacaggatcatgattggcccaagcattggaaggcgaaattgaagaggaacccaggagatttatctctggtcacctccttagttagtcatctgctgagcctgccagatcatcctatcgctcagctccttagacgactccagtgctctgtatatagcgctctctacccagctgtcagccgcgcagccgccccagcacccggctgttgccctcctactcccaacccaggctcacggaggctgcgcccctctcaaagtctgcattgtatgctgagtccgcctgaacctagtgcagctcccagacctcaggacagcccccccacgccacccttgcaaccaggcccagtgggcagccccagcccactgggggacacagcctctgggctgccggacaaagacagcagctttgaggacttggagcagttcctgggcacgagcgagcggcaagggaggggtaggggcgtgcagcccgagccgcagctgcagcaactaaagacagctgtggaagagattcacaacgctgtcgaccggctgctgagtctgacgctcttagcttttgagggactgaataccgctgctagcaaggaccggtgcctggcctgcatagaggagcctttctttagccccttatggccacttttactagcgttgtaccggtcagttcatagagctcgagaagcagctctgtcacggtctatggagctttacaggaatgctccgccaactgccatcgggataccaacaaaactgctccctcaaaatcctgaagccaagggagccacaggctatccgtattgtgccgccgcccaggaactgggcctcctcgtgctggaaagctgtccccagaaaaaactcgaatgtatagtccgcaccctgagaatcatctgcgtgtgcgccgaagattactgccctacacccgaagctactcctcaggccggtcccccccccattgccgccgctgcaataggggccgacgatctcttgcccatactctccttcgtggtgttaagaagtggactgccccagctggtcagtgagtgtgccgcccttgaggagttcattcacgagggatacctgatcggagaggaaggatactgtctcacgagtctgcagtcggctctgtcgtacgtagagctcctgccgcgcggtggtctcgcgaaatag

SEQ ID NO: 27701 - DNA, 1563 bp, Artificial Sequence
  Description of Artificial Sequence: Synthetic coding sequence
atggccagtaacgacaagggtatggccccctccctgggatctccttgggcctcacagatgggcccctgggacgctatactgaaggctgttaaggatcagctgcccagcctggacagtgactcccctctgagcgattatggagaggaagaactgtttatcttccagcggaatcaaacctcactcataccggatcttagtgaggagctcgccgaagatccagcggacggagataaatcccgagcctgggttgccgctgccgaagagtccctacctgagcccgtgcttgtgcccgccgaacttgcaaccgagcccggatgtcggcagaatactagaacaaaggacgcctctagccaagagggcagggatccagggcgaccctttgagtccagcggggaggtgtcggccctgctgggaatggctgaagaaccccctaggtggttggagggagaccttggcagtctcagctttaacaccaagggatctcaggggcctccttgggaccctcaagcagaggccacgttatcatgtcacgagggtgatcctaaagccgagcccttgtccacggccagtcaggaatctgtgaataggagagcgcttcgccaggaacgaaggaagatgatcgaaacagatattctgcaaaaagtgacgagagacgcttgcggccccacgagttccgacaaggggggagtgaaagaggccccgtgccacgctgcggagtcagcgccaagaagcaagatgcctcttgtggagcctccagagggacctcctgttctcagcttgcagcagctagaggcctgggacctggacgatatcttacagtcgctcgctggacaggaagacaaccaaggcaaccgcgcgcccggcactgtttggtgggccgccgaccacaggcaggtccaggaccgcatggtgccatctgctcataaccgcctgatggagcaactggccctgctctgcaccactcagagtaaagcgagtgcctgcgcgcgcaaagtaccggcagatacaccacaggacacaaaggaggccgattccggcagcagatgcgcttcacggaagcaggggtctcaggctggaccaggaccacagttagcccagggcatgcggctgaatgccgagtcacccactatatttattgatctgaggcagatggagctgccagaccacttatcacccgaatcctcgagtcattcttcgtcggatagtgaggaggaggaggaagaggaaatggcagcgctgggagatgccgagggcgcttcaccctctagcctcggcctgaggacatgcacggggaagtcacaactgctgcagcagttgagagctttccaaaaaggtaccgctcagccagagctcccagcttctaaaggacctgcaggaggccgggcccaggccccagaggacactgccggcagccggacagggagaaagcagcatatgaagctgtgtgcaaaagggcagagtgcccaagctcggctcccgaggggccggcctagggccctcggcgatgtccccgagcccggtgcggcaagggaggcccttatgcctccacttgaacaactctag

SEQ ID NO: 27702 - DNA, 828 bp, Artificial Sequence
  Description of Artificial Sequence: Synthetic coding sequence
atgccactggtcgaacccccggaaggacccccagtcctctcactgcaacaactggaagcctgggacctggacgacattttgcaaagtctagccgggcaggaagataatcagggcaaccgcgctcctgggacagtatggtgggccgcagaccatcggcaggtacaggacagaatggtgcccagcgcccacaacagactcatggaacagctcgctctgctgtgtacgacacaaagcaaggccagtgcttgtgctaggaaagtgccagccgacactcctcaggacacaaaggaggctgattctgggagccgctgcgctagtaggaaacaaggaagtcaggctggacccggtccccagctcgcccaaggaatgaggctcaacgcggaaagtccaacaatctttattgatttgaggcaaatggaactgccagatcatctttctcctgagtcgtcaagccacagtagcagcgactctgaggaagaagaagaggaagaaatggcggctctgggcgacgccgaaggggccagccccagcagccttggcctaaggacctgtaccggcaaatctcaactgctgcagcagctgagagccttccaaaaagggacagcccaacccgagcttcccgcctcaaaagggcctgcaggaggtcgggcccaggcaccggaagataccgcaggcagccggaccggaaggaaacagcatatgaagctgtgcgctaaaggccaatcagctcaggctcgcctgccccgcggtcggccccgtgccttgggcgacgtgccagaacccggtgcagcccgtgaggccctaatgcctccccttgagcagctgtag

SEQ ID NO: 27703 - DNA, 828 bp, Artificial Sequence
  Description of Artificial Sequence: Synthetic coding sequence
atggaagagagaaaagaggagggggaggccgaaattcaggagcacgggcccgagcattggtttagcaaatgggagaggcagtgcctggcagaggccgagcaagacgaacagctgcctccggaactccaagaagaagccgccgccgcagcccagcccgagcataagcaacagaagctgtggcaccttttccagaactccgccaccgccgtcgcccagctgtacaaagatcgagtgtgtcaacagccgggactgtctctctgggtgccattccagaatgctgcgacagccgtgacgaatttatacaaagagtcagttgacacacatcagagatcgtttgacatcggtattcagatcggttaccaaaggaggaacaaggacgttctggcttgggtcaaaaaacgaagacgcacaattaggcgggaggacctcatttcttttctttgcgggaaggtccccccccctagaaattcccgagccccgccacgcctgacggtggtgtcccccaatcgggctaccagcactgaaacctcttcctccgtggagaccgaccttcaaccatttagagaagcgatagcactgcatggtttatcaggggccatggcttcaatctcggtgcgctccagtactccagggagccccacgcacgtatcttccggatccaatgccagtaggcgtagaaatggtttgcatgacgtcgacctgaacacgttcatttccgaagaaatggccctccacctggataacggcggtacgcgcaaacgtacatcagcccagtgcggagacgtgatcaccgactccccaacccacaagcggaacaggatgatatag

SEQ ID NO: 27704 - DNA, 798 bp, Artificial Sequence
  Description of Artificial Sequence: Synthetic coding sequence
atgtccgagcagcagatggatctaaaggatctgatgcctacaaagagaaagtacatgtggaagactgccgaggaccgcagaatgtcggacctaacctgcgtgctggaatggcttgaaagacggcagggcaaaaagaagcaggcccctgaaaagcagaagccgaaagttgtcacggtgctgaagagaaacaaaaagaaagaggagaaaaaagggaagggactcatgaccgcacggggcggtaatagacgcgatactgagacatcacaacaggccctggggaagcgatttcgcaaagatgctgcttcctatcgctctctctacggggtcgagcagaagggtaagcacttaagcatggtccccggaagctacattaaggacggccccaaaaaatcggacaccgacatcaaggatgctgtggatccagaaagcacccagaggcccaatccttttcgaaggcaatcgatcgtgttagatccaatgctgcaggaggggacattcaatagccagcgggctacattcatccgtgattggagcaacaaaatgccagatatggcctacgaaagaaaattgaaaagcctgatggaaaagagcaccgagccgaagatggagaccatgaggatgctgaagccggaagaagttctgtcttgtcggtacctgaggctgtctaaagagaatattagaacactgctcaaattgtgcaaagacgccggcatgaacgtggatatacacccacatatggttgaggaggatatcgatgccaaaaaggtgttcaccgggatcccttcaatggcactatag

SEQ ID NO: 27705 - DNA, 687 bp, Artificial Sequence
  Description of Artificial Sequence: Synthetic coding sequence
atggagccagcttcatgctgcgccgaacggccaaagcctggaccaacaggcgtgaagacaaaaccaagttgcggggggtggcgcgcagttagcttactgctgctactcctcctcctggtactcgcagctgtgggcgtggtggctggaggcttattagggagcgcccagggccctccaaaaccccggctccagaccctgagaatgacacttccctccccacatatgccccggcccaatcaaacgatccttgtcgacgtagcacgcaacgcagcgaccattactgtaacaccaccccagtcaaatcacagttgggccgtgctgtttgacggccaaagtggctgtatctgctataggccggaagagcaccaggtgtgcttcctcaggctaatggaggactcggatcgagaaacactgcgcctgttggtggacacatccaaggtccaagaagcatgggtcccctcacaggacacgcatcacactcaagaactattggcagttcagggtagcttagaggtggatcccgcacaagccggtgccctggtgcaaagactgtgcatgcgaactcctatttattgggcccggagagccgaaggaccccggagacagcggctcatttacctatgtatcgacatatgctttccctccaatatttgcgtgtctgtgtgtttttattatctacccgactag

SEQ ID NO: 27706 - DNA, 582 bp, Artificial Sequence
  Description of Artificial Sequence: Synthetic coding sequence
atgttcaagaatacttttcaaagcgggtttctgtcaatcttgtactctattggttccaaacccctgcagatctgggacaagaaggtgcggaacggccacataaagcggatcactgacaacgatattcaatccctggtgcttgaaattgaagggaccaatgtgagtacaacatacatcacttgtcctgctgaccctaaaaaaactctgggcataaagttgccctttctcgtcatgattatcaagaatttgaaaaagtatttcacatttgaagtgcaggtgctggatgacaaaaatgtacgacgcaggtttcgcgcttccaattaccaatcaacaactagagtgaaaccttttatctgtaccatgcctatgaggctggacgacggttggaatcagattcagtttaatctactggacttcactcgccgggcctacgggacaaattatatagaaaccctcagagtgcagatccatgcgaactgtcggatccgtagagtctacttcagcgacaggctttacagcgaagatgaactgcccgccgaatttaagctctatcttcccgttcagaataaggccaagcagtag

SEQ ID NO: 27707 - DNA, 444 bp, Artificial Sequence
  Description of Artificial Sequence: Synthetic coding sequence
atgattgtgagtcgttatggcctggtgggatgtgatgctggtcaggtgcgcccaaaagtggaactttctttacccgcctttctagctctcccaaagaaggaatttaaggacaagccagaggttgaagaaaacaacctaatagaggaggccgtctggcagacttccttaaagatacctctgccccaagcccaggtccgcgagcgcgggggaggttccgcagggatctccgcagcacacccttctcagttgtgtacagccggagtccgcccttctagcgctctgagagcttcaagacctggttggagcctgcagactgcagctctccaggaaccaaccggtgccgattcctttttgccacgttcacataagacagctgttgacctgcatagcgcgagaatccccctgtacattcacacaaaatgcctccttatggagagcgtatag

SEQ ID NO: 27708 - DNA, 954 bp, Artificial Sequence
  Description of Artificial Sequence: Synthetic coding sequence
atggccagcgctggtgccgagcggcggccaggcgtgcaggaggctactgtggtcgggcagggtcagctaacggaagaaccagggagtgctcagacttctgagtgccccgttgctggcgaccagtttctggtcccagctcacgaagcccggggaacccagagtgaggaccagaggccagctggtgccgcctcggagtctgagctccaggaggaaggaccaaaattgggagaggagaggccaaaaccacatgcgggcgcgctcgaggagaggggcccacggccagtagtttccattgtacgacctcgccatggcccgaagaggaagcctgtcaagagccttagtcttcccgggttgagagctcacctcaaggcagaggccgaactgccacctaaactgcccttgcaagaggaggagccagaagactcccagagtgaaccatcacccagcgcaaagcagcacaaaaaagcgaaaaaaagaaaatcgctgggcgcccccgtgctccatgcagtggccagtatggtcagtgcgcctttggagactctccgtcttgaacgcaaggctcaacgcctaaggccactctaccagtatgttaactactgtaaccctgagttaaaccaggccggcaagggagatggtgaagcagaggtggaagctgaggcagagcttgctcctgtaccagaagagggcggagtcgaacaactacaggctctactgccccttgcaggagagcttgggcctggactggccctcccctgcccatctccactggtgactcccacccacgccctggccccactcggcgaagaagccggtgaggagccagggggactgccatcattgggggttagtgaccataaggctgaagttgacaagagcactcaagtggacattgataaaatgttgtccgtgtgcacagcacctttagtgccgcctcttagcccacagtataaatag

SEQ ID NO: 27709 - DNA, 465 bp, Artificial Sequence
  Description of Artificial Sequence: Synthetic coding sequence
atgagcgcgaccagagctaaaaaagtaaagatggcaaccaagtcatgccccgagtgtgaccaacaggtgccagtcgcttgcaaatcatgtccatgtggatacatctttatatctcggaaactgcttaacgcaaagcacagcgagaaatcaccaccatcaacagaaaataagcacgaggccaaaagacgccgaaccgagagggtccgtcgggagaaaatcaactcaactgttaataaggacttagagaaccggaagcggtctagaagcaactcccactccgaccatataaggaggggtcgcgggcgccctaaatccgcttccgccaagaagcacgaagaggagcgagagaaacaggagaaggagatcgacatttacgctaacctcagcgatgaaaaagcctttgtattcagcgtggctctggcagagattaatcgcaagatcatcaaccagcggctcattctctag

SEQ ID NO: 27710 - DNA, 282 bp, Artificial Sequence
  Description of Artificial Sequence: Synthetic coding sequence
atgtccgcaactagggctaagaaagtgaagatggccacaaaatcctgtccagagtgcgaccaacaagtgcctgtcgcttgtaagtcctgtccttgcggctatatttttatttccaggaaattgcttaatgccaagcactctgaaaagagccctccaagcaccgagaaacaggaaaaggagatcgacatatacgccaaccttagtgacgagaaggctttcgtatttagcgtggcacttgcggaaattaacaggaaaattattaatcagaggctgattttgtag

SEQ ID NO: 27711 - DNA, 576 bp, Artificial Sequence
  Description of Artificial Sequence: Synthetic coding sequence
tgagagcaagggcccgccgccccgaagagctggttgttgcttccaactactctcgccctccacggttccctcgatgcagtctcacaggcccaaggccgcccaggacacccagacgctccccccaatatttatgaggggggactgggcagccctcagccccaatgtccttcagctcaggggtcaaaaccaaagaatttccgattgaggcacctccgcgggctgggattgtacctcgagtctcacccaccccctaccgggcagtgtgaatctcattggctgggccgcctcatggctggaggttgtttgccccaacccgagggtactgcgtgggccctcgacctgcctcaaggtaccttggggccccgaaactccctctgttcagccttgttggaagcccgacttcccagagattcgctgggatctagcgccagcagttcctctatggaccccgataagggggccttacctcagccatctccctccaggctcagacccaaaaggagttggggtacctgggaagaagccatgtgcccactgtgtaaacggacaaggtctggagctctggagagaccatag

SEQ ID NO: 27712 - DNA, 996 bp, Artificial Sequence
  Description of Artificial Sequence: Synthetic coding sequence
atgctcaataggaaaacttcccattttctgggaatgcgagtgcagtctgaactggaacatctgagcgaactgagacgggaagccggcaaggaccggagctcagtgcacggctccgccgcccgcacacgcgcatctgtgcgcacccaatggaccacagccgcggccgctaaggcagatgaagatcccggggccaaccttttcccccctcctctccctaggcctagaatatgtatgtggaagtacttggacgtccacagtatgcatcagctggaaaagactaccaacgccgagatgcgcgaggtcttagctgagctgctggagcttggttgtccagaacagagccttagggatgccataacattggatctgttttgtcacgctctgatattctgccggcaacaggggttttccttggagcagacatccgcagcctgcgcgctgctgcaggaccttcataaagcttgcatcgctactcccctcggaaatgtggaggaatgttatcgctattttacttcggtattgttctgtcacggcgtccgccgcccaccattttcgatcgatctgtttaaggaggagcagttgctcgcactggaggattacgtggtgaatacatactttagacatttcaagctctataagtatgtcttcacgccacaggtgcgcttagatcttagtctgacttacatgggcctgcaaccacctaagctatggcctgagtctgaaacggagaaagaggagtccaaggagatggaagagcaagctgttacaccacagaaagaagaattggagaccgtcgcccctcccgagccggaaccctcacatattcatgtcctccgtgcatatattaaaactcaggtgaataaagagctggaacagttgcaggggctggtggaggagcggctgaaagcctcggaggagcgcctcagcagcaagttgaccgctttagagcgcccttttcagctccctccaggtaaaggcaaaagcaagactaaatag

SEQ ID NO: 27713 - DNA, 534 bp, Artificial Sequence
  Description of Artificial Sequence: Synthetic coding sequence
atgttaaacaggaagacctctcattttttggggatgcgagttcaaagtgagctagagcatctgtcagagcttcggagggaagccgggaaggatcggagtagcgttcacgggtccgcagctcgaacgagagcctcagtgcgaacccagtggaccacggcagccgctgccaaggccgacgaagatcctggagccaacctgttcccccccccccttccacggccccggatttgcatgtggaaatacctagacgtgcactccatgcatcagttggaaaagaccaccaatgctgagatgagggaagtgttagcagaattgcttgaactcggctgccctgaacaaagccttagagatgccattacactggacttgttttgccatgccttaatcttctgtagacagcagggcttctctttggagcagacatcagctgcttgtgctttattgcaggatctgcacaaggcctgcattggggaacgaggtcagctgcccgggctgagcccaagggaaaagcggaatagggcatggcacaagtag

SEQ ID NO: 27714 - DNA, 720 bp, Artificial Sequence
  Description of Artificial Sequence: Synthetic coding sequence
atgagagcatctcgcagtcccccttccccgcgccggtgtcaccatcaccatgaggcaacgggagcagccagtggggccgctgccggtgggcccggggctggctgtgtgggcctgtgtcgacttgctttgacaccaagcgcacaggatggccgtaattcaacttttcagacatacaagaaggaggtgtgtctcccacgtcactccatgcaccccgggccttgggcgatctgctgcgagtgccagactaggttcgggggtcgccttcccgtcagcagggtggaggccgcactgccttactgggtgccactgagtttgcgtccacgtaagcaaagccagaagaccgtacagttccctatcccccagactgcaaagatgtgtccttgcctctgtcataggttcggcggacggcttcccatgccccgtgatcaagctgttatgccatattgggttccacaggtcctgcgaagccagcagcagatcgtcagaagacagcagtcactgaaaggaattcaagcgccgctcctggatgcatgctgttggcataattgctggcggatttgcggtgatgaatgtttgcttagtaaattccaacagctgcaggcgccctatcaagaccagttaccggctcccgcagctaggctcttgccacttggtctgttaaccctactgcaagccatccctagagtcatcatggcaattcgacagtgctttggtgtgtag

SEQ ID NO: 27715 - DNA, 3426 bp, Artificial Sequence
  Description of Artificial Sequence: Synthetic coding sequence
atgtccttcagcctcaccttcactgagctggccaacattgctatcccacaatgtggcgtgctgaactttaaggctttacacctgctgttgcacggcattctggagcacattcatatggccgagctgaagaaggtgctttctggggacgaagactttcttcagacttcccaggtcgtaataatgccgcgtgagggagacgcccagcctatcctgaatcctatgaagaggctttcaaatgtattcgaccacgttgtctctcgcctggacaaactcgagaaccagctcgcgcttctgcaggatctaccttcgacagcacagttgctcgaagcaagtcagggaacagcgaggccagtccaggatctgtggcatctgattaagctccggaaaatggtggaaggacatgacgaagtgatggcaaaatctatgcagaccctccaagatctcctgacagatttgcacgcgcttcaagtgaccataacggcgttaagaaaagaagtggatatgcttaaaaacatgctcgataaagtgcatcctgagcgaatggacatcttcgccgaagatttcaagatccaaaattggaagatggtggccctacaacgcgaagtggcttccttgcaaaataagttcaaaacgatcccaaaaaccgaggacatggtgttgtggtccgggctgcacgatgcaatgtttaccagcgaaatcggctcaagtccactcgacctatggcagagcgtagagcagctgccagaggccgctctggcgcagaccacgaaatacctcgaggcaacaagggcaatccaagtgagcgaacccgtccagaatccccagttgctccaaacggtctggcactacgaggtccccgagttgctgccagagggctcttctgcgcaggcagtgagccttagtagggcccaagagccagcccagccgccagcccttacgcccgagtcagcccctggatgcactactgagtttgcaccaggccctgccccgggcaccgagcccgtacccggactggaactcggactcgagctagaacccgtgccggccctgggacccgttcctgggccctctgtgaccccaggatccctgcccgccccttggcctgtgctgggccccgtacctgcccccggtgcacagccccctcctcttggggactggccggccttgccacggcgatggcccctgccacagggctggcctcgggtgggctcgtggccgttgtgggatctgggtgtcctccggcccactcagccccagccatcccgggcccctccccccgctaccgagtttgggtcactctggccccgacctctgcagccttatcagagccggcagggcgaggctctgcagctggccgccgtgcaggtgaaaggggaagagaacgacgtgccatccctgcgcggcctccgagaacgggctaggaaagatggagcgcccaaggaccggactcgaaaagatggcgtgcccaaggatcgcgggggtaaagacgttgatcccaaggacagagcgcataaagacgatgtacctaaagatcgtggcggcaaggacgtggacccgaaggaccgcgcccataaagatgatgtgccaaaagaccgaggcggcaaggacggagacccaaaagaccgggtggggaaggacggggctcccaaggaggcacaacctaaggccccacaatccgctctacataggctaaaaacaacagctgcgatcgcggctgcagccgcagccgcctatgcggccgctacatcatcagctgcacaagccgctaaggtcgcggctaagttcgtgaaggatgctccagccactaagatggctgcaattgcaactgacaccgccgcagctggccccctgggggtgttcgcggatgtactgggggctggaccgtcaagaggtgctacagagagccagatcctcggtgacgactctgaaatctatgagatactgagtccctcctatagcgcagccagcattggcccagatccagccctgtctcaagccatggtggccaccaagcaagctatgagccccgaagataaaaaaagggcagttaagtatagcatgagtcatatagcgcagatccccgttaagcatgattccctcaaggaggaatttgctcagcttagctgtaatctcaaccagcggctgtcatatctggccaatatgggcggtccatcgtctctcggtaccacagtggacattcttcagaaaaagattggctccctacagaaatctcggctaaaggaggaggagctcgaaagaatttgggggaatcaaattgagatgatgaaagaccgttacatcaccctcgacaaggctgttgaaaatttacagattcgaatggacgagtttaagacgctccaggcacagatcaagcgtctggagatgaacaaagtgaacaagtccactatggaggaggagttgcgagagaaggctgatcggtccgccttagcgggaaaagccagccgagtggacctcgagaccgtggccttagaacttaacgagatgatccagggcattctgtttaaggtgaccatccatgaggattcctggaagaaagcgatggaggaactgagcaaagacgtgaacacaaagctggtgcacagtgacctcgatcctctgaagaaggagatggaggaagtgtggaagatcgtcagaaagttactaatcgagggcctcaggctcgatccagattctgctgccggattccgccgcaagttgttcaagagagtgaaatgtatttcctgcgacagaccagtggaaatgatgaccggcccccaactcattacaattcggaaagctcatcttctctcccgcctgaggcctgcctccgcaaactcctgtgagtaccttcagaggcagcaaatgagagagcaacagtggctgcagctgcaggacttggggatccaggaagattgtcagcaggattggggagacggaccacagaacgccacaagtttgaaatgcaagagttgcaatcttctgacactgtacccgtacggagatccacatgtgatcgattacgattctgcggaggtggatatactgggcgtggacggcattctgtacaaaggaagggttaattcgcagagaggcgctcagcctctagccgtcgcgaaggaactggcggcagtcaaggcccccagccccccaagtcaatctctgtatgaccgcgtgcattccagcgcactgtttggcgctatatgtccgcccctctgcccacgctctagcgcctgcagcgccgctagcggtcctcaccttactatgcctgcgcggcccccatcactcccaccgctactgctgcttccgcctcttatcccctctctcagggacccccagcaggccccagggtccacaaggttatcccgcgcccctcacatcgagtcaagagtcggccggaaacctcccgaagagccagctaatccttag

SEQ ID NO: 27716 - DNA, 495 bp, Artificial Sequence
  Description of Artificial Sequence: Synthetic coding sequence
atggccagcgccaggggtgctaagcaatcatcaccccgggtcggcacaactagatatacagagacaagtaccgtaagagtggaaacatcctctcaccgggtagagacctcatcccgaagagtggaaactagccaacggaggagcgaagggccatcactttccccaagcggcaagcgcctcccgaggatcctagaggccagctcccgccatgtggagagtagcagtcagaggactgaaaccacgagtcgtcatgtaagggcgtcctctctgcgagtagagacctccctgcattgcgccgagtctcccactccacgtcctagccgcccgcccgctcgcacaaaaaaacgaccggacgaaatgttattgccaaaaggtcatcagggggctcgggccttatcacaggaccgaaaagccagtagttgccagcctgcatctcaacttcctggcggaccgattatctttggttttatggaaacaaaccataaaagcatgtag

SEQ ID NO: 27717 - DNA, 504 bp, Artificial Sequence
  Description of Artificial Sequence: Synthetic coding sequence
atgtttgacttcagctttccaacccccgcatccgctggaaccaggatgggccccgcttcctgtggaggaaggagcctgcacttgccccagctgagattctccagggtcgacgctacggcggttacagatgtaccctttcaacgcatgcatgcacctcaccgtgcccctgaagttttttgttccagatcaagcaggggtgccgggcggggtcatcccactcccacacccagggtcagatgggctctcgccggcaatcagccgagatgttgtgcgcagctgctcagcggccgtggcgggtccggtgcccaacttcgggctgggtgggtacgcggggcagcagttggtaatctgtttatcttactcctaggcaaagaggatggggaggaggagggcacagttctgtcatattcatccatggtgcacatatctaatataacaggcatcgtcggaacaactgtgtcaagaactaagcctgctctcgtgctgatggaactgactttctag

SEQ ID NO: 27718 - DNA, 339 bp, Artificial Sequence
  Description of Artificial Sequence: Synthetic coding sequence
atggctcactctgcagcagcagtgccactgggcgccctggaacagtgcccgatccgagtggagcacgaccgtcgtcgtagacagtttactgttagactgaatggctgccatgacagggccgtgttattgtacgagtacgtgggcaagcgaatcgttgacctgcagcatactgaagtgcctgatgcatacagaggcagaggcatcgccaaacatctggccaaggctgccctggatttcgtggtggaagaggatctgaaggcgcacttgacatgttggtatatccagaaatacgtgaaggaaaatcccctcccccagtacctggagagacttcagccttag

SEQ ID NO: 27719 - DNA, 2478 bp, Artificial Sequence
  Description of Artificial Sequence: Synthetic coding sequence
atggaggtgcgtcgcggggatacctgcccacggccacacccatccgggctcagagaagaaggattggagcccaaggtggcatttccaggtggcgcaaataggtgctggaacctcggggctgatgccggaagtcggcttacggatgttttcggatccgtcatgctgaccggctccgccagcttttacgattgttacacgtctcagtccgaagataatgtcgatttacgccagacctatacgcctttctcatctacagagtattcttctagcgtcgactcctcgctgttttgtgcaccatggtccacgtacggtgatgacattaagcagccaagcaactctcagatctctatcaagaataggatccagaccgaaagaaacgattatggctcagagactgacttgtatggcctggtgagcaacattctcgaggaacaagataagagccagccatatttcgccgaaggcacgtgtagcagcaacttgaaatccgtttggccgatgaatacctcaaggtttgctgatcaccacgaccttctgactgagaccaagcggccaattgatacagtcatcagccagcaagcattctattccgatgaaagtgtcagtgccatggaaaagcagtacctgaggaacagcaatctgaccccacaacagaagatagacgagcttcaccacggctttacaggtctggacttggaggaacagtggatgtaccccagccggtctgaccactctaactgccataatattcagaccaacgacactgccaagactacctttcaggagtacccactgattaagaactgtttcaccccgcagaccgggctgagcgatatcatgaaagaatctggcgtcgatatctaccactacggaagagatcgcatttgtaccaaaggactggaagctcccttgcagcagaaaagggccgagatgtttttatcccagtttaaccgatacaatgaaaacgtggattactgccgctatcctgaatacgtacaccccaacaaggccaagctgaataaatgtagcaatttcagcgtgcaggacagcaaaaagttggccaatggcaccccggaaacacctacagtcgaggccgacacctataccaagttatttcaagtgaaaccggccaaccagaaaaagatggaagaaacaatcccagaccaacagaacttcacattccctaagaccacaccacacctcactgaaaagcaattcgctaaagaagctgtgttcacagccgacttcgggcttactagcgagtatggcttgaagccacacaccgcctgccctgctaatgactttgccaatgtaactgaaaagcaacagtttgctaagcctgaccctccgcattcagagtactttaagtccgtcaacctgctctcaaatagtgcgacatcatccggaggcataaatctcaacaggccaacctggatgaacgttcagaccaagaacaatacccccatcccatatcgaaaccagggcaatcttatgaagcttaactcacatctcagtgcagcttctaaaggaagtaaccattcttcagatttcccacagctgtcgtccactaacctgacacccaacagtaatttatttcagaagtattgccaggagaacccctctgctttctcatcttttgattttagttactctggagccgagcgcatccagtccgtaaatcacatcgagggcctcacaaagcccggcgaggagaacctcttcaagctggttacagacaagaagataaaacagcccaatggattctgcgacaattatagcgcccagaaatatggaatcattgagaatgtcaacaagcataactttcaggcaaagccacagtcaggacactacgatccagaagaaggtccaaagcacttagacggactctcccagaacacttatcaggatctattagagtctcagggccattccaacagccatcggacccgtgggggcgataactcccgggtcaaccgaacacaggtgtcttgctttagcaacaattacatgatgggagacttgagacataaccaatgtttccagcaattggggagcaacggcttccctctgcgctccactcatccttttggccacagcgtagtcccactactggacagctatgacctgctgtcgtacgacgatctgagccacctgtacccgtactttaacatgatgtacggcgacaactctttttccggcctaatgcctacctttgggttccaacgtcctatcaagacccgatccggacctgccagcgagctgcatattcgactggaggagtgttgcgagcagtggcgcgccttagaaaaggagagaaagaagacggagctggctttggcaaagaactaccccggcaagaaagtgtccagcacaaataatacccccgtgccgcgcctgactagcaacccttcaagagtggaccgattaatcgtggatgagctgagggagctagcaagagtatcctgcaaaaaccggtag

SEQ ID NO: 27720 - DNA, 2859 bp, Artificial Sequence
  Description of Artificial Sequence: Synthetic coding sequence
atggaggtgcgccgcggcgatacctgccctaggccacaccctagtggtctgagagaagaggggctcgaacctaaagtcgcttttccaggcggcgccaatcgctgctggaacctcggtgccgatgctggcagcagactgactgacgtctttggctccgtgatgctgaccggctcagcctccttctacgactgttacacgtcacagagcgaagacaacgtagacctccgtcaaacgtacacccccttctcaagcacggagtactcttcatctgtcgatagtagccttttctgtgctccgtggagcacttacggtgatgatattaagcagccgtctaatagccaaatctcaattaagaatcggatccagacagagagaaatgactacggcagcgagactgatctctacggcttggtctcaaatatcctggaggagcaggacaaatctcaaccatatttcgctgaggggacatgcagctcaaacctcaaatcagtttggccaatgaatacctcacgatttgccgaccaccatgacctgctgaccgagaccaagcgtcctatcgacaccgttatctctcaacaagctttttacagcgacgaatcagtgtcagcgatggaaaaacaataccttcgcaactccaacctgacccctcaacagaagatcgatgagcttcatcacggattcaccggtctcgacctcgaagaacagtggatgtacccttctcggagtgaccatagcaactgccacaacattcaaacgaatgatacagctaagacgaccttccaggaatatcctctgatcaagaactgctttacaccgcaaaccggactgtcggatataatgaaggaatctggcgtggacatatatcactatggcagagatagaatatgcaccaagggtctcgaagccccgctgcagcagaagcgggccgaaatgtttctcagccagttcaaccgctacaatgagaacgtggattactgtcgatacccagagtacgttcatcctaataaagccaaactgaacaagtgttctaatttttctgtccaagactcaaaaaagttggccaacggcacccctgaaacaccaaccgtggaggccgacacgtacaccaaattattccaagtgaaacccgccaatcagaagaaaatggaagagaccatcccagaccaacagaactttacattccctaagaccaccccacacctgactgaaaaacagttcgccaaggaggctgtttttactgcggacttcggtctgacttctgagtacggtctcaaacctcacaccgcctgtcctgccaatgatttcgccaatgttacggaaaagcagcaatttgcaaaacccgatcctccacactccgagtacttcaaatctgtgaacctgctgagtaattctgctacaagctccggcgggatcaacctgaataggcctacctggatgaatgtccagactaagaacaacaccccgattccatataggaatcagggcaatctcatgaaactcaattcacacttgtcggccgctagtaagggttcaaaccattcctccgactttccacagctcagctcaacaaatctaactccaaatagtaacttgttccagaagtattgtcaggagaatcccagcgcatttagttctttcgattttagctattccggcgcagaaagaatccaaagcgtcaaccacattgagggcctgacaaaacccggggaggagaacctgttcaaactcgtaactgacaagaagattaagcagcccaacggtttttgtgacaattattcagctcaaaaatatggaatcatcgagaatgtgaataaacataacttccaagctaagccacaatctggccattacgatccggaagaggggccgaaacacctggacggtctgtcgcaaaacacatatcaagatctgctggagtctcaaggacatagtaattctcaccggacacgaggaggcgacaacagtcgcgtcaaccgcactcaggtgtcctgtttcagtaataattatatgatgggggatctgaggcataatcagtgcttccagcagctgggatctaatggatttccattgagaagcacacatcccttcgggcactctgtcgtaccgctcctggacagttacgatctgttatcatacgatgacctctcgcatctctatccctacttcaatatgatgtacggggataatagtttctccggtctcatgcctacattcggcttccagcgcccgattaaaacccggagtggccccgctagtgaactgcatatacgtctagaggagtgctgcgaacaatggcgtgcgttggagaaagagcgaaaaaagacagaattagctctggccaagaactacccgggaaagaaggtgagctccactaacaatactcctgttccaaggttgacctctaacccctcccgagtagataggctgattgtggacgaactgcgcgagctagcccgggtggtgacgttactggggaagatggaacgcctcaggtccagtctgctccatgccagtatttccacggctctcgatagacacttagaatctatccacattgtgcagagtaggagaaaggacgaaatcgtgaatgcgagcaaccgccaacgccagggtgtgccacgctgtcaggatgaccgggatgtgtttgctctggcttccgccattaaagagatgtgcgtggccacgcgtaagacccgcaccgccctgtggtgcgcgctgcagatgacactaccaaagactgccagcaccgccgatgtggtgaaacctttgcaggatactgtcaactgtgaggacaaggtccacgagtccatcaacagctccaatcccatgaatcaacgcggggaaacaaataaacattag

SEQ ID NO: 27721 - DNA, 1980 bp, Artificial Sequence
  Description of Artificial Sequence: Synthetic coding sequence
atgaatacctcccggtttgctgaccaccacgacctcctgactgaaacaaagcgtccaatcgacaccgtcatctcacagcaggccttttattctgatgaaagtgttagcgcaatggagaagcagtacctgagaaactcaaatcttactcctcagcagaaaattgacgaattacaccacgggttcaccggcctggatctggaagaacagtggatgtacccatcccggtcagaccactcaaactgccacaatatccagacaaacgacacggctaaaaccacatttcaggagtaccctcttatcaaaaattgttttacgccacaaaccgggttgtccgacattatgaaagagtccggagtggacatctatcattatgggagagataggatctgcaccaaaggcctcgaggcccctctccagcagaagcgggctgagatgttcctgagccaatttaaccgctataacgagaatgtcgactattgccggtatcccgagtatgtccaccccaataaggcaaaactgaacaaatgcagcaacttcagtgtgcaggactctaaaaaactggctaacggtaccccggagacccctaccgtggaggctgatacatacacaaagctgttccaggtcaagccagccaatcaaaaaaaaatggaggaaacaatccctgaccagcaaaacttcaccttccccaagacaacccctcatctcaccgagaagcagtttgccaaagaagccgtgtttactgccgacttcggcctaacaagtgaatacggcctgaagccacacactgcatgtcctgcaaatgactttgcaaatgtgacggaaaagcaacaattcgctaaacctgaccctccccactcggagtattttaagagtgtcaatttgctgagcaactctgcgacctccagtggcggcatcaatcttaataggccaacctggatgaacgttcaaacaaagaataatactcctattccttaccgaaatcagggcaacctcatgaaactgaacagccatttatcagccgctagtaagggctccaaccactcgtccgacttcccccagctatcttcgacaaatctcacgcctaatagcaacctcttccagaaatactgtcaggaaaatccgagtgcattctccagctttgatttctcttacagtggggccgagagaatccagtccgtgaatcatatcgaaggccttactaagcccggagaagaaaatttattcaaactggttacggataaaaagatcaaacagccgaatggattctgcgacaattactccgcccagaagtatgggatcattgaaaacgtaaacaagcataacttccaggccaagccccagtcaggacactatgaccctgaggaagggcccaaacacttagatggtttaagccagaacacctaccaggatctgctagagtcacaaggacatagcaatagccacagaacaaggggcggggacaactccagagtgaacagaacccaggtttcctgcttctcaaataattatatgatgggagaccttcgccacaaccagtgcttccaacagcttgggtccaatggatttcctttgaggtcaacacaccccttcggacacagcgtcgttcctttgctcgattcttatgacctcctgagctatgacgatctgtctcatttgtatccttattttaatatgatgtacggggacaatagtttttccgggcttatgcccacatttggattccagaggcctattaaaactcgcagcggcccggcttcggaactacatattcgccttgaggaatgttgcgaacaatggagagcactcgaaaaggaacgaaagaagactgagcttgcgctggccaaaaattatcctggtaaaaaggtgtcaagtaccaataacactccggtacccaggcttacatccaatccatctcgcgtggatagactgattgtcgacgagttgagagagctagcacgggtgtcctgtaagaatcgctag

SEQ ID NO: 27722 - DNA, 492 bp, Artificial Sequence
  Description of Artificial Sequence: Synthetic coding sequence
atgaatacctcccgtttcgccgatcaccacgaccttctgactgaaaccaagaggccgatcgatacagtgatatcccagcaggctttctactccgacgagtctgtgtccgcaatggagaaacaatacttgaggaactctaatcttacaccgcagcagaagattgacgaattacaccacggattcactggtctggatttggaagagcagtggatgtatccttctcgctcagaccattctaattgccacaacattcagaccaatgatactgcaaaaacaacgttccaggagtacccactcatcaagaactgcttcaccccccagacagggctctccgatataatgaaagagtctggggtagacatctatcattacggccgtgacaggatctgcactaaaggactggaagccccactgcagcaaaaacgagccgaaatgtttctgtctcagttcaaccgatacaatgagaacgtggactattgcaggtacccctag

SEQ ID NO: 27723 - DNA, 390 bp, Artificial Sequence
  Description of Artificial Sequence: Synthetic coding sequence
atgaacacttctcgttttgccgaccatcatgacctgcttactgagaccaagagacccatcgacactgttataagtcagcaggccttttattctgacgaaagtgtcagtgccatggagaagcaataccttcgtaatagcaacctgacccctcagcaaaagattgatgagttgcaccatgggtttaccggcttggacttagaggaacagtggatgtacccgtcccgctcagaccacagtaactgtcacaacattcagacaaatgacacagctaagaccacattccaggaataccccctcattaaaaattgctttactccccagacaggtctgtctgatataatgaaagaatctggggtggatatctaccattatggtcgggaccggatctag

SEQ ID NO: 27724 - DNA, 495 bp, Artificial Sequence
  Description of Artificial Sequence: Synthetic coding sequence
atgaataattcactggactacctggcttatccagtaatcgtgtcgaatcaccggcaaagcactaccttcagaaagaaacttgattttggccattatgtgtcacacaaaaacaggatccagattgctaagccaacggtggatactaaaccgcccgtggcgcatacaaaccatattcttaagcttagcaagctgcagggcgagcaaaaaaagatcaacaagatcgagtacgagaataaacaactgtgtcagaagatcgcaaacgcccaccgcggccccgctaaggttgattgctggaatgagtacttctcgaagagcctaaatagggaaacaagaaatcgagagctcgtcaggattaccatggagaatcagggtatcttaaaacggctcgtggaccgcaaaccccattatgacagacgtgcctccgaaattgattggcagaacagccggcgctacatcaggaacaccaccagatacctgctgagccagaacgagtag

SEQ ID NO: 27725 - DNA, 573 bp, Artificial Sequence
  Description of Artificial Sequence: Synthetic coding sequence
atgaagggaacgcctagtagtctggacacattaatgtggatttaccacttccacagttctactgaggtggccctgcagcccccattactaagctctcttgagctaagcgtggctgccgcgcatgaatatttggagcagagatttcgggaacttaagtccctggagcccccggagcccaaaatgcaaggtatgctgccagctccgaaaccaacacttggattagtattacgggaggcaacagctagcctagtgtccttcggcactacactgttggagatcagcgctttgtggctgcagcaggaggcgcggcgacttgacggcagtgctggccctgcccccgatgggagagaccccggcgctgctctgtccagggtcgcccaggctgccggccagggagttaggcaggccggggctgcagtaggcgcatctgccagactactggtccagggcgcctggctgtgcctctgcggaaggggccttcagggtagtgcctccttcctgagacagtcacagcagcaactcggcctcggcatccctggtgaacccgtgtcctccggtcacggggtcagctag

SEQ ID NO: 27726 - DNA, 237 bp, Artificial Sequence
  Description of Artificial Sequence: Synthetic coding sequence
atggctcctcttccaggagctgaactcgtacgtaggccattacagctctaccggtatctgctgcgctgctgccagcaactacccaccaaaggaattcaacaacactataaacatgcggttagacaatcgttccgcgtccatagcgatgaagacaatcccgagcgcatccaacagattatcaaaagagcaattgaggacgccgactggattatgaataagtataaaaagcagaactag

SEQ ID NO: 27727 - DNA, 189 bp, Artificial Sequence
  Description of Artificial Sequence: Synthetic coding sequence
atggaccagttggtgttcaaagaaaccatctggaacgacgcgttctggcagaatccttgggatcagggggggctcgccgtgatcattctgttcattacggccgtgttactgttaatcctgtttgctattgtgtttggcctcctgacatcgacagagaacacccaatgtgaagcgggagaagaagagtag

SEQ ID NO: 27728 - DNA, 903 bp, Artificial Sequence
  Description of Artificial Sequence: Synthetic coding sequence
atgtgcgcccggggccaggtgggccggggcacacagttgcgaaccggtcgtccttgctcccaggtgcctggatcgaggtggcgcccggaacggctattgaggagacagcgcgccggaggcagacccagtcggcctcaccctgcgagagccaggccaggactttctctgccagctacgctcctgggtagtcgtgccgctgcggccgtacccctccctttgcctccagctcttgcccccggggatcctgccatgcctgtgcgtacggaatgcccccctcctgccggagcatctgccgcctctgctgcctctctgatccccccacccccaatcaacacccaacagcctggcgtggcaacttcactgctctattcagggagtaagtttcggggacaccagaaaagcaaggggaactcttacgatgttgaggttgtgctccagcatgtggatactgggaatagttacctctgcggatatctcaagattaagggcctgaccgaggagtacccaactctcacaaccttctttgaaggcgaaatcatctctaaaaagcatccctttctcacccggaagtgggacgcagatgaggacgtcgatagaaaacattgggggaaattcctggctttctaccagtatgccaaaagttttaatagtgacgattttgactacgaggaattaaaaaacggtgattacgtattcatgagatggaaagagcagttcctcgtgcccgaccacacaatcaaggatatttctggcgctagttttgctgggttctactatatatgtttccagaaatctgcagcgagcatcgaagggtactactaccacaggtcttcagaatggtaccaatctctgaacctgacccacgtacctgaacattccgcacctatctatgagttccgctag

SEQ ID NO: 27729 - DNA, 681 bp, Artificial Sequence
  Description of Artificial Sequence: Synthetic coding sequence
atgcccgtgcgtaccgaatgtcctcctccagccggcgcgagcgcagcatctgccgcctcattgattccgcctccacctattaatacccagcagcccggcgtagccacaagcctcctatactcaggttccaagtttaggggacatcaaaaaagtaaagggaattcttacgacgtcgaagttgttctgcagcatgtggatacgggcaattcttatctgtgcggttatctgaagatcaagggacttacggaggaataccctaccctgaccactttcttcgaaggagagatcatctccaaaaaacaccccttcttgacacgcaagtgggacgctgacgaagacgttgaccggaagcattggaatataggcaggtaccttgatctgcaaaccctactcgattggactgagacgttttgggtccgggaggagctcaggagacccccactggtgctcgcatgtgaagtctggctcagtcagggcgctgagccgatggagtgttttttgctgcagcagtttgtggccgcatttgtggttttgagcatctctcccaactttcatcacagctggaggacgcccagatttccaagggggactcctggggcgctgtactgcacctgggtgtgcctaagatttactatgtcaaataccctccacctcggctgccatttcttcatcattaactag

SEQ ID NO: 27730 - DNA, 1155 bp, Artificial Sequence
  Description of Artificial Sequence: Synthetic coding sequence
atgggagtgactggggcacacggtttcccctgttgcggcaagggctcggtcgaggtggccgagatgagagatgatcttagccaacaccagatccaggaagagcaagagctggaggccgatatgctggaacagaaaccacagctgcaggttgatctcgatctggacccggacccagacccagatccagagctcgagatcggacaggtccccgcacttttggagagtgaactatatcctgccctgaaactggaggccgagttggacacagaagccaacagcaacgaagagtccgactttgaagagcctatgcaactggtatgcaagatcgaatcggttcattctaacatgggactgccaaccccgcagaccttccggccatggtctttgaactccaattgtcggagcttcacagaggagaatcatgtgagtgcttgccaccattctatttccgctcagacgtcgaaacacctcttttgggcaaacaagctaattcaagcctcagaacactcacttcagcgggccattaacatgcagctcaacaacggatctgctggccagccgatcagatcccctctcagagaggctattcctacaaatgccctgtgcagcgaggagcaactccagatccctgatgcccatagcgctcctcccacaacttcttcccaggcacccagccctctgcttagcagcgacctgcccccaccaatcgacctaaccgaactcatcacctttgcctcatccctggctatggcaagttcttcacgtatggatttaccatccctggaacatatgatgaaagcaccacctcaggaggctttagaacctagcaccgaaccactgctgactaccgtggaggaacgggaacctgaaaatcatgctgaaacactgccagagaaaccaagagaggcccgggcacctctgaaatcttggtcccaggaagacaaaaacttcgcgcagagctattttgatttctctaaacccggcattaaacgggcgacaataaagggccaaatacagttgttgcaaccgcctgccacaagcccactgctccagggttcgaaagaggacagcgtgccgcctgggaaagaaaaggaaaatccactgctggtcaagatccattttaaactgagtgcccctaccattccagagaaatag

SEQ ID NO: 27731 - DNA, 1092 bp, Artificial Sequence
  Description of Artificial Sequence: Synthetic coding sequence
atgcgagacgacttgtcccagcaccagatccaggaagagcaggaactggaggcagacatgctggagcagaagcctcagctccaagtagacctcgacctggaccccgatccagacccagatcctgaactagaaatcgggcaggtgccagcactgctggaatccgaactttatccggctctaaagctggaggctgaactggatacagaagccaattctaatgaggagagcgatttcgaggagccaatgcagttggtgtgcaagattgaatcggttcatagtaatatgggccttcctacgccgcaaaccttcagaccttggtcccttaattctaattgtaggtcgttcacagaagagaatcatgtgagcgcttgccatcacagcatatccgcacagacttcaaaacacttattctgggcaaataagctgatccaggcttcagaacattctctgcaaagagccattaatatgcagttaaacaacggctctgccggacagcccattcgcagccctttgcgagaggcaataccaacaaacgctctctgttctgaagagcagctgcagatccccgatgcgcatagcgctcctcccaccactagttcccaggccccctcaccacttctctccagcgatttacctcctccgatcgacctgaccgagctgatcacctttgccagcagtctggccatggcgagcagctcacggatggacctgccttctctagagcacatgatgaaggcacccccacaggaagccctggagccctccactgagcccttgctgacaaccgtcgaagaacgcgagcctgagaaccacgctgaaacactccctgaaaagcctcgggaagccagggcgcctttgaaatcctggtcgcaggaagataagaacttcgctcaatcctactttgactttagcaagcccggcattaagagggcgacaattaaaggacaaattcagctccttcaaccgccagctactagtcccctcctccagggtagtaaagaagattctgtccctcctggaaaggagaaggagaacccactgctggtgaagatccactttaaactgagcgccccgacaatccccgaaaaatag

SEQ ID NO: 27732 - DNA, 1713 bp, Artificial Sequence
  Description of Artificial Sequence: Synthetic coding sequence
atggtaaaaacaaataaacccggggccaaagttgctgtctcagcacagaggggctcagaagtaaccaccaatactagccctcagcagggacacggttacgtactagcgtcatctcatcgctccgctgccgtgtccctgaacccgtcccacaggaggtctgaggcagctcacccaaccactccacattcagcgtcagattatcctagatccgtgagtttacagagcggcccgggccattatgccgtgcctacccccaggggcccagagaccggtcccaggacggaaagttcacgccactcaagtccccaccttaagtcccaaaagacccaaacgctcgccagtcacgcctcgagccgccaatggaaagtgagcccccctagagaggaggcagcccgtagaggcagtgagagcaagagcggccgggaggttggtcaccacgctagcagtattcctgacgctaagtccacacaccagctgtccttccaagatcagaagaacaacctccaatcccagattctcgaggatgacccgccctcaaaagtccaaaacccacagggtgttcgcgtcccgcgccggatcctgtcttatcccaaggatgaagcagttcagactgaacctatccagcgcatcactaccacgtctgagattcggtcgccccgcagcccttccctcctggagcatgggtcctcctgcgtgtctgctgactatcagaccgcacagaggagggtgcccgtggaggaatccgaaactgggccatatgggccgatcccctctaaacctaaggccctctatagaaacatgaacctagattctcttttaaagctgagtgtcctgaaggactctgatggggtacaccgagtaagcgctcgtgtggatcctgagtcactgcataagtacagcgcatatcccgagaccaaaccaagcgccaaagtgctggtgtcctcccaggtagaatccaacgtgcggacacccattagaggaaactcagaggtcggacgccgagtcacgatatcacctggggtgcagtctgtcgagcccacccaccatgtgaccgtgccatcagtgtctgaggggagtcacaagagctcaatgttcgtgactccagagcccatctacaagcagcagacacagaagccccctgaaatcacttacatgtcccagggaccaacgcctagatatcctgagctctctcaaaagccttccatccatgcagaactggaactgaccccgaggccactgcccccaagatcactacctcgctacggccccgactcctcttggtggcccttgttgaatccggaggtagaaaccccacagtctcagttaacaaccccggattttgagcctaagtgctctccctctctggacttgttactctccggtttcaagatagactcttcacccttctgtgaagatttaaaattccagagagaaaaggcatcactttctcccccttccccgcctaaggagtttccgagctgggccccactaagcgaggtccctcagactccaaagcatacatgcaagcagccaattcagcgatttacagcctttttcttggatgtgtcagaggagatgtataaccgcgtcatatggtggctgaagggcctctgcttcagtctgctctgggcccactgcggctctctaggcgatggacgtactggagaggaatggcatctgtgtatttaccgggccggatccttcagacgatag

SEQ ID NO: 27733 - DNA, 1029 bp, Artificial Sequence
  Description of Artificial Sequence: Synthetic coding sequence
atggatgacaagccaaatccggaagcacttagcgactcaagtgagcggctcttctcctttggggtaattgctgacgtccagttcgcagacctggaggatggcttcaatttccaagggactaggcggcggtattaccgccactctctactgcaccttcagggagcaattgaggactggaacaacgaatcttcaatgccctgttgtgtcctccagctcggagatatcatcgatgggtataacgcccagtataatgccagcaagaagtctttggagcttgtgatggatatgtttaagaggctgaaagttcccgtgcatcatacttggggaaatcatgagttctataacttttcacgtgagtacttgacacacagtaaattgaacacaaaatttctggaagatcagattgtgcaccatcccgaaacaatgccatctgaggattattacgcgtaccatttcgtcccttttccaaagttccggtttattctgcttgacgcatacgacctctctgtcttaggcgttgatcagtcctcgcctaagtacgaacagtgtatgaagatcctgcgtgagcataatcccaataccgaactgaactcccctcaaggcctatcggagccgcagttcgtccaatttaacggtggattttcacaggaacagctaaattggcttaacgaggtgttgactttttcagataccaaccaggaaaaagtcgtgattgtaagccacctgccgatttatcctgatgcatctgacaacgtgtgtctcgcatggaattatagagacgccctcgcagtgatctggagtcacgagtgcgtggtctgtttcttcgcaggtcacacgcatgatggtggctactcagaggatccttttggggtgtatcacgtaaacttagagggcgtgatagagactgcccccgacagtcaggccttcgggaccgtgcatgtgtacccagataaaatgatgctgaaggggagagggagggtacccgaccgaataatgaactacaaaaaggaaagagccttccattgttag

SEQ ID NO: 27734 - DNA, 525 bp, Artificial Sequence
  Description of Artificial Sequence: Synthetic coding sequence
atggacaagcatggagtcaaaactccactgtggaagaaggagactgaggaactgcgggccgaggatgcggagcaggaagagggaaaagagggctcagaggatgaagacgaagacaaccagcgccctttagaggattctgcaacagaaggagaggaacccccacgcgtagctgaggagggagaaggacgggagaggcggtctgtgtcttactgccctctgcggcaagagtcaagtacccagcaagtggcacttctgcgtcgggcagatagcggcttctgggggtggctgggtccactggctttgttagggggccttaccgcgcctacagacaggaaacggagccttccggaggagccatgcgtgctcgaaatccggcgccgaccccctcgtaggggtggatgcgcgtgttgtgaactccttttctgtaagaagtgtaggtcgcttcactcacatcctgcttatgtcgcccactgcgtgctcgatcaccccgacctgggtaaagccggagctgccggcaatagttag

SEQ ID NO: 27735 - DNA, 666 bp, Artificial Sequence
  Description of Artificial Sequence: Synthetic coding sequence
atgggagagaagagtcgtcgcaaagggcccgctccaaggcacgcagatgggaaactgggtaggacatgtgaccacccatacgctccctggtcattcacccctagtagccgagcgcccactgcatgggtgaggccaccttgcccggtgtgggctagccgacttcaggaacactcacccgagcctcggagagcccgcgcaccacccacgaggagggctcaagcggccctatacgctcctgcacttcgcctgagagaccatctggacagattctccatactgatgaccagctgtactagttggctgcaggccccacaagctccaggcctttgccgagatgagcaaagttcaagaatttcagtgcctcagttgtccggcgccccgatcctgttaccggacctggaagggactaagcttagcaatttccaggagtcaagcccattgccacacaagcacgagagaaaagacaagcggagcacaccggaagaggaggggagatcagcaccagaaaaaatcattcagagtctgaagctctgcccaggaggccatcggcctgcatcactgtcctccgggtgtccggccgggtgtaggctctcattcaatctgcccccatctatgctgctctctgtccagaagtgttgcatgcctagctcactaaagacctgctag

SEQ ID NO: 27736 - DNA, 1566 bp, Artificial Sequence
  Description of Artificial Sequence: Synthetic coding sequence
atggcctgtagtctgcagaaactgtttgcagtcgaagaagaatttgaggacgaggactttttgagtgctgtggaagacgcggaaaatcgcttcacggggtcactgcctgtcaatgctgggcgattgagacctgtgtcctctcggcctcaggagaccgtgcaggcgcaatcttcaagactactcttgctccatcccacggcgccatccgaagccttgggcctgcccgacctcgacctctgcctgcctgcaagttccactcctagtgccgactcccgaccctcttgtattggggcagcacccctcaggcccgtgagtacgtcttcatcatggattgggaatcaacgcagggtgacagttacagaagttctgagggagactgcgcggccacaaagcagcgccctgcaccccctgctgacctttgaaagccagcagcagcaagtgggtggcttcgaaggcccagaacaggatgaatttgataaggtcctggcaagtatggagctggaggaacccggcatggagctcgagtgcggagtttcatcagaagcaattcccatcctccctgctcaacagagggagggcagtgtgttggcaaagaaagctcgggtggtggatttgagtggatcctgtcaaaaaggccctgtacccgccatccacaaagctggtattatgtccgcccaagacgagagccttgacccggtcatacaatgccggaccccccgcccacccctacggcctggtgcggtcgggcatctgcccgtgccgaccgcccttacagtaccaacccaacagttgcactgggaggtgtgcccccaacgctctccagtgcaggccctgcagcctctgcaggccgctagagggaccatccagtcttctccacaaaaccgctttccttgccagccctttcagtcacccagtagctggctctccggaaaggcccacctgccaagaccaaggactccgaacagctcttgctctaccccttccagaacctccagcggcttgttcccaagaatcccactccagcctcaggctcctgtgtccagtatcggcagccccgtgggaaccccaaaaggcccgcaaggagcactgcagaccccaattgtgactaatcatctggtgcaactcgtgaccgctgcttccaggacaccacaacagcccactcacccatctaccagagctaagacccgacgtttcccaggccccgccggcattttgcctcatcaggccgccctaaagcagctccctcggaacaaggtgccgaatatggccgtgatgataaagtccctcaccagaagcaccatggacgcatcagtcgtgtttaaggatcctactggcgaaatgcaaggcactgtgcatcggctactgctggagacttgtcagaacgagctgaaacccggttctgtcctactcctaaaacagatcggggttttctccccatctcttcggaaccattatctcaacgtgacacccaataatctggtccacatctactccccagatagtggcgacggatcatttctcaagccgagccaacctttccctaagatgacttggatggattcctag

SEQ ID NO: 27737 - DNA, 414 bp, Artificial Sequence
  Description of Artificial Sequence: Synthetic coding sequence
atggcatgttccctccagaagctctttgccgtggaggaagagtttgaggatgaggattttctgtctgccgtcgaagatgcggaaaatcgattcacaggttccctgcctgtcaacgccgggagactccgtccagtttcaagcaggccccaggaaacagtgcaagcccaaagctcgcggctgcttctgctgcacccaacagctccatctgaagctctggggttacctgatctggatctgtgcctgccggccagcagtacacccagcgctgactccagaccttcatgtattggcgctgcacccctcaggcccgtgagcaccagtaattgcctcaactcgagccacagtgccacccctctcggctccctttccgctaccctgccatgttcaagcacttctgctagcccctcctgctag

SEQ ID NO: 27738 - DNA, 1944 bp, Artificial Sequence
  Description of Artificial Sequence: Synthetic coding sequence
atggcttgctctctccaaaagttattcgcagtcgaggaagagttcgaggacgaagatttcctgagcgcagtagaggacgccgaaaacaggtttacgggatctctgccggtgaatgccgggcgcctccggcccgtgtccagccgccctcaagagacagtgcaagcacagagttcaaggctcctcctgttacaccctaccgccccttctgaggcccttgggctgccggatctggatctgtgcctgcccgcctcgtccactccttctgctgacagtagaccaagttgcattggcgcagcgccactgcgccccgtcagcacatctagcagctggataggcaaccaaagacgggtgaccgtcacggaagtgcttagggagaccgctcggcctcagtcatctgctctgcacccccttctcacctttgaatcccagcagcagcaggtcggtggatttgaaggccccgagcaagacgagtttgacaaagttctggcctccatggaactggaagagccaggtatggagttggagtgtggcgtgtcttccgaagctattccgattctcccggcccaacaaagggaaggatccgtgctggccaagaaagctcgggttgtcgacttgagtggctcatgccagaaaggccctgtccccgccattcacaaggctggaatcatgtcagcacaggatgagtctcttgatcccgtgattcagtgtcgaaccccaagaccaccactcagacccggcgccgttggtcatctgccagtgcccaccgcactaacagtcccgactcagcaactccactgggaggtgtgccctcagcgcagtcctgttcaggctctgcagcccctgcaggcagctcggggcaccattcagtcatctcctcagaatagattcccttgtcaaccgttccaatcaccctcaagctggctgagtggaaaggcccatttacctagaccacgaaccccaaactcttcctgcagtacccctagcaggacgagctctggcctgttcccccgaattccattgcaaccccaagcccccgtgagtagcatcggctctcctgtgggtacccctaaggggccacaaggagccttacagacccctatagtgactaaccacctggttcagcttgtaactgctgcaagccggacgccccagcaaccaactcatccctcaacccgcgctaagaccaggagattccccggcccagccggaatcctgcctcaccaacaaagtgggaggtccctcgaagatattatggtatccgcgccccagacccccactcatggagcgctagccaaatttcaaactgaaattgtcgcctcttcacaggcaagcgtggaggaagatttcggtcgaggcccctggttgaccatgaagagcaccctgggtctcgacgagagagacccgtcatgcttcttatgtacatactcaatcgtcatggtgctgagaaaacaggctgccctgaaacaactgccccgtaacaaggtgccaaacatggccgttatgattaaatccttgacaaggtctaccatggatgccagcgttgtgttcaaagatccaacgggcgaaatgcagggaacagtgcacaggttgctcctggaaacctgtcagaatgagctgaagcctggttccgtcttgctcctaaaacagattggggtgttctccccatccctgcgaaatcattacctgaacgttacccctaacaatctcgtgcacatctattctcccgattcaggcgacgggagcttccttaagccaagccagcctttccccaaagatagcggcagtttccagcacgacgttgcagccaaaccagaggagggcttcaggacagcacagaacctagaagccgaggccagtcccgaggaagagctcccggaagcagacgacttagatgggttgttatcagaattgccagaagatttcttctgtgggacctcttcttag

SEQ ID NO: 27739 - DNA, 2922 bp, Artificial Sequence
  Description of Artificial Sequence: Synthetic coding sequence
atggagactaaggtccacttgttctgtcaagccgaagaaaatatagacctgctggatgatggttctaactcatttgccacagacctttcatctggcaccataaaccacaagaaatacatcaagttttcaaaaacgatcgaaaaagaaattagtcccgaaatacgctctcttagccccgaatataaaaagattttcgagacctccatcatcttctgcggcgaggagaagtcttccgacttcagtggcgagaaaaaggttggccgcaagagcctgcaagtccaacagcacagcaaaagaactgaaattattcctccattcctgaagctatctaaagagaaggtcactaggaaggaaaatagcctgtgcaaactccccaaccaatactcagtgcacaaaaccagcagtccactgtgcacctcttcagcgatcacacgagagaaggagatgctgtcaaacctttacatgaccttgtatgatgaagtgacacacgggtacctgcatagtaaggagctgtctgcccttcacaaggcctgcaagatttttagtaagatccgatcagggaaaatttacgtcaacgacttacccgtgattctctgcatccttcggattagtattagcgacttagagatgcggcaggccctcaagacggtggatatagacgcttttcaggatgcgctaaaaatcttttgtcgaattaagggcggcagagtgtcgactgatgatgtgttcgccgtactggatagcatgggtattcctataaatcgcgaaatactggaagaggtgaccaagcatacgtacattgactcaaaccacatggtggacattggagatatcatattcaccttaaatgaactgcaggagcagtacgaggacgtgtcaatcacagaaggatctccgttgaatgagatcaccagcgaccgtaagttaagttctgtcgctggctgttacctgaagtacaagaaaaagaacagcctctcatctaaacttccagagcccagcatatccaagaagctcaataagaaatcaaaccaatattattctaaaatcatggaaaatgacgacctggaatcgaagaggcccaagaatacctggcagattcgcaagttcttaggcggagtcggctcgtctaatgttggagtgcaggaaccttacagtaaaaacggtatcaacttcaagaagcattccgaaaaaggggagatccacgatagtaagtcaaaacctcagagcctgaagtcttctacatcactctctaagtctctagacaagagcgatattagctcaattcccaaactccagaagccggccgtgagaaagcatagtagcctccagaagcaggtgagttctacagagaagaccgccatatccaccctcgagaacttttgcgaggccatcagcaagctgcaagagaactatattgctgccgaggagctgcagtcaattctgccctccacagggatcaacctgcttgacgaggaatttcaaaaaattgtgaccgacacttcccgcaatgagaacggcatggtcgaattagacgactttgtcaatgctctggctaaagaacgatcatttcctgagtgtaacgctctgcccggggtgattaaagcaatcgacaagatcaaagataaaaacgtggactacgaggatctcaatacctgcctacagaactttggcatttatttatctaaaccagagttcaagaagatcactgagttgaccgaagccggcgagaccaagaaggtgaatttcaaggagtttattgacacaatgatgagtaatactgagtgttttagcgaaaaactcgtgctgcctgacgcgatcgaaactctcgacgacctcaggaaggaaaccatgtccgtttcagatctgtggaatacgctctctagtctcaactcaaacctcaaaaaggatgagttcctcgctgcactggaactcgtgaccgtggacgaaggcgataaggtacagttcgaagagttcgccaaagtggtgcgaaacatgagagacgccgccaggctggaggaattgcaggaggtcgtcttggccgccgacctactcgagggcgacatgatagccggcaaaaatctggaggactttctgcggaatgtcgggattaagtctccaaaagaagaagtggaaaagattttacaatcagacttcgtgtctgaggacaacatggtgaacataaaagactgcatgagagcgctgagggacactcagaagttcagcaactatattgatttcagaaaagaggccagcaatctcaagcttcctaaagtcaatgagatcaaggaagctgccaatatcctgagtcatgttgacaacggtaagattggcatcccggatctggagcacgccctaaaatgtctgaatgttaacctgactgaagaggattttaacgaagcccttaattgctgtaacgtctccgacaatatggaggttgatttaaaagatttcctgatgaaaatgaaagagtctccgcatttccagaagtccaaagccacccaaatcctccttgccaccacacaaattctgcaaaatgacctggtcgacgtgagcgatctgaaaacgctgctgatggacaaagacttacacactgcgaacgctattctgacagtgatgctccggcacgtaccggagcatgaaagcggaaaagtgagtatccaagaattcatgaccaaactctcagacattctgacaattcccaaagccgccgggaagttttatctcatttgcacgtattgcccggacttagagagacaggccgtcgtctatatgctgaaaactattcaggatagcattgtgaaagctcaagtgtctaaaaaacaatacaacatgaacattaaacaacacaagatcagccttcacaacttttgtcttaattcaaaagctaacattgccaaactaaaccccaactctaagttttag

SEQ ID NO: 27740 - DNA, 1596 bp, Artificial Sequence
  Description of Artificial Sequence: Synthetic coding sequence
atggagacaaaggtgcacctgttttgtcaagctgaagaaaatattgacctgttggacgacggttcgaacagttttgccacggacctgtccagcggaacaatcaaccacaagaagtatatcaagttctctaaaacaatagaaaaagaaatcagtccagaaataaggtcactgagcccagaatataagaaaatttttgaaacatccataatcttctgcggagaggagaagtcatccgatttctcgggcgagaaaaaggtgggcagaaaaagcctgcaagtccagcaacacagcaagcgaacagagataatcccgccattcctcaaactgtctaaagagaaggttactcggaaagagaacagtttatgtaagttacccaaccagtactctgtgcacaagaccagtagtcctctgtgtacaagtagtgccatcactcgcgagaaggagatgctatccaacctatacatgacactgtacgacgaggtaacacacggctatctccactccaaggagctgagcgcctttcaggatgctctgaagatcttttgtaggataaaaggtggcagagtgagtactgacgacgtgtttgccgtcctggactctatgggaattcccatcaaccgagagattctggaagaggttacaaaacacacctacattgactccaatcacatggtggacataggagatatcatatttacactgaacgaactacaagaacaatatgaagatgtatcgatcaccgaaggcagccctctaaatgaaatcacctccgacagaaaactgtcctctgtcgcaggatgttatttaaaatataaaaagaagaacagcctttccagcaagctgccagagccttctatctcgaaaaagttaaacaaaaagagtaaccagtattactctaagataatggagaacgacgacctggagtccaagagaccgaagaacacttggcagattcgcaaatttctgggtggcgttgggtcaagtaacgtgggagtccaagagccctattctaagaacgggatcaacttcaagaagcatagcgagaagggcgaaattcacgactctaaatctaaacctcagtcactgaaatcatccactagcctaagtaagagtctggataaatccgatataagtagtatccctaaacttcagaagcctgccgtgcggaaacatagctccttacagaaacaggtttcttccacagagaaaactgctatctcaaccttagaaaacttttgtgaagctataagtaagttacaagaaaactatattgcggctgaagagctgcaatcaattcttccctccactgggattaacctcctggatgaggagttccagaaaatcgttaccgacacctcccgaaacgaaaacgggatggtggaactggatgatttcgtcaacgcgctcgctaaggagagatcctttcctgagtgcaacgcactgcctggggtaatcaaggccatcgacaaaataaaggacaaaaatgtcgactatgaagatctaaacacatgtctgcaaaactttggcatctacctgagcaaacctgagtttaaaaagattaccgagctgaccgaggccggggagactaagaaatag

SEQ ID NO: 27741 - DNA, 162 bp, Artificial Sequence
  Description of Artificial Sequence: Synthetic coding sequence
atggagaccaaagtacacttgttctgccaggctgaggagaatattgatctcctggatgatggctccaatagctttgctacagacctttcgtctggcactatcaaccacaagaagtacattaaattcagcaagaccatagagaaggagatctctcccgagtag

SEQ ID NO: 27742 - DNA, 114 bp, Artificial Sequence
  Description of Artificial Sequence: Synthetic coding sequence
atggagaccaaggtccatctgttctgccaggcagaggaaaatattgatttgctggacgatgggtccaactcattcgctacagacctgtcctctggtaccatcaaccataagtag

SEQ ID NO: 27743 - DNA, 228 bp, Artificial Sequence
  Description of Artificial Sequence: Synthetic coding sequence
atgaacaggctgtacttgacaccggatggattcttttttagggttcatatgcttgccttggacagcagcagctgcaataagccatgccccgagttcaaacccggtatagagactgacctgaacgacgcagcatacgtcctgtatacaacagtttgcaacgtaggggctaccgcccgtgctgtgggtagaccggctttcttctgggaacgttgggaaactatgacttag

SEQ ID NO: 27744 - DNA, 294 bp, Artificial Sequence
  Description of Artificial Sequence: Synthetic coding sequence
atgaatcggttatatttgacacccgacgggtttttcttccgggtgcatatgcttgccctggacagtagctcgtgcaataaaccttgtcccgagttcaaacctggcagtcgttacatcgtgatgggccacatataccacaagcgccgccaactgcccaccgcgcttttgcaagtactgcgaggaaggctgaggccaggcgacgggctcctcaggtcttcatcatcctacgtgaaacgctttaatcgcaagcgcgaaggccagatacaaggagccatccacacacagtgcatctag

SEQ ID NO: 27745 - DNA, 228 bp, Artificial Sequence
  Description of Artificial Sequence: Synthetic coding sequence
atgaacaggctttatcttactcccgatggcttctttttccgggtgcatatgctcgccctcgattcctccagttgtaataagccgtgccccgaattcaagcctgggattgaaaccgacctcaatgacgcagcttatgtcctgtacacgaccgtctgtaacgtaggtgctactgcaagggctgtgggtcgacccgcctttttctgggaaagatgggagacaatgacttag

SEQ ID NO: 27746 - DNA, 228 bp, Artificial Sequence
  Description of Artificial Sequence: Synthetic coding sequence
atgaacaggttatacctaactccagacggattcttcttccgcgtgcatatgctcgcactcgactcctcatcttgcaataagccatgccccgagttcaagccaggaatagagaccgatctgaacgacgctgcgtacgtgttgtatacgacggtgtgtaacgtgggcgctacagcgcgagcagtggggcgtccagctttcttctgggagaggtgggagactatgacatag

SEQ ID NO: 27747 - DNA, 1689 bp, Artificial Sequence
  Description of Artificial Sequence: Synthetic coding sequence
atgcttgcttgtctgccaggcccaggagatctgtcattccaactgttgagccacacgcagatgaacacaggtcttcagaagtgggataccacccaaaaaatgcgcaccgcccattatcccacgccagccgaactggatgcctatgcaaaaaaagtagcaaacaatccattgacaattaaaatctttcctaactctgtgaaagtgcctcaacggaaacacgtgcgaaggacagtgaacggcctcgacacaagtgcccaacggtatagcccctatcctacacaagccgccacgaaagcaggcctgctcgccatcgtcaaggtccccgccaagagcatcctaaaagacttcgacgggacccgggcccgtttgttgcctgaagccatcatgaacccgcccgtagccccttatgccacagtagcacctagcacattggctcacccgcaggcccaggcgcttgcacgacaacaggccctgcagcacgcccagaccttggcacacgctcctccacagactctgcaacacccacaaggaatcccccctccacaggcgctgtctcatccccagtccctgcaacagccccaagggctgggccacccacagcctatggcacagactcaggggttggtccaccctcaggccctggcgcatcagggacttcaacacccccacaacccactgctccacggcggaagaaaaatgcccgatagcgatgctccgcctaacgtcacagtttcaacgagcacaataccgctgtcaatggccgccaccttgcagcactctcagcctccggatctgagcagcatcgttcaccagattaaccagttctgccagaccagagccgggatcagcacaacttcagtatgcgaaggacaaatcgccaaccccagccccatcagtcggtccctactcattaatgcttccaccagagtttcaacacactccgtgccaacccccatgccaagttgtgtggtgaaccccatggaacatacccatgccgccacggctgccctgcccgcagccgggcctgtaaacttgcctactggaataagtcgggtgcccacagggtacccaagtgacttgaagcctgtaacctggaatcaacatcaactcgcacacttacagcagatgtgtagtgaagcaagtggcacccccgctccaggcctgacgggcaagcacgccgcagggagggagctggccgggcctgggtttgttggaaaggctccagcttatccccaggagctgtgcctggctcagagttttcacttgaagcccccgctggaaaaaccgacgccttcaccaccagtgaacgggatggctgctccactggcctacccgaacgggcactatttccaaccgctctggaataatattttaccgacgccgaactctgattcgtcagggagtcaggacctggcaatgccgttccacggcgggcagccaacaggagccccactggactgtgccgctgctccaggtgcccactaccgagctggaacggggggaggtccagtggcttcccaaaattctctaatgcaaacagtcgactacttgtcaggagacttccagcaggcctgtttccgcgagcagagcctcgccatgctgtccaaggctcatcgcgcccccgggaatagggcacccgatccaacggagagccggtctttacatatccagcaccccggataccgttag

SEQ ID NO: 27748 - DNA, 1689 bp, Artificial Sequence
  Description of Artificial Sequence: Synthetic coding sequence
atgctagcatgcctgccaggacccggagatttaagttttcagttactttcccatacacaaatgaataccggcctgcagaaatgggatacaactcagaagatgaggacagcccactacccaacccctgctgagctggatgcttatgccaagaaagtggctaataatccactgacaatcaagatctttcccaactctgttaaggttccccagcgcaagcacgtcaggagaaccgtgaacgggcttgacacatccgctcaacggtacagcccataccccactcaggctgccaccaaagctggccttttggctatcgtgaaggtccctgccaaatcaattctgaaggatttcgatggcacccgggcaagactgctacctgaagctataatgaatcctccagtcgctccttatgcgactgtagcaccttctaccctcgcccacccacaggcccaagctctggctcgacagcaggccctgcagcatgcccagacattggcccacgcccccccgcaaactctgcaacatccccaaggaattccgccccctcaggcgctttcccatccacaatctctccagcaacctcaagggctcggccatcctcaaccaatggcccagacccaaggactcgtgcaccctcaggccctggcacaccagggactgcagcatccccataatcctttactgcacggagggcgtaaaatgcctgattccgatgcaccacccaacgtcaccgtctcaacctcaaccattccgctttcaatggctgccactttgcagcatagccagcctccagatctctcttctattgtgcaccaaatcaaccagttctgccagacacgggccggaatctctactacaagtgtctgcgagggacagattgcgaatcctagcccaatatcccgaagtctgctgatcaacgcctcaacgcgcgttagcacacactccgttccgacgcccatgccatcctgcgtggtcaaccccatggaacatacccatgctgcgacagccgcccttcccgcagcaggaccagttaacctccctacaggaatctcaagggtaccaacagggtatccatccgatctgaagcctgtgacctggaatcagcatcagctcgcacatctgcagcaaatgtgttccgaagcaagtggcacccccgcacccgggctcacaggcaaacatgctgcagggagggaactggcaggtccaggattcgtgggtaaggccccagcttacccccaggagctatgcctggcccagtcgtttcacctcaaaccacccctggaaaaacccactcccagtccacccgtaaacgggatggccgccccgttagcctaccctaacggacactactttcaacccctctggaataacattttacctacgcccaactctgactcatcaggttcccaggatctggcaatgccttttcacggaggccagcccaccggggctccactagactgcgcagcagccccgggagcacactatcgcgctggtacgggtggaggacccgttgcaagccagaattctctgatgcagaccgtcgattacctttctggagacttccagcaggcttgttttcgtgaacagtccctggccatgttatccaaggcccacagggctcccgggaaccgcgcccctgacccaacagaatctagatctctgcatattcagcaccctggttatcggtag

SEQ ID NO: 27749 - DNA, 711 bp, Artificial Sequence
  Description of Artificial Sequence: Synthetic coding sequence
atggaggcatccgacggacagggcggcgagggggacaaaccgttagagcaggttaccaacgtctcatgccttgaaacatcttcatccgcttcccctgcacgcgatagcctcatgagacacgccaaggggctcgatcaagacacttttaagacctgtaaggagtacctgaggcccctgaagaaatttctccggaaacttcacctgcctcgagatctgccccaaaaaaagaagcttaagtacatgaagcagtccctcgtggtattaggcgaccacatcaacactttcctgcagcactactgtcaggcgtgggaaattaagcattggcgcaagatgctgtggcgttttatatcattgtttagcgaattggaagccaaacagctacgccgactctataagtatacaaaaagctcacaacctgccaagtttctcgtcactttttgtgcatctgacgcacctgaaaggagcctgttggccgacagggaggatagcctgccaaaattatgccacgcttgggggttgcatagtaatattagcggtatgaaggagcggttgagtaacatgcaaacccctggacaggggagtcccctcccaggacaaccgaggtctcaagatcatgtgaagaaggattctctgagggaattatcgcaaaagccaaagctgaaaagaaagcggatcaaagaggcccccgagacccctgaaacggagccgtag

SEQ ID NO: 27750 - DNA, 582 bp, Artificial Sequence
  Description of Artificial Sequence: Synthetic coding sequence
atgtccggtcctccgagtgccccacagggtgccctcgctgcaccgcgctctcctgccgtacgccgcaaaggtctccaggccccatcatggggtagcccgggtcggccagccgcgcacagtccttgggcctgcggacccccgcactggggaccacagagggggcctaggaatgctgccgccgctcgtcccgggccaagatcaaggtggcataaaaggtgcgcagcggcatgtggtgcttgcgctaggcctcccggccatcagcttcagccccccggcgccggggccccgcagccaggggtcgcgtgcagctacctaggaccacgcccacaacgaacaccttgttctgcccagagccgtcctggctggtgtgccggtcctcgtcggaggcatgcccccgggaccgagccgcatgtggcccccgggcgcgccccaccaccccgcgcaggggcttctcccggaagtcggctcctgccgggttctcctagcttgctcctccctgcggctacctggaggacgtggggccaggagtcaaaagtgctgaggaagatcctgaaagcatgggatcccttttctcttctctag

SEQ ID NO: 27751 - DNA, 1713 bp, Artificial Sequence
  Description of Artificial Sequence: Synthetic coding sequence
atggcctacgaaaagtccacagatatcagcgatgtgagtcggagtatgttcctgtatccttggttggaataccctgataaaacaaaggagctgcgcaaggctatggctcctgtgcacctccctctttcctgttatcagatgcctaaggaagaatttccacctagccccgagtgttggcggcagcacccttcaaagccaaacagcgtaccttactgctattttaagaagcccgaaatttacactcactggcatgatctgtacgaccaacgagaggaacgggaggccgaaaagatgctccgcaagatgcgcgatgattgtcgatatatcaaagaggtgcaccaaacacatatcaagatgtttcatctccctatgtccaaactgaccatcaagagtgagatgagaagccgcccactggaaccaacccaggatccgttaaaatggcagagactaagggaactgactaagtctctcgaatcccccagggaggatgaacagttctacgccgcacaggccttagggtgtctgaggatctccgataagttcgttatggaagcactacagcaggttgctcagacgggaccagaaaaagtgaaatacgaagcgtatcggacattagctatcttgggctgcttaaataaacacgtcatccgcgctctgattaaacagctgaaggagaagaacgagggccagcgtatggaaacgctcactggtcttcgcatggccctcaattcttgggccgccgtcagcaaggacaaaaggacccaggttggagacgagggcaagcttgttccagtcctgcagaccctgataaagaagtcctccagtgaggccagtctggaagctgctttatgtctgggctttctcaggccttgttccaatatggtccaagagtttctgctgcaatgtctgtgtcagggcttgaaaacccaacgcatgaaagctttgcgaatgctcgtaaaggtgatgcacgtccacagtgcccccgtgatcaaggccattcttgaccagctttgctcctcttctgtgctggaagatcgctttgaggctacccaaatgttaaagactatcgggcttgaacagatccaagctcaaggcttggaggagctaacctttaatttgcttaggcgcaaaactcataacgaaccatttcttgccgtccggcaggccgtcgcccaaaccgtcgaggaactcaagctcaaacctaccatgatgaacctggtggaggcccagctaatgaatcctgatgctacagctcgacaagaggctgtaatatccctcggggtgctgggtatcaggtctcctcaggtgtttcatctgctgctcgatttacttgacgccgagaatcatcaggccgtcaagaagtctctacaggagactttaatcttgtgcgccagtatcgacccttggattcagaataagctcaaaaataaagtgctgagcgtttatgaggcccccaagaccaacgtaaaggctgagcccactaggttccaaaaagagcctgaaaatcccgaagaactgaccatccaggatttcaggctcgctaaacttaatccactgttcattgcaaaatcaattacaaaagtcggccagaaaaagaccccagcgtttcctccatgctgttccaagccgaggaaacatcgcccccaggtcattggtccatggcagcccagaatcaaaaaacaactccgcgtcctggccgagatagccaagtag

SEQ ID NO: 27752 - DNA, 1422 bp, Artificial Sequence
  Description of Artificial Sequence: Synthetic coding sequence
atgttgcctgggccagctctccgcggcccaggccctgcccaatatcaaaggcctggaatgtctccgggaaataggatgcccatggcactagctggaggcaccccatgttggctcccaatttggtgttccagttctgcctctacttggcacgctacgcatcatgacggatcaatccccaagactcccgcttgcgccccgcaaccaccaatgcccgctcaaaggaggggtcttaagagacgcaaaatggccgataaagtgctgccccagcggattcgtgaactcgtacccgagtcccaggcctatatggacctgctggcctttgagcgtaagctggatcagacaattgcccggaagcgcatggagatacaggaagccattaagaagccgctcacacagaagcgaaagcttaggatatacattagcaacactttttctccgtcaaaggctgagggtgacagcgcaggcactgctggcacacctggtggaaccccagctggcgacaaggttgcctcctgggaattgagagtggaagggaaacttttggatgacccctctaagcagaagcgtaagttttcttcctttttcaaaagcctagtcattgaactggataaagagttgtacggacctgacaaccacctggtggagtggcatcgcatgcctacaacgcaggaaaccgacggattccaagtgaagcggcccggagatttgaacgtaaagtgcaccctactgttgatgctcgaccatcagcctccacaatataagctggacccacgactcgctcgcctgctgggagttcacacccagaccagggcggccattatgcaagcattgtggttgtacatcaaacataatcaactccaggatggacacgagcgcgagtatatcaattgtaatcgctacttcagacagattttcagttgcggtcgcctccggttttcagagatccctatgaaactggccggtttgcttcagcacccggatcccattgttatcaatcacgtgatttccgtggaccctaatgaccagaagaaaactgcctgctatgacatcgatgttgaagttgatgaccccctcaaggctcagatgtccaatttcctggctagtactacgaaccagcaggagatagcatccctggacgttaagattcatgagaccattgaatcgatcaatcaactgaagacccagcgtgatttcatgttatccttctcaaccgacccccaagactttatccaggaatggctgcgctcacagaggagagatcttaagatcatcacagacgtcattggcaatccagaggaggaacggagggctgccttctaccatcaaccatgggcccaagaggctgttggccggcatatattcgccaaagtgcagcagaggcggcaggagttagaacaagtgttgggcattaggctgacttag

SEQ ID NO: 27753 - DNA, 570 bp, Artificial Sequence
  Description of Artificial Sequence: Synthetic coding sequence
atggccagcggcgccgggggctcttggggccgcagcccgccccagtccgcagtccccacaccttgggtcacttttctgcaacctctctcatgggctgtgcctcccgctccccctcagccaggtcgggtcaaagaggatctgctggaacttatgatgcttcagaatgcccaaatgcaccaattactattgtcacgactggtagctggcgcgctccaaccaagaccagcgagcccttgtccacaggtctatttggaggtaccccaagaggaaccagaggaggaagaagaagaaatggatgtgagggaaaagggaccccttgtattccaccatcactacttaccatacctgatgccttcgcctggggcgctcctgccctggcctgccccattctttccaacacccgcttgtcagccctacctccaggacgtccctaggatacagcattgtccagcctccagagaacgagaggtccgggcagtgcctccgcctccaccccccagtgccactgggactgtgggcgctgatgtgccccctgctagcgactactacgatgccgagtcacttctctag

SEQ ID NO: 27754 - DNA, 711 bp, Artificial Sequence
  Description of Artificial Sequence: Synthetic coding sequence
atggccagtggcgctggtgggagctggggtcgaagcccacctcaaagcgccgtccctactccatgggtgacatttttacagcctttatcttgggccgtgccccccgctcccccccagccggggcgagtgaaagaggaccttctggaactgatgatgctgcagaatgctcaaatgcaccagctgctcctgagtcgcctagtagcgggtgccctccagccccggcccgctagtccatgccctcaggtttacttggaggtgcctcaggaagagcctgaagaagaagaagaggagatggacgtcagagaaaaaggtcccctcgtcttccaccaccactatctcccttatctaatgccctcccccggcgcattattgccatggccagctccatttttccctacccccgcctgccagccatatctccaggatgtgccaaggatacagcactgccccgccagtcgagaaagagagaccacgatgatgccaagagcctcatacgaagatcgccctagaccttgggagcttcatcaactgcccgctctagacaccgcacctgaaccaccacctgccccactgttgagcacacctaggtgcccttggctcgctgtcttactcacgccctccactagtgcacgcccatcatctccaggagaaatctcaccttgtcctacacccatgagcagctggacgggacgaatctgcgccgtcgtgtag

SEQ ID NO: 27755 - DNA, 420 bp, Artificial Sequence
  Description of Artificial Sequence: Synthetic coding sequence
atgatgctgcagaacgctcagatgcaccagcttttgctgagcagattggtcgcaggcgccttgcagccgcgtcctgctagcccatgccctcaggtctatctggaggtgccacaagaagagccagaagaggaggaagaggaaatggatgtcagagagaaaggacctctggtgttccatcaccactatcttccctatctgatgccttcccccggcgcgctgctgccatggcctgccccctttttcccaaccccggcctgccagccataccttcaggacgttcctcgtatccagcactgccccgccagccgggagagagaagtgagggctgtgccgcccccaccgccgcccagcgcaacaggaactgtcggggctgatgtccctccggcttccgattattatgatgctgagagcctactctag

SEQ ID NO: 27756 - DNA, 297 bp, Artificial Sequence
  Description of Artificial Sequence: Synthetic coding sequence
atggcctccggtgcgggaggctcctgggggcggtctcctccccagagcgcagtgccaactccatgggtgacgttcttacagcccttaagctgggcggtgcccccagctccccctcagcctggacgcgtgaaggaggatctcttggagctcatgatgttacagaatgcccagatgcaccagctgctgctttcacgactggtggccggagccctgcagccccggccggcaagcccttgtccgcaggagtcttgtgcccctacacccacgccacagtgtcacagagattgtggatgctag

SEQ ID NO: 27757 - DNA, 1506 bp, Artificial Sequence
  Description of Artificial Sequence: Synthetic coding sequence
atggagaatcagctatggcataacacagtccgttgctgtaatcagtaccaggaatcgcctcacgacgcagaggacattttactccttctgctcggcctcattgtgctggtgaatatcgggattaatgtcgctactatgatgtggcatggcctgcagaatgcactagacaagatgattgattgggctacccagaagaacgagattcaggccagcgaatcaccgccctcaggcccacctgacaaagcacaggatgtccatatccattgcatcctcgaccccgtgcaggtgaagatgtcaaggcccactcagtatagctcctttagctgtcatcatttttccaaccatcattctagctccctcctgcggtgcgtcaggcggagaagacgcaggcataggcgctgccgtcgtcgttgctgtaaccaccagcagcgaccgcagaattatcgccaaataccacactcgcattcagtgttccgtaatccccataggtcccagaaaatgagccagttgcatcgcgtccctttctttgaccaggaagatcctgattcttacctggaggaagaggataatttgcccttcccttaccctaagtacccacgtagagggtggggcggattttatcagagagccggactgccgtcaaatgtgggcttatgggggcaccaaggaggaatactggccagcctgccccccccgtctctctacttgtcaccagagctgagatgcatgccaaagcgggtcgaagcccgttccgaacttcggctgcagagttatggacgccacggatcgcagtcccggctgtggggcaatgttgaagccgaacagtgggcttcttctccacccccaccccatagattacccccaaaccctagctgggtcccagtgggccattctccctaccccagcgtgggatggatgctttatgactcctgggaccagagacgcagaggcacggaggggtttgagcggccccctgcttctgtatcgcgcaacgcacgccccgaggctcaggggtgtcgcgagcaccacagccctcagagtcatcagcagagcttgctgggccacgcttatggccaatcccacagatcacctcaccctagtaccgaacctctgggctactcgtcacaggacccacgagaagtcaggaggagggccgcagattgggccgaggcgctaccagcatggcgcccactgacaacctcagcctcactgaccgtgctcgatgaagcttcacatcagcgaactccagcaccttctagcgttctggtacctcattcaagccagccgtggccaaaagtgcaggctgccgatcccgcgcccccccccaccatgtttgttcctttgtctaggaaccccgggggaaacgcgaattatcaggtatatgattctctcgagctcaaacgccaggtgcagaagagtagggccagatcttcttcactgcctccggcaagcacctcaactctgagaccgtcactgcatcggagccagaccgaaaaacttaattag

SEQ ID NO: 27758 - DNA, 1812 bp, Artificial Sequence
  Description of Artificial Sequence: Synthetic coding sequence
atgagtgggtactcaagtgacagagatcgtgggagggatagaggtttcggcgctccacggttcggagggtctagggcaggacccctctccgggaagaagtttgggaatccgggtgagaagttagtcaagaaaaaaaatttctaccaggaacatccggatttggcacgccggactgcccaagaggtggagacttacagaaggtcaaaggaaattacagtgcgcggtcataactgtcccaaaccggtgttgaacttctacgaggccaattttcctgcaaacgttatggacgtgatcgctcgtcaaaactttactgagcctactgcaatccaggcccaggggtggcccgttgctctgagcgggctcgacatggttggcgtggcccaaacaggaagcgggaaaacactctcctacctgctcccggccattgtacacatcaaccaccagcccttcctggagcgcggcgacggacctatctgcctggttttggcacctacaagagagctggcacagcaggttcaacaggtcgcagccgaatactgcagagcgtgtcggttgaagagtacctgcatatacggcggcgcacctaaaggccctcaaatccgagacctggagcgaggcgtcgagatctgcatcgccacacccgggagacttattgattttttggagtgtggtaagaccaatctcagaaggactacttaccttgtgttggacgaggccgatcgaatgcttgacatgggctttgagccacaaatcaggaaaattgtggatcaaattcgaccagatcgccagaccttgatgtggagcgcgacatggccgaaggaggtgagacaactggctgaggatttcttaaaagactacatccatataaatatcggggctctggagcttagtgctaaccataatattcttcaaatagtggacgtgtgtcatgacgtcgagaaagatgagaaactgatcagactgatggaggagataatgtccgaaaaggagaacaaaaccatcgtgttcgttgagacaaaaagacggtgtgatgaactgaccagaaagatgcggagggatggatggcccgccatgggtatccacggtgacaaatcacagcaggagcgggactgggtgctaaacgagttcaaacacggcaaagcccctatactgatcgctaccgatgtggcatccaggggactcgacgtcgaagatgtgaaattcgttatcaattatgactacccgaatagcagcgaagattatattcatcgaatcggccggacggcgcgtagtacgaagaccggaacggcctatactttctttactccaaacaatataaagcaggtgagcgatttaattagtgtcttgagagaggcaaaccaggccatcaatccaaaactcttgcagttggtcgaggatcggggatcgggaagatcacgggggaggggcggtatgaaagatgacagaagagacagatacagtgcaggtaaacgcggcgggttcaatactttccgcgatagagaaaattacgatcggggatactctagtctgctgaagcgagatttcggagccaagactcagaacggtgtgtactccgcagctaactataccaacggttccttcggatccaacttcgtctcagcaggtatccagacctccttccggacaggaaacccgacaggcacatatcaaaatggctatgattccacccagcagtacggctcgaacgtaccaaacatgcacaatggcatgaatcagcaggcctacgcctatcccgctacggcagcagctcctatgatcggctatccgatgcctactggatattcacagtag

SEQ ID NO: 27759 - DNA, 1191 bp, Artificial Sequence
  Description of Artificial Sequence: Synthetic coding sequence
atgcttcccagtctacaggaatcaatggacggcgacgaaaaggagctcgagagcagcgaggagggcggcagcgctgaggaacgccggcttgagccccctagctctagccattattgtttgtatagttaccgaggctccaggctggcccaacaaaggggggacagcgaggatggaagtcccagtggaacgaacgccgaaactcccagtggtgatgatttctccttaagcttagctgacactaacttgccgagtgaagtggagccagaactgagaagctttatcgccaagcgcttaagcaggggcgcagtcttcgaaggactgggtaacgtggctagtgtggagctgaaaatcccaggctatagagtgggatgttactactgcctctttcagaatgaaaaacttctgccagaaaccgttacgatagattcagagagaaatcccagcgagtatgtggtctgttttctcggcgggagtgaaaagggcctagagctgtttcgcctggagttggacaagtatatccagggtcttaagaacaacatgaattgcgaggcccgcggccttgagagccatatcaagagctatctctcctcctggtttgaagacgtagtttgccctattcagagggtggtgctgctgttccaagagaagctcacctttctgctccatgcagccctgtcatacactccggtggaagttaaggagagcgatgagaagaccaaaagagatattaatcgattcctatctgtggcctcactccagggtttaatccacgaagggacaatgactagcctgtgtatggccatgactgaagagcaacacaaaagcgtagtgatcgattgttcatccagtcaaccacagttttgcaacgctggatcaaatcggttttgtgaagattggatgcaagcttttctgaacggcgccaaaggagggaacccgttcctctttaggcaggttttggagaattttaaactgaaggccattcaggacacaaataaccttaagcgctttatccggcaggcagagatgaatcactacgccctctttaagtgctatatgttcctgaagaactgtggaagcggggacatactgctgaaaatcgtcaaggtggagcacgaagaaatgcctgaagccaaaaatgtgattgccgtcctggaggaattcatgaaagaggcactggatcagtccttctag

SEQ ID NO: 27760 - DNA, 732 bp, Artificial Sequence
  Description of Artificial Sequence: Synthetic coding sequence
atggatgaactcgccctgtcattttcccttacctgccttctgcccgaaaacagagcttcactatctccgagccagccgctgagtttccagtgccttaaggcaccagccaccctcacatgggaggatgagaaacaacaaaggtggggccaacctcatggccccgtaagctccccactgctgggtgaccatagatgcctggtcccatttagggacttgaatccgtcaagcgaagtgaacactgcaaatttgctggagtctccttcttccctgctgttgactagctgttatatttgctcgtatttctctttctatattctaggagaaaagcgatgtcacagccttaagaggctgcgctattctgtctgttgtaaggtctgtcctaacttctgcgcctgtggcaaggaaaacgtctccggcacgggacaggtgtgtaccggggtccacgtgggtgcaaaggagcaggaggaacccggcggcacacaggctctgcgttcttgcggaatctactgccttgaggagcgtaccgacaaagcgagtcatgaggagtgtcgagaacggagtactcttggaagacctcagtgcaccggcctgaccccctcactcgctggcgagagcccttgcccacgccttctgccgggctccccaacagtgagacacctgatcgccagctcttgcccagggttgagcgatcccctgcctttaccacccggaacactgccacttgggagctag

SEQ ID NO: 27761 - DNA, 732 bp, Artificial Sequence
  Description of Artificial Sequence: Synthetic coding sequence
atggacgagcttgctctctcgtttagccttacttgcctcctgcctgaaaatcgagcctcattgagcccctcacagcccctctcattccagtgtttgaaggcgcccgcgaccctcacttgggaggatgaaaaacagcagcgatggggccagccccacgggcctgtatccagcccgctcctcggcgatcacagatgcttggtcccgtttagggatctaaacccgagctctgaagtgaacactgccaatctgctagagagcccatcatcactgcttctgactagctgttatatctgctcttacttctccttttatatcctaggcgagaagagatgccatagcctcaagagactgcgatatagtgtctgttgcaaagtgtgcccaaatttttgcgcctgtgggaaagagaacgtaagcgggactggtcaggtctgcacgggggtccacgtgggggctaaagaacaggaagagcccgggggaacccaggcattgagatcgtgcggcatctactgtctcgaagagagaaccgataaagcatctcatgaggaatgtcgcgagcgcagtacactgggtcgcccacagtgcaccgggttaactccttctttggccggagagtccccctgccctcggctgctacctggctctccgacagtgagacacctgattgccagctcatgtccaggcctcagtgacccgttgccactgccccctggtacattaccactgggcagctag

SEQ ID NO: 27762 - DNA, 117 bp, Artificial Sequence
  Description of Artificial Sequence: Synthetic coding sequence
atggacgaactggcactctcattttcgctcacctgtttgctgcccgaaaaccgtgcctctctgtccccatcccagccactatccttccaatgcctcaaagctccggcaaccctttag

SEQ ID NO: 27763 - DNA, 756 bp, Artificial Sequence
  Description of Artificial Sequence: Synthetic coding sequence
atggggcgaccattagagggccagccccttcgggctctggacctgtatccagagcccgccttcctacggtcgggcaaggatccaaaatcttcacctgctagttctccatctttcgcagtgctggggccggaagtgcgaagtaccggaggacaggccgggtctcggcgtcggccatccgctccctgctcccaagatcgcgcggcggccgagggggcacccgcacttttgggtggctctccatcaagcggtagtcctggtcatcctcccggctccgcttttggggtcgaagccggctgcagagccctgaatgtttccgagcacgctcgcggaggttttgcactcggtctgccattcggtctgtcagggggcgcatatctcttcctgctcctggatggggctggtgaccctaaacccacgcccgaagccccaatctctagcgccgacgggcgcgcttggttcccaagcgagtcctcatggcagctccctcagcttcccgcaggcagtacaagtgggagcgagcctagggctcgcccagggctgggtccaagacaactgctaacagggcccagggacggcgcagccggccagggccccgggagaggcttgactgctcgccttggacgcgagagggagatcgattgcggaccccgacaggcaggccacggcggtactgccacagatacaggccgcgcaggatcaggcgctcgccacaggcctccgcgggatagaggcaccccaggactcaggactcattag

SEQ ID NO: 27764 - DNA, 435 bp, Artificial Sequence
  Description of Artificial Sequence: Synthetic coding sequence
atgacccggatgactcggcctttgaagagtcacgtccaagtcgtccctagcacactgatgtggcaatcacaggccaggacacagccagcgccactatgctgcaagttgctcacaccacgctggctcccactgctgctgccgacccacccacacagccactgcctggccgggcatttatttttccccgcaagatactcttgcagttcagagtggaagcaacagctgacctgccatctgtgtgtgactgacagtgctcccccccgacatacaggagtagtggtgagtgaacacctgaggcgaaccgagaaactgttcttcactattctgtcccctaatcagagcaagccttttaagacttggaaaatgctgaaggccaccattccaatttttgtttgctttctgctgaatctggcccagaaccctcgtccactgtag

SEQ ID NO: 27765 - DNA, 1023 bp, Artificial Sequence
  Description of Artificial Sequence: Synthetic coding sequence
atgaagtatggcaatccgaactatggcgggatgaaaggcatactgagcaatagctggaagcgtagatatcactcaaggaggattcaacgggatgtgatcaagaagagggctctgatcggggatgacgtcggattgacttcctacaagcacaggcactcaggtttggtgaacgttcccgaagagccaatcgaggaggaggaagaggaggaggaggaggaagaggaagaagaagaggaagatcaggacatggacgcggacgaccgcgtagtggtggaataccatgaggagcttcccgccttgaagcagccaagggaacgatctgcgtcacggcgctcctccgcctcttctagcgacagtgacgagatggattacgacctcgagctaaaaatgatctccaccccatcccccaagaagtccatgaaaatgacgatgtacgccgacgaggtggagtctcagctcaagaatatcaggaattcaatgagagcagacagcgtctcatctagcaatatcaagaataggatcggcaacaaattacctcctgaaaagttcgctgacgtgcggcatctgctcgacgagaagcgccagcactccagacccagacctcccgtgtcatctaccaagtccgatattcggcaaaggctgggtaaaaggccgcacagcccagaaaaagctttctcatctaaccccgtggtcaggcgggagcctagtagtgacgtacactctcgattaggagtgcctagacaggattcaaaaggtctgtacgctgacacaagagaaaagaaatctggtaacctgtggactcgactaggatccgcccctaaaacgaaagaaaaaaatacgaaaaaggtggaccaccgtgcacctggcgcggaagaggatgactcggagctgcaacgggcatggggcgctctgattaaggaaaaggaacaaagtcgtcaaaagaaatcaagacttgacaatctgccctctctccagatcgaggtatcaagagagtcatcaagtggatcagaagccgaatcatag

SEQ ID NO: 27766 - DNA, 1863 bp, Artificial Sequence
  Description of Artificial Sequence: Synthetic coding sequence
atggcggccgtacgaggactgcgagtgagtgtaaaggccgaggcacctgccggacctgcactgggactgcctagtcccgaagctgaatccggcgttgacagaggggagcctgagcctatggaggtggaggagggagagctggagatcgtcccagtgaggaggtccctaaaagaactcatcccagatacttctagaagatatgaaaataaggctggttcttttatcacaggcatcgacgtgacatccaaagaggccattgagaaaaaagaacagcgcgccaaacggttccactttcgatctgaggtgaatctggctcagcgcaacgtggccttggacagagatatgatgaaaaaggccatcccaaaggttcgccttgagaccatttacatatgtggggtagacgaaatgtctactcaagatgtattttcatactttaaggagtaccctccagcccacattgagtggcttgatgataccagctgtaatgtagtctggctcgatgaaatgacagccacacgggcattgattaatatgtcaagtctgcccgcgcaagacaaaatacgatctagggacgcatctgaggacaaatccgccgaaaaaagaaaaaaggataagcaggaggactcttctgacgacgacgaagccgaagagggggaagtggaagacgagaactcttctgatgtcgaattagatacccttagccaggttgaggaggaaagcctcctacgcaatgatctgagaccagctaataaactggctaaagggaaccggctattcatgaggttcgctaccaaagacgataaaaaggagctgggtgccgcccgcaggtcccagtactacatgaaatacggaaaccctaattatggcgggatgaaggggattctaagcaattcgtggaaacggagataccatagtcgcagaattcagcgtgacgtgatcaagaagagagctctcattggcgacgacgtgggcctcacctcctataagcatcgccacagcgggttagtaaatgtcccagaagagcctattgaggaggaagaggaggaggaggaagaggaagaagaggaagaagaagaagatcaggatatggacgctgatgatagagttgtcgtggagtatcatgaggaattgccagccttaaaacaacctagagaacggagcgcatccagacgcagtagcgcctcctccagcgactctgacgagatggattacgatctcgaacttaaaatgatcagtacacccagcccgaagaaatccatgaagatgacaatgtacgctgatgaagtcgaatcccaactgaagaatatcaggaactccatgcgggctgattccgtgagttctagtaacatcaagaaccgaataggaaacaaattacctcccgagaagtttgccgacgttcgacatctacttgacgagaagcgccagcacagtaggccacgacccccagtctcaagcacgaagtccgacatccggcagagacttggtaagcgcccccactcccctgaaaaggccttctctagcaaccctgtggtgaggcgggaaccttcatccgatgttcattcacgccttggagtgccccgccaggactcaaagggtctctatgcagatactagagagaagaagtctgggaacttatggacgcggctgggcagcgcacccaagactaaggaaaaaaacacaaagaaggtggaccatcgggcccccggcgccgaggaagacgattccgagctgcaaagagcctggggcgccctgattaaggaaaaagaacagtcccggcaaaagaaaagtagactggataacctgccttctctgcaaattgaggtgagtcgggagagctcatcaggctcagaggccgagtcatag

SEQ ID NO: 27767 - DNA, 1140 bp, Artificial Sequence
  Description of Artificial Sequence: Synthetic coding sequence
atggaaacactgtgccctgcacccagactcgctgtaccagccagtcctagaggaagcccttgctccccaacgcctagaaagccatgtcggggcactcaggaatttagtcctttgtgcctgcgcgccctcgcattctgtgctttagccaaacctagagcatcttcgctgggacctggccccggagagcttgccgctcgctcaccagtattgcggggaccacaggcacctctgcggcctggcggctgggctccagacgggctgaagcatctgtgggcacctaccggtaggcctggcgtgccaaatacggccgctggggaagatgccgatgtagccgcatgccctcggagaggcgaagaagaggaaggcggtgggggctttcctcacttcggggtccgaagctgtgcccctccaggccggtgtcctgcccctccacacccacgcgagagcacgaccagttttgccagcgcacctcctcggccagccccaggattagaaccccagcgaggccccgccgcatctcctccacaggaaccctcatcccgccctccctctcctcctgcagggctctccaccgaacccgctggcccaggtacagcaccacgcccttttctccctggtcagccggcagaggtggacgggaatcccccccccgcagcccccgaagccccagcggcgtccccgtcaacagcctcccccgcaccagctgcacccggcgatctgcggcaagaacatttcgaccgacttatcagacgttctaagctttggtgttatgccaagggcttcgccctggacacccctagcctgaggaggggacctgaacgtccccctgcaaagggaccagccagaggcgctgctaaaaagcggcgactgccagcgccccctccacgcactgcacaaccccgacggccagcccctactttgcccacaacgtctaccttctcccttttgaactgctttccctgtccacctgcgctggtggtcggggaggatggggacctgaaaccagccagtagtctgaggctgcagggcgatagcaagccaccccccgcccaccccttgtggcgctggcagatgggaggccctgcagtgcccgaacccccgggcttgaagttctggggaattaatatggatgaatcttag

SEQ ID NO: 27768 - DNA, 1272 bp, Artificial Sequence
  Description of Artificial Sequence: Synthetic coding sequence
atggaaacccggggaccaggactggccgttcgtgctgagagcaggagactcgttggcattggtccaagggctccccccggccgcgtgggacttcaaccttcaggtcgtttggaccgccgcggtggagcgggaacaatgggctacaaagacaacgatggcgaggaggaggaacgtgagggcggggctgctggtcctcgtggcagccggttacccccaattacaggcggagcctctgagcttgccaagcgaaaagtgaaaaagaagaagcggaaaaagaagaccaaaggtagcggtaaaggggatgataagcaccagagtcaaagcctcaaatcacagcccctgagctcttctttccacgacattctgtcaccctgcaaagaaagaggccctaagccagagcataggcaaagcaaggtggaaaaaaaacacttgcccagcgattctagtacagtgtctttgcccgactttgctgaaattgagaatctcgcaaatcgcatcaatgaatccttgagatgggacggaatattggccgatccagaagccgagaaggagcgcattcgaatatacaagttaaatagacggaagaggtacagatgcttggcacttaagggatttcacccagaccctgaggctttaaagggattccatccagacccagatgccctgaagggttttcacccagatccagaagctttgaaaggctttcaccctgatccagaagctctgaaggggatccacccagacccggaagccctcaaagggttccacccagaccccgaggctttgaaaggctttcaccccgatccagaggccctgaaagggtttcacacggaccctgaagccctaaagggctttcacatagacccagaggcccttaagggattccatccagatcccaaggctctgaaaggattccacccagacccaaaagccctcaaaggctttcataccgaccccgaagctctgaaaggctttcatcctgatccgaaagcactgaaaggatttcatcccgaccccgaggcccttaagggattccaccccgacccagaagctctgaagggatttcatccagatcccgaagccctaaaaggcttccacaccgacccaaacgctgaggaagccccagaaaacttaccatacctgagtgataaagacggaagctcctctcacaggcagcctacatctaaagccgagtgtccgaacttatgcttcgaaggcaatttaacacccaagttactacattcggacctcgcccctaccctgctggaatag

SEQ ID NO: 27769 - DNA, 465 bp, Artificial Sequence
  Description of Artificial Sequence: Synthetic coding sequence
atggcttatctgtccgaatgcagacttcgcctcgagaagggctttatccttgatggcgtcgctgtgagtacagcagctagggcctatggacgatccaggccgaaattatggtctgctattccgccctataatgcacagcaggattaccatgcccggtcttactttcagtctcatgttgtgccaccccttctgaggaaaaccgatcaagatcatggcggtaccggacgcgatggctggatcgtggattatatccacatttttggccaggggcagagatatctgaatagacggaattgggccgggacaggtcactccctgcagcaggtgaccggccatgaccattataacgccgacctcaagcccattgatgggttcaatgggagattcggatacagacgcaacactccagcgctcaggcaatctacctcagtcttcggtgaagtgacccactttcctttattttag

SEQ ID NO: 27770 - DNA, 798 bp, Artificial Sequence
  Description of Artificial Sequence: Synthetic coding sequence
atgggactaccaggtctcttctgtctcgctgtactggctgcatcgagcttctctaaagctcgggaggaggagattacccccgtcgtgtcaatcgcctacaaggttttagaagtgttcccaaagggcaggtgggtcctaattacgtgttgcgctccacagcccccaccccctatcacctactcattgtgcgggaccaaaaacattaaggtagcaaagaaagtggtgaaaacacacgaacccgcaagctttaatctgaacgtgactttgaaatcttcaccagacctgcttacgtacttctgctgggccagcagtacctctggcgcccacgtcgacagcgcacggcttcaaatgcattgggaactatggagcaagcctgtatcagaattacgggctaacttcactctgcaagataggggcgccggccctagggttgagatgatttgccaagccagttccggcagtccacctatcacaaattcactgataggtaaagacggacaagtacacctccagcagcggccttgccatcgccagcccgctaacttcagtttcctcccctcccagaccagcgattggttctggtgccaagctgcaaataacgcaaacgtacaacattctgccctgaccgtggtaccgccgggtggcgatcagaagatggaggattggcagggccctctcgagtcacctatccttgccttgccactgtataggtctactaggcggttgtcagaggaggagttcggcgggttcaggattgggaatggtgaggtgcgaggcagaaaggctgccgctatgtag

SEQ ID NO: 27771 - DNA, 903 bp, Artificial Sequence
  Description of Artificial Sequence: Synthetic coding sequence
atgtccaggccaggaatcgtcgagtcgtacgagatcactcccgtggtgagcatcgcgtataaggttctcgaggtgtttcccaaaggacgctgggtactgatcacatgttgcgccccccaaccgcctccgcccattacatactccctatgcggcaccaagaatattaaggtggctaagaaggttgtcaagacacatgagcctgcaagcttcaatttgaacgtgaccctgaaatctagtccagacctgcttacttacttctgttgggcttcatctactagcggtgcccacgtggacagcgccaggctccagatgcactgggagttgtggtcaaaacctgtctccgagttgcgggccaacttcacattacaggatcgcggcgctgggcctagggtagaaatgatatgccaggcaagttctgggtcacctccaataactaacagtttaattgggaaagatggtcaggtgcacctccagcaacgaccctgtcatcgacaacctgctaatttttcctttttgccttcacagacatcagattggttttggtgccaggctgccaataacgctaacgtgcagcactctgccctcacggtggtaccccctggcgaacgagccctgggattccctgagggacaattggccttgctctgtagggagggagctagcgtgcaggacaccgggagatgggaggtgggccagctgtatccagctacagctgagagccgtgaaggaacaggcggaaatcatgctcatcccggtccctgcctgaaggaagcccagccctcttgcctgagacctctgcctggcggactgccgagagcccccaccatcgtactcgttggaagcttggctagtacagcagccatcacttccagaatgctcggttggactacttgggcccgttag

SEQ ID NO: 27772 - DNA, 399 bp, Artificial Sequence
  Description of Artificial Sequence: Synthetic coding sequence
atggtgaaaaagtttaaagatagtaagagcgtcctgctaattacatgcaaaacatgtaacagaactgtgaaacatcacgggaaaagtaggtcgttcgtgagtacattaaaatcgaatcccgcgaccccaactagtaagctcagtttgaagacgcctgaaaggcgcaccgctaacccaaatcatgacatgtctggttccaaggggaaatctcccgcttctgttttcaggacccccacctccggccagtcagtgagcacttgtagctctaagaacacatcaaagactaagaagcacttcagtcaactgaagatgttgctgtctcagaacgagtctcagaagattccaaaggttgatttccgaaactttctctcgtctctcaaaggcgggttattaaagtag

SEQ ID NO: 27773 - DNA, 663 bp, Artificial Sequence
  Description of Artificial Sequence: Synthetic coding sequence
atgaggcagaagcactatttggaagccgctgctaggggtctgcatgacagttgcccagggcaggctcggtatctgctatgggcctatacaagctcacacgatgataaaagtacctttgaagaaacttgcccatattgctttcaactgttagtgttggacaattctcgggtgcgtctgaagccgaaagcgagactcacccctaagattcagaagctgcttaaccgagaggctcggaactatactctttccttcaaagaagctaaaatggtgaaaaaattcaaggacagcaaaagtgtactcctgatcacatgcaagacatgtaatcgcaccgtcaaacaccacgggaaatcacgttcatttgtttcaacactgaaatcaaacccggcaactcccactagcaagctctccttgaagacacccgaacgccgaacagcaaatccaaaccatgacatgtccggttcaaaaggaaagtcacccgcctctgtgtttaggacgcccacgtccggccagagcgtctcgacctgttccagtaagaacactagtaagacaaagaaacacttctctcagctcaagatgctcctttctcagaacgaaagccagaaaatacctaaagtggattttaggaactttctctcgtctctgaaaggaggactcctcaagtag

SEQ ID NO: 27774 - DNA, 663 bp, Artificial Sequence
  Description of Artificial Sequence: Synthetic coding sequence
atgagacagaagcactatctggaagctgctgccagaggccttcacgactcatgtcccgggcaagcacgttaccttctgtgggcctatacgagttcccatgacgacaaatcaacgttcgaggaaacgtgtccatattgttttcagttgctggtcctggataacagtcgggttaggctgaagccaaaagccaggctgacccccaaaatccagaaactcttgaatcgggaagcaaggaactatacactctccttcaaagaagcgaagatggtgaagaagtttaaggactccaagtcagtgctcctcattacatgtaagacatgcaacaggactgttaaacatcatggcaagtcacgctcctttgtgtccaccctgaagagtaatcctgcgacccctaccagcaaactcagcttaaaaactccagagcgccgcaccgccaatcccaatcatgacatgagtggaagcaaaggtaagtctccagccagtgtgttcagaacaccgacctctggccagtctgtatcgacctgctcaagcaaaaacactagcaaaacgaagaaacatttcagtcagctgaagatgcttctctctcagaacgagtctcagaagatccccaaggtggacttccgaaattttctgtcttctctcaaagggggtctcttgaaatag

SEQ ID NO: 27775 - DNA, 1212 bp, Artificial Sequence
  Description of Artificial Sequence: Synthetic coding sequence
atgaaaatggaggaagctgttggcaaggtggaggagcttattgagtccgaagcaccccctaaagcatctgagcaggaaaccgccaaagaggaggacgggagtgtggagctggaatctcaggtccaaaaggatggcgtagctgactcaacggtgatttcctcaatgccatgtctcttgatggaactgcggcgggatagttcagagtcacagctggcaagcacagagtccgacaaacccaccacaggacgagtatacgaaagtgacagcagtaaccactgcatgctgtctccttcgagtagcgggcatctcgcggacagcgacacgctcagttcagccgaggaaaacgaaccttcacaggctgagacagcagttgagggcgatccctccggcgtgagtggcgctaccgtgggccgcaaatccaggcgttcgaggtcagagagcgaaaccagtactatggccgccaaaaagaatcgacagtcctccgacaaacagaacggtcgggtggccaaagtcaaagggcaccgctcacagaagcacaaggagagaatccggctgctcaggcagaaacgggaggccgcagctagaaaaaagtacaaccttctgcaagactcctcaacctctgactccgacctaacttgtgattccagcacctcctctagtgatgatgacgaagaggttagcggttcgagtaagaccattacagcagagattcccgacggcccacctgtggtggcacactacgacatgtctgatacaaacagtgatcccgaagttgttaatgtagacaacctgttagccgcggcagtggtgcaggagcattcaaattccgtgggcgggcaggacactggagccacctggagaaccagtggtctcctggaggagctaaacgcagaggcagggcaccttgatcctggcttcctggctagcgataagacatccggcaacgcccccctgaacgaagagattaatatcgcctcttctgactctgaggtggaaatcgtcggcgtgcaggagcatgcccgctgcgtccaccctagagggggcgtgattcagtctgtcagttcttggaaacacgggtccggaactcaatacgtatccactcggcagacccagagctggaccgccgtcacgccccagcagacctgggcctcacccgctgaagtcgtcgatctgactctggacgaagacagcagacggaagtacctgctgtag

SEQ ID NO: 27776 - DNA, 1029 bp, Artificial Sequence
  Description of Artificial Sequence: Synthetic coding sequence
atgaagatggaagaagccgtgggaaaggttgaggaactgattgagtcagaggctccaccaaaggcgtcagaacaggagaccgccaaagaggaggacggctccgttgaacttgagagtcaggtccagaaggacggggtggctgactctaccgttatatcgtctatgccttgcctcctgatggagctccgccgcgactcctccgagtcacagttggcgtccactgagagcgacaagcccactaccggtagagtgtacgagagcgattcatccaatcattgcatgctgagccccagcagcagtgggcatttagccgacagtgacactctgtccagtgcggaagaaaacgagccatcccaggcggaaaccgccgtagagggtgatcctagcggtgtctctggagctactgttggaagaaagagtagaagatctcgctccgaatccgagacctccacaatggccgcaaagaaaaaccgccagtcatcagataagcagaatgggagggtcgccaaagtcaagggtcatcggtcacaaaaacacaaggagaggatcagactgctgcgtcagaagagagaagccgccgcccgaaaaaaatataatcttctccaggactcctccacctctgatagcgatctgacatgcgatagctctactagcagcagtgatgatgatgaagaagtgtccggttcaagcaagacgatcaccgccgagattccaggccacctggatcccggctttctggcctccgataagactagtggaaacgcacctttaaatgaagagatcaatattgcctccagcgactccgaggtcgagattgtgggagtgcaggaacacgcacggtgcgtgcacccgagggggggagtaatccagtccgtgagctcctggaagcatgggagcggcacccagtatgtaagcacgcgccaaacacagtcctggacagcagtcacgccccagcagacctgggcttcaccggcggaagtggtggatctgacactcgacgaagattccagacgcaagtacttactgtag

SEQ ID NO: 27777 - DNA, 231 bp, Artificial Sequence
  Description of Artificial Sequence: Synthetic coding sequence
atggtgtgcatcccttgcattgtgatccccgtgttactatggatctataagaagttcctggaaccgtatatttatccactggtctccccttttgtaagtcgtatctggcccaaaaaagctatacaggagtcaaatgatacaaataaagggaaagtcaacttcaaaggggccgatatgaatggactgccgaccaaaggaccaacggaaatctgcgacaagaagaaggactag

SEQ ID NO: 27778 - DNA, 231 bp, Artificial Sequence
  Description of Artificial Sequence: Synthetic coding sequence
atggtctgtatcccctgcatcgtgattcccgtgctgctgtggatctataagaaatttctagagccatacatttaccctcttgtgtcaccgtttgttagtcggatctggcccaaaaaggctatccaggagtcaaatgatacaaataaaggcaaagtgaattttaagggtgccgatatgaatggcttgcccacgaagggacccacagagatttgcgacaagaaaaaggattag

SEQ ID NO: 27779 - DNA, 2490 bp, Artificial Sequence
  Description of Artificial Sequence: Synthetic coding sequence
atgaccgagaataagactgtatcatcatcttcaactagagatgaccaaaccaatattggtctgacatgtcaggaagtgaaagcactcagagaaaaggcctggtcccggaccaacgaaggcaacgcaatgtcacagtccctggttctatacggggcttcaaaagaaaactctgagggcttccatgagtccaaaatgactaacaccgagggggtgaataagggcatctacttcagctacccgtgccggcgccactcatgtgcagtggtgaatataccggcgccctgtgtgaacaaaatgattagccatattcaagacgtagagtcaaagatccaagagcatctgaaacgatttgagacgtccttcgaagagtggtctcgcacttcctcaacaaaggatctgaaagaggattggagcgttaccacaccagtgaaggaagtcaagccgggagagaagagggacgaaaagtgtcccgaactgaagcaggagatggaaacactactgagtgaggcaattcgcctgatcaagtcacttgaaaccgaccgggccgatgctgaagaggcactgaagcagcagcgatcccgcaaaaacatgattaacatgaagatcgactcctggtcagtctggaagctccaggaacttccacttgctgtacagaaggagcatgaagcgtatctgtccgacgtcatagaactgcagtggcacttagaggataaagctaaccaactgcagcacttcgagaagcagaaaactgaactggaggaagcgaacgctaagatccaggctgacattgattatatgaatgagcacggacctctgctggattcaaaacagaaccaggaattacaggatctaaaaaaccattataaaaagaagatggaggtgatggacctgcatcggaaggtgaatgaggagctggaagaagcactggaagcctgcgagaatgcgcgtctaaaggcccagcagattaaagaggaaatcgataaagatatttatcaagacgaaaagactattgaggcatataagagagaaatctatcagctgaacagcctgtttgatcattattcttcctctgttatcaatgtcaacaccaacatagaggagaaggaagaagaggtgaccgaggcaatccgggaaacgaaatctagcaagaacgagctacattcgcttagcaagatgctcgaggatctacggcgtgtgtatgaccagctcacctggaaacaaaaatcgcacgaaaatcaatatctggaggctgtgaatgatttttatgcagctaaaaagacctgggacatagaactttcagatgtcgctaaagatttcagcgcaatctcccttgcttgtacgaagctgacagaagataacaaaaaattggagattgatatcaataaaataactgttaaaacaaatgaatcaattcgcaaaaagagtaaatacgaaagtgaaattaaatacctcacaatcatgaaactgaagaatgacaaacatctcaaaaatatctacaaagaggcgtaccggataggaaccctttttcatctgacgaagcacaagacagatgagatggaagacaagatcgcggaggtgcggaggaaatttaaagggagggaggaattcctgaaaaaactgacccagggagaggtggcagccggcatggtattgcaaaaaaaactatacagtatctacgaggtccaggctctggaaaggaaggaactgattaagaacagggcaatttgcgccatgtctctagccgaattgcaagagcccttactgcagctggaggacgaggccgagcgaatcaggtcactcgacaaagagcattcggtgtccaagaggtctgccatattcaaggacttagaggccaccaagagcaaaacaatgatcttctatgccaaaattaacgagctcaacgaagagttaaaagcaaaggaggaagagaagaagtcatttgaccaaactctcgagatcctgaaaaataaattcattaccatgaggttcaagcgcgagcacgctcagactgtatttgatcactatatgcaagaaaaaaaagactgtgaagagcggatctttgaagaggaccagcgattccgtgtcctgcttgccgtgcgacagaaaacactccaggacacccagaagataatcgctgacagcctcgaagagaatctgaggctcgctcaggagtatcaacagctccagatcacctttctgaaagagaaggataactactttaacatttacgataaacagctatcactggacacctctatccgggacaaaaaacaattatgccaactccagcgccggatgcacactctctggcaggagcacttcaagctggtggtgctctttagtcagatgcggctcgcaaacttccagactgactcccaggagtcaatacaaaaaattctggccgtgcaggaggagagttcaaatttaatgcagcacatcttagggttctttcagactcttaccgatggaacatgtgaaaacgacgggtag

SEQ ID NO: 27780 - DNA, 2604 bp, Artificial Sequence
  Description of Artificial Sequence: Synthetic coding sequence
atgacagaaaacaagacagtgagtagtagttcaacacgtgatgatcagacaaatatcggactcacctgccaggaagtcaaggcactgcgagaaaaggcttggtcacgtacaaatgagggtaacgctatgtcgcagagcctggtgctatacggtgctagtaaagagaactcagaaggatttcatgagtctaagatgaccaatacagagggagtgaacaaaggaatctacttctcctacccctgccggcgtcacagctgtgccgtggtcaatatcccagccccatgtgtgaataagatgatctctcatattcaagacgtggaaagcaagatccaggagcacctgaaacggtttgagacaagcttcgaagagtggtcccgcacctccagcacaaaggaccttaaagaagactggagcgtcactacgccagtgaaggaagtgaaaccgggagagaagagagatgaaaaatgtccagagctaaagcaggagatggagactctattatcagaagcaatccggcttattaagagcctcgagaccgacagagctgatgccgaggaagctttgaaacagcaaaggtctagaaagaacatgatcaacatgaagattgactcatggtccgtatggaagctgcaagagctccccctggccgtccagaaggagcacgaggcatacctgagtgacgtgattgaacttcaatggcatctggaggataaggccaaccagttacagcatttcgaaaagcagaaaacagagcttgaggaagcaaatgcaaaaatacaggcggacatcgactatatgaacgagcatggacctttgctcgactctaagcagaatcaggaattgcaggatctgaagaaccactataaaaaaaagatggaggtgatggacctgcataggaaggtgaacgaagagttggaagaggcactggaggcctgcgagaacgctcgactgaaggcgcagcagattaaagaggaaatcgacaaggatatttatcaagatgaaaagactatcgaggcctacaagcgagaaatctaccagctgaacagtctgtttgaccactacagtagcagcgtaataaacgtgaacaccaatatagaagagaaggaggaggaggttacagaagcaattcgggagactaagagtagcaaaaatgaactgcacagtcttagcaagatgctggaagatctgagacgagtctacgatcagttaacatggaaacaaaagtctcacgagaatcagtatcttgaagcagtgaacgacttctacgccgccaagaagacctgggacatcgaactgtccgatgtggccaaggacttttccgcgattagtctggcatgtactaagttgaccgaagacaataaaaaacttgagatcgacattaataagatcaccgtgaaaaccaacgaaagcatccgaaagaagagcaaatacgagtccgagattaagtatttgaccataatgaagctgaagaacgacaagcacctcaagaacatttataaggaagcctaccgcattgggacgctcttccatctgaccaaacacaaaaccgacgaaatggaggacaagattgccgaagtcaggcgaaaatttaaaggtcgagaagaatttctcaagaagttgacacagggcgaggtggccgccggaatggtcttgcaaaaaaagctctacagcatctacgaggtccaggccctcgagaggaaggagttaataaaaaaccgcgctatctgcgccatgagtctggccgaattgcaggagcccctgctgcagctcgaagacgaagctgagagaataaggtctctcgataaagaacactctgttatgttgaataacattattgaccagaaggatctgattcggaggaaagtcggtaaagtcaagaaaaagctgcggaagaagggcaagaagaccctcgacgcactgattgagactgagtccaagcgttccgctatcttcaaagacctggaagcaacaaagagcaaaaccatgatattctatgcaaagatcaatgagttgaacgaagagcttaaagcgaaggaggaggagaagaaatctttcgaccagaccctcgagattttgaagaacaaattcattacaatgcggtttaaaagagaacacgcccaaaccgtcttcgatcactatatgcaggaaaagaaggactgtgaagagcgcatatttgaggaggatcagcggttccgagtcctccttgccgtcagacaaaagaccctgcaagatacacaaaagatcatcgcagacagtcttgaggaaaacctgagactcgcgcaagaataccagcagctacagatcacgttcctgaaggagaaggataactatttcaacatctatgacaaacagctgagcttagacacaagtattcgagacaagaagcagctgtgtcagctgcagagacgcatgcatacattatggcaggagcacttcaagctggtcgtactgttctcccagatgcggctggctaatttccagactgattcccaagagagcatccagaaaatccttgccgtccaggaagaatcctctaatctcatgcagcacattctgggattctttcagactctcactgacggtacatgtgagaacgacggctag

SEQ ID NO: 27781 - DNA, 894 bp, Artificial Sequence
  Description of Artificial Sequence: Synthetic coding sequence
atgactgagaacaaaacagtgagctctagttcaacacgcgacgaccaaactaatatcgggttgacttgtcaagaggtgaaagctttacgagagaaagcatggagccggaccaatgaaggcaacgccatgtctcaaagtctggtgttgtacggtgcctcaaaggaaaacagcgaggggttccacgagagtaagatgaccaataccgagggcgtgaataagggtatttacttcagctacccatgccgaaggcacagttgcgccgtagtgaatattcccgccccttgcgtgaacaagatgatcagccacatccaggacgtggagtctaagattcaggaacatcttaagaggttcgagacatcatttgaagagtggagccgaacctcatccacaaaggacctgaaggaggattggtccgtaaccacccccgtgaaagaggtgaaacctggagagaaacgcgacgagaagtgtccggaactgaaacaagaaatggaaactctgctaagtgaagctataaggctgatcaaatcactggagacggatagagctgacgccgaggaagctcttaagcagcaacgaagcagaaagaatatgatcaatatgaaaattgacagttggtcggtgtggaaactgcaggaactgcctctggccgtgcagaaagagcatgaggcttacctgtccgacgtgattgaacttcagtggcatcttgaggacaaagctaaccagctgcagcacttcgagaaacagaaaactgagctagaggaggctaacgccaagatccaggcagacatcgattacatgaatgagcatgggcccttgcttgactccaagcagaaccaggagctccaagaccttaaaaaccattacaaaaagaagatcaaaaagaaaaaaaaatag

SEQ ID NO: 27782 - DNA, 2454 bp, Artificial Sequence
  Description of Artificial Sequence: Synthetic coding sequence
atgaccgaaaataaaacagtgtcctcaagtagtacccgcgatgatcagaccaacatagggttgacatgccaggaagtgaaagctctcagggagaaggcttggagccgcaccaacgaaggtaacgctatgtctcagtctctggtgttatacggcgctagcaaagagaactcagaaggttttcacgagtccaagatgaccaacaccgagggcgtgaataagggcatctatttctcatacccatgtcggaggcatagctgcgcagtggtgaacattcctgccccatgtgtgaataaaatgattagccatatccaggacgtggaaagtaagatacaggagcatctcaagcggttcgagacatctttcgaagaatggtcaaggacgtctagtacaaaggatctgaaggaggactggagcgtaactactcctgtcaaggaggtgaaaccaggggaaaagagggatgaaaaatgtcctgagctcaaacaggagatggaaacactcctgagcgaggcgattaggctgataaagtcactggagacagatagagcagacgcggaggaggccctcaaacagcaaaggtcccgtaagaatatgatcaacatgaagattgactcatggagcgtgtggaaactgcaggaactccccttagccgtgcaaaaggaacatgaggcttacctgtccgatgtcatcgagctgcagtggcacctggaggacaaggccaatcagttgcagcattttgagaagcagaagacagaacttgaagaggctaacgccaagatccaggcagacatcgactatatgaatgagcatgggcctctgcttgacagtaaacagaatcaggagctgcaagacttaaagaaccattacaagaagaaaatggaagtcatggaccttcatagaaaagtcaatgaggagctcgaagaggccctggaggcgtgtgagaatgcacgtctcaaagcccagcagatcaaggaggaaatcgataaggatatttaccaggacgagaaaaccatcgaggcctacaaacgggaaatttatcaactcaattcactgtttgatcattacagcagcagtgtaatcaatgtcaataccaacatcgaggagaaggaagaggaagtgacagaggccatccgcgagacgaaatcttcaaaaaacgaattgcattctttgtccaagatgctcgaggacctgagacgtgtctatgaccagctgacctggaagcagaagagccacgaaaatcagtacctggaggccgtaaatgacttttatgcagccaaaaagacctgggacatcgagctgtcagacgtggctaaggacttctccgcaatttctctggcatgtacaaaactcactgaggataataaaaaactggaaatagacatcaataagatcactgttaagaccaatgaatccattagaaagaaatcaaagtacgagtccgagattaagtacttgaccatcatgaagctcaaaaacgataaacacctgaagaacatatacaaagaagcctaccggatcggcaccctctttcacttgacaaagcataaaaccgatgagatggaggataaaattgcggaggtgcggcgcaaattcaaaggcagggaggagtttttgaaaaagttaacacagggtgaggtcgccgccggaatggtgcttcaaaaaaaactgtactcaatctacgaggtccaagcgctcgagcgcaaggaattaatcaagaacagggccatttgcgcaatgtctttggccgaactacaggagcctctgctgcagctcgaagacgaggccgagcgcataaggagccttgacaaagagcactccgtcatgcttaacaatatcattgaccagaaagacttaattagacgaaaggttggtaaggttaagaaaaaactgagaaagaaagggaagaagacgctggatgccctgatagagactgaaagtaagcggagtgcgatttttaaggacctggaagccaccaaaagcaagaccatgattttctacgccaagatcaatgagcttaacgaggagctcaaggcgaaagaggaggaaaagaaatcatttgaccagaccctggagatccttaagaataaatttatcacaatgcgctttaagagagagcacgcccagaccgtgttcgaccactacatgcaggaaaagaaagactgtgaggaaaggatttttgaggaagaccagcggttccgcgtcctcttagcggttcgacaaaaaaccctccaggacactcagctgtgccagctgcagcgcaggatgcatacgctgtggcaggaacactttaaattggtggtactattctcccagatgcgattggcaaacttccagaccgacagtcaggaatctatccagaaaattctagcagttcaggaagagagcagcaatttaatgcagcatatcctcggtttttttcaaactttaacagacggcacctgcgagaacgacggttag

SEQ ID NO: 27783 - DNA, 2604 bp, Artificial Sequence
  Description of Artificial Sequence: Synthetic coding sequence
atgaccgaaaataaaaccgtgtcttcatcctcaacccgggacgatcagactaacattggcttaacatgtcaggaggttaaagctcttagagagaaagcctggtcaagaacgaacgaagggaacgctatgagtcagtcgcttgttctatatggtgcatctaaggagaactccgagggctttcacgagtccaaaatgaccaacaccgagggcgtcaacaaaggaatctacttctcatatccttgccgtcgtcatagctgcgctgtggtgaacatccctgccccttgcgttaataagatgatttcacatatccaggacgtagagtctaagatacaggagcacctgaaaaggtttgaaacttcctttgaggaatggagtcggaccagctcaaccaaagatctcaaagaagattggtccgtgactacccctgtgaaggaagtcaagccaggtgaaaagcgggatgaaaaatgtcccgagttaaaacaggagatggagaccctcttgtccgaggccattcgacttatcaaatccctggaaaccgacagagctgatgctgaggaggcacttaaacagcagaggtcccgaaagaacatgattaacatgaagatcgattcctggtccgtgtggaagctgcaagagctacctctcgccgttcaaaaagagcatgaggcgtatcttagtgatgttatcgaactgcagtggcacctcgaagataaggccaatcagttgcaacattttgagaagcagaaaacagaactcgaggaggcaaatgctaagatccaggccgacatcgattacatgaatgagcacgggcctcttctggactccaaacaaaatcaggaacttcaggacctcaaaaaccattataaaaagaaaatggaggtaatggacctccatcggaaggtaaatgaagaactggaggaagctctggaggcatgtgaaaacgcacggctcaaggcgcagcaaattaaagaggaaatagacaaagacatttaccaggacgagaagacgatcgaggcctacaagagggagatttaccagctcaacagtctattcgatcactacagttcatccgtgataaacgttaatacgaacattgaagaaaaagaggaggaagtgacggaggccattcgagagacgaagagtagcaaaaacgaactgcactctctgtctaagatgctggaggacctcaggcgcgtttacgatcagctgacatggaaacaaaaatcacacgaaaatcagtatctggaggccgtgaacgatttttatgcagctaaaaaaacctgggatattgaactttccgacgttgcaaaagacttttccgctattagccttgcctgcactaagctcaccgaggataacaagaagctggagattgatattaataagataacggtgaaaactaacgagtcaatcagaaaaaagagtaagtatgagtcagaaatcaaatacctgacaatcatgaaactgaaaaacgataagcacctcaagaacatatataaggaagcatataggattggcaccttgtttcacctgaccaagcataaaacagatgaaatggaagataagatcgcagaggtacgtaggaagttcaagggacgggaggaattcctaaaaaagctaacacagggagaggttgccgccggcatggtgcttcaaaagaaactgtatagcatttatgaggtccaggccttggaacgcaaggaactgatcaagaatagggccatctgtgcaatgtccctcgctgaattacaggagcctctgctgcagttggaagatgaggcagagcggattcgctcactggacaaagaacactccgttatgctcaacaatattatcgatcagaaagacctcattcgcaggaaggtggggaaggtcaagaagaaactgcgcaagaagggcaaaaagaccctggatgccctgattgaaaccgagagcaagcggagcgctatcttcaaggatcttgaggccacgaaatccaagacaatgatattctatgcaaaaatcaacgaactgaatgaagagctcaaggccaaggaggaagaaaaaaagtctttcgatcagaccctggagattctcaaaaataagtttattactatgaggtttaaaagagaacatgctcagactgtgtttgatcactatatgcaagaaaagaaggattgcgaggaaaggatttttgaagaagaccaaaggttccgcgtgcttctcgctgtgaggcagaaaactctgcaggacacacagaaaattattgctgatagcttagaggagaacttgcgtttggctcaagagtaccagcagctgcaaatcacatttctcaaagaaaaggacaattactttaatatctatgacaaacaactgtccttagatacatcgatcagggataaaaaacagctttgccagctacaaaggcgaatgcacacattatggcaagaacatttcaagctggtggtgttattctcccaaatgaggcttgcaaacttccagactgatagccaggagagcatccagaagattttggccgtgcaagaggaatccagcaatctaatgcagcatatcttgggattcttccaaaccctgacggatgggacttgcgaaaacgacggctag

SEQ ID NO: 27784 - DNA, 2676 bp, Artificial Sequence
  Description of Artificial Sequence: Synthetic coding sequence
atgacagagaacaagaccgtgtcatcttcttccacacgtgatgaccagacgaacatcggcctgacctgccaagaggtgaaagccctgagagagaaagcttggagtcgcactaatgaaggtaacgccatgtcccagtccctcgttctttatggcgcgtctaaggaaaattccgagggatttcatgagtcgaagatgacaaatacagaaggagtcaacaaaggcatctacttcagttacccttgtagacgccacagctgcgccgtggttaacatcccggccccttgtgtgaataaaatgatttcacacatccaggatgttgaatcaaaaatccaagaacacctcaagcgctttgagacttcctttgaggagtggtcacgcacttcatcaactaaggacctgaaagaggattggtcggtgacgactcccgttaaggaagtgaagcctggtgaaaagagggacgagaagtgtcctgaacttaaacaggagatggaaacgctgttgagtgaagcgattcgactgatcaagtctttggagacagaccgcgccgatgcagaggaagctctgaaacagcagagaagtagaaagaatatgatcaacatgaagattgactcgtggagcgtgtggaaactgcaagaactcccccttgccgttcagaaggagcacgaagcctatctgagcgacgtgatcgagctgcagtggcacttagaagacaaggccaaccaactccaacattttgaaaaacagaagactgagcttgaggaggcaaacgctaagattcaggccgatatcgattatatgaacgagcatgggcctctgctggattcaaagcagaatcaggaactccaggaccttaagaaccattacaaaaagaagatggaggtgatggatctgcaccgtaaagttaacgaagaactcgaggaggccctggaggcttgcgagaatgcccgcctgaaggcccaacagataaaagaggaaatcgataaagacatctatcaagacgaaaagacaatcgaagcctacaagcgagaaatatatcagctgaactcgctatttgatcactatagttctagcgttattaacgtgaatacaaacattgaagaaaaggaagaagaagtgacagaagcgatccgcgaaaccaaaagtagcaagaacgagcttcactcgttgtcaaaaatgctggaggatttaagaagagtatatgaccaactcacttggaagcagaaaagtcatgaaaatcagtatctcgaggccgtgaacgacttttacgcagctaaaaaaacttgggacatcgagttgagcgatgtcgccaaagacttttctgcaatttctcttgcgtgcacgaaactgaccgaggacaacaaaaaacttgaaatcgatatcaacaagatcacagtcaagaccaatgaatctattcgaaagaaatcaaagtatgagagcgaaatcaaataccttactatcatgaaactcaaaaatgataagcacctgaagaatatctataaggaggcataccgcattgggacattgtttcaccttacaaaacacaaaacagacgaaatggaagacaaaattgccgaagtcaggcgcaaattcaaaggacgtgaggagttcttaaagaaacttactcaaggggaggttgcagccggcatggtccttcagaaaaagctgtacagcatttatgaagtccaggccctcgaaaggaaagagctaatcaaaaaccgggcaatttgtgctatgtcccttgcggagctgcaggagcctctgttacagctagaagacgaagccgaaaggattcgaagcttagataaagaacattcagttatgttgaacaatatcatcgatcagaaggatcttattcggcgcaaggtgggaaaggtaaaaaaaaagctgagaaagaaggggaaaaaaactctagatgcactaatagaaactgagtcaaaaagaagcgcaatcttcaaagatctggaggccactaaatctaagactatgatattctatgccaagatcaacgaactcaatgaggaactgaaagccaaggaggaggagaagaagagtttcgatcagaccctggaaatcctgaaaaacaaatttattaccatgcgatttaaaagggaacatgctcagactgtgtttgatcattatatgcaggagaagaaagactgcgaggagcggatttttgaggaagatcagaggtttcgggtccttctggctgtccggcaaaagacccttcaggatacacaaaagattatcgccgacagtttggaggaaaatctccgcttagctcaggagtatcagcagctacaaattacatttctgaaagagaaagataattacttcaacatctatgacaagcagctcagcctggacacctcaatacgggataagaaacaggtcgctggcttcctgcctaagaagctgcccaattcactgccgatcatatccgacgagctgagcaacttccagctgtgccaactgcagcgcaggatgcacaccttatggcaggagcatttcaaactggtggtgcttttctcccagatgcgtctggctaatttccagacggattcacaggagtcgatacaaaagatcctagccgtgcaagaagaatcgagtaacctcatgcagcatattctgggcttctttcagacacttaccgatggaacttgtgagaacgatggatag

SEQ ID NO: 27785 - DNA, 210 bp, Artificial Sequence
  Description of Artificial Sequence: Synthetic coding sequence
atggttttcgctccgggcgagaagcctgggaacgagcctgaggaggtgaagctgcagaacgcttcaaaacagattgtccaaaatgccatcttgcaggccgtgcagcaggtgtcccaggagagtcagagacgagaggaacgcatcagcgacaaccgagaccatatccagctcggcgtgggggagctcaccaaaaagcatgagaaaaagtag

SEQ ID NO: 27786 - DNA, 372 bp, Artificial Sequence
  Description of Artificial Sequence: Synthetic coding sequence
atgacgccagcaagcggtgcaaccgcgagcctcggcagactgcgggctagaccacgctcacgctgggatgcggcatatctgccagccgtggctgcggtttgcgtggcgagagcctctcacgtaccaaacggaacactgcgctttggggtgtgcaaagccaggcgtaccatgcgcccactcccccgcaggattgaagtccgtaccaagcgtgggccacagcgacccgccgctccggaaagatcacctcagccacggctccctccctccaggcacccttctcgtcggggtccacgcagacatctgtcggggtgtagtgcgccagcctgccgaattccaaccggatgtcgctgcccttgcggccggcctagctag

SEQ ID NO: 27787 - DNA, 2058 bp, Artificial Sequence
  Description of Artificial Sequence: Synthetic coding sequence
atgaacgattccagacagcaatcccttttctttataaccctccctgacctgaataaactttgcgccgtccgtatcatcctgagcaacaaagtcgccgatacagaaatccgaaccatccagatgaagatgtgtaggcagctcctttttctccatcaggatattttgacatcccctgtgagtgggattctcaatcagatatgggttgtgatggcaatccccttttataaagcacgaaagttgaatgcttatgtcgaaaaatacggagccaagatggaagccccccagagagttatccccgtgattctgcagaattgtctcagttattccttcatggcgagacttgcaccagcgtggaaccgcacaggacacctgctgatccaagggagagacttccttagccagatgggcaagcagagtgcagttgtgttaaacatcaacgtcaccgaaactcaggtgtgcctgagcattgaggcctgcaccatcagactaccagcccctgagctgaaggaattcgagatttcacagtcaataatcaaggattttcacgccaataagcatgccgtaatcgagagacactctatcctgagcaattggtgttacgtacttcctagcatgaagatgggccagattattaacatctttcacgctatccccgctgcttgccccttccatagctacggcgatttccagagacattgggatgcactttacggttataagctgcccggggactgtgggaagataaagatctattgcaacatttacttcaagatgctgggtgaaagaacctttacatatcctctgtcatgcattcggtcgcaacctatgcaatttttcccacgagtcgactctgaagtcgtgctaaagagcttcctttccgatctgaagtcaaaactcccccacatctgcggcttccctatcaagatgacctcaaagccttgttactatacacaggaattaacaaagcctaacattcaggaacacaaggttaagcctcctaatctcactacaaaaaaaatgctcagagcctcactcacccaggcaactagccggaagcctgcttgtgcccaatccctgcttccttgtagcgtggctgtcgatcataaggtcgaactgagcgtgtctcaacctacctcagggatctttagtgccctccatctccagccggaatcagtgcagggcagaaaaaaatccctgtctatcagagctccccaagtccattccgaggtgctcatgcctaatagaggcaacactcaggtgcaacacactaatttgtcaagccagagcaacatcacacccaagttcgttcccgtattcaagaaccggctgttacagatgaacaaaaacacttcagtgctgggttccccaaagcgtaaacaacacgacgtaacacagagtaagttattctctttaaagacgtctatgatacagcatgacaagctaaacttggggcccgcaataaaaaaccggtatagcagtaacatacagatgcaggccgctaataacttgaaccaggagaacagcaggcccctgcaggagaagaacacagaatcgagcgagaatatgaccaaattcccatccagtcgagggaaatcaactgtgtctctgaacaaaaataagcagctgtctaatagcgccgttttcgtagtaagcaacaataacttgggagtagttaaatccgccgtggactttcaaatgaaggggaaggaaaatctgaccggaaagggaatcacacaaatcttaggtaaatcccatgggagcttgaagctgaagaggcaaccgcacatctttgagtctgatggagagaccgaggatccgcgacttcttcaacagcaaagcgaaaatcaggccaaagaagtcggcacaagtgatcaccggcttattgtgtccaaaattgctcaccggagcaagcggaagctctgcccagagagctccaagacctccaaaaaacaccacagcgacactgtgcactatggtcaatcatcaagttccaagaagcaaatcctagatagcgacaagtccaaacttaaaaaatcattgatcatccacaatgcatag

SEQ ID NO: 27788 - DNA, 1974 bp, Artificial Sequence
  Description of Artificial Sequence: Synthetic coding sequence
atgggcgaagaggactattacctggagttatgtgagcggcctgtgcagtttgagaaggccaatcctgtaaattgtgtattttttgacgaggccaacaagcaggtgtttgctgtgagatccggaggcgccactggagtggtcgtcaagggaccggacgacagaaacccaatcagcttccgcatggatgacaagggagaggtcaaatgcatcaaatttagtcttgaaaataagatactcgccgtacagcggacaagtaaaacggtggatttttgtaacttcattcctgataatagtcagcttgagtacacacaggagtgtaagacgaaaaacgccaatattctcggattctgctggacttcctcaacggaaatagtgttcatcaccgatcagggtatcgagttctaccaggtcctgccagagaaaagatcccttaagcttcttaaatctcacaatctcaacgtaaactggtacatgtactgccccgaaagcgctgtgatcctcctgagcactacagtgctcgagaatgtactgcagccattccattttagggcaggcacaatgtcaaaattgcctaagtttgagattgaactccccgccgctcccaagagtacaaaaccatctctaagcgaaagggacattgccatggcaacaatatacgggcaactgtatgtgctattccttcgccatcactccaggacgagcaactcaactggggctgaagtggtactgtaccacctgccaagagagggggcctgcaagaagatgcatattctcaagcttaataggactggcaaattcgcactgaacgttgtcgataatcttgtcgtggtgcatcaccaggacaccgaaacatccgtcatattcgacattaaactccggggagagttcgatggcagtgttacattccaccatccagtgctgccagcgcggagcatacagccatatcaaatccccattactggccccgcagcagtgacttcccaatctccagtcccctgtaagctgtacagttctagctggattgtctttcagcccgatataattatcagtgcatctcaagggtacctgtggaacctgcaagtgaagctggaacctatcgttaacctgttgccagataaaggccgactgatggatttcctcctgcaaagaaaggagtgtaagatggtgatcctttccgtgtgcagtcagatgctgtcagagtctgaccgtgcaagcttacccgtgatcgccacagtatttgataagctcaatcacgaatacaaaaagtacctcgacgcagaacagtcttacgctatggcggtggaggctgggcagagccgatccagccccctcctcaaaagacctgtgaggacgcaggcagtgctcgaccaatcggatgtctacacgcatgtgctgtccgcatttgtggaaaagaaggagatgcctcataagtttgtcattgctgtgctgatggagtatatccggtctctgaaccaatttcagatagctgtacagcattatctgcacgagcttgtaataaagactctcgtacagcataacctgttttacatgctacaccagttcctccagtatcacgtgctgtcggactccaagcccttagcctgcctgctcctgtccctggaatcattttacccgcctgcacatcagttatccctcgacatgttgaagaggttaagtactgccaacgacgagattgtcgaggttctgctgtctaagcaccaagtactggccgctctacgattcatccgtgggattggtggacatgataatattagtgctcgaaaattcctggacgctgctaagcaaactgaagacaacatgctcttctatactatattcaggtttttcgaacaacggaaccagcggttgagaggttcgcccaatttcacacccggcgaacactgcgaggaacatgtcgcattcttcaaacagatttttggggatcaggccctgatgcgtcctactactttttag

SEQ ID NO: 27789 - DNA, 1830 bp, Artificial Sequence
  Description of Artificial Sequence: Synthetic coding sequence
atgggcgaagaggattactatttagagttgtgcgagaggccggtgcagtttgagaaggccaatcccgtcaattgcgtttttttcgacgaggcaaataaacaagttttcgccgtccggtccggcggtgccacaggcgtcgtggtgaaaggcccggatgaccgcaacccaatctcatttcgtatggatgataagggagaagtcaagtgcattaagttcagtttggagaataaaattctggcggttcagcgaacttcaaagactgtggtgttgccagaaaagaggagcttgaagctgctgaagagccacaaccttaacgttaactggtacatgtattgtcctgagtccgcggtgatcctactgtccacaacagtcctcgagaacgtgttacagccatttcacttcagagctgggactatgtctaagctgcctaaattcgaaatagagctccccgcagctccgaagagtactaaacctagtctgtccgaacgcgacatcgccatggccacaatttatgggcaactgtacgtactgtttcttagacaccactctagaaccagcaattccactggggccgaggttgttctttaccacctgccgcgggaaggagcttgtaaaaaaatgcacattctgaaactgaataggactgggaagttcgctcttaatgtggtggataatctcgtggtcgttcatcaccaggacacagaaactagcgtgatcttcgacattaagctcagaggcgagtttgatgggtcagttaccttccaccatcccgttctgcccgcccgaagcatccagccgtaccagatccctattaccggccccgccgccgtaacttctcagtcacccgtgccatgcaagctctacagctcaagttggatcgtctttcagcccgacattattattagcgcaagccaggggtacctatggaatttgcaggtcaagctagaaccgatcgtgaatcttctcccggataaaggacggttaatggatttcctccttcagcggaaggaatgcaagatggtcatcctgagtgtctgctcccaaatgctcagcgagtctgatcgtgcgtcactgcctgtaatcgcaaccgtctttgacaaactcaaccatgaatacaagaagtacctggatgccgaacagagctatgccatggccgtagaagccggacagtccagatcatcccctttgctgaaaaggccagtaagaacccaggcagtgctcgatcagagtgacgtgtatacacatgtgctcagtgccttcgtggaaaagaaagaaatgcctcataagttcgtaattgccgtgctgatggaatatattcggtcactaaatcagtttcagattgccgtgcagcactacctgcacgagttggtgatcaaaaccctagtgcaacacaacctcttttatatgctgcatcaattcctgcagtaccacgtgctgtccgactctaaacctctcgcatgtctgcttctttccttggagagcttttaccctcctgcacaccagctgtctcttgatatgcttaagcggctatctaccgcaaatgacgagattgtggaggtcctgttgtccaagcatcaggtcttggcagctctccgttttattagagggatcgggggacatgacaacatctcggcgcgaaagtttttggacgccgccaagcagacagaggataatatgttgttctatactattttccggttctttgagcagcgtaatcagagattaagggggagtcccaactttactcccggtgaacactgtgaagagcacgtggcgttcttcaagcagatcttcggggaccaggccttaatgaggcccacaacattttag

SEQ ID NO: 27790 - DNA, 1503 bp, Artificial Sequence
  Description of Artificial Sequence: Synthetic coding sequence
atgtattgcccggagtctgccgtaattctgctctccactaccgtattggagaacgtcttgcagccttttcatttcagagccggcaccatgagtaagcttcctaaattcgaaattgaactgcccgccgcgcctaagtcaacaaagcccagcctgagcgaacgggatatcgcaatggccacaatctatggacagttatatgtacttttccttaggcaccacagccgaacaagtaatagcaccggagcggaagttgttctgtaccacctcccaagagagggcgcctgcaagaagatgcatatactgaagcttaaccgaacaggtaagttcgcgctcaatgtggtggataacctggttgtggtacaccaccaggacaccgaaacttcagtaatcttcgacattaagttgcgtggggaattcgacgggtccgtgaccttccatcaccccgtgttgccggcaaggagcatccagccttatcaaatccctattaccgggccagctgctgtgacaagccaaagcccagtgccttgcaagctttatagcagttcttggatcgtattccaaccagatatcattattagtgcctcccagggatatctgtggaacctgcaagtgaagctggagccgatcgtaaacctccttccggacaaaggaagactcatggattttctcctgcagaggaaggagtgcaaaatggtcatactgtccgtctgctcacagatgctgagtgagagcgatcgggcctccctgcccgtcatagcaaccgtgttcgacaagcttaatcacgagtacaagaagtacctggatgccgaacagtcctacgcaatggcggtggaggctggccagtctaggagttcacctctgttgaaacggcccgtgagaactcaagctgtcctggatcagagtgacgtgtacacccatgtgttgagcgccttcgtcgaaaagaaggagatgcctcataagtttgtgatcgcagtgctaatggagtacatcagaagcctaaaccaattccaaatcgccgtgcaacactacctgcatgagctcgtaattaagactctagtccagcataatctgttctacatgctgcatcagtttctgcagtaccatgtcctctccgattccaaaccactggcatgcctattactgtctctcgaaagcttctaccctcctgcccaccaactctcgctggatatgctcaaacgcctaagcaccgccaacgacgaaatagtggaggttcttttgagcaagcatcaagtcctcgcagcacttagatttatccgaggtattggtgggcacgataatattagcgcacgtaagtttctggatgcggcgaaacaaaccgaggacaacatgctgttctatacgatattccgttttttcgagcaacggaatcagagacttcgtgggtctccgaactttactccaggcgaacactgtgaggaacatgtggcatttttcaagcagatttttggagaccaggcactgatgcgtccgaccactttctag

SEQ ID NO: 27791 - DNA, 1359 bp, Artificial Sequence
  Description of Artificial Sequence: Synthetic coding sequence
atgtactgtccggaatcagccgtcattctgctctcaaccaccgtgctggaaaatgtgctgcagccctttcattttcgcgcgggaactatgtctaagctgcccaaatttgagatcgagttgcccgccgctcccaagtctaccaaacctagcctgtctgaacgcgacattgcaatggctaccatttatggccagttatacgtactgttcctgcgacatcacagcaggacatcgaatagtaccggagcagaagttgtgctatatcacctgccgagggagggggcctgcaagaagatgcacattttaaagctgaatcgtaccgggaaattcgccctgaatgtcgtcgacaacttagtggtggttcatcatcaggacaccgagacctctgtcatttttgacatcaaactccggggcgaatttgacggcagcgtaacctttcatcatccagttcttcctgcacgcagtatccagccataccagattccaatcaccgggccggccgcggtcacatcgcagtcccccgtcccttgcaaactctattcatctagctggatagtatttcaacccgatataattatatctgcttctcagggctacttgtggaacttgcaggtgaagttagaacctatagtgaatcttttgccagacaaaggccgtttgatggattttctattacaacggaaggagtgtaagatggtgatcctatccgtctgctctcaaatgttatcagagtctgatcgcgcaagcctgcctgtcatcgctactgtcttcgacaagcttaaccacgagtataagaagtacctcgacgctgagcagagttatgccatggctgtggaagcagggcagtccaggtctagccctctgctgaagcggccggttaggactcaggccgtcctcgaccagtccgacgtgtacactcatgtgctgagtgcttttgtggaaaaaaaggagatgccccacaaattcgtgattgctgttttgatggagtacattcggtcactcaatcagttccaaatcgccgttcaacactaccttcacgagttggtgattaaaaccctggtgcagcacaacctgttctacatgctccaccaatttttgcagtaccatgtgttgagcgactctaagcccttagcctgtctcttactgtccctggagagtttctaccctcccgcacaccagctctccctcgacatgctaaagatgcttcagagtagactgaagacaacttgcttcagcattcagtactcagcattcctcaactctgagactagtgtgtgcgagggcgcaccaatttctcaccagggtaacactgtgaaaaatatgctgctgttttccaacagattcctggaaaccaagctatag

SEQ ID NO: 27792 - DNA, 711 bp, Artificial Sequence
  Description of Artificial Sequence: Synthetic coding sequence
atggcacggccactggtaccaagcagccagaaagcactcctgctggaacttaagggtctgcaagaagagccagttgaaggcttccgagtgaccctcgttgacgaaggggacctttataactgggaagtggccatctttggtccaccaaacacatactacgagggtggttactttaaggcacggctcaaattcccaatcgattatccttatagccctcccgcgttcaggtttttaacaaaaatgtggcaccctaatatttacgagaccggcgatgtttgcattagcattctccacccccccgtcgatgatccacagtctggagaattaccttctgaaagatggaacccgactcagaacgtcaggacaatactgttgagcgtgatctccctcctgaacgagcccaacaccttctcgcctgcaaacgtagacgcctccgtaatgtacaggaagtggaaggaatctaagggcaaagatcgagagtatacggacatcatccgtaaacaggtgctggggacaaaagtagatgccgagcgtgatggtgtgaaagtgcccacaaccttagccgagtattgcgtcaagaccaaggccccagccccagatgagggtagcgatctgttctatgatgattactatgaagacggggaagtcgaggaagaagctgacagttgcttcggcgatgacgaggacgactcagggacagaggagtcttag

SEQ ID NO: 27793 - DNA, 486 bp, Artificial Sequence
  Description of Artificial Sequence: Synthetic coding sequence
atggggtccaaagccaaaaaacgcgtgctgctgccgactagacccgcccctccaactgtagaacagatcttagaggatgtcagaggggccccagccgaggatccagtctttacaatcttagctcccgaagaccctcctgtgccattccgtatgatggaggatgcagaagcccccggagaacagctataccaacagagtagagcgtatgtggctgctaaccagcggctgcagcaagccgggaatgtgcccaggttgccccctcaagcagatctctcggggcccgccggtctggggtctgcccagggcggtctgcaccccgggtttccctggggcagcgtgggaccccgcctggcgttcaccggtagccagcccacgtgggtgttaacgcaggcgccgcttctgatgctcggtttgcgtttcatcaggaggttaatccacgctgagttggtgggccccactcaactggccccctcttgtgtcacttag

SEQ ID NO: 27794 - DNA, 477 bp, Artificial Sequence
  Description of Artificial Sequence: Synthetic coding sequence
atgggaagcaaggccaaaaagagagttctgctgcctactcgccccgctccccctactgtcgaacagatacttgaagacgttcgtggcgcccccgcagaagatccagtgttcacgattctcgctcctgaagggcggggtagccccgtgccaggaaaatccggccccgagacccctgctgcaagaggtcgggaaaggtctacccctttaaccccagaccctaccccctgggaacccccccaacatgggcacgacccgcccgtacccttccggatgatggaagacgcagaggcgccaggagagcaattgtaccagcagtcccgtgcatatgttgccgcaaatcaacgccttcagcaggccggaaacgtgttacgccaacggtgcgaactactgcagcgcgccggcgaagatcttgagagggaggtcgcccagatgaaacaggccgctctgcccgcagccgaggctgcttcctctggctag

SEQ ID NO: 27795 - DNA, 357 bp, Artificial Sequence
  Description of Artificial Sequence: Synthetic coding sequence
atgggaagcaaagcaaaaaagagggtcctcctgccaactagaccggctccccctactgtagagcagattctggaggatgtacgcggggcacccgccgaagatccagtgttcactatcctggccccagaggacccaccagttccatttcgaatgatggaagatgccgaggccccgggtgagcagctatatcagcaaagccgcgcatatgtggccgctaaccaaagacttcagcaagctggaaacgtcctgaggcagcgctgtgaactgctccaacgtgcgggagaagacctggagagagaagtggcccagatgaagcaagccgcccttcctgcagccgaggcagcaagcagcggttag

SEQ ID NO: 27796 - DNA, 507 bp, Artificial Sequence
  Description of Artificial Sequence: Synthetic coding sequence
atgttacctgctgccttgctccgaagacccggccttggcagacttgtgaggcacgctagggcctacgccgaagcagccgcggctcctgccgccgcgtcgggccccaaccagatgagtttcacttttgcaagccctacgcaggtgttcttcaacggtgccaatgtccgccaagtcgacgtgcccacactgacaggcgcttttggcatcctggctgctcatgtccctacacttcaggttctgagacctggactggtggtggttcacgcggaagatggcaccacatccaagtattttgtttcatccgggagcatcgccgtgaatgctgatagtagtgtccaactactggcggaagaagctgtgaccctggacatgctggatctcggcgctgcgaaggctaatctggaaaaagcccaggctgagctggtgggaaccgcggatgaagctacaagagccgaaatccagatccgtattgaagccaacgaggctctcgtgaaggcccttgagtag

SEQ ID NO: 27797 - DNA, 1422 bp, Artificial Sequence
  Description of Artificial Sequence: Synthetic coding sequence
atgtctagtccagagcccccaacagaaccccccgaacctgacaatccaacctggtctacccagccaacttactccaacctcgggcagataagggctcacctgctgcccagcaaggcctgtcgtttacggacacctggctcacttagcaccaaccccgaaccgctgccgcctcctttgccgaagaaaattttgactcgcacccagtccctccccacccgaagaacacttcatccatcctccatccaggtgcagccaccccggaggcctttcttgggctcccatagcgtggataagtcccaggcggctgtcggccccgcgtgtctcccagccgagcttacgttcggaccagcagatgctcccctgggattatctctgagagatcttcactcccctgaagccgtccacactgctttggcggcccgccagttgcagggactgcgcacaatttacgctcgcctgcgagccagactgatgggtggacaccccggtccctgtcatccaggtcacagtttcaggctgctggattccagcccctgtgctgagagcggagacgccctgtactatcgagtggtgagggcccacgaggacgcctggcacattctggtggccaaggtcccgaaaccaggagccgacgtcccacacccatgggggctggagctccaggcatctctctcacctcacttcaacctgcaaggcctgtgtggcctggttccagaggggaccctccctggagctccatggcggggggcggtcgcactagctgccgaggttcctgagaggactgtcgcccagtggctggccgaggcctgcacacagccgcccgaagaatttgtctgggcagtcgccttgttgctgctccagctctcagccgcgctcaaattcctggaggcatggggcgccgccttagtggaactcagaccagagaatctactgcttgtggccccaagagggtgtgctactacaggaccacctcgcttgctactgaccgactttggccgggtgtgcttgcaacctccgggaccacctgggagccccgggccccacgccccgcaattgggctccctgcttagagctctgctctctctggctgctccgagtaccacacccttagctgctggcttggagctccttgctgctcagttgactagactgaggccatctgctagcagaactcgtggcgccctccaggcgctcctttggggtccaggaccagagttgagaggtcgaggagcgcctctggggccatggctgcgagccctggggccatggctgcgagtacgaagaggactccttgtgttgcgactcgccgaaagggccgctggcggagaggcgcccagtctggaagattggctatgctgcgaatatctagcggaagccacggagtcttcaatgggccaggccctagcccttttgtgggattag

SEQ ID NO: 27798 - DNA, 228 bp, Artificial Sequence
  Description of Artificial Sequence: Synthetic coding sequence
atgatcggcgatattctcctgttcgggacactattaatgaacgcaggggcagtcctaaactttaagctcaaaaagaaagacactcaggggttcggcgaggaaagccgcgagccctctactggggacaatatcagagagttcctcctgagcctaagatactttagaatttttatcgcgctatggaacatattcatgatgttctgtatgatcgtactgttcggctcctag

SEQ ID NO: 27799 - DNA, 531 bp, Artificial Sequence
  Description of Artificial Sequence: Synthetic coding sequence
atggccgcacggggacgccgggccgaaccacagggacgcgaagcacccggacctgcgggaggcggtggtggtggctccagatgggcagaaagtggatccggaactagccctgagagcggggacgaagaggtgtcgggggctggctcctccccagtgtctggcggggtgaatctttttgcaaatgatggatcgtttctggagctatttaagagaaagatggaggaagagcagaggcagcgacaggaggaacccccacctggcccgcagcggcctgaccagtccgctgcggccgctggccctggagaccctaagaggaaaggaggccctggttcaactttgtcattcgtggggaagcgcaggggagggaacaaactggccctgaaaacgggtatcgtggcgaagaaacagaagacagaagacgaagtgctgacttccaagggcgacgcctgggctaaatacatggccgaggtcaaaaagtataaagcacaccaatgtggagatgacgataaaacacgccccctggtgaagtag

SEQ ID NO: 27800 - DNA, 1518 bp, Artificial Sequence
  Description of Artificial Sequence: Synthetic coding sequence
atggctacaggcgccctccttccctgcagtagaccgtgccccatgtcccgactagacttccttaaagcttctcatttcagcttaggcccggatctccggttgcacgaggggaccatgcgcacgacttctcatagggattttgcatatcctgccgctacccgggaacccccctcactgcaacctcccccggcactccttttccctatggaccctcggtgggatcgcgaggaaagggtgtccgaggcccaccgtgcttttccaccccctagcacacctccatgggaactcctgcaggcccaggcccgggagaggacgctggccatgcaagccggaaaccttcatctacatgaggatgcacatgccggtattgggctatccaacgcccacgccgcttacggctggccggaacttcccgcgagaacgagagagcgaatccgaggagctagactgatcttcgatagagattctcttcccccaggggatagggacaagctccgcatacccccaactacacatcaggccttattccctccacatgacgcacggccacagccaagagctcctagttgccaccttggggggcccaatacactgaagtgggactatacgcgtcaggatggaaccagttatcagaggcagttccaagcgctcccgggtcccccagcactcagatgcaagcgagcctcaagcggcgtggaactgggggattgcaagatctcctacgggtcaacatgtagcgaacagaagcaagcttatcgaccgcaggatctgcccgaggatcgatacgataaagctcaagcaacagcacacatccactgcgttaacattcgccctggagacgggctttttagagacaggaccacaaaagctgagcatttttacgcccgcgagcctgaacccttcgtgctgcaccatgatcagacccccgagtctcacattcttaaaggcaattggtgccccgggccagggtcattggatacgttcatgcagtatttctatggtcagccaccaccccccacacaaccacctagccggcatgtgcctcatgaaaagctccagtcccacgttaccctgggagagcccaagctgttgaagaggtttttcaagaccactatggggagtgactactgtccctctgagtggcgccaggtgcagaaggcccctaacctgcacctacagcagtcatatctgcctcggggcacgggcgagttcgacttcctgacaatgaatcagaaaatgctcaaaccgcaccgcacaccccctgcccctgtgaccgaggagatgcttcaaaggtgcaagtacagtcacatggagccacccctaggaggcctccggttctttagcacacagtataaggatgaattcccattcaaataccagggaccagcagcgctcagactgaaaaatccccaggaaggcttcgtgcccctgggaacccctcatcagcgcggctgccgcgagaagatcgatcctctcgtgccccaaccacccatgtacctttgtccctctcaacagtag

SEQ ID NO: 27801 - DNA, 672 bp, Artificial Sequence
  Description of Artificial Sequence: Synthetic coding sequence
atggcaacaggagctttactgccttgcagcaggccttgccccatgtcaagactggatttcctaaaagctagccacttttctcttggacccgatcttcggttgcatgagggcaccatgcgcactacatcccatcgggattttgcctatcccgcggccaccagggagccacccagcctgcagcctcccccggctctgctgttcccgatggacccccggtgggatcgcgaggaacgggtgtctgaagcacatcgcgcctttccacccccctcaactcccccatgggagctcctgcaggctcaggccagggaacggaccttggctatgcaggccggcaacctgcacctccatgaagacgctcacgcagggataggcctgtccaacgcgcatgctgcctacggctggcctgagttgccagccagaaccagggaacgcattaggggggcacgccttattttcgatcgtgattcattgccccctggggatagagataaactcagaattcctcccaccacgcaccaggcccttttccctccccacgacgcccggccccagccacgggcaccgtcatgccacctgggaggcccgaacactttgaagtgggattataccagacaagatgggacatcttaccagcgtcagtttcaggctcttcctggccctcctgccctgtag

SEQ ID NO: 27802 - DNA, 579 bp, Artificial Sequence
  Description of Artificial Sequence: Synthetic coding sequence
atggccactggcgccctactgccctgttccaggccctgccccatgagcagactggacttcctgaaggcatcccacttttccttaggacctgatctccgtctacatgaagggacaatgcgcaccactagccatcgggactttgcctatccggccgccacccgcgaaccaccatccctgcagccgcctcccgctttattgtttccgatggaccctagatgggacagagaggaacgagtgtctgaagctcacagagcgttcccacctccttcgactcctccatgggaactcctgcaggcacaagcccgagaacggaccttggctatgcaggcaggaaacttgcacctccatgaggatgcccatgcaggcattgggctgagcaatgcacacgccgcatacggctggcctgagctcccagcccgtacgagggaacgcattcgaggggcccgccttatttttgacagagactccctgcccccaggggaccgtgataaactgcgtattccacctacgacacatcaagcactattcccccctcacgacgcccggccccagccccgcgcgccgagttgccatctttag

SEQ ID NO: 27803 - DNA, 1269 bp, Artificial Sequence
  Description of Artificial Sequence: Synthetic coding sequence
atggtgatggcggctctctccctggtcgctgcctgctggggtcgggctgccgccgatgaaagcgtccagctcccggccgccccagggagctctgtcagagctagagagacgatggtatccgtgactatggccactagcgagtggatccaattttttaaggaggcaggcattcctcctggtcctgccgtaaattacgccgtcatgtttgtcgacaatagaatccagaaatcgatgctgctggacctcaacaaagagattatgaatgaacttggagtgaccgttgtcggagacatcatagccattctgaagcatgcaaaggtcgtacaccgccaagacatgtgcaaggcggcaacagagtctgtcccctgctcgccatccccgttagcaggggagatcagaagagggacctccgccgccagtcggatgatcacaaattccttaaaccacgatagtcccccctccacacccccccggcggcctgacacttctacatctaagatcagtgtcactgtgtctaacaaaatggctgccaaatctgcaaaagcgactgccgccctggcccggcgcgaagaagaatcgctggctgttccggccaagaggagacgggtgaccgcagagatggaaggaaagtatgtcataaacatgcccaaagggactactccacgcactaggaaaatcctggagcagcaacaggcagccaagggactccaccgtaccagcgttttcgaccgtctcggtgccgaaacaaaagctgacaccaccacagggtccaagccaactggagttttctctcgactgggcgcaactcccgagactgatgaggacctggcttgggatagcgacaatgactctagctcttctgtgctgcagtacgccggggtactgaaaaaactcgggagaggacccgctaaggcatcacctcaaccagcgctgacggtgaaggccaaagccacaagctccgccaccaccgccgctgctccaactctcagacgcctggccctgagctcacggtcaggcttggaaagaaaacccgagagccttagcaaggtgtcgataattaaaagactgggcgccgccgcgctggtgccagaagctcaggatagccaggtgacaagtacgaaaagtaaatctagcgcggaagtgaaggtgactattaagcgtactctcgttggcccacgcggttcatccagttccgagggattgggggcacaaatggaccacgctggcaccgtttccgtgtttaaacgactggggcggcgcacattctag

SEQ ID NO: 27804 - DNA, 1068 bp, Artificial Sequence
  Description of Artificial Sequence: Synthetic coding sequence
atgtttgtagacaaccggattcagaagtcgatgctgcttgatctgaataaggaaatcatgaacgagctgggcgtcaccgttgtcggagatataatcgccattctgaaacacgctaaagtagtccaccgccaagacatgtgtaaggcagcaaccgaatcagtgccctgctcacccagtcctctggctggggagattagacgcgggacttctgcggcttcgcgcatgataacaaattccctgaatcatgactctccaccttccacaccgccccgtaggccagatacttctaccagtaagatcagtgtgaccgtgtccaataagatggccgccaagagcgccaaagcgactgccgctctcgcccggagggaagaggagtccctggcagttcctgcaaagcgtaggagagtgaccgccgaaatggaaggcaagtatgtgataaatatgcctaaggggacaacccccagaacaagaaagatcctggagcaacaacaggccgccaaaggcttgcacagaacatcggtgttcgataggttaggcgcggagactaaggccgatacaaccaccgggtccaagcccaccggagtattctcaagattaggcgcaaccccagaaaccgacgaggacctggcctgggatagcgacaatgatagttcgagcagtgttcttcaatacgctggtgttcttaagaagctgggaagaggcccagccaaggcttctccacagcccgcattgaccgtgaaagctaaggctactagcagcgcgacaaccgcggcagcacctacattacggagattagctctgtcatcacgctcagggctggagcgaaagcccgaaagtttatcaaaggtgagcataattaaacggctgggggctgccgcgctggtccccgaagcccaagatagccaagtgacctccactaagtcaaaatcttcagctgaggtcaaagtcactatcaagcgcacactggtcgggcccagaggctctagcagttccgaggggctaggggcgcagatggatcacgccgggacggtgagcgtttttaagcgcctgggccggcggacattctag

SEQ ID NO: 27805 - DNA, 1269 bp, Artificial Sequence
  Description of Artificial Sequence: Synthetic coding sequence
atggtcatggccgctctcagcctggttgcagcatgctggggacgagccgcagccgacgagagtgtccaattaccagcggcgccagggtcctccgtccgggcccgggagaccatggttagtgttaccatggccacttcggaatggatacaattttttaaagaggccggaattccacctgggcccgcagtaaactatgccgtgatgttcgtggacaacaggatacagaaaagcatgctcctggacttgaataaggaaatcatgaacgaactgggagtgaccgtggtgggtgacatcatcgctattttaaagcatgccaaagtcgtgcatcgtcaagacatgtgtaaagccgccaccgagagtgtgccttgttctccctccccactggcgggagagatcaggagaggcacatcagcagcctctaggatgataaccaattccttgaatcacgacagtccccccagtacacccccccgccgccctgatacatctacctctaagatcagcgtgaccgtctcaaataagatggccgccaaatcagcgaaggccacggcagctctggccaggcgcgaggaggaatctttggctgtcccagccaaacgccgcagggttaccgccgagatggagggcaaatatgtgatcaacatgcccaagggtaccacccctagaactcgaaaaatcttagaacagcagcaggcagcaaagggtctgcatcgcacaagtgtttttgaccggctgggtgctgagaccaaagccgacactactacggggagtaaacctacaggcgtgtttagtagacttggggctaccccagaaacagatgaagacttggcatgggacagcgataacgactcctcctcctccgtgcttcaatacgctggcgtgcttaaaaagcttggacgtggccccgctaaagcatcacctcagcctgccctgactgtgaaagccaaggccaccagttcagccactacggctgctgctcctacattacgccggcttgcgctcagcagtagatccggactggagcgtaagccagagtcactgagcaaggtgagcatcattaagcgtttgggggcggccgccctagtgccagaagctcaggattcacaggtcacttcgaccaagtctaagagctccgccgaagtcaaagtgaccattaaacggacacttgtgggtcctagagggtcctcttcttccgagggcctcggagcacaaatggaccatgctggcaccgtcagcgtatttaagagactaggtcgtcgcactttttag

SEQ ID NO: 27806 - DNA, 354 bp, Artificial Sequence
  Description of Artificial Sequence: Synthetic coding sequence
atgaccgtgttggaggccgtgcttgaaatccaagctatcaccggctctaggctgctttctatggtaccaggaccagcccgcccccccggctcctgctgggaccccacccaatgtacacggacctggctgttaagccatacaccccgcaggcgctggattagcggcctgcctcgtgcatcttgccgccttggagaggaaccccctcctctcccatattgcgaccaagcctatggagaagaacttagcatacgtcaccgggaaacttgggcatggctgtcaagaaccgatactgcatggccaggcgccccaggagttaaacaggcaagaatacttggcgagctattgctggtctag

SEQ ID NO: 27807 - DNA, 354 bp, Artificial Sequence
  Description of Artificial Sequence: Synthetic coding sequence
atgacagttcttgaagcagtgttagagatacaggccattacgggttcacgcctactttccatggttcctggccctgcgaggccacccgggtcctgctgggatcccacacagtgtacccgaacgtggctgctgtctcacaccccacgtagacgctggatttcgggcctgcctcgcgcatcatgtcggctgggagaggagcccccacctttgccatattgcgaccaagcctatggtgaggagctgagcatccgccacagggagacatgggcctggctgagccgcacagacacagcctggcctggggcacccggcgtgaagcaagctcgcattctgggcgaactgttgctggtgtag

SEQ ID NO: 27808 - DNA, 1827 bp, Artificial Sequence
  Description of Artificial Sequence: Synthetic coding sequence
atgctcccactgctggatagtagtaaaagagcaggaacactgggctcaggatgtggagtgccccgagtgcactctgcagctttaagccgagaagaaggggcctcgcgggacatctggcgaatcaaggtgtgggccagagtaatgaccacaccggccgggtctggatcaggattcggatccgtctcgtggtgggggctgtcccctgccttagatctccaggctgagagagacgccactgtggacgccctcccaactactatggttccacagccagcagtgattctacccggcccccccgtagaccctgattcccaagccgacaccgttcacagtaatcctgaactggatgtgctactgttagggagtgtggacggtagacatttgctgcgcacactgagtagagccaagttttggccaagaagacggtttaacttttttgttctcgagaacaatctggaggcggttgcacgccacatgctgatcttttccctagcattggaggaacctgagaagatgggcctgcaagagagaagcgagaccttcttggaggtctggggcaatgccctgctgcgtccccccgtggccgcctttgtgcgagcacaagcggacttattggcacatttagtgcctgagcccgaccggctggaggagcaattaccttggctttcacttagagctctgaagttccgtgaacgggacgccctggaagcggtgttccgattctgggcagggggcgaaaaagggccgcaggcttttccaatgtcaaggctctgggattcccgactgagacattacctgggtagcaggtatgatgctagacggggcgtgagtgattgggacctgcgcatgaagctgcacgaccggggagcacaagtgatacacccacaggaatttcggagatggagggacaccggggttgcctttgaactgcgggatagctctgcctaccacgtgccaaatcgcactcttgcctccgggagattactgtcttaccggggggagcgggtggccgcaaggggctattggggtgatatcgcaaccggcccattcgtggcttttgggatcgaggctgatgacgaatcgctgttaaggacttccaacggacaacccgtgaagactgctggcgagatcactcagcataacgtgaccgagttgttaagagatgttgcagcttggggacgtgctcgcgcaactggcggtgaccttgaggaacagcagcacgccgagggcagccctgaacccggaactccagctcccaccccagaatccttcaccgttcactttcttcccttggattcagctcagaccctgcatcacaagtcatgttacaacggccggtttcaactgctctatgtggcctgcggaatggtccacctcttaatcccggaactcggagcttgcgtggcccctggcggtaacctgattgttgagctcgctcgctatttagtggacgtgcgccaggaacagcttcaaggcttcaatacacgtgtgcgggaattggcacaggcggccggcttcgccccccagaccggtgccagaccatctgagacatttgcgcggttttgtaagagccaggagtctgcacttggaaacactgtcccagcagtcgaacctgggaccccccctctagatatactggctcagcctctggaggcttcaaatccagcgctagagggacttactcaaccgttgcagggggggacccctcattgtgaaccttgccagctgcctagcgaatcaccaggttctctctccgaggttctagcccagccccagggcgcgctcgcgcctcctaattgcgagtctgacagcaagactggcgtgtag

SEQ ID NO: 27809 - DNA, 1767 bp, Artificial Sequence
  Description of Artificial Sequence: Synthetic coding sequence
atgctcccattgcttgattcctccaaacgcgcaggtacactaggctcggggtgcggcgtgcctagagtgcactccgcggccctttctagggaggagggcgcaagtcgtgatatttggcggataaaagtctgggcacgggtaatgaccacacctgctgggagcgggtccggctttggatctgtctcctggtggggcctttcacccgcactggatctgcaggccgaaagtcccccggtggatcctgactctcaggcagatacagtgcacagcaatccagagcttgacgtccttcttttaggttctgtggacggtcgccaccttctgagaaccttgtcaagggccaagttttggccccgccgccgcttcaacttcttcgtccttgagaacaacctcgaggcagttgcccggcatatgctgatattttctttagcattagaagaacctgagaagatggggttgcaggagcgctctgagactttcctcgaggtttggggaaatgcccttctgcgaccgcccgttgcagctttcgtgagagcccaggccgacctgttagctcaccttgtacccgaacctgacaggctggaggaacagctgccatggttgtccttaagggcccttaaattcagggagagagatgcccttgaggcagtgtttaggttttgggctggcggagaaaagggcccacaggctttcccaatgagccggctttgggattcaaggctgaggcattatctgggaagccggtacgatgcgcgcagaggggtctcagactgggatctaagaatgaagctgcacgataggggcgctcaggtgatccatccccaagagttccgtcgttggagggataccggagtagcttttgagcttcgcgactctagcgcttaccatgtgccaaacaggactctcgcatccggccggctgctttcataccgtggggaaagagtagccgcccggggatattggggggatatagcaaccggtccatttgtagccttcgggatcgaggctgacgacgagtctttgctgaggactagtaacgggcaacccgttaaaaccgcgggggagattacccaacataatgtgacagaactcctccgtgatgtagcagcttggggcagggcacgggccaccgggggtgatcttgaagaacaacagcacgctgaaggaagccctgaacctggcacgccagccgctcccacaccagagagtttcacggtccatttcctgcctctggatagtgcacagaccctgcaccacaaatcctgttataatgggagattccagttgttatacgtggcttgcgggatggttcaccttctgatccctgagctcggggcgtgcgtcgccccaggcggaaatcttatcgtcgagctggcacggtacttggtcgatgttaggcaggagcagctacagggattcaataccagagtacgagagttagcccaagctgccggcttcgctccgcagaccggcgccaggccgtcggaaacgttcgctagattctgcaagagtcaggaaagcgcgctcggtaatactgtgccggccgtggaaccaggcactccacccttggacatcctcgctcagcctctcgaggccagcaatcctgccttggaggggctgacacagcctcttcaagggggtacaccacattgcgagccttgccagctaccctcagaatcacctgggtccttgagcgaagtgctggcccagccgcaaggggcacttgcgccacccaactgtgaaagcgatagcaagactggcgtatag

SEQ ID NO: 27810 - DNA, 1464 bp, Artificial Sequence
  Description of Artificial Sequence: Synthetic coding sequence
atgaaaatgcgggctcaaattcccgaatcactaagggaggaggggatcgagattctaaaaccccagttctttgttctggagaataacctcgaggccgtggccaggcacatgctgatctttagccttgccctcgaggagccagagaagatggggctccaggagaggagcgagacctttctagaagtttgggggaacgccctgttgaggccgcctgtggcagcgttcgtgagggcgcaggccgacttacttgcccacctagtcccagaacccgacagactggaagagcagctcccatggctttcacttcgggctctaaaattcagggagagggacgcgctcgaagcagttttcagattctgggcggggggcgagaaaggccctcaggctttcccaatgtcccgattgtgggactcaaggctgcgtcactatctgggaagccggtacgacgctaggcggggggtgtctgactgggatctgcgaatgaaactccacgatcgcggagcgcaggtgatacaccctcaggagttccgacggtggagagacaccggggtggcatttgagctgcgtgattcctctgcctatcatgtcccaaatcgcacattggcctccggacgtttgctgtcataccggggggaaagagtggctgccagagggtactggggtgacattgctaccggtcccttcgtcgcatttggcatcgaggctgatgatgagagtttactgagaacatcaaatggacagcccgttaagaccgccggggagattacacagcataacgtcacagagttgcttcgtgacgttgccgcctgggggcgcgctagagccaccggcggggatctcgaggaacagcagcacgcagagggctctccagaacctgggacaccggctgcccccacacctgagtcattcacagtccacttcctgcccctggactccgctcagacacttcaccacaagagttgttacaacgggcggtttcaactactgtacgtggcctgcgggatggttcatttgcttatccccgaactaggagcatgcgtggcgcctggtgggaatttgattgtagaattggcaaggtatctagttgacgtgaggcaagaacagctccaggggtttaacacacgggtcagagaactagcccaggcggctgggttcgcacctcaaactggagctcgtccatctgagaccttcgcacgcttttgtaaatcccaggaatccgccctcgggaacactgtcccggcggtcgagcccggaacacctcccttggatatcctggctcagcccttggaagcatccaatccggctctggaaggcttaacccagcctctgcagggcggaactcctcattgcgaaccctgccagcttcctagcgagtccccaggatccctctcggaggtgctggcacagcctcaaggcgcactagctccaccaaactgtgagtctgactctaaaacaggagtctag

SEQ ID NO: 27811 - DNA, 783 bp, Artificial Sequence
  Description of Artificial Sequence: Synthetic coding sequence
atggcagctgccgccctgaggcgtttctggtctagacgccgtgctgaggctggagacgccgtggttgccaaacccggggtctgggcgcgcctgggttcctgggcccgtgccctgctgagggactacgcagaagcctgtcgagacgcgtcagccgaggcaagagcaaggcccgggcgcgccgccgtttacgtgggccttctcggcggcgccgctgcctgtttcaccttggccccttccgagggcgcgttcgaagaggcactcttagaagccagtggaacacttcttctgttagccccggctactcgtaatcgcgagtcagaggcctttgttcagcggttactgtggctgcgggggcgcggacggttgcgatatgtgaaccttggattgtgttccctggtgtatgaggcgccattcgacgcccaggctagcctgtatcaagcccgatgtcgatacctgcagccacgatggaccgactttcctggaagagtcttagacgtgggctttgtaggtaggtggtgggttctgggcgcatggatgcgtgactgtgatattaacgacgatgaattcctgcacctgcctgcgcacctgcgtgtggtcggaccacaacaacttcattcagagaccaacgagaggttgtttgatgagaagtacaagccggtggttttgaccgacgaccaggtggatcaagcactgtgggaggagcaggtgctccagaaagaaaaaaaggatcgtttagctctgagtcaggctcatagcttggtccaggctgaggcccctcgatag

SEQ ID NO: 27812 - DNA, 1005 bp, Artificial Sequence
  Description of Artificial Sequence: Synthetic coding sequence
atgaagcctccgcctcgccggcgcgcggcccctgctcggtacctcggggaagtgaccggtccagctacctggagtgcccgcgagaagagacaacttgtacgcctcctccaagcaagacaggggcagcccgaacctgatgcgacagagctggctcgtgagctgcgagggaggagtgaagccgaaattagggtgttccttcagcaactgaaaggccgcgtggcccgcgaggcgatccagaaggtgcatcctggtggtctccagggcccgaggcggagggaggcacagcccccggcccccatcgaagtctggacagacctggctgaaaaaataaccgggccactagaggaagctctcgctgtcgctttcagccaggtgctgaccatagcagctacagagccagtgacacttctgcacagtaagcctccaaagccaacccaggcccgcggcaagccactgttactgtctgccccgggcggtcaggaagaccctgcccctgagatcccctcaagcgctcctgctgccccttcatctgcaccacgcacccctgaccctgctcccgagaagcccagcgagagcagcgccgggccaagtactgaagaggattttgccgttgattttgagaagatctacaagtacttgagctccgtttcccgtagcggtcggtcccctgaacttagcgctgctgagtccgccgtcgttcttgacctgcttatgtcgctcccggaagaactgcccttgctcccgtgcactgcccttgttgaacatatgaccgaaacttacctccgccttaccgcaccccagcccatacctgcgggtggctccctaggcccggctgccgaaggcgacggtgctggctcaaaggcaccggaagagaccccccccgctactgaaaaggctgaacacagtgagctgaaatcaccctggcaggctgcagggatatgtcccctcaacccattcctcgtgcccctcgagttgctcggacgcgctgccactcccgctcggtag

SEQ ID NO: 27813 - DNA, 300 bp, Artificial Sequence
  Description of Artificial Sequence: Synthetic coding sequence
atggctcagggccagcgcaagttccaggctcataagcctgctaaatctaaaaccgccgcggccgcatccgagaagaaccggggacctcggaaaggaggaagggtgatagcgcccaagaaggcccgcgttgtccaacagcagaagctcaagaagaaccttgaagtgggcatccgcaaaaagatcgagcacgatgtcgtgatgaaagcgagttcgagtctgcctaagaaattggcgctgcttaaagccccagcgaagaagaaaggagcagcagcagccacttctagcaaaaccccaagctag

SEQ ID NO: 27814 - DNA, 420 bp, Artificial Sequence
  Description of Artificial Sequence: Synthetic coding sequence
atgagagccggcgggctggtggacgggaggtattcccctgtggccccacagtggaggccccccggagagacgcacaccggcgggcatgggaaacgcctgcacggacccggaagggacgtgctcagtacaagctatgatgaggatttcaatcatgagccctgtcagaggaaaggacacaaggcgcactgggccgtctcggccggtgtgcttttgggcgttcgcgccgtgccctctctaggctatactgaagatcctgagctccccgggttatttcatcccgtactgggtactccttgccaacctccctctttgcccgaagagggctcacctggagctgtatacctcctgagcaaacagggtaagtcctggcattaccaactgtgggattatgaccaaggaccacccctctctagccattag

SEQ ID NO: 27815 - DNA, 1056 bp, Artificial Sequence
  Description of Artificial Sequence: Synthetic coding sequence
atgaccagtccatgtagtccccccttaaaaccgcctatttctccccccaaaactccagtgccccaggctagcagcataccaagcccccctctgccgcctagccctctggacttcagcgcactgcccagtccaccttggtctcaacagacgcccgttcctcctcctctgccattacctcctccgccagccgctacaggaccagcacctcgtcatgttttcggcctagagaagagccagctgctaaaggaagcttttgacaaagcgggccccgtgcctaaaggcagggaggatgttaaaagactgctgaaattgcataaagatcgctttcgcggggatcttagatggatcttgttttgtgccgacttaccttctctgattcaggaaggtccgcagtgtggacttgtggctctgtggatggctggaaccctcttatcccccccaagcggagttccactcgagcggcttatcagggtggccaccgagcgaggatatacagcacagggagagatgttctccgtagcagatatgggccggctcgcgcaggaagtgcttggatgtcaggctaaactattaagcggaggcttaggcggccccaatcgtgacttggtgttacagcacctggtgaccggacatcccctcttaataccgtatgacgaggacttcaatcacgagccatgtcagcgtaagggccacaaggcccattgggcagtctctgcaggcgtcctgctcggggtgcgtgccgtcccctcattaggatacaccgaagaccccgaattgccaggtctattccaccctgtgctagggacaccgtgtcagcctccatcccttcccgaagaaggctctccaggagccgtgtatctcctttcaaagcagggaaagagttggcattatcagttgtgggactatgaccaggtacgtgaaagcaatctacaactgaccgacttctctccttccagagccactgatggccgggtctacgtcgtccctgttggcggtgtcagagcagggctgtgtggtcaagccttgctgctgacccctcaggactgctcccactag

SEQ ID NO: 27816 - DNA, 1440 bp, Artificial Sequence
  Description of Artificial Sequence: Synthetic coding sequence
atggaccgatctctaccggtattttcgatccaggatagcccatttggggacgcccccctaggtcgctcccactactggccctcacagtcacaaacctggtgtcctaagaccttgtccccctctcggagtcagcggtcaaggctgcctcaggcacccaaggccctcgctacaggcccaaactcacctgaattgttcgaggagtcttggcccagctcatccggcacgcccagcctgcctagtacaaccgaaggacagatgtgggcatctccagcacccacacttatcgattcgggtgattctgtggtggctaagtacatcaacagattcaggcaagctcagcccacctctagagaagagcggcagccagcggggccaacaccggctgacttttggtggctgcaatccgactccccagatcccagctcccagagtgctgccgcaggagctaacaaacccgagggcaggcctcacactgccgtccccactgccgtaaacgttacaagtgcatcccatgccgtggcacctctacaagagatcaaacagaatctccatacatggaatagcagcctgctcgatctcgaaaccctgtccctgcagtcaagggccgctcggttgctgaaacgttccaaggcctcgatttcttcaagctcaagcctgtccccttccgacgcatctaccagcagttttccaacttcctccgatggtctgtcgccgttcagcgaaacgtttattccagactcttccaagggcctgggacctcgagcccccgcctcccctgctcctgcccaggcccagacaccaaccccagcgccagcgccagccagctctcaggctcccctgcggccagaggatgatatattatatcagtggaggcagcgcagaaaattggagcaggctcagggctctaagggagaccgcgcctgggtgccacctctcacaccagcactgcggacactggctgaatccctgaaggctaaggcactcccccctgcggctggaagcgtgatcaggaaatcagaggccaccccgagcccaggcgcctgcttgcagccggaagtgcctctgtcacccgcagagcaagccaccacagttaaagcatctccaccggccttccaagtgggttcacctgaagccctggctccaccccccccggcagcggatcatgcaccatcagaagccctcctagctcaggctctgctgttacaagctgctgaagactccgacggcagcgagtttcaggatgaccctgttctccaggttctcagggcccaccgtgcggaactatctcggcagaagagagaagctgacgcccggctgagctttcttctggatcaggcagaggatctggggagttggtccccccctgctggaagtcctccccggtccccacgtcggctgctacggagggagggtgactctctcgaggccagacgactgtag

SEQ ID NO: 27817 - DNA, 330 bp, Artificial Sequence
  Description of Artificial Sequence: Synthetic coding sequence
atgtgggcctctccagcccctacactcattgattccggcgattctgtggtggccaaatacattaacagatttcggcaggcccagccaacttcacgagaagagaggcagccagccggaccaactccagccgacttctggtggttgcagtccgacagtcctgatccttcctctcagtcagccgcggccggcgcaaataaacccgaggggcggccccacacagcagtccccactgcagtgaacgtgacaagtgcatcccacgctgttgcacccctccaggagatcaagcaagtcacatcacccttcacaccgtccctaggctgtctgaattag

SEQ ID NO: 27818 - DNA, 1914 bp, Artificial Sequence
  Description of Artificial Sequence: Synthetic coding sequence
atgacgaaacggaagaagctgcggacctctggggaaggactgtgcccgccaaagccccttaagaacccaaggttgggagacttctatggcgatccacaatcttcaatgctggggtgtctgcatcatccagaagagcccgaagggaagctggggccagtcccctccactcagcaacacggtgaagagcctggaaaggccgtgagttccagtcccgacgaagagaccggcagcccctgcaggcttctgcgtcaaccagaaaaagaacctgctccacttccaccttcacaaaattctttcggccgctttgttccacagttcgccaaatctcggaaaaccgttactcggaaagaggaaatgaaagacgaggaccgcgggtccggggccttcagcttggagacaatagccgagtcctctgcccaaagccccggttgtcagctgctggtagagacgctgggcgtgcccttgcaagaggccactgagttgggcgatccgactcaggctgacagcgcaagacctgagcagtcgagccagagcccagtgcaggctgttcctgggtctggagatagtcagcccgatgacccccctgacaggggcaccgggctgtctgcctcgcagagagccagccaggaccacttgagcgaacagggtgccgatgactcaaaacctgagaccgatagggttcctggggacggtggacagaaggagcacctgccaagcattgactcggagggcgaaaagcccgatagaggggccccccaagagggcggcgcccaaaggacagccggcgcaggactgcccggggggccccaggaggaaggcgatggagttccttgtacccccgcttccgcccctactagtggccctgcgcccggactgggtcctgccagttggtgtctggagcccgggtctgtggcgcaaggatcaccagatccccagcagacacctagtagaatggggcgggaaggcgagggaacccattcttcactcgggtgctccagcctcggtatggttgttattgctgatctctcaaccgacccaaccgaattggaggagagagctctggaggtggccggtcccgatggacaagcctccgccatttcccctgcatcaccgcggcggaaagcagccgacggcggacaccgtagagccctgccaggatgcacctcgttgactggagagactaccggagagtctggagaggccgggcaggacggcaagccccctggcgatgtgttagttgggcccacggcttctctcgctctggccccaggctcgggagaatctatgatgggtgctggtgatagcggacacgcctcgccggacacgggcccttgcgtcaaccaaaagcaggaacccggacctgcccaggaggaggctgaactcggaggccagaatttggagcgtgacttggaagggtttagggtctcgccccaggcatctgtggtgttagaacaccgggagattgcagacgatcctctgcaggaacccggagctcagcagggaatcccggatacaacttcggagctggctgggcaaagggaccacctcccccattcagctgatcagggaacatgggctgactccctggcagtggagcttgattttttattagactcacagattcaagacgcgctggacgccagcgattttgaagcaccccccgagcagctgtttccatccggtaataagcctggaccttgctggcccggtccttcctcccacgccaatggagacccggtggcggtggccaaggcccagccaagcaggttaattatgggcactcatcgcgacctggaggcttttaaaaggcttaattacagaaagactaaactgggaggcaaggcccccttaccgtatccatccaaaggcccaggaaacatccctagaggagaccctccctggagggaactgtag

SEQ ID NO: 27819 - DNA, 2007 bp, Artificial Sequence
  Description of Artificial Sequence: Synthetic coding sequence
atgacaaaacgaaagaagctccgtacatctggtgaaggcctttgccctcctaaaccactgaagaaccctcggctgggagatttctacggagaccctcaatcgagtatgctgggctgcctccaccatcctgaggagcctgagggcaaactaggaccagtgccgtcaacacagcagcatggagaggagcctggcaaagccgtgtcaagctcacctgacgaggaaactggtagtccttgcaggctgttgcgccagcctgaaaaagagcccgcccctctcccccccagccagaactcatttggaagattcgtgccccagttcgccaaatccagaaagactgtaacaaggaaggaagagatgaaggacgaagacagagggagtggcgccttttctctggagacaattgcagaaagcagcgctcagagtcccggttgccagctacttgtcgagactctgggcgtgccactgcaggaagctaccgaacttggggatccaacccaagccgatagcgcccgccccgaacagagcagccaatccccagttcaggccgtgcccgggtcaggagactcccagcctgacgaccccccggacaggggaaccggcctgagtgcttctcagcgtgccagccaggaccatctatccgagcagggagcagatgactctaaacccgagacagacagggtgcccggagatgggggccagaaggagcatctcccctccatcgactctgagggcgaaaaaccggatagaggggccccccaagagggaggcgcccaaagaaccgcgggcgcaggactccccggcggcccacaggaggaaggtgacggggtcccgtgtacgccagctagtgccccaacttccggccctgctcccggcctcggcccagcgagctggtgcttagagcctggatccgtcgcccagggtagccccgacccccagcagacccccagccgcatgggcagggagggtgaagggacacatagctccctgggctgtagtagcctcggaatggtggtcatcgctgacctgagtaccgacccaaccgagctggaagaaagagcccttgaggtggccggtccggacggccaggcttcagccatttctccagcctcccccagacgcaaggccgcggatggcggacaccggagagcccttcctgggtgcacgtcccttacaggtgaaacaactggtgagagcggagaggcgggacaggacggtaaaccacccggcgacgtgttggtcggccctacggcaagcctggccctagcccccgggtcgggggagtctatgatgggcgctggggacagtggtcatgcatctcccgataccgggccatgtgtcaatcagaaacaggagccaggtcccgcccaggaagaagccgaactgggtggtcagaacctggagagggatctagagggctttcgagtgagccctcaggcatcggttgttctggagcaccgtgagattgcagatgaccccctccaagagccaggggcccagcagggaatccccgacactacatccgaactggccggtcagcgtgatcatttgccccatagtgccgaccagggcacctgggccgatagtctggccgtggagttggactttctactagattcccaaattcaggacgctcttgatgcctctgacttcgaagccccgcccgagcaactctttcctagcggcaacaagccaggcccctgctggcccggtcccagttctcatgcaaacggagaccctgttgcggtagccaaagcccagccaagaactttcgtggggattcaggccagtgaggctagtaggatggaagatgccacaaacgttgtccgcggtttaatagtggaactgtccaatctgaacaggctcattatgggcacccatagagatctggaagccttcaaacgccttaattatcgcaagaccaagcttggaggtaaagctcccctgccctatccctccaagggccctggtaacatcccgcgcggtgatcccccctggcgggaactgtag

SEQ ID NO: 27820 - DNA, 606 bp, Artificial Sequence
  Description of Artificial Sequence: Synthetic coding sequence
atgatcacggaaacagcagccgaaccaaccgtgccagccgtgccagccgcagaggaagccaccgaagcccgaggcagggaggagccggcctggccttggaaagatgcacccattaggaccttagtgcaacgaatccaccaacttcaagctgaacgcgcccagggctttcggcggttagaggaatggcttgccccagtccaggggcttagggcctggggcaggggtctgcgcgtgcctacctgccgccgggggcacagacagtacctacgtagtggcccagattacgattttgctcgctatcggtctacagtccacggcgtcacacaggcattcgctgccgcatccagagaagtgctcgctgtggaagccgagcttggcggcccgaggaggcagcctcttctggccggacacgtaaggtccctgcaagagttagagcagacacggcttggcacagtagccctgctacaactgatggaaacccctgagctcgccgggcaggaggacgcagtgagaatgcagcagttgaagatgaaagttatcaaaaccatggaagccatcagcgaagttctgcaggatcttcgattcgatgctgagagcgccgagtag

SEQ ID NO: 27821 - DNA, 540 bp, Artificial Sequence
  Description of Artificial Sequence: Synthetic coding sequence
atgatcaccgaaacagcggctgagcctactgtgccagcggttcctgcggctgaggaagcaactgaggcacgggggcgcgaggagcccgcgtggccttggaaagatgctccaatccggactttagtccagagaatccaccagctgcaggccgaaagggcccaaggtttccggagacttgaggaagggcaccgacagtacctgcgcagtgggcctgactatgactttgcgcgttacaggagcactgtccacggcgtgactcaggctttcgcggctgccagcagagaggtcttggctgtggaggcggagctgggagggccccgaagacagcctctgctcgctgggcatgttcgctcactgcaagagcttgagcaaacacgattgggaaccgtggcattgctgcaacttatggaaaccccagaactggccggccaggaggatgcagtcaggatgcagcaacttaagatgaaagtgatcaagacgatggaggccattagcgaggtccttcaggatttgaggtttgacgctgaatcagccgagtag

SEQ ID NO: 27822 - DNA, 876 bp, Artificial Sequence
  Description of Artificial Sequence: Synthetic coding sequence
atgtcccaggagggagtggaattagagaaatccgtccggagactcagggagaagtttcacggcaaggtgagcagtaagaaagccggcgcactcatgcgcaaatttggttccgatcacacaggagttggcaggtcaatcgtgtacggagtgaagcagaaagatgggcaagagctctcaaatgatctggacgctcaggatcctccggaggacatgaaacaggatagagacatccaggccgtggctacgtccttactccctttgacagaggcgaatctgcggatgtttcagcgagcgcaagacgacctgatcccggctgttgatcggcagttcgcctgtagtagctgcgaccacgtttggtggcgccgcgttcctcagcggaaagaggtttcacggtgtagaaagtgcaggaagcgctatgagcctgttcccgctgataagatgtggggtctggccgagttccactgtccaaagtgtcggcacaacttccgcggctgggctcagatggggtcaccctccccatgctatgggtgcggctttcccgtatacccaactcgcatcttgcctccaagatgggacagagatcccgacagaagatcaactcatacccattcctgttccgcagcggactgttataaccgacgggaaccacacgtgcccggaacatcttgcgcgcatcctaagtcccgaaaacaaaaccacctgccaaaagtcttgcatcctagcaaccctcatatctcttcagggtccaccgtggctacatgcctaagtcagggagggctgctggaagacctggacaaccttattctcgaggatctgaaggaggaagaggaagaagaggaagaagtagaagacgaggagggcggtccacgagaatag

SEQ ID NO: 27823 - DNA, 723 bp, Artificial Sequence
  Description of Artificial Sequence: Synthetic coding sequence
atgtcccagcaccagcaggcatgtgggatttgcaggcaggaggatccccccgaagatatgaaacaggacagggatattcaggccgtggcaacctcactgttgcctttgacagaagcaaacctgagaatgttccaaagggctcaagacgacctgatcccagccgtggatcgtcagttcgcctgttcttcatgtgatcacgtgtggtggcgtcgtgtcccacagagaaaggaagtgtctaggtgccggaagtgcagaaaaagatacgaacccgtgcctgccgataagatgtggggtcttgctgaatttcactgccctaagtgtcgtcacaacttccggggctgggcccaaatgggcagcccctctccctgttatggctgcgggtttcctgtgtacccgacacgcatactgcccccacgctgggatcgcgatccagaccgtaggagcacacacacacactcctgcagtgccgccgactgctacaacaggcgagaaccacatgtgccaggaactagctgcgcacatcccaagagccggaagcaaaaccacctccccaaagtccttcatcccagtaatcctcatatttcctcaggtagcactgttgcaacatgccttagccagggtgggctgcttgaagacctcgataacctgattctggaggatttaaaggaagaggaggaggaagaagaggaggtggaggacgaagaaggaggtccaagggagtag

SEQ ID NO: 27824 - DNA, 1884 bp, Artificial Sequence
  Description of Artificial Sequence: Synthetic coding sequence
atggaaaggcccgaaccacctcctgggaccgctgccggtcaagaggagcaggagttgagagagcgggcttttttttcctgggcggagttttcacggtttttcgacgcttggtgtcaacagcgactggctctgttcttcgtgaaaagtagcatgcatctcgcccgctgtagatgggcctcagctcctccgttgtacaccttaatcgacgtgctaaagtatagctacgtgaggctggtgtgcaaggacgtcagggcgcctagtcgccctgccgtgggaccaccccagcccggttgcccagctttcatcatagtcaagctgtccccactacgcgatcgcctcgtcgtaacagagtgtcaactgactcatagtcaccctgcgtgcccactcgaatttgcatattatttccgtccaggacacctgctggctaacgcttgcctcccagttcggaccacaaacaagatcagcaagcagtttgttgccccggcagatgtgcgaaggttgttatcttattgcaaggggagggaccatggagtcctggacgcactgcatgtgctggagggtttgttcaggacagaccctgaagcaaaggttaagttggtgttcgtcgaagatcaggcagtggtagagaccgtcttttttctcacctcacgcactcgcgcattgctcaggaggtttccgagaatgctgctggtcgatcggctgccaggtctccaaggggctctggatttgttggccgtactttgcgtggacggtagtggaagagcacgccaagccgcctgttgcgtggctcggccaggaactccaagtttgcttagatttgctttagcgtctctacttcagagtgccccggacgtgaagggcagagtcaggtgcttgacagccgggcccgaagttgctgcccaattgccagccgtccgacaacttctgccctgtgcgcgcgttcagatttgtcgggcccaaggcctggagaccctgttctcaaaagcgcaggagttgggaggggctgggcgagaggatcctggactctggagccgcctctgtagacttgccggggcctcctctcctgcagcttacgatgaggctcttgccgaattgcatgcccacgggccggctgcattcgtggactacttcgaacgcaactgggaacccagacgagacatgtgggttcgcttcagagctttcgaagccgccagggatctggacgcctgcgcattagttagaggtcaccggcggaggctgctgcgtaggctgagcccctctcggggcgtggcgcagtgtctgcgggatctggtcgctatgcagtgggcagatgccgctggagaggccgtcccagaaggacccgacggtgggggaccgtggttagaggacgagcccggacggggtgcacagggagaaaacgaaagggtacgcggcctggagaccggagactggggcggcgctcctaaggagggttcgatttggcgcggcgcccagatggaaaaggagtgggccagagccctggagacacgcgactggggaggagcccaatttgaaggcgagaaggggcgagcgctgcaaattcgcgactggcgcgggggcagactggagaaccagaagccgcgcggcctggagggaggcgttctgagagggtccaaactcgagaaaggtcaccttcggggacccgaaattcgcgattggagaggtccgcaactcgagggagaaaaagactggggtctggagggctacgtgtggcggggatctcagctggaagaccaagccctgcgggggcttgaagggtatacttggcgcgtggcccaactcgaggatcgcagaagcacaacagatctgagaggaactcaattcgactatgagagaggcaagggcgagtcaacagaagatcggtag

SEQ ID NO: 27825 - DNA, 393 bp, Artificial Sequence
  Description of Artificial Sequence: Synthetic coding sequence
atggagttatggaggcagctcaatcaggcaggtttggtaccaccaggactggggcctccaccacaggcactgcgggaagtaagtcccgtagaaatccccggccagacacttcgaacagccggtgctgatacgggaggcgcatgtgatagtctcctgtggatccgggaggaattggggaacctgcggagggtggacgttcagctgctggggcagctgtgctctttgggtctggaaatgggagccctacgcgaggaactggtgactatactagaagaggaggaggagtcttcgaaggaggaggaggaagatcaagagcctcagagaaagcaggaagaggaacacctggaggcttgccctgctccccacccccccgactttgaaatgatgatatag

SEQ ID NO: 27826 - DNA, 630 bp, Artificial Sequence
  Description of Artificial Sequence: Synthetic coding sequence
atgcagaccctgcgccaagaagccgcacgtccctgtatcccatcaggcaccttggaagcaagcttccctgcgccgctgtactcagatgattatttgagcctagaagggagcaggtggccacctgctataaggcaagcaactcgctggaagtataccccaatgggaagggacgctgctggccaactctggtataccgggctgacaaattcggacgcttgggaagcgtggtacaacctcccacgcgcccccgcatctccatttcgcgaggcctacaatcggtggcactcatgttaccagcatcgggagtgttcaatgccaagcgcatacacacagcacctgagagagacggcatggcatgaccccatcgttcctgcgcagtatcaggcccccagtacaaggtggggctccgctctgtggaaagataggccaatcagagggaaagagtacgtactgaacaggaaccgctacggagtcgaacctctgtggcgggcttcagactacgtgcccagcctgtcggctccgcagcgcccccccggcactactcagaactacagagaatgggtattggagccctattgccctagtacctgccagagatcaccaccctcgcttacaccaactcccagatag

SEQ ID NO: 27827 - DNA, 390 bp, Artificial Sequence
  Description of Artificial Sequence: Synthetic coding sequence
atgcgacttaaagtgggctttcaagggggagggtgcttccgcaaggatgctttatgtctggagggcggggtctctgctagatgggctagggcaccccatagcgctccacttcgaccgccccgcgagctgcacgcggccccgccacctgcgaccccaacgcagaccgtggtcaggccagccggtttcccaagacggacgcgcctgatggtcagaagcgccccccctacccagcggccaccgacaggttccggatgtgtgtccggcctgtggcgcaaggggctcgggttacgaccacaaacactgcttcgggtcggctcagttgtactgtctagcgcccctgcattacgtccccgacttggcccctgccttaggcccccacctagtgactag

SEQ ID NO: 27828 - DNA, 222 bp, Artificial Sequence
  Description of Artificial Sequence: Synthetic coding sequence
atgggggtcaagctcgaaatctttcgaatgatcatctatctgacattccccgtcgctatgttctgggtgtccaatcaggctgagtggttcgaggatgatgtgattcagcggaagagggagctgtggccccctgaaaagttgcaggagattgaggagttcaaggaaaggctgcgaaagaggcgggaagagaaacttcttagggacgcgcagcagaatagctag

SEQ ID NO: 27829 - DNA, 5955 bp, Artificial Sequence
  Description of Artificial Sequence: Synthetic coding sequence
atggagttgacccctggcgcgcaacagcagggaattaattaccaggagcttaccagcggctggcaggacgtgaagtcaatgatgctcgttccggaacctacacgaaagttcccttccggccctctgctgaccagcgtcagattctccaacctcagccctgagtctcaacagcaggatgtcaagagcctcgagttcactgtggaacccaagctccagtcggtaaaacatgtgaagctgagcagcgtgagtctgcagcaaacaattaagagtgtggagttagcaccagggagcctgcctcaaagagtcaaatacggcgagcaaactcctcgaaccaactatcaaatcatggagagcagtgaactgattccacgtccaggacaccaatttgccaagtacgccgagatgattccccagcccaaataccagattcccaagtctgccaatctgatttccatccccatctatcatgctactgagtctagcgaaatggcccaggggctggcttacaaaggaatcgacacagtggaaaaaagtgtgggtttgactcccaaacttaccggccgggcaaaagaatccctcggtatgcttctgcagcctgacctgcaggtccctaaatttgttgatctgacacctatggtgagagatcagggcagtaaatttctgggcctcacccccgagaaaagctatcagatccttgagactatggagctgctcagccagtctcggcctcgagtgaaggacgtcggggagctgtacatgaaacctctgcagcagaccgtagaatatgagggtattacacccgaacttaagcattactttacagaggcaatgggtttgacggctgaagctcgaatacaggccaacgaattcttcggaatgacgcctaagcccaccagtcaggcaaccggatttgcggaacggtctccgagattatgtccacagaatctcgaatgcgtggaagtcatttcagagaaacgactccaaggagaagagagcgtggttcttatacctaaatccctgcatcacgtgcccgacagcgcaagtgggatgacaccggggctcggacaccgtgtcccagagagcgtggaactcacctccaaatctggcgtccaggtggagaagaccctgcagttaactccaaagccccagcaccacgtcgggtcccccgggattatctcagggctgggccaccaagtcccagagagtgtaaacctgacatgtaaacagtggcttcagatggaagaatcattagaggtgccccttaagcagacctctcaggtcatcggtcacgaggaatccgttgagctcacgagcgaagcacggcagcatcgcgaagtgtctatgggcctcactaagagcaaaaaccagtccatgaaatcccccggtacgacaccgggcccacttggccgcatagtcgaatttatgcgtatctcgccagaacccctggaccaggtaactgagtcagcacgaactcaacttcaggtcgctcagtccgaggaagtcatcctcatcgatgtgccaaaggtcgtccagtcagtgaaagtgacccctggtccgcctttccagatagtgaaatctgtcacaatcccgcgccctacccctcagatggtcgaatacatcgagctgacgccaaagctccagtacgtacggccaagcgaacaccataccggaccgtgcctccaggacgtgaagtccactaaactaattaccaagccaaagcaccagatcctggagaccgtggagcttaccggctttcaaatcgtaaagacgatgctgatccccggccccagcctccagatcgtcaagtccgaggagctcgcaccaggccctataccacaggtagtcgagccaattggagtggcactagagtcgggaatcgaagccattaattgtgttgacttgttaccccgcccacacctgcaggagctgatcgtcccagctgaattaacgccaagtccctgcacgcaggtaaaaagtgcagagttgacatctcctcagacatcaccatttgaggaacacaccatcttgacgcacaaacaggggctgcaggctgtcaagagtactgttatcaaaacggaaccaccaaaagtgatggaaaccgaggacttgaaccttggccacgtctgtcagaacagagactgccaaaaactcactagcgaagaactgcaggtggggacagacttttcccggttcctccaaagtagtagcaccacactcatctcatcctccgtccgcacagcttcggagttgggtggcctttgggactccggtatacaggaggtcagtcgggccttggacattaaaaaccctggcaccgacattctacagcccgaggaaacttacattgaccctaccatgatccaatcactcacattccccctcgcactacataaccaatcatccgacaaaacagcgaacatcgttgaaaatccgtgcccagaaatactgggcgttgacgtgatctctaaggaaactactaagaggaaacaaatggaagaactagaaaactccctccaacgccaccttcctcagagctggaggtcccgctcccgaacgttccaggccgagtccggcgtgcagaaaggtttgatcaaaagcttcccaggtcgccagcacaatgtttgggaaagtcacgcatggagacagcggctacccaggaaatacctgtcaaccatgttaatgctgggcaacattctcggaactactatggaacgcaaactctgttctcagacatctctagccgagagagctacagcagatacatgccagtctatccagaacttgttcggtatcccagcagaactgatggagccatcacagtccctgcctgagaaaggaccagtgaccatcagtcagccaagtgtggtcaagaattacatccagagacacaccttttatcatggccataagaagcggatggccctgcggatttggacccgcggttctacttcctctatcattcagcagtacagcggaacaagggtacgcatcaagaagacaaatagcaccttcaacggtatcagccaggaagttatccagcatatgcccgttagttgtgccggggggcaactaccggtgctagtaaagtctgagagcagcctctccattttttacgacagagaagacctggtgcctatggaggaaagtgaggattctcaaagtgactcacagaccagaatctccgagagtcagcactcactgaagcctaattacttatctcaggcaaagacggacttcagcgagcagttccagctcctcgaggatctgcagttgaaaattgctgctaaattgttgagatctcagatacctccggacgttcccccccctctggctagtggccttgtgctcaaataccctatatgtctgcagtgcggtaggtgctcgggactgaattgccaccacaaactacagacgacctccggtccttacttgttgatctacccacagctgcacctggttcgtactcccgagggccacggagaggtccggttgcacctggggttccgccttagaattggtaaaaggagccagatcagtaaatacagggaacgggacagacctgtaatcagaagatccccaatctcacccagccaacgcaaagcaaagatttacacccaggccagtaaatcgcctacatctacaatagacttacagtctggacccagccagtctccggcacctgtgcaggtctatattaggcgtggtcagaggtcaagacccgacttagtggagaagacaaagacacgggctccaggccactatgagttcactcaggtgcacaatctgccggaatcagattctgagtccactcaaaacgaaaagagagctaaagtccgcaccaaaaagacctctgactccaaataccccatgaagcgtatcaccaaacggctccggaaacacagaaagttttatacaaactcgaggaccactatcgaaagccccagcagagagctggccgcccacctgcggaggaaacggattggagctactcagacgtcaacagcctcattgaagcgacagcctaagaagccaagtcagccaaaatttatgcaactgctctttcagagtctgaaaagagcctttcagacagcccaccgagtgatcgctagtgtcgggcgaaagccggtcgacgggactagacctgacaatctctgggctagtaagaattattacccaaagcagaatgcccgcgactactgtctgccttcttctattaaaagagacaagcgctctgccgacaagctgactcccgcagggagcacaattaagcaggaggacatactgtggggcgggaccgtacagtgcaggagcgcgcaacaacccaggcgagcctacagctttcagccacggcctctccgcctgcctaaacctacggactctcagtcaggaatagccttccagaccgcatccgtaggtcagccattgaggacggtccagaaagattcttcgtctcggagcaaaaaaaacttttatcgcaatgagacctcttcccaggaaagtaagaatctcagcacgcccggcacgcgcgttcaggctcgcgggaggatattgccaggtagccctgtcaaaaggacatggcaccgccacctgaaggacaagctcactcacaaggagcataaccatcccagcttctatcgggaacgtacaccccgcggaccatctgagagaactagacataacccaagctggcgcaaccaccggagtccttctgagagaagccaaagaagcagcttggagaggcggcatcatagccccagccagagaagccactgcagcccctctaggaaaaatcactctagcccttccgaacgttcctggcgatctccaagccagaggaatcactgtagcccacccgaaagaagctgtcactctttgtcagagaggggcctgcacagccccagtcagcgctctcacaggggaccatctcagcggcgccaccattccccctctgaaaggtcacacagatcacccagcgagcgatcacaccggtctagttccgagcggcgccatcgcagcccatcccagaggtctcacagggggccaagtgagcggagccactgctctcctagcgagcgccgccatcggtctcccagtcagcgcagccacagaggacctagtgaacgaagacatcattcgccttcaaaacgatcccacagaagtcctgctagacgatcccatcggtcaccatcggagcgcagtcaccactcccctagcgagcgcagtcaccattcaccaagcgaacggaggcaccattcaccttccgagcgcagtcactgtagtccctcagagcgatcccactgttcgccatcagagcggaggcaccgttctccctccgagagaagacaccacagtccatccgaaaagagccaccattcaccgagtgagcgatcacaccattcgccaagtgaacgccgacgacactctccgcttgagcgaagcagacatagcttgctcgaacgatctcaccgttctccttcggagcgccggagccacaggtccttcgagcggtctcatcggaggatctcagagcgttcacactctccgtcagaaaagtctcacttgagccccctggagcgctcgagatgcagccccagtgaacgtagaggccactcatcaagcggaaaaacttgtcacagcccttccgaacgttcccaccgctctccatccggaatgagacagggccgcaccagcgaaaggtcccaccgatcttcctgcgagcggacacggcactcacctagcgagatgcggcccgggaggccatcaggcaggaaccactgcagcccgagcgagaggagcaggcgctcgcctctgaaagaagggctgaaatattctttccccggtgagcgaccctctcactcactctctcgggattttaagaatcagaccacccttttgggcacaactcacaaaaatccaaaggccggccaggtctggagacctgaggccactaggtag

SEQ ID NO: 27830 - DNA, 612 bp, Artificial Sequence
  Description of Artificial Sequence: Synthetic coding sequence
atgacagtgaagtggaaacagctgtcagcacctgccagcggagcggagatccagcggttccctgtgccagcagtcgaaccagtgccagcacccggcgcggattcccctccgggcaccgctctggaactggaagaagccccagaacccagctgtcgctgccctggcactgctcaggaccaaccgagtgaggaacttccagattttatggcgccccccgtggagcctccagcgtcagctctcgaacttaaggtatggctcgagctcgaagtggctgagcgggggggacagcactcctctagccagcagctcccccattgtagccagagctgggcacagtggaagctatggaggcaaagacccgggttcgcgatatgggcaccccttcctcactggagagggaccagtctgatccagcagtcctccagtccggctgccgagggcccggctgcaaccgccgccggggccgtgtgtctgcccgctggcggagcaggagagcaggagaaggaacctgtaagcaggggatctagtaggtcaagttgctcgcagcggcgccctcctccacccggaatggaggtatgcccacagctagggatatgggccatatgcccctag

SEQ ID NO: 27831 - DNA, 630 bp, Artificial Sequence
  Description of Artificial Sequence: Synthetic coding sequence
atgttcgtaaggccagaatccggtgaacagggcccagagacactggcccccgctagcggggccgaaatccagcgcttccctgtgcccgcagtcgagcctgtgcccgcacctggagcagactccccccctggcacggccctcgagctggaagaggctccggagccttcctgcagatgtcccggcaccgctcaggaccagccctctgaagaattgcccgactttatggcacctcccgtggaacctccagcttccgctctggaactcaaagtgtggctggagctggaggtggccgaaagaggtggacagcactctagttcacagcagctccctcattgtagccagagctgggcccagtggaagctctggcggcagagacccggtttcgccatttgggccccactaccccactggcgaggtacttccctcatccagcagagcagttccccagccgcagaaggaccggcagcaactgccgccggcgccgtctgcctccccgccggcggcgcaggtgaacaggagaaggaacctgtttctagaggaagctccaggagtagttgttcccagagaagaccaccgccacccggaatggaggtatgtccccagctcggcatctgggctatatgcccgtag

SEQ ID NO: 27832 - DNA, 1725 bp, Artificial Sequence
  Description of Artificial Sequence: Synthetic coding sequence
atggaacccaactccctcaggactaaggtcccagcgtttctgtccgaccttggcaaggccaccttgagaggaattaggaagtgtccccgttgcggtacttacaatggaactcggggtctcagctgtaagaataaaacttgcggaacaattttccgatacggagccaggaaacagccctccgtggaagcagtaaagatcattaccggtagtgatctccaggtttattctgtcaggcagagagacagggggcctgattatcgatgtttcgttgaactgggtgtgtccgagactactatccagaccgtggacggtactatcatcacccagttgagttcgggtcgctgctacgtcccatcctgtttgaaagcagcaactcaaggcgtggtagagaatcagtgccaacacatcaagttagctgtgaattgccaagcggaagctactccactgacgttgaaatcttctgtcctgaacgccatgcaggcttccccagaaaccaagcagaccatctggcagctcgctaccgagcctacaggcccactggtccagagaataacgaagaacattctcgtggtgaagtgcaaggcttcccagaaacattcactcggctacctgcatacatcattcgtgcaaaaagtctccggtaagtcgttgcccgagaggcgctttttctgcagctgtcaaaccctgaagagtcacaagtccaacgcgagtaaagacgagaccgcccaacggtgtatacacttttttgcctgcatttgcgctttcgcctccgatgaaacactggcccaggagtttagtgacttcctgaactttgactctagtggtttgaaagagatcatcgttccgcagctagggtgtcattcagagtccacagtttcagcctgtgagtcaaccgcttccaagagcaagaaaagacgtaaagatgaagtgtcgggagcgcaaatgaactccagcctgttgccccaagacgccgtgtcttctaacttgaggaagtcaggattgaagaaacctgtggtggccagtagcctcaaaaggcaggcctgtggacagcttctggatgaagcacaggtcacactgagctttcaggattggctcgcttcagtgacagagagaatccaccagactatgcattaccaattcgatggcaaaccagaaccgctggtgttccacatccctcagagcttctttgacgcactgcaacagagaattagcatcggatcagccaagaagaggctgccaaattctaccactgccttcgtgcgaaaagacgctttgccccttggcacattctcaaagtacacttggcatatcaccaatatcttacaggtgaagcagattctggataccccagagatgcctctggaaatcacacgctctttcatacagaaccgcgatggcacatatgagctgtttaagtgccccaaggtggaggtggaaagcatcgccgaaacctatgggcggattgagaagcagcctgttcttcgcccattggaattgaagacattcctgaaggtggggaatacatcacccgatcagaaggaacctacaccttttatcatcgagtggatccctgatatactgccgcaaagcaaaattggagagttgcgaattaaattcgaatacggccaccacagaaacgggcacgtcgccgagtatcaggaccaacggcctcccctcgatcagccactggaattagctcccctaactaccattactttcccctag

SEQ ID NO: 27833 - DNA, 69 bp, Artificial Sequence
  Description of Artificial Sequence: Synthetic coding sequence
atggagcccaactccctgcgaacaaaggtgcctgctttcctgtcagatcttgggaaggcgacactgtag

SEQ ID NO: 27834 - DNA, 480 bp, Artificial Sequence
  Description of Artificial Sequence: Synthetic coding sequence
atggaacctaattcccttcgtactaaagtgccggcctttctaagtgatcttgggaaggctactcttaggggtattcgaaagtgtcctcgctgtggcacatacaatggaaccagaggactgtcatgtaagaataaaacctgcgggacaattttcaggtacggagcaagaaagcagccctccgtagaggctgttaagataatcactggctccgatctgcaggtttacagcgtgcgccaaagagacaggggaccggactatcgctgcttcgtggaactcggcgtgtctgaaactaccatccagactgtggatgggaccattataactcaactgagctccggtcgttgttatgtccccagctgtttaaaagctgccactcagggagttgttgaaaatcagtgccaacacatcaaactcgcagtgaactgccaggccgaggctaccccactgacactgaagtcatctgttctgaatgccatgtag

SEQ ID NO: 27835 - DNA, 387 bp, Artificial Sequence
  Description of Artificial Sequence: Synthetic coding sequence
atggagcccaactcccttcgaactaaggtgccggcatttctgtcggacctgggtaaagccaccctacgcggcataagaaaatgccccagatgcggcacatataacggcactagaggactgtcatgtaagaacaaaacttgtggcactatatttcgatatggcgcccgtaaacagccctcggtggaggccgtaaagatcatcaccggcagcgatctacaggtctattcagttcgccagcgggacagaggcccagattatcgttgctttgtcgaactaggcgtcagtgaaactactatccagactgtggacggcaccatcattacccagctgtctagtggtcgctgttacgtgccatcttgtctgaaggccgccacacaaggagtgtag

SEQ ID NO: 27836 - DNA, 1725 bp, Artificial Sequence
  Description of Artificial Sequence: Synthetic coding sequence
atggaaccaaactccctccgaactaaggtgccagcattcctgagtgatcttgggaaagctaccctgagaggcattagaaagtgtccgcggtgtggcacctataacggtaccagagggctgtcgtgtaaaaacaagacctgcggcactatcttccgatatggcgctcgaaaacagccatcggtggaggcggtcaagatcatcacaggaagtgacctccaggtctattctgtacggcagcgggataggggacccgactatagatgttttgtggagttgggcgtatctgaaaccaccatccagacagtggacgggacaataattacccagctctcaagtggacgctgctatgtcccgtcttgcctaaaggccgctacacagggagtcgtcgagaaccagtgccagcacatcaagcttgccgtgaactgccaggccgaggcaacaccactcaccctgaagagttctgttctgaacgctatgcaggctagccctgaaacgaaacagacaatctggcaactggctactgagcctacaggccccctggtccagaggataacgaaaaatattttagtggtgaagtgcaaggcttcccagaaacacagcctgggttatctgcatacctcatttgtacagaaggtcagcgggaagtccctccccgagagacgattcttctgttcgtgtcagacactgaagtcccataagtcgaacgcctccaaggatgaaactgcccagcgttgcattcacttttttgcttgtatttgcgccttcgccagcgatgagacactcgcccaggagttctcagattttctcaacttcgattcatctgggctgaaggagatcatcgtaccccaactcggctgtcactcagagagcacggtgtctgcttgtgaatctacggccagtaaaagtaagaagcggcgaaaggacgaggtgtcaggtgcacagatgaactcctcccttcttccacaagacgctgtgagctccaacctcagaaagtccggcctgaaaaagccagtggtcgcctcttctcttaaacgccaagcttgcggacaacttctggatgaggcccaagtcacattgtcgttccaagattggctggccagtgtgactgagagaatccatcagaccatgcactaccagttcgatggcaaacctgaaccgttagtcttccacatcccacagtcattctttgacgccttgcaacagaggatctccatcgggagtgcaaaaaagcggctgcccaatagtactacagcctttgtaaggaaagacgcccttcctttaggaaccttcagcaagtacacctggcacatcaccaacatactacaggtgaagcagattctcgacacgccagaaatgccccttgagatcaccaggagcttcatccagaacagagatggcacttatgagctgttcaagtgtcccaaagttgaagttgaatccattgcagaaacatacggaaggattgagaagcaacctgtgctacgcccactcgagcttaaaacgtttctgaaagttgggaacacttccccagaccagaaagagcccactccttttattatcgagtggatcccagacattctcccccagagtaagattggagagctccgcatcaagttcgaatacggccaccacaggaatgggcatgtcgccgagtaccaagatcagcggccccctctggatcaacctcttgaactggcccctctaaccacaatcacatttccctag

SEQ ID NO: 27837 - DNA, 180 bp, Artificial Sequence
  Description of Artificial Sequence: Synthetic coding sequence
atggaacctaacagtctccgtaccaaggtgcctgcgttcttatctgatttggggaaggctacactgcgcggaatccgtaaatgccctcggtgcggaacctacaatggaactcgggggttgagttgcaagaacaagacatgcggcaccatctttaggtacggggcgcggaagcagccttag

SEQ ID NO: 27838 - DNA, 183 bp, Artificial Sequence
  Description of Artificial Sequence: Synthetic coding sequence
atggaacccaacagcctgcgtacaaaagtccctgcttttctgagtgaccttggcaaggctaccttacgcgggattcgcaaatgcccccgatgcggaacgtataatggaacacgcggattgtcatgcaagaataagacgtgcggtacaatttttcggtatggcgcccgtaagcagccctcctag

SEQ ID NO: 27839 - DNA, 96 bp, Artificial Sequence
  Description of Artificial Sequence: Synthetic coding sequence
atggaacccaattccctgcgcacaaaagtccctgctttcctgagcgacttgggaaaggcaaccctcagaggcatccggaagtgcccacggtgttag

SEQ ID NO: 27840 - DNA, 507 bp, Artificial Sequence
  Description of Artificial Sequence: Synthetic coding sequence
atggagcccaactccctacgcaccaaagtgcccgcttttctgtcagacctggggaaggcaacactaagggggattaggaagtgtcctcggtgtgggacctacaatggtacaagagggctgagttgtaagaataaaacttgcggtacgatattccgctacggcgcccgcaaacagccttccgttgaggctgtgaaaatcattaccggctctgacctccaagtctactcagtcaggcagcgggacagggggcccgactaccggtgtttcgtggagcttggagtctctgagacgacgatacagaccgtggatggtacaattatcacgcagctcagtagcggacggtgctacgtgccaagttgcctgaaggcagcaacccagggggtggttgaaaaccagtgccagcatatcaaactggccgtcaattgccaggctgaagccacacctctgactttaaagagcagcgtgctcaacgctatgcaggcctccccggaaactaagcagacctag

SEQ ID NO: 27841 - DNA, 339 bp, Artificial Sequence
  Description of Artificial Sequence: Synthetic coding sequence
atggaacctaacagcttgcgcactaaagtccccgcattcctaagtgacttgggaaaggcgaccctgcggggcattcgcaagtgccccaggtgtgggacatacaatggaaccagaggtctgtcatgtaaaaataaaacatgtggtactatcttcaggtatggggccagaaaacaaccttctgtagaggccgttaagatcattacaggctctgacctgcaggtttactccgtgcggcagcgcgatagaggccccgattataggtgctttgtggagctcggcgtgtctgaaaccacaatccagacagttgacggtaccatcatcacacagctgtcctcctag

SEQ ID NO: 27842 - DNA, 978 bp, Artificial Sequence
  Description of Artificial Sequence: Synthetic coding sequence
atggatagcgagcttaaagaggagatccctgttcacgaggaattcattctgtgtggaggcgccgagactcaggtgttaaagtgcggtccctggactgacctgtttcacgatcagagtgtaaaacgaccaaaattgctaatttttatcattcccgggaatccaggattctccgctttctacgttccgtttgccaaagctctgtactcattgactaataggcgattccctgtgtggactatcagccacgccggtcacgctctggctcctaaagacaaaaaaattctcacgacctccgaggactcgaatgcacaggagatcaaggatatctacggtctgaacggtcagatagagcacaaactcgcattcctgcggacccacgtcccaaaggatatgaaactcgtcctgatcggacactcaatcggctcatactttactctccaaatgctaaaaagagtgcctgaactgcctgttattagagcttttctgctgtttcctaccatcgagcgcatgtcagagagtccaaatgggcgcatcgcaacccccctcctgtgttggttcagatatgtgctctacgtaacggggtatctcttactgaagccgtgtcctgagaccattaaatcactcttgatccgacgcgggttgcaggtgatgaatctggagaacgaatttagtcctcttaacattctggagcccttctgtctggctaatgcagcgtatttaggaggacaagaaatgatggaggtggtgaaacgggacgacgagactatcaaggaacatctgtgtaaactcactttttattatgggaccatagacccttggtgccctaaggagtactacgaagacatcaaaaaggattttccagaaggagacataagactgtgcgagaagaacatccctcatgcgtttattacacacttcaatcaggaaatggccgatatgatcgcagacagtttgaaagacgatttatctaagatgtag

SEQ ID NO: 27843 - DNA, 834 bp, Artificial Sequence
  Description of Artificial Sequence: Synthetic coding sequence
atggattctgagctgaaggaggagattcccgtccacgaggaattcatcctgtgcggaggggctgaaacccaggtgttgaaatgtggcccctggacagacttgttccatgaccagtcagtgaagcgccccaagctacttatatttatcattcccgattccaatgcccaggagatcaaggatatctacggactaaatggccagattgaacataaactggcttttctgcgtacccacgtgcccaaagacatgaaactggtactgatcggacactctatcggtagctactttaccttgcaaatgctgaagcgggtgcctgaactgccagtaatccgagcctttcttctgttcccaacaatagagcggatgagcgagagccctaacggacgtatagccacgcctctgctatgctggtttagatatgtactctatgtgactggttatttgctgctgaagccttgtccagagaccatcaaaagtcttctgatcaggaggggcctgcaggtgatgaacctggaaaacgagttctctccactcaatatcctggagcccttctgcctggctaatgcagcctacctgggtggacaggagatgatggaggtcgtgaagcgggacgacgaaacaataaaggaacacctctgtaagctaactttctattatggcactattgatccatggtgccccaaggagtactacgaggatatcaagaaggacttccccgagggagacatacgcctgtgcgagaaaaatatccctcacgcctttattacccatttcaaccaggaaatggcagatatgattgcagactctctcaaggatgatcttagtaagatgtag

SEQ ID NO: 27844 - DNA, 501 bp, Artificial Sequence
  Description of Artificial Sequence: Synthetic coding sequence
atggactctgaactgaaagaagaaattcctgtgcatgaggagtttatcctgtgcgggggcgctgaaacacaggtgctaaaatgcggaccatggacggacctgtttcacgaccaatctgtcaaacgccccaagctgctcatctttataatacccggcaaccccggtttcagtgccttctacgtccccttcgctaaagctctctactcccttactaatcggcgattccctgtgtggacaatcagccatgccggccacgcgttagcccccaaggataagaaaatcctcaccacatcagaagattccaacgcacaagagattaaggacatctacggcctcaatggtcagatcgaacacaaattggcctttcttcgcacccatgtacccaaggacatgaagctagtcctgatcggtcattcaattggatcctacttcaccctccaaatgctaaagagagtgcctgaactgcctctaatgctgccgaccctaggggccaagaaatag

SEQ ID NO: 27845 - DNA, 588 bp, Artificial Sequence
  Description of Artificial Sequence: Synthetic coding sequence
atgaaactggtgctcattggccatagcattggctcttacttcacgctccagatgttaaaacgagtgcctgagctgcccgtcattcgggctttcctcctgtttcccaccattgaaaggatgtccgaaagccccaacggcagaatcgccacacctctcctatgctggtttagatacgtcctatatgtgacagggtacctactgttgaagccctgcccagagacaatcaagtctctccttattagaagaggtttacaggtcatgaacctagagaacgaattctctccattgaacatactggaacccttctgtctggccaacgccgcttacctgggaggacaggaaatgatggaagttgtcaagcgcgatgacgaaacaattaaggagcatctctgcaagctcaccttttactatggcacgatagacccctggtgccctaaagaatactatgaggatatcaagaaagacttcccagaaggggatattaggttatgcgagaagaacatcccccatgccttcataacacacttcaatcaggaaatggctgatatgatcgcagattcactgaaggatgaccttagcaaaatgtag

SEQ ID NO: 27846 - DNA, 2166 bp, Artificial Sequence
  Description of Artificial Sequence: Synthetic coding sequence
atggagctgggcaaggggaagttactacgaacgggtctcaatgccctgcaccaggcagttcaccctatccacggacttgcctggacagacggaaaccaagtggtgctgacagacctgcggcttcattctggcgaagtaaagtttggcgacagcaaagttatcggccaattcgagtgtgtgtgcggcctgagttgggctccgccggtagccgatgacacccctgttctcctggctgtgcagcatgaaaagcacgtgactgtgtggcagctctgtccatctccaatggagtcaagcaagtggctaacatcacagacctgtgaaattaggggctctttgcctatcttgccccaggggtgcgtgtggcaccccaagtgcgccatactgactgtactcaccgctcaggatgttagtatcttcccaaacgtacactcggacgactcccaggttaaagccgacatcaacacacaagggcggatacactgtgcctgctggactcaggacggtcttcgtcttgtagttgcagtcggaagcagcttgcattcttatatctgggattccgcccagaagacactgcatcgctgctcgagctgtttagtgtttgatgtagattcgcatgtgtgctcgatcacagcgaccgtcgactctcaggttgcgatcgccacggaactgccattggacaagatttgtggcctcaatgcttccgaaacattcaacattccaccaaacagcaaagacatgactccctatgccttgccagtaataggcgaggtcagatctatggacaaagaggctaccgacagtgaaactaactccgaagtgagtgtgtcttcttcttacctagaaccattagatctgacccacatccatttcaaccagcacaagagcgaggggaattctttgatctgtctccggaagaaagactacctcaccgggacagggcaagattcttcccatctggtgctggtgacttttaagaaagccgtgactatgaccaggaaggttactatccccggaattctggtgcccgatctgatcgcctttaatttgaaagcgcacgtggtggccgtggcctccaatacctgcaacataatcttgatttacagcgtgataccctcttctgtgccaaacatccagcagatcaggcttgaaaacaccgaacgccccaaggggatttgctttctaaccgatcagctcctattaatccttgtaggtaagcaaaagctcaccgacaccacctttttgccatcctcaaagtccgatcaatacgcaatcagcttgattgtcagagaaatcatgctagaagaggagccatccattaccagcggcgaatcacaaactacatactcaacatttagtgcccctctcaacaaggccaatcgaaagaagcttatagagtctttatctcccgatttctgtcatcagaacaaaggcctcctcctgacggtcaacacctccagccagaatggccggcccggacgcacacttattaaggaaattcagagcccgctctccagtatttgcgatgggagcatcgctctagatgctgagcccgtgacgcagcctgcctccttgccaagacactcatccacaccagatcatacttccactctggaacccccacgcttgccacaacgaaaaaacttgcagtcggaaaaggaaacataccagctgtctaaggaggtggagatactctctcggaatctggtggagatgcagaggtgcctctccgagctcacaaaccggctgcacaacggaaagaaaagttcatccgtctatccgctgtcccaagatttgccatatgtgcatatcatttaccagaagccatactatctgggccccgtagtcgagaaaagggccgtcctgctatgcgatggaaagctccggctgagtaccgtgcagcaaacattcggactgtcactcatcgagatgttacacgattcacattggatactactgagtgctgatagcgagggcttcattcccctgacatttactgctactcaggagatcatcattagagatggtagtttaagtcggtcggatgtgttccgtgattcttttagtcatagccctggggcagtgtcctccctgaaggttttcacggggctggcggcaccttccctggacacaaccggttgctgcaatcacgtggacggcatggcgtag

SEQ ID NO: 27847 - DNA, 525 bp, Artificial Sequence
  Description of Artificial Sequence: Synthetic coding sequence
atggagctgggcaaagggaaactgcttagaacgggactgaacgccctgcaccaggcagtccatccaattcacgggctggcctggaccgacgggaatcaagtcgtactgacagatctcaggctccactctggggaggtcaaattcggtgactctaaggtcattggacagtttgagtgcgtttgtggcctaagttgggctcctccagtagctgacgacaccccggttctcctggccgtgcaacacgagaagcacgtcactgtgtggcagttgtgtccgtccccgatggaatcctccaaatggctgacaagtcagacttgcgaaatcaggggatctctcccgattctcccccagggttgcgtgtggcacccaaaatgtgccatcctgacagttttgaccgcccaagatgtcagtatctttcccaacgtacatagcgacgatagccaggtaaaggcagacattaacacccaggggaggattcattgcgcgtgctggacccaggatggacttcgcctcgttgtagcctag

SEQ ID NO: 27848 - DNA, 1869 bp, Artificial Sequence
  Description of Artificial Sequence: Synthetic coding sequence
atggaactgggaaagggaaaactgctcaggacagggcttaatgctttacatcaggcggttcatcctatacatggcctggcttggactgacggcaaccaggtcgtcctgacagatctgaggctccattctggagaagttaaatttggagattccaaagtcatcggccaattcgaatgtgtctgcgggctatcttgggctccacccgtagctgatgacacacctgtccttttggcggtccagcacgagaagcatgttacagtttggcaactctgcccctcccctatggaatcttcaaagtggctcaccagccagacatgcgagatcaggggatcgttgcctatattaccccagggatgcgtgtggcacccaaagtgcgctattttgacggttttgaccgctcaggacgtgtcgatttttcccaatgtccactccgacgacagccaggtgaaggcagacatcaacactcaggggaggattcactgtgcatgttggacacaggacggcctgcgccttgtcgtcgcagttggtagctccctgcacagctatatttgggacagtgcacagaagacactgcatcggtgcagctcctgtctcgtttttgatgtggactctcatgtatgctccattacagcaaccgtcgactctcaggtcgccattgccacagaactacccctcgacaagatctgtgggctaaatgcttcagaaacctttaatatccctcccaattcaaaggacatgaccccttatgctcttcctgtgattggggaggtacgatctatggacaaggaggcgacagatagtgagactaatagcgaggtttccgtctcaagctcctatttggaaccactggaccttacacacattcactttaaccagcataagagtgagggaaacagtttaatttgcttgcggaagaaagactacctgaccggtactggtcaggatagctcccatttggttctggtcacgttcaagaaggccgtaaccatgacacggaaggtcaccattcctggaattctcgttccagacctcatagcattcaacttgaaggcccatgtggtagcagttgctagcaacacctgcaatatcatcctgatttacagtgttatcccatcaagtgttcctaacattcaacaaatcagactggaaaatactgaaaggcccaaggggatatgctttcttaccgatcagctgctgcttattcttgtgggtaagcagaagcttaccgatactactttcctgccatcctctaagagcgatcagtacgccatcagcctgattgttcgcgaaattatgctggaagaggagccgtcaatcacctctggggagagccaaacaacatactccactttctccgctcccctgaataaggctaacaggaagaaactcatagaatcactgtctcccgacttttgccaccagaacaaagggctattacttacagtcaacacctcgtctcaaaacggcaggcctggtcggacacttatcaaagagattcaaagccctctttcatcgatttgcgacgggtctatagccctcgatgctgaacccgtaacccagcctgccagtctaccaagacacagcagcacgcctgaccacacctccacccttgagcccccccgcctgcctcaaagaaagaatttacaatcagagaaagagacctaccagttgtccaaggaggtggaaattctgtcaaggaacctggtcgagatgcagagatgtctgtcagaattgacaaatcgcctgcacaatggtaagaagagcagtagtgtctacccattgagccaggacctcccctatgtgcatattatatatcagattcccacgggattcttttcccttttgactgtgagggccctgagccgctag

SEQ ID NO: 27849 - DNA, 480 bp, Artificial Sequence
  Description of Artificial Sequence: Synthetic coding sequence
atggaatcgaggccctcagggcggcagcacgctagtgaaggagacggcgatcagagccccacacagtgtgcagggatgcgctccagcgggcgttcagaccagccatatgtactgaaggggaatccattgctactgagggtgcgctgctattcagggtgtgcttcggggtctggccgacagctgcagctgagtgtgtttcaggacctcaaccagttttctcactgcagggtgtggagatctcccgccctcattgtcaaaggcgaaccgccatggtgcagccagcaggacacccagagcccttttcagacaggcacgcccctggagcggccatgctttcgtatgaaactgtcaggctgggaactcactaagaacgctcaacgtgccctgggatctaagcttcaacacatcttaagcctcgactccacacaggcatgcggggcaggggggccaacaatcctcagaccacctcgcgcgccctag

SEQ ID NO: 27850 - DNA, 699 bp, Artificial Sequence
  Description of Artificial Sequence: Synthetic coding sequence
atggccggagacgtcggcgggaggtcatgcaccgactcagaactacttctgcaccctgagctactaagccaagagttcctgctgctgactcttgagcagaagaacatcgcagtggagactgatgtgagagtgaacaaagactcactcacggatctgtatgtgcagcacgctattcccctcccgcagcgagatctgcctaagaataggtggggaaagatgatggagaagaagcgggagcaacatgagatcaaaaacgaaacgaaacgatccagtaccgttgacggcctgcgcaaacggcctctgatcgtctttgacggttccagtaccagtacatctataaaggtgaagaaaaccgaaaatggggataatgaccgcctgaaacctccgccccaggcaagcttcactagcaatgcctttagaaagttaagtaattcctcgtcatctgtgtccccactgatcctgtcctcaaatctccctgtgaacaataagaccgagcacaacaataatgatgctaaacaaaaccacgatcttacacaccgaaagtctcccagtgggcccgtaaaatccccacccctctcaccggtgggaactaccccggttaagctgaaacgggcggccccgaaagaggaggccgaggcaatgaacaacctcaagcctccacaagccaagcggaaaatccagcatgtgacatggccatag

SEQ ID NO: 27851 - DNA, 687 bp, Artificial Sequence
  Description of Artificial Sequence: Synthetic coding sequence
atgaggagactaagagtgacaacacacgcttcacttaggccttcaacaagtctcccacagcggtttctgagaggcgcactgtgggtggcagattggggcctactggctactaccatggcaggcgacgtaggaggaagaagctgtacggatagtgagctgctgcttcatcctgagctcctgtctcaagaatttctcttgctgactctggaacagaagaatattgccgtggagaccgatgtgagagttaataaagatagcctgaccgacttatatgtgcagcacgcgatcccattgccacagcgcgacctgcccaagaatagatggggcaagatgatggagaaaaaaagagagcaacatgaaattaagaatgaaacgaagaggagctctaccgttgatgggctgaggaagagacctctgattgttttcgacgggtcttctacatcgacatctattaaagtcaaaaagaccgaaaacggcgacaacgatcggctgaaacctccccctcagaatcacgacttaactcacagaaagagtccatccggcccagtcaagtctccgcctctctcccctgttggaacaacaccagttaagctcaagcgagccgcccctaaggaggaggccgaagctatgaacaacctgaagcctccccaagctaaacggaagattcaacacgtgacctggccttag

SEQ ID NO: 27852 - DNA, 489 bp, Artificial Sequence
  Description of Artificial Sequence: Synthetic coding sequence
atgggatctcatcccacaccggggctgcaaagaacgacatccgctggctatagactgccgcctaccaggccccccgcgagcgtcagccccgccgctcgcggcggaccgatggcgtcaaggggcctggcggggggttgtcaagcgccgcaagctcttaaggctcagagggtggcacaaggagcggcttgcgacggcgtgcagcaggaccagctgtggcgcgaactgcttgaagctgagaggcgtggccagcagaggtggatccagaattggagctttctcaaagattatgatccaatgggtaacaagaaagaaccagagaaactgccagaccacgtgcctttattctctgatactgtgccatcctctaccaaccaagtggtgggttctcggcttgataccccactggggcagaccctgatcagaatggactttttctttactgaaggtgctcgaaaaaaaaagctggaggatcagatgcaaccaatttag

SEQ ID NO: 27853 - DNA, 489 bp, Artificial Sequence
  Description of Artificial Sequence: Synthetic coding sequence
atgggaagtcaccccacgcctggcctccagcggacaacttccgccggctatcgtttgccacccacacgtccccctgcaagtgtcagccccgctgctagaggcggcccaatggccagccggggcttggccggtggctgccaggccccacaggctctcaaggcacagagggttgcacagggtgctgcctgcgacggcgtccagcaggaccagctctggcgagaattactggaggcagagcggagaggacaacagcgctggatccagaactggtctttcttaaaagactacgatcctatgggcaacaagaaggagccagaaaaactgccggaccacgtccctttattctcagacacagtgccaagttctactaatcaggttgtcggaagtcggctggacaccccccttggccagactctgatcaggatggatttcttcttcacggagggagcccggaagaaaaaactggaggaccagatgcagcctatttag

SEQ ID NO: 27854 - DNA, 1239 bp, Artificial Sequence
  Description of Artificial Sequence: Synthetic coding sequence
atgctccctcaaaataaggaccaggttctccctcagacctcagtgttgcccggccgaccgacatgggggttttcccagctggtggactcaagtccgcacaatctccagcctctgagtccacaccaggggcttcctccttctcagcccccattttctagtacccagagcaggaggccctcgagcccccctccagcctccccgagtcctggcttccagtttgggagctgcgactccaacagcgactttgctcctcatccctactctcccagcctgccctcaagcccaacattctttcaccagaattacctgagtcttcctcggccaagagcttctagccccagcaaccattggctatatccctccccccccctgacaccctctttcagcccatcacagcctcagaattcttcacttcctcacagcccttgtcagtcgccttctcaccccgaagaattgcactctagtactctgacttcacctgggccatcaccaccttctcaccggctgcacagcaatcgccagacttggcggtggcaccaataccgtgacacggggtcagggtctcccggagtggtagaacgatgtgtccctagcgagaaagacccagcccagtttagagatcccggggcactggcccaggcactggtagtccagctgggtcatagacgcattgcacacgatctgcgcctgctgcttttgcaacacctctggcttggacggacaggtcaggcccccgttgtggagtaccccatttgcctcgtgtgcctgcgtcctaggagtccatcctgccctctacctaggtaccgtacaggccctcgcctactggcgttcccacaactattaccatgtgtgcagggccaggaaagtgggcctttgcggatcggaataggctttggcctccggctgcctcaagggcaggctagagctctgcacctactgcctgagaaaaggccgaaggaagctggaccacagggcaaggccacgcaggcgtgcgggcatcaacttcctgcttcgcaaccgccagccgctcaggcccgggccgatccagtaccagggactccaagccagaccaggtcttttcggtctgcgggactccagtcccccaactcaccacggtgcttttctggcccaccaccgcgcgcccctaagcaagtgaccacttccctcaagccacggccctgtcccggcccaaagcgacctgtatctctggaactgattctgcagaagtcttccgtgtag

SEQ ID NO: 27855 - DNA, 897 bp, Artificial Sequence
  Description of Artificial Sequence: Synthetic coding sequence
atggataccggcgtgtgggggtggggtgcggccgcttgtcggtggggacccgctgaaagagccgctggaagcctgaatgcggcatcgttaagggaagaacagttacatctgagcttgttggttagttctgggtggaggacgatctcttttcacgtggtgcctgtcgtccgcagaaagttaggcgcccccgccttagaaggcgttcagcagatgcccggcttccccgagggcagcttgcggaggattctgtctcagggcgtcgacctggtgccagcttccgcccagttgtggcggactagcacagattaccttctgacccgcctcctaggcgaactgggctcactgcagggacataggttggacagcctctcaatactggaccgggtcaaccatgaatcctggagggatagcggccagactgacggcctgacatttggtcacctaaaaatggtcctcctgtgggcttctgtgctgttcctggcacccgaagactgggccgagctccagggcgcagtttacaggctgctggtagtcctgctgtgctgcctcgccacaaggaagcttccccacttcctgcacccgcagaggaacttgctgcagggtagcggcctggacctgggtgccatctaccaacgtgtggaggggttcgcgtctcagcccgaagctgccctccgcatccatgctacacacctaggtcgttctcccccacccaggattggaagcggactgaaagcactactccagcttcccgccagcgacccgacatactgggccacggcatacttcgacgtgctcctggacaaattccaggtgttcaatatccaggataaagatcggattagcgctatgcaatccatttttcagaaaactaggacgttgggcggggaggagagctag

SEQ ID NO: 27856 - DNA, 1344 bp, Artificial Sequence
  Description of Artificial Sequence: Synthetic coding sequence
atgcccgcaccagcactgcccacatcggcgatggctgtgcaggttcctctctggcaccattatctgcaggccatacgatccagggaggctcccagggcccaggactttcagcgtgccgagaacgtgctcctgacagtcctcgagcgcgtccatgccctcgatccgagatttatagtggattattccaggggtctggaagcattccagttcgcacttagaagcagcgaggatcctatggacatggaggtacccctgtgggtggatgcggaagctctgttaatagaggaacccgaggctacgcaacccgaagacggactggagttatgtcacctgggcgtcccacgggagggcgccggtctggaacgctggaccaccgaagacactttcaccgctagtagcgagggggatgccaaatgcaggggtcatatagtgccttcgaaggttctctgtgtgctaaaggacctcctggtagcggcaatagtccattgcaaacaccatagccttatagcaccgggctcattaaatgcagcgagtctaagggaagagcagctacatctgtccctccttgtgagcagtggatggcgaactatatcgtttcacgtggtgcccgtggttaggcgcaaactgggcgcccccgccctggaaggcgtccagcaaatgcccggtttccctgaggggtcgctgcggcggattctgagtcagggggtagacctggtgccagcctccgcccagctatggagaacctctactgattacctgctgactagactgttgggtgagttggggtccctacaggggcataggctcgatagtctgtcaatcctggatcgggtaaaccatgaaagctggagagatagtgggcagactgatgggctgacgttcgggcacctgaagatggtcctgttatgggcctctgtgctctttctggctccagaagattgggccgagctgcagggagccgtttatcgcctgctggtcgtgctcctgtgctgcctagccacacgcaagttacctcactttcttcaccctcagaggaacctgctacaggggagcggcttggacttgggcgctatttatcagcgcgtggaaggctttgcgagccagccggaggcagcactgaggattcatgccacacatctgggccggtcacctccaccccggattggttccggcttaaaagccctgctccaacttccagcatccgatcccacttattgggcaacagcatatttcgatgtcctgctggataaattccaagtgtttaacattcaggataaagatagaatctctgccatgcaatccatttttcagaaaactaggaccctcggaggggaggagtcctag

SEQ ID NO: 27857 - DNA, 840 bp, Artificial Sequence
  Description of Artificial Sequence: Synthetic coding sequence
atggatacaggatccctcaatgcagctagcctgagagaggaacagctgcacctgtcgctgctggtctcttccgggtggcggactatctcattccatgtcgtccccgtcgtgcgtagaaagctgggcgctcccgcgctggagggcgtccagcagatgccaggcttcccagagggctccctgaggaggattctgagtcagggtgtggacctggttccagcctccgcacagttatggaggacatccaccgactatcttctaacacgactcctgggggaactgggcagcttacaaggtcacaggcttgactccctgtcaatcttggaccgcgtgaatcatgaaagctggagggattccgggcagacggatggactgactttcggccacttgaagatggtcctcctgtgggcatctgtgttgtttctggccccggaggattgggcagaactgcagggggctgtgtatcggctcctcgtggtcctcctatgctgcctcgctacaagaaagctgccccattttttacacccccagagaaacttgctgcagggtagcggattggatcttggagcgatctaccagagggtggagggtttcgcaagtcagccggaagcagcccttagaatccacgctactcatctgggacgaagcccacccccccgcatcggctctggcctcaaagccctgctgcagctccctgctagcgatcccacttactgggccactgcctactttgacgtcctcctcgataagtttcaagtatttaatatccaggataaggacaggatcagtgccatgcagtctatcttccagaagactcgtactctagggggagaggagagctag

SEQ ID NO: 27858 - DNA, 402 bp, Artificial Sequence
  Description of Artificial Sequence: Synthetic coding sequence
atgcccgcacccgcccttcccaccagcgccatggcggtgcaggttcctctgtggcaccattatcttcaggccattagaagtcgagaagctcctcgcgctcaggatttccagagagctgaaaatgtgcttttgactgtgttggaaagggtacatgccctcgacccccgttttatagtcgattacagtaggggcctggaagccttccagttcgccctcagaagtagcgaggatcccatggatatggaggttccactatgggttgatgccgaggctctactgatcgaggaacctgaagccacacagcccgaggacggcctggagctctgtcacttgggcgtgccaagggagggtgccgggctcgaacggtggaccacagaggataccttcacggccagctcttag

SEQ ID NO: 27859 - DNA, 2889 bp, Artificial Sequence
  Description of Artificial Sequence: Synthetic coding sequence
atgatttcaacgagggtgatggatataaagctgagggaggccgcagaaggcctgggggaggactctacagggaagaaaaagagcaagttcaagacttttaagaaatttttcggtaaaaaaaagcgtaaggaatccccatcctctaccggatccagtacttggaagcagtcgcagacgcgcaatgaggtgatcgccatagaatctgggccggtaggatacgacagcgaggatgaactggaggaatctaggggtacactcgggtctcgggccctgtctcacgattctatctttatccccgaaagcggccaagacgccacccggcctgtgagagtgttctcccaggaaaatgtgtgtgataggatcaaggctctccagctgaagatccagtgtaacgttaagatgggaccacctccaccaccaggcggcttgcctgccaagcgaggggaggacgctggtatgagctctgaagatgatgggctgcctcgttcaccacccgagatgagtctgctgcacgacgtcgggcccggcacgacaataaaggtgagcgtggtgtcaccagatcatgtgagcgattctaccgtgtcagcccgtataagcgacaactcactggccccagtggccgacttttcatacccggcggagagctcctcctgcctggataatagcgccgccaagcataagctccaggtcaagccccgaaatcagcgctcatctaaaatgcggcggctgagttctcgggcacaaagtgaaagcctgagtgatttaacctgtaccccagaagaggaggagaacgaggagaaacctcttctggaagtgtcaccggaggaaagacccagctcgggacagcaggacgtagcccctgacagaggccctgagcccggcccccctgcccccttgccacctccgggcggcgcgcgagcccgaagagcccgactacaacattcatctgctctgacggcgtcagtggaagaggggggagtgccaggcgaagatcccagctcaagacccgcaactccagagctcgccgaacctgagtctgcgcccacactgcgcgtggagccacctagcccccctgaaggtccgcccaatcccggtcctgacggcggcaaacaggacggagaagcacctccagccgggccttgtgcacccgctacggacaaagccgaggaagtagtttgtgcaccagaggacgtcgctagcccgttccctaccgccatcccagagggtgatacaaccccccccgaaacggaccccgccgctaccagcgaagcaccctccgccagagacggccccgagaggtcagtccctaaggaggccgagcctacaccccccgtgctgcctgatgaagagaagggtcctcctgggcctgcacccgaacccgagcgggaagcagaaaccgaacctgaacgaggtgcaggtaccgaacccgaacggatcgggactgagcccagcacagcgccagccccatcacccccagctcctaagtcgtgcctgaagcataggcccgctgccgcgtctgaaggcccagctgcttcccctccactcgcagctgctgaatcaccaccagtggagcctgggccaggttcactggatgccgaggccgctgcccccgaaaggcctaaggcagagcgggccgaggcgccacctgctggagcagagcgcgctgctccggagaggaaagccgaaagggggggagctgagctcaggggggccaagaagttctccgtgtctagttgccgcgctcggcccaggccaggcgtctcccggccactggaaagggcttccggtcgactgcccctcgccaggtccgggcccgtgtggcgatctgaggcagctctggatgacctgcagggcctgccggagccacaacacgccaagccgggcccgagaaagctcgccgagcgcgggccccaggacagtggcgatagggctgcttccccagctgggccccggaagagcccccaagaggctgcagcggcccctggcacccgcgaaccctgccccgccgcccaggagccagctccttcagaggatcgcaatcctttcccagtgaagctgagatccacatcactctcgctgaagtaccgtgatggggcttcccaggaggtcaagggcgttaagagatactcagccgaggttagattggagcgatctctgaccgtactgccaaaagaggagaaatgtcctcttggcaccgcgcctgctctccggggaaccagagcaccctccgaccaagggaaagggaaagcgcgcccacctgagcctctgtcaagcaaaccccccctgccccgcaagccactccttcagtcattcacgctacctcatcagcccgcaccgcctgatgccgggcccggggagagagaacctaggaaagagccacggactgccgagaaacgaccactacgccggggtgctgagaaatctctgccccccgcagcaactggccccggggctgacggccaaccagctcctccttggatcactgtgacaagacagaaacgacgtgggacgttggatcagcctccaaatcaggaggacaaaccgggcgccaggaccctcaagtcagaacctggcaagcaggctaaagtgccagaacgaggtcaagagccagtcaaacaagctgatttcgtgagatccaaaagcttcctaattactcccgtaaaacccgctgtagatcggaagcagggcgccaaactgaacttcaaagaaggactgcaacggggaatcagtttgtctcaccagaatctcgcgcaatcagcagtgatgatggagaaagaactgcatcaactgaaacgggctagttatgccagtactgaccaacctagctggatggagctagcacgcaagaagtctcaagcctggtctgatatgccacagattatcaaatag

SEQ ID NO: 27860 - DNA, 1188 bp, Artificial Sequence
  Description of Artificial Sequence: Synthetic coding sequence
atggccctccccggctacccgctgggaaacgttgatgacagccgcagcaaagacagccctgcaggagaacctcagggacaggtgcctctgaccgccgatgtgctcgctgtcagttcaagcgtggcttccacagattggcaagatatcgaccaggccagcttcaagacagctacccctagagcaataagtactagtggagacaaggataagtctgctgtggtgccggaacacggccagaaaacacctagaaaaataacgccactgctgcccagccagaacccttctcctctacaggtgtccatgtccctgcaaaaccctgcctgggatcgacaggtgcaggatgctcggacatcccagtctcttgtggtgttccccagtcacctcctgggaaaagacaaaatgagccagatggccagtgtcccagaacgcgagcctgagagcgctccctcagccccgagtgccgagctccaatctacccagcatatggaggcccagcccgtggaatctgacgccgatcacgtgactgccggagcaaatggccagcatggaccacaggccgcgagtacaacaaaaagcgccgaggagaaggccgagcatcctaaggcgcctcaccctgaggcggaagctctgccctccgatgagagccccgtcgcaatgggagctaatgtagttgactcgttaggcgacctgcagacttggttctttccacccccgccagcaggatctgtgtctcccagccctggaccccatgaagtggctctcgggcgtaggcccctggacagttccttgtacactgccagtgaagagaattcctacatgcgctccatgaccagtctattggatagaggagagggctcaatctcttctttagcggatattttagtgtggtcagagaccacaatggggatggccatagctaccggctttctggacagcgggcatagcacagtggcggatttgctgcacagcagcggtccttctcttcgatctgtaccttcgctcgtcggatcggtgtcttccgccttctcatcggggctggtaagtggcacttcttctgcactgaggaccataacccgcgtgctggagactgtggagcagagaacggtggagggaataagatctgctatgcgctatttgacctcccatttgacaccgcggcaggcccaggccgaccccaattacgattag

SEQ ID NO: 27861 - DNA, 534 bp, Artificial Sequence
  Description of Artificial Sequence: Synthetic coding sequence
atggaccagcctgctgtggctacagcctcaacctctattagagaagacctggtgggaggtgagagtttcatcacggcttctaaacctgctcagaaaacatcctctttcgaacgagagggctggtggcgaatcgctctcaccgacacacctatcccaggcacttaccatcttaagacttttattgaggagagcctcctaaatccagtcattgccacgtacaactttaaaaatgagggcagaaagaagcctcctctcgtgcaacgaaataatccggtgctgaacgacctcccacagtatatgcctccagactttttagacctgctaaagaagcaagtcgctacatattccttcaaggacaagccccgtccaagcccctccactcttgtggataaagatcagtcactccaactgtcaccaggacaatataatgtcctgcccgctccggttccgaagtacgccagcagatcctgtgtatttcgcagcaccgtgcagagatttccaacgacatacttcattccagttagtataatgtag

SEQ ID NO: 27862 - DNA, 747 bp, Artificial Sequence
  Description of Artificial Sequence: Synthetic coding sequence
atggatcagcctgccgtggctaccgcctctactagtatcagagaagacctggtaggcggggagtctttcatcacagcttcaaaacccgcacagaaaacctcctcatttgaacgcgaaggttggtggcggattgccctgacggacacccctattccagggacttaccatctgaaaaccttcatcgaggaatctctgctgaatccggtgattgccacgtataactttaaaaatgaggggagaaaaaaaccccccttagtgcaacgtaataacccggtgcttaatgatctaccccaatacatgccgcccgattttctggacttactaaaaaaacaagtggctacttactcttttaaagataagcctaggccctctccctcaaccctcgttgataaggatcagagcctccagctgtcgccgggacagtataacgtgctacccgccccagtgcctaaatatgccagccgttcttgtgttttcagaagtaccgttcagagattcccaacgacatacttcatcccccacgagggtcctggaccaggacactataacgtaaagatgcccccaacctcctccgtgacctcatgttttcagtccagggtgccacgattccttccaagctgcagcaaaacccccggacccggcgcatatacaaccctacggcaattccctaaacagagccctactattgccaaaatgggccaggagcacagcctgttcttcaacaacaacaactggctattgaagtag

SEQ ID NO: 27863 - DNA, 1164 bp, Artificial Sequence
  Description of Artificial Sequence: Synthetic coding sequence
atgagctccaaggtgtactcaactgggtcacgagccaaggaccaccagccttcaggtcccgagtgcttgcccttacctgaggcaaacgcagaggccattgatttccttagctcactgcacaaggaggagttacagatgctgttcttttcagagactctcgcgatggtaagtgacacgggggagccccagggagagcttaccatcgaggtacagaggggaaaataccaggagaagcttggcatgctgacgtattgtctgttcgtgcacgcttcatcccgcgggttcctggataagatgctctgcggcaacagtcttctggggtatctgtcagaaaaactggaactgatggaacagcattcccaagattttattaaattcctgatcctgccgatggagagaaagatgagcttgctgaaacaggacgaccagctggccgtgacgcgctctattaaggaaggcgaggaagtgaaaacaggggttacctccttcccgtggtccagcattaaaggtttcatttccgaggccgccaacttagtgctcttgcgcgttatggcctggcgccgaatggttccttccaatgccagattcctcacactcgacacggaaggtaaactttgttacctcacatatcagaatctggggtttcaaaccatccaggttgatcaccagcaagctgaagttttcatcgtcgagcagacggtgcatgcagaggagggaatccctatgtcctgccagtactatttgttgagcgacggccatctcgccaaaagaatccaggtcggctccccaggctgctgtattattactaaaatgccaatcctgagggaggaggacgaaatagaacctcggcccgtgttcgaaaagaagcctctggtgtgggaagaagacatggaattatatagcaaattcctggaccggaaagaagaattgcgcctgggacacgcatcctatctgaggcagcatcccgaggcccacgccctaatctcagattttctgcttttcttgctcttaaggcagcccgaagacgtggtgacattcgctgccgagttctttggccccttcgacccatggaggccatcttccccagcattaggttcatcccacagaccgaacccattccgatctctcgaacccgagggggatgcgcggagtggagctgcctag

SEQ ID NO: 27864 - DNA, 1761 bp, Artificial Sequence
  Description of Artificial Sequence: Synthetic coding sequence
atgtcagtgcatcagattaggaagcacgctgttcttcctcccataatctgtagaagcgataaagaattccttgaaagtgttcagagatatataattaccgagacggagcgattaggctgttcagaggagggacccgcagacgagtattacataatttaccgcaacgtgttcgataaggtaatcgagcatatcacagcctataaaagcatcctcacatctatcaagaaagaatacgatgcatttatcgaaacaatcaagaaggatagacggaccaccttttgtctacacgggaagctaaaaggtttggcagccgaaccgacagctctggtgtattatcgaaagcggacaatccagctggaagccaagatgcgcatcatagagtctaactcatcaaagatccaatcccagatcgaccacatcaagcagtgcagagcagaatacgataccaaggaggtcaaatactgtaccttttctaaggacccttccaagcccattccaggaatgactctgcaggagtcgatgaatctggatgccctgactaaatatatgaagcacttggaagataagtacgctgaaattaagcaggctatgctgataaaatacgttccagcccagcgaaaggccgacctcgacgaggagatgatagtgttactgaaaagacgtgatgtagccgaaaatctcaacaagaaactacagttctgccaccaaagactgcagattatcagccaggccctgagctcttgggtgaagtcagatatgagctcccccttccaggacttcgtggaacagatccaaaagaccaaataccttcagggtgatcagggcatagtcgaggaacttatggaagacgacccaaggagggccaaggaggcggaaataatgcttcactacatcgagcggtttaatgagctgatctcattgggcgaatatgaaaaagctgcctgctatgccgctaactctccacgaagaatcttgcggaatatcggtacgatgaatacttttaaggcagttggaaaaatacgcggcaaaccgctgcccctcctgctgttctttgaagccctgttcattacatctcacgcatttccttgccctgtggatgctgccctgacactggaggggataaagtgcggcttaagcgaaaagcgccttgaccttgtgaccaactgggtgactcaggaaagactgactttttccgaggaggccggtgatgtcatttgcgattacggcgagcaggacacatataataaggccaaatgtctggctctggcccagatcgtgtacagcgagtgtggccttcataaaaaagccatcctatgtctctgtaaacagggccagacacatcgagtgatggaatacatccagcagctgaaagattttacaactgacgatctactacagctgctgatgtcctgtccacaagtagagctcattcagtgtctgacaaaggaactcaacgagaagcagccaagtctaagctttggcctggcaattctccatctgttctcagccgatatgaaaaaggtgggcataaaactgctgcaagagattaacaaagggggaattgatgccgtcgagtctttgatgatcaacgattcattctgttccatcgaaaaatggcaggaagtggcaaacatatgctcacagaacgggttcgacaaactttcaaacgatattacatccatactaaggagccaagccgccgtgaccgagatcagtgaagaagacgacgcggtgaacctgatggagcacgtgttctggtag

SEQ ID NO: 27865 - DNA, 141 bp, Artificial Sequence
  Description of Artificial Sequence: Synthetic coding sequence
atgagtgtgcaccaaattagaaaacacgccgtgctgccccccataatctgccgcagtgataaggagtttctagaaagcgtccagcgctatattattaccgagacagaacgcctggggtgtagcgaagagggtccagcttag

SEQ ID NO: 27866 - DNA, 414 bp, Artificial Sequence
  Description of Artificial Sequence: Synthetic coding sequence
atggagtacattcagcaattgaaggatttcaccaccgatgatctcttgcagttgttaatgagctgcccacaagtggagctgattcaatgcctgactaaagaactgaacgaaaagcagccttctctctcctttgggctggcgatcttacatctcttctcagctgacatgaagaaggtgggcataaaattgctacaagaaattaataaggggggtatcgatgccgtggagtctctgatgatcaatgattcattttgctcaattgagaagtggcaagaagtggccaacatctgctcccaaaatgggttcgacaagcttagcaacgacatcaccagcatcctgagaagtcaggctgctgtgactgaaatttccgaagaggatgacgccgtgaaccttatggaacatgtgttctggtag

SEQ ID NO: 27867 - DNA, 1761 bp, Artificial Sequence
  Description of Artificial Sequence: Synthetic coding sequence
atgtcggtgcatcagatcagaaaacacgcagtcctcccgcctatcatctgtcggagcgataaggaatttttggaatccgtccagcggtatatcataacagaaacggaaagactcggctgcagtgaagaaggccctgccgacgagtactacatcatatacagaaacgtattcgacaaggtcattgagcacattacggcttataagtccatccttacctcaatcaaaaaagaatacgatgcctttatcgaaaccataaaaaaggacagacgcacgacattctgccttcacggtaaactcaaaggcctcgcagccgagcccaccgccctcgtgtactatcgcaaacgaacgatacagctggaagcaaaaatgagaataatcgagtcaaactcgagcaaaatccagagccagattgatcacatcaagcaatgcagggcggagtatgataccaaggaggtaaagtattgcactttcagtaaagacccaagtaagccaatcccagggatgacactccaggaaagtatgaatttggatgcgctgactaaatatatgaaacacctcgaggacaagtatgcggagatcaagcaagctatgctgattaagtatgtgccagcccagcgcaaggctgacctggacgaagagatgatagtcttgttgaagcgacgtgatgtcgccgaaaacctcaacaagaaactgcaattctgtcatcaacgactgcaaatcatctcccaggccctgtcaagttgggtaaaaagcgacatgagcagtccgttccaggacttcgtagagcaaattcagaagacaaagtacctgcagggagatcaagggatcgtagaggaacttatggaggacgaccccagacgcgctaaggaagccgagatcatgctccattatattgaacgtttcaacgagctcatatctctgggcgagtatgagaaggccgcatgttacgccgccaatagtccccggcggattctccggaacattggtacaatgaatacctttaaagcggtggggaaaatcagaggtaagccattgcccttactcttattttttgaggctctgttcattactagccacgcattcccttgcccagtagacgctgctttgacattggagggaattaagtgtgggctgtctgagaaaaggcttgatttggtgacaaactgggtcacgcaggagcggttgaccttctcggaagaggcaggcgacgtgatctgcgattacggagaacaggacacatacaataaggccaagtgtctggctctggcccagatcgtgtactcagagtgtggcctgcataagaaagccatcttatgcctgtgtaaacagggccagactcacagggtgatggaatacattcagcagttgaaagactttactacggacgatctgcttcaactgttaatgtcctgcccgcaggtggaattaattcaatgtctaacaaaagagcttaacgagaagcagccctcacttagcttcggtctggcaattctgcacctattttctgcagatatgaaaaaggtggggattaagttactccaggaaatcaacaaagggggaatcgacgcagtagaaagtctgatgatcaatgacagtttttgtagtatagaaaaatggcaggaagtggctaacatctgtagtcagaacggttttgataagctcagcaacgatatcactagcattctgaggtcccaggctgccgtcaccgagattagcgaagaagatgatgcagtgaatcttatggaacacgtgttttggtag

SEQ ID NO: 27868 - DNA, 54 bp, Artificial Sequence
  Description of Artificial Sequence: Synthetic coding sequence
atgtctgtgcatcagatacggaagcacgccgtgctccctccaattatctgctag

SEQ ID NO: 27869 - DNA, 243 bp, Artificial Sequence
  Description of Artificial Sequence: Synthetic coding sequence
atgagtgtgcaccagatccgcaagcatgctgtgctgcctcccatcatctgtcggagtgataaggaatttctggaatccgttcagagatatataattactgaaaccgagcgcctaggatgttcagaggagggtcctgcagacgagtactacattatttacaggaatgtttttgataaggtgatcgagcacatcaccgcttacaagagcatcctgacatcaattaagaaagaatacgacgcatag

SEQ ID NO: 27870 - DNA, 501 bp, Artificial Sequence
  Description of Artificial Sequence: Synthetic coding sequence
atggaagccggcccgcaccctagacccggtcactgttgtaagcccggggggaggctcgacatgaatcatggttttgtgcaccacatcaggcggaatcaaatcgccagggacgactacgacaagaaggtgaagcaagccgccaaggagaaggttcggcggcgccacactcctgcccctaccaggcccaggaagcccgacctgcaagtctatctcccccgtcatcgtgacgttagcgcccaccctcggaatcccgactatgaggagagtggagaatctagctcctctggcggttccgaactggagcctagtggtcaccaactcttctgcttggaatacgaagctgacagcggcgaagttactagcgtgattgtgtatcagggagatgatccgggcaaagtaagcgaaaaagtgtccgcacatacccccctggatcccccgatgagggaagctttgaagttaaggatccaggaggaaatagcaaagcggcagtcccagcactag

SEQ ID NO: 27871 - DNA, 384 bp, Artificial Sequence
  Description of Artificial Sequence: Synthetic coding sequence
atggaagccgggccccacccgaggccaggccattgttgcaaacctggcggaaggcttgacatgaatcacggtttcgttcatcacataagacgaaaccagattgccagagacgactatgataagaaggtgaagcaagccgcaaaggagaaagttaggagacggcataccccagccccgacaagaccacggaaaccggacctgcaagtttatttgcctaggcaccgtggtgaagcagcacgccctgcttgcctgcagccagcccgcagctcctgtaatgctcttccctttagcataggaaagaatcattttctgctgcttcggttctccagcagcagactttttccagaacctcctcctcagagaagtcaaatctcggctgaatag

SEQ ID NO: 27872 - DNA, 606 bp, Artificial Sequence
  Description of Artificial Sequence: Synthetic coding sequence
atggcatcccgcagcgcggggacattgctaaccgagttcaacgccgcttacgttccaccgggcctgatgcccggataccagggccacgttccaactgtagccttttcatttggagctccatatggaaccaccactctgaaatactttcaggatcacagaaacagagctatggagaagtcgcatacccctttcagccagggcgggcacttccctactatcttcagcactaatccaaatctgttgctgatggaaagagcctcaaccagggacagatggcttcataaaccttcctacactagatttaacttagacagccaccgatccaccgaattaaccaatttctatcagatggtgcagcagcacagaaaatattaccaggacaagacagggactgtccccagagttccttattttgctatgccggtccgcgaacccgagcggtatccactgcccaccgtccttccccccctctgtccaaaaaaaaaatggcatctgttgaggctcgctccagagaacttaaagacctatcaaacatttccctcaggcaagcgggttagccctcaggaacgcaaaaagcgggactgctacttcgaattcagagcctag

SEQ ID NO: 27873 - DNA, 348 bp, Artificial Sequence
  Description of Artificial Sequence: Synthetic coding sequence
atgcaggtgatgaatttaaatgttcccatgcgcccagggatcttagtccagcgccagtccaaagaagtgctggcgacgcccctggagaatagacgtgatatggaagctgaggaggagaatcagatcaatgagaaacaggagcccgaaaacgcgggggagacgggacaggaggaggatgatggcttgcagaagatccatacaagcgtgacccgcaccccatctgtcgttgaatcccaaaaacgacctctgaagggtgtcacgttctcacgcgaggtcatagtcgtggatcttgggaacgaatatcctacaccgcgcagctatacccgagagcacaaggagcggaagtag

SEQ ID NO: 27874 - DNA, 585 bp, Artificial Sequence
  Description of Artificial Sequence: Synthetic coding sequence
atgagcctgttggcaaagccaatgagttttgaaactaccgcgatcacattttttatcatcttactgatctgtctcatctgcattttgctgttgctcgtggtcttcctgtataaatgcttccagggccgaaaaggaaaggaaaccaagaaagttccttgtaccgacgcgaatggaggcgtcgattgcgctgcagcaaaagtggtgaccagtaatccggaagatcacgagcgaatcttgatgcaggttatgaacctgaacgtgcctatgcgaccggggatcttggtgcaaaggcagtctaaagaggttctggctaccccgcttgaaaatcggagggacatggaggcagaggaggagaaccagatcaatgaaaagcaagagcccgagaacgccggcgagacaggacaagaagaggacgacggcctgcaaaaaatccacacctccgtcacgcgaaccccctctgtcgtcgagtcacaaaaacggcccctcaagggagttacattcagccgcgaagtgattgtggttgacttgggcaacgagtaccccacaccaagatcatatactcgggagcataaggagcggaaatag

SEQ ID NO: 27875 - DNA, 381 bp, Artificial Sequence
  Description of Artificial Sequence: Synthetic coding sequence
atggcccctggtgaggtaacaatcacagtgcggctgataaggagctttgagcatagaaactttaagcccgtggtgtaccatggcgttaacctggaccaaacagtcaaggagttcatagtctttctcaaacaggacatcccattaagaactaatctccctccccccttccgcaactataagtacgatgcactgaagatcatccatcaagcccacaaatccaagaccaacgaactggttcttagcctcgaggatgatgagaggctgcttctcaaagaggacagcaccctgaaagctgctggcattgctagtgagacggagatcgcttttttctgcgaagaagactacaagaattataaggcgaatccaatttcgagctggtag

SEQ ID NO: 27876 - DNA, 381 bp, Artificial Sequence
  Description of Artificial Sequence: Synthetic coding sequence
atggcaccaggagaagtgacgattaccgtccggctgatccgctcatttgaacatagaaattttaaacccgtggtctatcacggcgtcaacttggatcagactgtgaaggagttcatagtgtttctgaaacaggatattcctctccggacgaacctgccaccccccttccgaaactacaagtacgatgccctcaaaatcatccatcaggctcacaagagcaaaacaaacgaactggtgctaagcttggaagacgatgaacggttgttgctgaaggaagacagcacgcttaaggccgccggaattgcttctgagacggagattgcatttttctgtgaggaagactataagaactacaaagccaacccaatcagcagctggtag

SEQ ID NO: 27877 - DNA, 381 bp, Artificial Sequence
  Description of Artificial Sequence: Synthetic coding sequence
atggcacccggagaggtgacgattaccgtcagactgatcagatcttttgagcatcggaattttaagccggtggtgtaccacggcgtgaacctggaccagaccgtgaaggaattcattgtctttctcaagcaagatataccacttcgtacaaaccttccacccccgttccgtaactacaaatacgacgccctgaagattatccaccaggcccacaagagtaaaactaatgaactcgttctgagcctggaggacgacgaacgccttttgttgaaggaagactctactctgaaagcggccggaatcgcctccgaaacggagatcgcctttttttgcgaggaagactacaagaactataaggctaatcccatcagctcctggtag

SEQ ID NO: 27878 - DNA, 381 bp, Artificial Sequence
  Description of Artificial Sequence: Synthetic coding sequence
atggcccctggggaggtcacaatcaccgtcaggctgatccggtcctttgaacaccgcaatttcaagccagtagtgtatcatggggttaacctggatcaaacggtaaaagagtttatcgtcttcttaaagcaagatattcccttgcgaactaatctgccaccccccttccggaactacaagtacgacgctctgaagattatacaccaggcacacaaaagtaaaacaaatgaactggtcctctccctcgaagacgatgagcggctgctcctaaaggaggactccaccttaaaggctgctgggatcgcaagcgaaactgagatagcttttttttgcgaagaggattacaagaactacaaggccaatccaatttcaagctggtag

SEQ ID NO: 27879 - DNA, 1659 bp, Artificial Sequence
  Description of Artificial Sequence: Synthetic coding sequence
atggatacctcatccgagatgttagtgcgttttggacgaagatgcggacgtgccaaggagagcacagagattaggaactctgaagaagatcaggtgctttaccttcccctgttgcccagcaaagtcgaccttcagcaggtgacaatcataccccacgacgagtggaagaggatccaggattcactggaccgtttgacgagagaggccgcctgtctgagggccgagcgcaaagcaaagaaggaaatgcatctgaggtcccaggaggtcgtgaagcattggaccaacacctacgcaggaatgaaagaacagaagttagaagccaagaagaagagggatgaagagattgaggcggaaaggcagatcctcgatttggaagaagagatctacaagcagggaaaacggaaaaaggccatcgaaaacgccaagcaataccagttctatcagaccgagcgggttaagaacttccattcaggtctcctgctgtcccgagtgatgaaggagagggacgctcagatcgaatttaggaaaagtaagattaagtctgacaaaaaatgggaagaacagctaaagctgaacatcgagaaagcttttaaagaggagcaggagaaagctgagaagagacacagagagcgcgtggcgctggccaaggaccatctcaaacagataaaggagcacgaagaagaggaggagcgccgcaagaagtacgaggaaaaggatgcagaagaaatcaagcgccagaatgctctctacgaaatcgagatgcgcaagaagctggaaaagaaacgggaagagatgcatgagtcccgccgccggttcctggaacacatgcaggacaaacatattatcaaagccgtggagcagcagcagcaggaagaggaggatgaaaaaatgaggaaattcatcaaggctaagaaacgcctgattcaaatggggaaagagaaagaggcagagacacaccgcctaatggagaaaagacgcgaacgcattcataattttttaagcgagttgctgaaggagaagctcgacaacgaggatatgattatcgccagagatatcgccgaggcggaggctgaatgggagaaacgtgaacgtgagaaggatgaaaaaaacaaggcagaactaaaaactatcgccgagtaccgcgccattgtgatgaaaaacaaagaggaagaagagcggcagagaaagatcgaagctaaagagcagctcctggctgtaatgaaggccgatcagattttctgggagcacgagaaagagaaaaaatgcaaagccgataaggaacaccaggaagtgcaggatgcccatatccaacaaatggccaaaaacaaatttaatgctaaacaggccaagcaggctgagctggactactgcaggctgacagaggctctggttgccgaaaaggagaaggaatttcaggactatgcccgggaggtcatagagttggaaagcgagactactaacaaatatatctatccgcttgtgaaggccgtgcaagaggggcccggtggtgggcgcggccccgtgtttgttgataggggaggcctgagaccctcatatcaggctaatgacgttaccggggtgcagctacctttttataatagtcaggggcccaagtacaatttccagaagagcaaacgacgcctaggcttcacttggtag

SEQ ID NO: 27880 - DNA, 2679 bp, Artificial Sequence
  Description of Artificial Sequence: Synthetic coding sequence
atgcactggctggccagcgcaacacagaccagcgcgtctatcgtgagctcgtccttgttgtcagcagtggatgtcagcagttccttaaccatgtccgagtacttccaaaatacaagccttccgggaacagctaattcccgccagttttccctcccagttgtgtccaacgccgcctttttaacggggtccatctccaacttcagccgagccagcgcaccggctatctcatccgcctggctgcagccttctgcctctggcaccagttttcaaccactcatggggtctgcctacctgtaccagcattcttcaacgaccatgcttagcggcgtaactggacaatcccacatctgcacatctgcagcttcatacccaggggtcttcgagtgggactctacagcgagcaccgtgaagaagtcttcaagtctcagagacttcacagttaccgtgattgatcaaaataccgccgtgtcaagtatgagcatgaccgcccagtactataaaacctcggatacaaataccatggttcccttgtacccttctctgagcgcaagtcttgtccaggggacactcactcaaatccctaaccaacaaggccacaacctgtccctgccttgccagataggctcgcaagtgtattattacaaccagggcactctggggcctcagttgtcgtgcctgcaaagctacggttcggtgtcttacactgggtatcgcgcttcagcccaccagccagagatggtgatggtcttaaaggaggtacagcctacaaacgtattgccccccgtgtcaacaagcgggatgtattattcagtgagcagccagcccatcaccgagaccagcgttcaagtgatggagacctcactgggaatggacacctccctgggtttacagtcacctagtcaaacattctgccttccgcagaccccagagttttcaaagtcctttagcagtagaaatactcagactctcgagagtaatccctcacctgagctgggcgatatcagtattacacccgtccagagccccaccaatctgcttacactgtcaccggcaccctctcaagaaaagaacgaaaatgaaaatctcgatgagatcaaaactaatttgagtcgcaaccaggacccgcctctgctgccagtcgagattccagacatccatccactgctggcatgcatagacccgctgggccaggaggagcagcccggcagcgaaaacgccaatctgagaaacaagtctctttctctagaagaccagggcatcttcgaaaatgggatagagagctcatctgacctagccgatatcacgacctgggtcgaagatacatatttgcccccgatcttctcatcgttacaggatctggaccaacccgaaaagagctgtgttataaagggtcattccgatcaggtgaggaagaacaagcacaaggctagtgagcctatacagggggcccccaaagccaagattcagcccaagaaccctgaatgcctgctggagagagaggtcgtagttggaagcgcaacagtgtctaatagcgcctccgtgaacaaggccaaacattctagcaacaaaccacacaaggccgcgtcctcaagaattagcaagaccaaatcccacggtcaggaaaagacaaaaggaaacagaaagaacagttcaaagaaatcagaggagagcaaacaatcgggcaaaaaggtcaaagtggaagaaaaacaaaccatccccaacatgaagcgcaaaaagaatcaacctgaattatctcagaagaccctgaagaagcctcgcagtagtttgggtatgcacatgctggagtctgtgcaagtttttcacgcactgggcaaaaagattgatatgaagaccggtttcagctcatccaggacactggggtcttccagcaatacgcagaatcgccaaccctttcccgccttgaagccctggctcgatattcaacatgaaggaaagggccctgagaagatccaggttaaggcccagaaattggatggatctgcggaaaaggagtgcacttctccctctcattcagagttgccgccccctggcaaagtgaagttaattcccctgccctttcttacactggatcagcctcaagctcgacacgtttcccgcaggccgaaccccttggctagccggcgaccagccgtggcataccccgctcgccctgacagcacgaactcagcccaaagtaacgcagttaatccctcacggcctgcccccacaaacacatccctgaccggacctgccactcctgcccagccaataagcgccaaggctacacagccttcaagcgcaaatccaacgcagccaacagtgccccaatccgcagcctcacgtccttccgcgtacaaaacctccagctgctcttcactgcaaagagagcccgtctcgacggcagtgacctcactgcgctctctccctaagcctcagaaccagtttctcattcaggatttttcactgcaacctagaccttggcggaagccaactgttcctgagcccgtcatgtccacacctatcactgaggagcaaaggcctgagagggaggccatgaagaggaaggcccagcaggaacgcgagaatgccgcaaagtatacctcactggggaaagtacagttcttcatcgagagagagagggacatggagatcgccgaatattacggatacaccatctag

SEQ ID NO: 27881 - DNA, 2769 bp, Artificial Sequence
  Description of Artificial Sequence: Synthetic coding sequence
atgcactggctggccagtgcaactcaaacttctgcatcaattgtatcttctagtctgctctccgcagtcgacgtctctagctccctcaccatgagcgagtactttcagaatacaagcctgcctggcacggcgaactcccggcaattcagcctgcctgtggtgagcaatgcagcatttctcaccggctcaattagtaatttctctagggcgtccgctccagcaatctcctctgcgtggttacaaccttctgcaagcgggacatccttccagcctcttatgggatcagcttatctttatcaacatagttccacaactatgctaagcggcgtcaccgggcaatcgcacatctgcacaagcgctgcaagttatcccggggtgttcgagtgggactctaccgcatccacagtgaaaaaatccagcagcctgcgagactttactgtcaccgttatagaccagaacacagcggtctcctctatgtccatgactgctcagtactataagacatcagataccaacaccatggttccactatacccgtcattgagcgcgtcactggtccagggcaccctcacacagatccctaaccagcagggccacaacctttctttgccgtgccagattggctctcaggtttactactacaaccaggggaccctgggtcctcagctgtcctgcctgcagtcatacggatcagtgtcttatacaggatacagggcaagcgcccatcagcctgagatggtaatggtccttaaggaggttcagcccacgaatgtgttgcctcccgtgtccacttctggcatgtactactcagtttctagccaacctatcactgagacatcagtccaggttatggagacatccctcggaatggacacgtccttgggtttgcagagcccaagccagactttttgtctgccccagactccagagttttcgaaatccttcagtagcagaaacacccaaacacttgagtccaatccaagtcccgagctcggagacatttcaattacccccgtgcagagtccaacaaacctcctcacattgagtcctgcacctagtcaggagaagaacgaaaacgagaacctggacgaaatcaagactaatttgtctaaaccgttggatgtgcaccagatcctgataggcaaccaggaccccccactgcttcccgtggaaattccagatatacaccctttgttagcttgtatagatccactgggtcaggaggagcaacccggatccgaaaacgctaaccttcgaaataagtctctttcccttgaggaccaagggattttcgaaaatggaatcgagtcatcgtccgacctggccgacatcaccacctgggtagaggatacctatcttcccccgatattctcctcattacaggatctcgatcaacccgagagccccagcgcaaaaaaggctaaagatacctccgccattaaggtaaaccaagtgcaggaaaagagttgcgtgattaaagggcacagcgaccaagtgcgcaagaacaaacataaagcatcagagcctattcagggggcccctaaagcgaagatccagccgaaaaaccctgagtgcctccttgaaagggaggtggtagtgggaagtgctacagtgtctaactcagccagcgttaataaggccaagcacagtagcaacaaaccgcacaaggctgcctccagccgtatttcaaaaactaagtcccatggccaggagaagacgaagggcaaccgcaaaaactcctcaaagaaatctgaggagtcaaagcaaagcggcaagaaagtaaaagtggaggaaaaacaaacaatccctaatatgaagcggaagaagaaccagccagaactgtcgcagaagactctgaagaaacccagatcatctctcggcatgcatatgcttgaaagcgtccaggtttttcatgcactcggaaaaaagatcgatatgaaaaccggcttcagtagttctaggactctggggagttcctcaaacacccagaaccggcaaccatttccagcccttaaaccttggctggacatacagcatgaagggaaaggcccggagaaaattcaggtaaaagctcagaaactggatggcagcgccgagaaagaatgtaccagcccatctcacagcgaattgcccccccccggaaaggtcaaacttattcctctcccattcctgacacttgatcagccacaggcgcgccatgtgtccaggaggcccaaccctctggccagccgtcgaccagccgtggcctatcccgctcgacccgattcgaccaactctgcgcagagcaacgctgtgaaccctagcaggcccgctcccaccaatacgtcactgactggtccggcaacacctgcgcagccaatatccgcaaaggccacacagcctagtagtgctaacccgacacagcctacagttcctcagagtgccgcctccagaccttcagcttacaagactagttcctgctcaagtttgcagcgtgaaccagtctcaaccgcggttacgtctctgaggtctctgcctaagccacaaaatcagttcctgatccaggacttctcacttcagccgagaccctggaggaagcccacagtgccggaaccggtgatgtcaacacctatcactgaggagcagagaccagagagggaggcaatgaaaagaaaggctcagcaggagagagaaaatgctgccaagtatacttctttaggcaaggtgcagtttttcattgagcgggagagggacatggagatcgccgagtattacggatacacaatctag

SEQ ID NO: 27882 - DNA, 582 bp, Artificial Sequence
  Description of Artificial Sequence: Synthetic coding sequence
atggagcgccgcttaattaagaaggaaatgaaaaaactcctgggcgattacataggcatccggctacgcgagaacgaatttgatccaaagggacggagacagctcaccttcctggacgatatggcccactatgatctagcaatttccgtggcactgcagtggctggatccgagcgaagaccttacgtggctggagtgggaggaattgaagatcccgctgcacggacgccccatctatcctaaccgcagagaacgggaagccatgatcctaagctcgtatgcaggcattttaatgaatagcatccctatcgaggaagtctttaaaatctatggtgccgacagttctgcggattctggcactatcaaggttcctcgcgtgtccagcctgtgcctctccctgcaccctttcgccatgctgaccgctcctaaggctgctgcctatgccaggaagcagagtgttaaatcgaggaaagttactaccaacaaaaatgctacttccattagcgctaaggaggccaacgccaccgagtggaaatccagccagaggttctccgacacacagcccaagcataaagtgacatag

SEQ ID NO: 27883 - DNA, 201 bp, Artificial Sequence
  Description of Artificial Sequence: Synthetic coding sequence
atggagcgaagactgatcaagaaggagatgaagaagctgctcggagactatattggcattcgtctgagagaaaatgagtttgaccccaagggccgcaggcagctgacattcctggatgacatggcccactatgacttagccatctcagttgcactgcagtggctcgacccatctgaggatctgacctggttagaatggtag

SEQ ID NO: 27884 - DNA, 1767 bp, Artificial Sequence
  Description of Artificial Sequence: Synthetic coding sequence
atggagatgcagagtcccattgtgcaacgacaagagaggcaggttcgcgaccggggagtaactcggtctaaagccgagaaagtgaggcctcccacagtccccgttcctcaggttgatatagtgccggggagactcagcgaagctgagtggatggccctcacagcacttgaggaaggcgaggatgtcgtaggcgatattctcgccgacctcctcgcccgggtgatggactctgcttttaaggtgtatctgactcaacagtgtatcccttttacaatcagtcaagccagggaagcgatgctgcagattactgagtggaggtttctggctcgcgatgagggggaaagcgcagtggccgaagatccaacctggggcgaagacgaagagccatcagcgtgtaccacagatagttgggcacagggctccgtccctgtcttacacgcttcaacatcagagggccttgagaatttccaaggtgaagatcctggaggtgtggatcggattcccctcgggcggagctggatgggaaggggctcacaagaacagatggaatcctgggagccaagcccacagctgcgcgtaacttctgctcccccccccacatctgaactgttccaggaagccggacccggggggccagtcgaagaagccgacggccaaagccgcggcctgagcagcgcaggatcactgtctgctagttttcagctcagcgtggaagaagccccagccgacgatgctgacccgtccttggacccatacttagtggcttctcctcaggccagtactggacgtggccacccactcgggtttcacctgtctcttgaggatttatattgctgcatgccacagctggatgctgctggagaccgactggagctgagaagcgagggggtcccatgtattgcgtcaggggtgctggtctcctatcccagtgtgggcggcgccacccgtccatccgctagctgtcagcaacagcgtgcaggacacagcgatgtgcgattgagcgcccaccaccataggatgcggaggaaggccgctgttaaaagactggacccagcaaggctgccatgtcattgggtgcgacccctcgcagaggtgctggtacctgattcacagacccgccctctggaggcctaccgcggccgccagagaggcgagaaaactaaggccagggccgagccccaagccctcggacccggcacccgcgtctctcctgccgccttctttcccctacggccaggcatcccctttcgcgacttggattccggtccagcacttttgttccctactctgaacctcgggctgtcttctccttctttggaaagcaagttaccgctgcctaactcgaggatacgatttcttactactcaccctgtcctacctgatgtggctcggtcacgctcccccaagctgtggccaagcgttcgatggccaagcggatgggaaggtaaagctgagctcttgggcgagctctgggctggcagaaccagggtgcccccgcaagggttagaactggctgaccgcgaggggcaagatcccggccggtggccaaggaccacaccacccgtgttagaggcaacgtctcaggttatgtggaagcccgtcctgctccctgaggcactcaagctcgccccaggcgtaagcatgtggaatcggagcactcaagtgctgctgtcttctggcgtccctgagcaagaggataaagagggctcaacattcccccccgtagaacagcatcccatacaaactggagctcctaagcccagatag

SEQ ID NO: 27885 - DNA, 63 bp, Artificial Sequence
  Description of Artificial Sequence: Synthetic coding sequence
atggcaagctgtctggccctccgtatggccctcctcctggtgtcgggtgttctggccccctag

SEQ ID NO: 27886 - DNA, 453 bp, Artificial Sequence
  Description of Artificial Sequence: Synthetic coding sequence
atggaggactacgccttaacgtttggcatcaaccctttcatcgcactcatgatccaacctatagtcacaatgaccgtcgtggacaatcagggtctgggtttacccgtggacattcagcacaaggctaaaccctcccccaaggcctctcagatgctgccacccgacctggggcctcctagtttccagaatctgctgagcccctcagaaaaactggaaccatgggatcccggaatgagaaagctgacggtccagacctgtggtcttacttttatacatccagcgggacacgggctgtgccaccccactgctgaggcatcagccgaaactctgtcctcaacagccttgaaccggcctagtgtgagggaaggggcctgcaatgagaagagcactgaaaataaaaaaccccaggattctgtcctgtggtctcacagcagatggttccaagggaattag

SEQ ID NO: 27887 - DNA, 291 bp, Artificial Sequence
  Description of Artificial Sequence: Synthetic coding sequence
atggaggactatgctctcaccttcgggatcaatccgttcatcgcactcatgatccaacccatcgtgacaatgacagtcgtcgataaccagggactgggccttcctgtggacatacagcataaggctaaaccgagtccaaaagcctcgcagatgcttcccccagatctggggcctccttccttccaaaattgtttcacgtgtagaactgccccctctcttgttatggtgctgagctggaaaagcggagtccgcagggaggttcccgtgcacccttcatacgccaaatactag

SEQ ID NO: 27888 - DNA, 621 bp, Artificial Sequence
  Description of Artificial Sequence: Synthetic coding sequence
atggctgctaccaagactgctagctacgatgagcacttcagaccagagaagttacgggaatggcccgagcctgaatctgtgagtttgatggaagtgcttgccagagaggacattgacgaggctgtctgcgccatcttgtttaaagagaattctatagtaaaagttaccgtgccgccgtttgtcgacccactatttcaaagacagcaagaagttgatgaggaaagacgcaccgggctgcagtgtgaaaccggaaaacgccacagcattaaggaactggaagagattgagaaggcccgattgcacgcgtccagcccatactttacttttaccagccattgcgtgatccctaaggagtggcacaaagcttctgcacgggccagatccaagacttacaaatacagtccggagaagcttatctacgccgacaagaagcagaaaaggaaagagaagaagacagcagatctatcacaggctgcatttgagcgccagtttctgtcttctaagctgtcccaaaaaaataaagtgggcgagcggaagggactcgtgtctaggggcctgggcaggggctggcacgctggtctgtgcagtacgcacgaacaacatatactggtgcctgagtag

SEQ ID NO: 27889 - DNA, 288 bp, Artificial Sequence
  Description of Artificial Sequence: Synthetic coding sequence
atgggctgcatgaagagtaagcagacgtttcccttcccaacaatctacgaaggagaaaagcaacatgaaagcgaagagcccttcatgcccgaagaaaggtgcctgccacgcatggcatcccctgtgaatgtcaaggaggaagtcaaagagccacctggtaccaatacagtgattcttgagtacgctcaccgattgagccaggacatcctatgcgacgccttgcagcagtgggcttgcaataacatcaaataccacgatatcccatatatcgaatccgaaggaccttag

SEQ ID NO: 27890 - DNA, 288 bp, Artificial Sequence
  Description of Artificial Sequence: Synthetic coding sequence
atgggttgtatgaaatctaagcagactttcccctttcctactatttatgagggcgagaagcaacatgaaagtgaagaacccttcatgcccgaggaaaggtgtctccctcgaatggccagccctgtcaacgtcaaggaggaggtgaaagagcctccgggtactaacaccgttattctcgaatacgcgcaccggctgagccaggatattttgtgcgatgccctgcagcagtgggcatgtaataacatcaagtaccatgacattccctatattgaatccgaaggaccttag

SEQ ID NO: 27891 - DNA, 204 bp, Artificial Sequence
  Description of Artificial Sequence: Synthetic coding sequence
atgggctgtatgaagtccaaacagaccttcccttttccaactatttacgagggtgagaagcagcacgagagcgaagaacccttcatgccagaggaacgatgtctgccacgcatggcctctccagtcaatgtgaaggaagaggttaaagagccacctggaaccaacaccgtgattctggagtacgcccacaggctctctcagtag

SEQ ID NO: 27892 - DNA, 288 bp, Artificial Sequence
  Description of Artificial Sequence: Synthetic coding sequence
atggggtgtatgaaaagcaaacagacatttccgtttcccaccatctacgagggggagaagcagcacgaatccgaggagccttttatgccagaggagagatgtttaccgcgaatggccagccccgtcaatgtgaaggaagaggtcaaagagccccccggcacaaatacagtgatcctcgaatacgcgcaccgcctcagtcaagatatcctgtgtgacgccctgcaacagtgggcttgtaataatattaagtatcatgatataccctacatagagtctgaaggcccgtag

SEQ ID NO: 27893 - DNA, 288 bp, Artificial Sequence
  Description of Artificial Sequence: Synthetic coding sequence
atgggctgtatgaagtctaagcagacatttccctttcctactatatacgaaggcgagaaacagcatgagtcagaagaacctttcatgcctgaagaaaggtgcctacctcgcatggcctccccggtgaacgtcaaagaagaggtcaaggaaccaccagggaccaacacagttattctggaatatgctcacagacttagccaggacattctgtgcgatgccctccagcagtgggcatgcaataatattaaataccacgatattccatacatcgagagtgaggggccctag

SEQ ID NO: 27894 - DNA, 93 bp, Artificial Sequence
  Description of Artificial Sequence: Synthetic coding sequence
atgggctgtatgaaatctaagcagacattccccttccctacaatttacgaaggggaaaagcagcacgaaagtgaagaaccgttcatgccatag

SEQ ID NO: 27895 - DNA, 396 bp, Artificial Sequence
  Description of Artificial Sequence: Synthetic coding sequence
atggtgaggatgtccaggcccctctttctggactgggcctggcggcccttgtgctcaccctcccagagtctccccctaacctatggcccagagggttggatactgcagtggaagggcacgtgcagacaacaaactgcactgcattgtccgtttgactttcctcaggctcccttgcgagggaggcatacactgtcacaggtgcccaataagggccatgaaaaagccagtgcggtgcaactgccggaaaaacaagggaccgatcagtctcggagaggtcctacaagtgcagtcaccaaagctcgcacctcttacccagaatcggagaccttcatagtatacctttgtagctatttctggaatagcagtaaaggcgtttacatgtcgggatcaacttag

SEQ ID NO: 27896 - DNA, 879 bp, Artificial Sequence
  Description of Artificial Sequence: Synthetic coding sequence
atgaaaagcgaggccaaggacggagaggaagagtctctgcaaacggctttcaagaaactgcgcgttgacgcatcaggatccgtggcgtcattatctgttggagaaggcacgggagtgcgagctcctgtgcggactgccaccgatgacacaaaacccaaaaccacgtgtgctagtaaggatagctggcacggatcaacccgaaagagcagccgcggtgcagtaagaacccagaggagacgccgttccaagagccctgtgctgcacccccccaagtttatccactgctccaccattgcaagcagcagctcttcgcagttgaagcataaatctcagacggacagcccggacggctcttctggcctaggcattagcagtcctaaagaattttctgccggcgagagtagtacttccctggatgctaaccataccggtgccgtcgtcgagcccttgcgaacctctgtgcccagactgccctccgagtctaagaaggaagacagttccgacgctacccaagtgcctcaagcctctctaaaagccagcgatctcagtgactttcagagcgtgtcaaaactcaatcagggcaaaccatgcacctgtatcggcaaggagtgccagtgtaagcggtggcatgacatggaagtgtactccttctccggcttgcaatccgtaccgccgctggcgcccgagcggcggtcaactctcgaagactatagccaatcactccacgcccggacactgtcgggctcaccccgaagttgcagtgaacaggcgcgcgtgtttgtggacgacgtgacgattgaggacctgagcggctacatggagtattacttgtatattcccaaaaagatgagccacatggctgaaatgatgtatacttag

SEQ ID NO: 27897 - DNA, 879 bp, Artificial Sequence
  Description of Artificial Sequence: Synthetic coding sequence
atgaaatcggaggcaaaggacggagaggaagagtccttgcagaccgcgtttaagaagctacgcgtggacgcctccggcagcgtggcctccctctccgtcggggaaggcactggagtgcgcgcgcccgtgaggactgccactgatgatacgaagccaaagactacctgcgcatcaaaggatagttggcacggaagcacccgcaaatcatccaggggtgcggtccgcactcaacgccgccgtcgctctaagagccctgttctgcatcctccaaaattcatacactgtagtacaatcgctagcagctcatcctctcagttgaagcacaaatctcagacagacagccctgatggatcttccggacttgggatttcctcgcctaaggagtttagtgctggcgagtcaagcacctcgctggatgccaaccacactggtgcggtggtggaacccctgcgaacaagtgtgccaagactgcccagcgagtccaagaaagaagatagctccgacgccacacaggttccccaagcgtctcttaaggcctccgatctgagcgattttcaatccgtgtccaaattgaaccaaggtaaaccatgcacctgcataggcaaggagtgccaatgcaaaagatggcatgacatggaagtgtactcgttttcaggactccagagcgtgcccccgctggcccctgagagaaggagtaccctggaagactactctcagtccttgcatgccagaactctaagtggatctccccggtcctgctctgagcaggcacgcgttttcgtcgacgatgtgactatcgaagacctcagtggctacatggagtactacctctacattcccaagaagatgtcccacatggcagagatgatgtatacctag

SEQ ID NO: 27898 - DNA, 528 bp, Artificial Sequence
  Description of Artificial Sequence: Synthetic coding sequence
atgggacaggtggtatatgtacctgtcaagactggcagcggggctgatggtctgtctgaacctgagggaataagtttaaagagagtcgctgtagttgaagacttttttgatatcatctacagcatgcacgtggaaagttccgcagaaccaggcaaggctcctaagcacgcgggtcagaagaagacgtaccgggctattgcggagacctacgcctttcttcctagggaggcggtcacacgatttctgatgagctgtactgagtgccagaagagaatgcacttcaattccaacgggctggaacctaaagaaaacgagccaccatctcccctggtctctggaatcattgattacaatatgccactcacctccacttatctgaagcagatgaagctgcgcgttatgaattcccaggagcagtgcctgccatctggagcggaagatattatgtctggggggcccacgttagaggccgccgagtttgatgacctgattggaaagtgtctgccagaccgccctattgcagaatag

SEQ ID NO: 27899 - DNA, 276 bp, Artificial Sequence
  Description of Artificial Sequence: Synthetic coding sequence
atgagcgacagcacttggatgtccgccgatcctcacctggctagcagcctgtccccttcccaggatgagagaatgcggtcaccacaaaacctgcacagtcaggaggatggccctcacagattatcacatttgagtcaggggttaaatatcatctgcagtcttgacacatccctgcgagctcgcaatccacgcgtgtctgccgagagaaacgacttctctttcagaggccgctctaggtgtgttacctctaactccctagcaaaggatgggtactag

SEQ ID NO: 27900 - DNA, 1311 bp, Artificial Sequence
  Description of Artificial Sequence: Synthetic coding sequence
atgtcggattcgacatggatgtccgcagacccccatttagcctcaagtctgagcccaagtcaggacgagcgaatgcggtccccccagaacctccactctcaggaggacgatgatagctcatccgaatccgggtccggaaatggcagttctacacttaatccttctacctccagcagcacacagggtgatcctgcatttcccgagatgaacggcaacggagcggtggcgccgatggatttcactacagctgccgaggatcaaccaatcaatctatgcgataagttgccacctgccaccgctctgggaacagcaagctatccttctgatgggtgcggagcagatggactgcggtctcgcgtgaagtacggggtcaagacaaccccagaaagtccgccctacagttctggttcctatgactctatcaagaccgaagtgagtgggtgtccagaagacctcacggtggggcgcgctccaaccgccgacgatgatgatgacgatcacgacgatcatgaggacaatgataagatgaatgactctgaaggcatggatccagagaggctgaaggcgttcaatatgtttgttagactttttgtggatgagaaccttgatcgaatggtacccattagtaagcagcctaaggagaaaatacaggcaatcattgagagctgcagcaggcagtttccagagtttcaggagagggccagaaaaaggataagaacatatctgaaatcctgtcgccgcatgaaaaaaaatggcatggaaatgacacgccccacacctccacatcttacatccgccatggcagagaatattctggcggccgcttgcgagtcagaaaccaggaaagccgccaagcggatgcgcctcgagatttaccaaagctcacaggatgaaccaattgccttggataagcagcattcccgggactcggccgctattacacactccacttattcgctgccggcgagcagctatagccaagatccagtctatgccaacggcgggctgaactatagctaccgcgggtacggcgccctgagctcgaatttacagccccccgctagcttgcaaacaggaaaccatagcaacggcccaaccgatttaagtatgaaaggtggcgcctctacaacctctaccacgccaacccctaccccttcatctacctccacgtcccgccccgtgcccactgcacaactgtctccaacagaaatatcagcagtgcggcagctcatcgccggttacagggagtccgctgcatttcttcttaggagcgcagatgagcttgaaaatttgattctgcagcagaattag

SEQ ID NO: 27901 - DNA, 246 bp, Artificial Sequence
  Description of Artificial Sequence: Synthetic coding sequence
atgagttgtacagaatgccagaagcgtatgcacttcaactctaatgggttggagcctaaagaaaacgaacccccttctccacttgtgagcggaatcatcgactataatatgccactgacaagtacctatttaaaacaaatgaagttacgcgtgatgaattctcaggaacagccatcctcgctgagcccagccccgggattcgttaataccgtgatcacggtcctaatctgcgcccatgaagagtag

SEQ ID NO: 27902 - DNA, 342 bp, Artificial Sequence
  Description of Artificial Sequence: Synthetic coding sequence
atgaaactgagggtgatgaattcgcaggagcaagatgagacctccgtgagttccgaggattttgatatgtccgatagtacttggatgtcggctgatccccacctggcctcctctttgagccccagtcaagatgagcgtatgcggagtccacagaacttgcactctcaggaagacggaccccataggctgtctcacttatcacagggcctcaacattatctgtagccttgatacgagccttcgtgcacgaaaccccagggtgtcagccgagaggaatgatttcagttttcgggggcgaagcaggtgtgtgacttctaactcccttgcaaaggacggatattag

SEQ ID NO: 27903 - DNA, 468 bp, Artificial Sequence
  Description of Artificial Sequence: Synthetic coding sequence
atgcatgtggaaagttccgccgagcctggcaaagccccaaagcatgctgggcagaagaaaacctatagagctattgctgagacctatgcatttctcccgagagaggccgttacacgattccttatgtcatgtacggagtgccaaaagagaatgcattttaattcaaacgggttagaacccaaagaaaacgagcccccctcccctcttgtctcaggcattattgactacaatatgccacttacatccacttaccttaagcagatgaaacttagagtcatgaattcccaggagcaggacgaaactagcgtatcttcggaagacttcgacatgtccgactccacgtggatgtcagctgatccccatctagccagcagtctgagcccgtcacaggatgagaggatgagatcccctcagaatctgcactctcaggaggacggcggggtgtgcctacaggggcccactgcctag

SEQ ID NO: 27904 - DNA, 1197 bp, Artificial Sequence
  Description of Artificial Sequence: Synthetic coding sequence
atgtccgatagcacatggatgtctgccgacccgcacctcgccagctctttatccccaagtcaagacgagcggatgaggtcgccacagaacttgcacagccaggaagatgacgattccagttcagaaagcggttctggcaatggatccagcaccctgaatccctccacaagtagcagcacccagggagatccagctttccccgagatgaatggaaacggggctgttgcacccatggatttcacgacagcagcagaagaccaacccattaacttatgcgacaaacttccacctgcaaccgcacttggaactgcatcttacccgagcgacgggtgcggggcggatggcttaaggagccgggtcaaatatggcgtcaagactacacctgagtccccaccttattcttccggctcatacgactctataaaaaccgaagtgagcgggtgcccggaagacctgacagtaggccgagcaccgacagctgacgacgacgacgatgaccacgacgatcatgaggacaatgacaaaatgaatgatagcgagggaatggatcctgaaagacttaaggcctttaacatgttcgtaaggctgtttgtggacgaaaaccttgatcggatggtgccaatatcaaagcagcctaaggaaaaaatccaagcaataattgaatcttgcagtaggcagtttccagagttccaagaaagagctaggaagagaatcaggacttacctaaagagttgcagaaggatgaagaaaaatggtatggaaatgacaaggcccacaccccctcacctgacatccgctatggctgagaacatcttggctgcagcctgtgaatcagaaacacgcaaggcggccaaacgcatgaggctggagatctaccagtctagtcaagatgaaccaatagccctggacaaacaacactcccgagatagtgccgcaatcacccattctacttattccctgcctgcctccagctacagccaggaccccgtttacgccaacggtggtctgaactactcctatcgcggctatggagccctgtcatctaatttgcaaccgcccgccagccttcagacaggaaaccattccaatggccccactgacttatccatgaaaggtggcgcatctacgacttccaccacaccaaccccacggcttggggcccctctgacgagacgctggggttgcagttccgtgtag

SEQ ID NO: 27905 - DNA, 231 bp, Artificial Sequence
  Description of Artificial Sequence: Synthetic coding sequence
taacaaaagaggatgcattttaactccaacggactggaacccaaggaaaatgaacctccctctcctttggtcagtggaatcatcgactacaatatgccgctaacaagtacctatttgaaacagatgaagctaagagtgatgaattcccaggagcaaccatcctcacttagcccagccccaggcttcgtgaacacagtcataaccgtcctgatctgtgcccacgaggagtag

SEQ ID NO: 27906 - DNA, 648 bp, Artificial Sequence
  Description of Artificial Sequence: Synthetic coding sequence
atgcgcggactgaggtggagatacactcgcttgcccagccaggtcgaagacacccttagtggcgaggaggggaatgaagaggaggaagaggaggaagctgcacccgaccctgctgccgctcctgaggacccaacagttccccagctaacggaagcctcccaggtactgtccgcctccgaaatccgccagctttcttttcacttcccgccccgggtgacaggtcacccttggagcttggtcttttgtacctctcgggatgggttcagcctccagtccctatacagacggatggaaggttgttcaggacctgtgctgctggttttgagagatcaggacggccaaatcttcggggcctttagctctagcgctatccgactatcaaaagggttctatgggactggcgagacttttctgttctccttttctccgcagttaaaagttttcaagtggaccggatcgaactctttcttcgtgaaaggtgacctcgactcactcatgatgggttccggcagtggacggtttggtttatggctggatggagacctttttcgaggtgggagcagcccctgtcccacctttaacaacgaagtgctagctcgacaggagcagttttgtatccaggaactggaggcctggcttctgagctag

SEQ ID NO: 27907 - DNA, 3210 bp, Artificial Sequence
  Description of Artificial Sequence: Synthetic coding sequence
taagttgccggaacaccaacctccagccaaccgtccttcgggccgtccattagagaacggccgtcacagtccctttgcccatgcccttgtcccgcaggcgagggcgatcccgcatggccagccctggaacggcgcctggtgacttcacggggccgacagccttccccccagtcacacgcccaacttttaactcgccgaagacatagttctgagcaggtgccaccggagtctgagccgagggctgacttccggtctggaaagtggctgcaggagcccgccactggagatgcacgcgacagcaggcaggctctccgtgcacgcatgagtagcaagcatcgcatttgtagccaggaagaagtggtcatcccgtgtgcttatgactctgattctgagtctgtggatctggagctcagtaacctggagatcataaagaagggttcttcctctatcgagttgaccgacctcgatatacccgatatacccgggcttcactgtgagcctctcagccactcccctcggcatttaacgcagcaggatcccttatccgaagctatcgtggagaagctcattcagagtatccagaaggtctttaatggtgagctgaaaggcgagctggagaagcttaaatttttaggagatctctccagcctgagtcaggctttaccatacgacgaaacagctaagtctttcattcattcacatatcgccgacatcgtgcataccttaaacgttctggttcaggaagagagacctcactcactatcctcctccatgcggcaggaggttttcgtgacgatcgccgacctgagctaccaggacgttcatcttctgctggggagcgaggatagagctgagctgttcagtctaactataaagtctattattacactaccatccgtgcggacactgactcagatccaggagatcatgcctaacggcacgtgtaacaccgagtgtctttatcgtcagacattccaggcatttagcgagatgctgcaaagtctagtagtgaaagaccctcatctcgagaacctggacactatcatcaagcatctagtgccctggctgcaatcggtgaaggatcacgaaagagagcgtgccacagcctccatggctcaggtgctgaaatgtctgtccaaacatcttaacctgaagctcccacttaggttccagagactgggccacttagtcgctctcatggctttgttgtgcggagatcctcaggaaaaggtggccgaagaggccgctgagggcattcattcgttactgcacattacactgagactgaagtatatcacgcacgacaaaaaggatcagcagaatctgaaacgggccctcactaagtgcagggagttcttggagcttcactcctcagctgcgaagtgcttctacaattgccccttccggatagctcaggtgtttgaagggttcctcgattctaatgagctgtgccagtttatcatgaccacttttgataccctgaagactttgaagcatccctgcattcaacgctccgccggcgaactgcttctgaccttggcaaagaataccgagagtcaatttgagaaggtgcctgagattatgggcgtcatttgcgcccagctgagcattataagtcagcctcgcgttcgacaacagattatcaatacagtcagtctgtttattagtaggccaaaatatacagacatcgtgctgagttttctgttgtgccaccccgttccatacaacagacacctggccgaggtctggagaatgctgtccgttgagctgccttccaccacttggatactttggagattgctgcggaaacttcaaaagtgccacaacgagcccgctcaggaaaagatggcctacgtggccgtcgccgctacggacgccctctacgaggtatttctcgggaacagactacgagctgccaccttccggctctttcctcagctgctcatgacgctgcttatccaaattcaccatagcattggtctgactatgtccgacgtcgacataccaagtgggctctacacagaacaggaggtgcccagtgaggttacccctttgtgtttcgctatgcaggctacgaaaacccttttgctgcgtacgtgctgcctacaggagttcaacattatggaaaaaaataaaggatgggcccttcttggaggaaaggacggccatctgcaaggactgttcttactagcaaatgctcttctggaaaggaaccaattgctggcccagaaggttatgtacctgctggtccctctgcttaatcgcgggaacgacaaacacaagctgacgagcgcaggattttttgttgagttgctacggtctcctgttgccaaaaggctgccatccatttactcggtggcaagattcaaggactggctgcaggacgggaatcatctctttcgcatcctgggccttcgggggctttataatttggtcggacaccaggagatgagagaagatataaaaagtcttctcccctatatcgtggatagccttagagagacggacgaaaagatagtgctgagtgccatacaaatcctgcttcagctggtaaggacgatggactttaccactctagctgcaatgatgcggacattgttttctctcttcggagatgtgagaagcgatgtgcatcgcttctccgtgaccctttttggagctgctattaaatctgttaagaatcctgataagaaaagcatagagaatcaagtgctggactccctagtccccctgctcctgtactcgcaggatgagaacgatgcagttgcagaagaaagcagacaggtgttaacaatttgtgcccagtttctgaagtggaaactgccgcaggaggtgtatagcaaggacccctggcatatcaaacctactgaggcaggtacgatctgtcgtttctttgaaaaaaaatgtaaaggaaaaatcaatatactcgagcaaacactgatgtacagtaagaaccccaagctgccaattaggagatctgctgtcctgttcgtcgggctgttatccaagtatatggaccacaacgaactgcgcagaatgggaaccgattggattgaagatgatctgagagacctgctgtgcgatcctgaaccgagtctgtgtattatcgcgagtcagacactgctgctcgttcagatggctagagctgagcccaagcccaagcagagggtgaactggctgcaaaagctgatgggccgctccagcgcttag

SEQ ID NO: 27908 - DNA, 1890 bp, Artificial Sequence
  Description of Artificial Sequence: Synthetic coding sequence
taacagcctcgccaggtcgccggcactccaacaagtagccagccctctttcgggcccagcatacgggaaaggcctagccagagcttatgtccatgtccctgtccagccggggagggtgatcctgcttggccggcgctggagagacggttggtaacttcacgagggcggcagccatctccacagtcacacgctcagctgttgactaggagacggcattcaagcgaacaggtaccacccgagtcagaaccaagagccgacttccggagcgggaaatggctgcaggaacccgccaccggggacgctagggactccaggcaggccctgagggcccgaatgtcctcgaaacatagaatctgctctcaagaggaagtggtgatcccatgcgcctacgattccgactcagagtccgtggacctggaacttagcaatctggagattatcaaaaaaggcagcagctccatagagcttacagacctggacatcccggacattcctggcttgcattgcgagcctctatctcattcgccacgacacctgacacaacaggaccctttgtcagaagcgattgtcgaaaaattgattcagagcatacaaaaagtctttaatggggagcttaagggagaactcgaaaaactgaaattcttgggtgatctgtcgtcactttctcaggctttgccatatgacgagaccgccaagagcttcatccactcacacatcgctgacattgtgcacacactcaacgtgctggtgcaggaggagagacctcactccctgtcgtccagcatgcgccaagaagtgttcgtgactatcgctgacttgtcctatcaggatgttcacttgttgctgggcagtgaagaccgggccgagttattctccttgacgattaagtctatcatcacgctcccctctgttcggacactcactcagattcaggagatcatgcctaatggcacatgcaataccgaatgcttatataggcagacctttcaagccttctctgaaatgctgcagtcgctcgtggtgaaagacccacatctcgaaaacctggatactattatcaagcacctggtaccatggttacagtccgtgaaagaccatgaacgagagcgagctaccgcctcaatggcccaggtcctcaagtgtttgtccaaacatctgaatctcaaactaccacttcgtttccagagactcggacacctagtggctctaatggcgctcctgtgcggtgacccacaagagaaggtggctgaggaagccgccgaggggattcactcccttctacatatcaccttgagactgaagtacataacccacgacaagaaggatcagcaaaatctgaagcgggctctgaccaaatgtagggagtttctggagcttcactcaagcgccgcgaagtgcttttataactgccccttccggatagcacaggtgttcgaaggatttctagacagtaatgagctctgccagttcatcatgactacatttgacacactgaagactctcaagcacccatgtattcaacggagtgctggggaacttctgctaaccctggccaagaatacagagtctcagttcgaaaaggtgccagaaattatgggcgttatctgtgcccagctcagcatcatctctcagcctcgggtgcggcagcaaatcatcaatacagtgagtctgtttatttctaggccaaaatacacggacatagtgcttagtttccttctgtgtcatccagtgccttataataggcatctagctgaggtttggcggatgctgtcggtagagctgccaagtacaacgtggatactctggcgactgctcagaaagttacagaagtgccacaacgagcctgcgcaggagaagatggcgtacgtcgccgtggccgtctccccttag

SEQ ID NO: 27909 - DNA, 3129 bp, Artificial Sequence
  Description of Artificial Sequence: Synthetic coding sequence
atgcctttgtcccggcgaggccgaggttctcgactggctggcagcagagctgcaacatcgaacctgcccagagctacagctctttcacccaagcatgcacagttgctaacgaggaggcgccattcttcagagcaggtcccaccagagtccgaacctagggcggatttccgcagtggaaagtggcttcaggagccagctaccggtgacgcaagggattccaggcaggcacttagagcccggatgagcagcaagcaccggatttgcagtcaggaagaggttgtcattccttgtgcctacgattcggactcggaatccgtcgacctggagctcagtaacctggaaattatcaagaaggggtcttcctccattgagctgacagatttggacatccccgacattccgggtttgcattgtgagccgcttagtcacagcccacgccaccttactcaacaggacccattgtcagaggccattgtggaaaagctaattcagagcatacaaaaggtgtttaacggggagctgaaaggcgagcttgagaaactgaaattcctgggtgaccttagctctctgagtcaggccctgccatatgatgagacagctaaaagtttcatccattctcacattgccgacattgttcacactctgaacgttctggtccaggaggagagaccacattcactgagtagcagcatgcggcaggaagttttcgtcaccatcgccgacctctcatatcaagacgtccacctgctgctgggcagcgaggaccgggctgagctcttttcgctgactattaagtccatcatcacattgccatcagtcaggacactgacacagatacaggaaattatgcctaatggcacatgtaacactgagtgtctctacagacagacctttcaggccttctctgaaatgctgcagagcctggtggttaaggaccctcaccttgaaaacctggacaccatcattaagcatctcgtcccatggctgcagtctgttaaggatcacgaaagggagcgtgccacggcgtccatggcacaagttcttaagtgtctaagtaaacaccttaatctcaaactgcctctgaggttccagcgtcttggacacttagtcgcattgatggcacttctgtgcggtgatcctcaggaaaaggtggccgaggaggccgcagagggcatacactccctacttcacattacccttcggctgaagtatatcacacatgataagaaggatcagcaaaatctcaaacgggcccttacgaagtgtcgggaattccttgagctccatagttccgccgctaagtgcttctataattgtccctttagaatagctcaggtgtttgaagggttcctcgatagcaacgaactgtgccagttcattatgaccacttttgacacactgaagaccctgaaacacccatgtatccagcggagcgccggagagctactgctaaccctggctaagaacacagagagtcagttcgaaaaagtgcccgaaatcatgggcgttatttgtgcccagctgtctataattagccaaccacgcgtgcgccaacagattattaatactgtgagtcttttcatttctaggcccaaatacaccgacattgtgttgagctttctcctgtgtcatcccgtgccatacaataggcatctcgctgaggtgtggcggatgctcagcgtggagctgcccagtacgacctggattctttggagactgctgcgcaagctacaaaagtgccacaatgaacctgcccaggagaagatggcctacgtggctgtggccgccacagacgctctctacgaagtgttcctgggcaaccgtttgcgcgccgctaccttccgcctttttcctcagctgctgatgacactgcttatacagattcaccacagcatcggtctgacgatgagcgatgtggatatccccagcgggctttacactgagcaggaagtaccgagcgaagtaaccccactctgtttcgctatgcaggctacaaagactctgctcctacgcacctgttgccttcaggagtttaacatcatggagaagaacaaaggttgggcgctgctgggcggaaaagatgggcatcttcagggtctttttctcctggctaacgccctcctggaaagaaaccagcttctagcccaaaaggtaatgtacctgttagttccactccttaatagaggcaacgacaagcacaagctgacttccgccggattcttcgttgagttattacggtcaccagttgccaagcgcttaccgtccatttacagtgtggcccggttcaaagattggctacaggatgggaatcatctgtttcggatcttgggcctgcgcgggttatacaatctcgtgggccatcaggagatgcgggaggatatcaagtctctgctgccatatatagtcgactcgctgcgtgaaaccgatgagaagatagttctgagcgccattcagatcctcctgcaactcgtgcggacaatggatttcaccactctggccgcaatgatgcggacgttatttagtctttttggagacgtgagaagtgacgtgcatcgtttttcggtaacactgttcggcgccgcaataaagtctgtgaagaaccccgataagaagagtattgaaaatcaggtcctggacagtctggtgcctctgctcctgtattcacaggacgaaaacgacgctgtggctgaagaatccaggcaggtcctgactatctgtgcccagttcctgaaatggaaattacctcaggaggtctacagcaaggacccttggcatatcaagcctacagaagccgggactatttgcaggtttttcgagaaaaaatgcaaaggcaagataaatatcctcgaacagaccctgatgtactcaaaaaatccgaagctcccgattcggcggtccgccgtgctgtttgtgggcctcctcagtaagtatatggaccataacgagctcaggcggatgggcaccgattggatcgaagatgacctcagggacctactttgtgaccccgaaccaagcctttgcatcatagctagccaaacattgctgcttgtgcaaatggcacgggctgaaccaaagccaaagcaacgggtgaattggctccagaaactgatgggacggagcagcgcttag

SEQ ID NO: 27910 - DNA, 2013 bp, Artificial Sequence
  Description of Artificial Sequence: Synthetic coding sequence
tagtgtaacacggagtgcctgtacagacaaaccttccaggctttttcggagatgctgcaatctctcgtcgtgaaggacccccatctcgaaaatttagatacaatcatcaagctgccactacgctttcagcgattgggccatctcgtggccctcatggccctgctgtgcggcgatccccaggagaaggtggcagaggaggcggcagaagggatccactccctgttgcacattaccctgagactgaagtatattacccatgacaagaaggaccaacagaacctgaaacgcgcccttactaagtgtagggagttccttgagctgcactcgtctgccgcgaaatgtttttacaactgtccctttcggatcgcccaggtacctgaaatcatgggggtcatttgcgctcagctgtcgatcatctctcagcctagagtgaggcagcagataattaacaccgtttccttattcataagccgacccaagtataccgatattgtgctgtcatttctactgtgtcatccagttccctataatcggcacttagcagaagtttggaggatgctgtccgtggagctgccctcaactacatggattctgtggcggctattgcgaaagctccagaaatgccacaatgaacccgcccaagagaagatggcctacgtggccgtggccgctaccgatgccctgtatgaggtcttcctcggaaatcgcctgagggcagcaacttttcgcctgtttccccagcttctgatgaccctcctaattcagatccatcacagcattggcctgactatgtcagatgtggatattcccagcggcttgtacacggagcaggaagtgccgagcgaagttaccccactgtgtttcgcaatgcaggcaaccaaaacgttgctgttgagaacatgttgcctacaggagttcaatattatggaaaagaacaaagggtgggcactacttggcggcaaggatgggcatctgcagggcttgtttcttctggcaaatgcactcctcgagcgcaaccaactcctcgcacagaaagtcatgtacctgttagtacccctcttgaataggggcaatgacaaacacaaacttacatccgccggcttcttcgtcgaattgctcagatctccggtggcgaagcgtcttccttccatatattctgtggccaggttcaaggactggctccaggacggaaaccaccttttccgcattctgggccttagagggctgtacaatctggtcggtcatcaggaaatgagagaagatatcaagtcgttgctaccgtatatcgttgactctctgcgggagactgatgagaagatcgtgctgtcagccatccagattttgctgcaacttgtccgcactatggactttaccacgctggccgccatgatgcgcaccctgttttccctttttggggatgttagaagcgatgtgcacaggttctctgtaactctttttggggccgctatcaaaagcgtgaagaaccctgacaagaagtccatcgagaaccaggtgctcgacagtctggtacctctgctcctttacagtcaggatgaaaatgatgcagtggccgaggagtccagacaggtgttgacaatttgcgcacagttccttaaatggaaacttcctcaggaagtttacagtaaggatccttggcacataaagcccacagaagctggcacgatctgcaggttttttgaaaagaagtgcaagggcaagatcaacatcctcgagcaaactctgatgtacagcaagaatcctaagctccccatcaggcgtagcgccgtcctctttgtagggttgctgtctaaatacatggatcataacgagctgaggcggatggggactgactggatcgaagatgatctgcgagacctcctctgcgaccccgagccaagtctatgcatcattgctagtcagactttgttactagtccagatggcccgtgctgagccaaaaccaaaacagcgggtcaattggttgcaaaagcttatgggcaggtcgagtgcatag

SEQ ID NO: 27911 - DNA, 1803 bp, Artificial Sequence
  Description of Artificial Sequence: Synthetic coding sequence
tgacacccgtccccccggcaccagcccagacaggttgccggcacccccaccagtagtcaacccagtttcggcccgagcataagagaaagaccctcccagagtctatgcccttgcccatgtccggccggtgagggagatcccgcatggccagccttggaaaggcgcttggtgacgtcgagaggcaggcagcccagccctcagagtcatgcccaactcctcacaaggaggaggcatagcagtgaacaggtgcctcccgagtccgaaccacgtgccgactttcggagcggaaaatggctccaagagccagcgacaggagacgcacgtgacagcagacaggcgttaagggctcgtatgagttcaaagcacagaatctgcagtcaggaggaagtcgttatcccttgcgcctatgactccgatagcgagtcagtcgatctggagctcagcaacttggagattatcaagaaaggaagtagctccatcgagctgacagacttggatatccccgatattcctggcctgcactgcgaacctttaagccattctcctagacatctgacccagcaggaccctctctccgaagcaattgtggagaaactgatccagagcattcagaaggttttcaatggggagttgaaaggcgagttagaaaagctgaagtttttaggagacctgtcttccctcagccaggctctaccttatgatgaaacggccaaaagctttattcactcccacatcgctgatatcgtgcacaccctgaacgtcctggtccaggaagagcggcctcacagtctgagtagcagtatgcgtcaggaggtgtttgtaactatagctgatctctcctaccaggacgtgcatctcctgctgggctccgaggatcgcgcggagctgttctccttaacaataaagagcattatcacactgccttctgtgaggacactgacccagattcaagaaatcatgcctaacggcacttgtaacactgaatgtctttacagacagaccttccaggcattctcagaaatgctgcagtcccttgtcgtgaaagacccacatttagagaatttggacacaattatcaaactcccgttacggttccagcggctcggccacctggtcgccctgatggctctactctgcggtgatccgcaggagaaggtggccgaggaggccgctgaagggatccactcgctcctccatatcactcttcgcctgaaatacatcacccatgacaagaaagaccaacagaatctcaaacgcgcccttactaaatgccgcgagttcctcgaactccacagcagtgcagcaaagtgtttttataactgccccttcagaattgcccaagtcttcgagggctttctcgactccaatgagctgtgtcagtttattatgaccacatttgataccctaaagacgctaaaacacccatgcattcagcggagcgcaggggaactgttgctgacccttgctaagaatacagagtcccagtttgaaaaggtaccggagatcatgggcgtcatttgcgctcaactgagcattatttcgcagcctagggtaaggcagcaaatcattaataccgtctcattgtttatttcccggccaaagtatacggacatcgtcctttcattcctcctttgtcaccccgtcccctacaacagacacctggccgaggtctggcgcatgctgagcgttgagctcccatctacgacgtggatcctatggcggctgctcagaaaactgcagaaatgccacaatgagcctgcacaggagaagatggcttatgtggccgtcgccgtgagcccctag

SEQ ID NO: 27912 - DNA, 75 bp, Artificial Sequence
  Description of Artificial Sequence: Synthetic coding sequence
atgcgtcaggaggtatttgttaccattgcggacctttcttaccaagatgtgcatctgctcctgggatccgaatag

SEQ ID NO: 27913 - DNA, 105 bp, Artificial Sequence
  Description of Artificial Sequence: Synthetic coding sequence
atgcgacaggaggttttcgttaccatcgccgacctgtcctatcaggacgtgcatctccttctgggatctgaggatagagccgaacttttctctttgacaatttag

SEQ ID NO: 27914 - DNA, 2799 bp, Artificial Sequence
  Description of Artificial Sequence: Synthetic coding sequence
gctggctcccgagctgctacctcaaccagcaggggggccttatctcagagccacgcacagctgttaaccagacggaggcactctagcgaacaggtgccccctgaatcagagcctcgtgccgactttcgctctggcaaatggctccaggaacctgctactggggatgcaagagattcccgtcaggcccttagagcgaggatgtcctccaagcatcgtatttgttctcaggaggaggtcgtgatcccttgcgcttacgacagcgattctgaaagcgtggacctagaactgagcaatctggagataatcaagaagggcagttcttctatagagttgaccgacctcgatattcctgatattcctggtctgcactgtgagcccctctctcactctccacgccatttaacccaacaggaccctctgagcgaggcgattgtggagaaactgattcaatctatccagaaagtgtttaacggagagctgaaaggcgagctggagaagttaaagtttctcggagatctgagtagtctgtctcaagcgctgccttatgatgagactgcaaagtcatttatccacagccatatcgcagacatcgtccacacactaaacgttcttgtgcaggaagagagaccccattcactctcgagcagcatgaggcaggaggtgtttgtcactatcgccgacctctcctaccaggacgttcatctgctcctaggttcagaagatagggctgagctcttttctctgacaattaaaagtatcataacacttccttctgtgcgcactctgacccagatccaggagataatgccaaatgggacatgcaacaccgagtgtctctaccgtcaaacctttcaggcattttcagagatgctgcagtcactggtggtcaaggatcctcacctggagaacctagacaccatcattaaacatctggtcccatggctgcagtcagtgaaggaccacgaacgagagagggctacagcgtcgatggcccaagttctgaagtgcctgagtaaacacctgaacttgaagttaccactccgattccagagactagggcacctggtggcacttatggctctgctctgcggcgacccccaggagaaagttgctgaggaggccgccgagggcatccactccctgctgcacatcaccctccggctgaaatacattacacatgataaaaaagatcagcaaaatttaaagagggctctgaccaagtgcagggaattccttgagctgcattctagtgcggctaagtgcttttacaactgtcccttcaggattgcacaagtattcgagggttttcttgatagcaacgagctgtgtcaattcattatgacaaccttcgacacactgaagacacttaaacatccctgtatacagcgttcggcaggggagcttttactaactctggcaaaaaacactgagagtcagtttgagaaggtgccagagatcatgggggtgatatgtgcccaactgtcaatcattagccaacctcgggtgcggcagcagattatcaacaccgtgtcactattcatctccaggccgaaatacacagacatcgttctgagtttcttattatgccatccagttccatataatagacacctggcggaggtgtggaggatgctgtcagtagaattaccaagcactacatggatcctatggcggctgctcaggaaattacaaaagtgccataacgagcccgctcaggaaaaaatggcttatgtggcggtcgccgccacagacgcactatatgaagtattcctcggaaaccggctgcgggccgcgacctttcggctgtttccacagcttctgatgacgcttctgattcagatccaccatagcatcgggctaactatgtctgacgtcgacataccgtccggattgtatactgaacaggaagtgccttccgaggttacaccactctgcttcgctatgcaggctaccaaaactctgctcctgcggacttgttgccttcaagagttcaatattatggaaaagaataaagggtgggctttgctgggtgggaaagacggtcatctgcagggcctgtttcttctggcaaacgcgttgctcgaaagaaaccagctactcgcacagaaggtgatgtatttgttagtccccctcttgaataggggaaatgacaaacacaaactaaccagcgctggattttttgtagagttgctaagatcccccgtcgccaagaggctgccaagtatttattccgttgctcggtttaaggactggttgcaagatggcaaccatttgttccggatcctggggctaaggggactctacaatttagtcggccatcaggagatgcgggaggacatcaagagcctcctcccttacatcgtggactccctgcgggaaaccgatgaaaaaatcgtgttaagcgccattcagattttgcttcagttagtgagaaccatggacttcacaactctcgctgcgatgatgagaactctgttcagtctgttcggggacgttcgcagtgacgtgcatcggttcagcgtgaccttatttggagccgctatcaagagcgtcaagaaccccgacaagaagtcaatcgaaaaccaggtgctggattctctagtccctctgctgctttacagccaggacgagaatgatgcagtggccgaagagtctcggcaggtcctgaccatctgtgcacaatttctgaagtggaagctgccacaggaggtgtactccaaggacccatggcacataaaacccaccgaggcaggaacgatctgtcggttcttcggcaagaaggtgcagggcgagaattag

SEQ ID NO: 27915 - DNA, 462 bp, Artificial Sequence
  Description of Artificial Sequence: Synthetic coding sequence
atgggaaattacagttctcataaacgtaccaaagcaccgaagcaggctcggaaggagcggcctgcggacatggataaggcctggtggaagtctttcctcaatcacctgacaagaaagaagcctgcaaccaggattgtattgatactgcctcttgataaacggcagccactggctaatgcaggacagagaattgactacgcaagcggcgccggactgggatcacccgcagctccgagattgcgcggtgccggggaaggtagcgagagagagcccagaatgccagtccttcttctactgagacgacaggaggcccggcggcctgaagagggaggcgcacgcgctgccctgtcttggccccggctgttgtcacgcttccggtctcccggcaaggcaccgagagaggcgggtccagccgaggagcagccccgaaaaagatgtcgttgccctcggccccaactctag

SEQ ID NO: 27916 - DNA, 1995 bp, Artificial Sequence
  Description of Artificial Sequence: Synthetic coding sequence
atggagtcgttcatggagtcactgaacaggctcaaggaaattcacgagaaagaggtgttgggactgcagaacaaactgttggaattaaactccgaacgttgcagggatgcccagcggattgaagagctcttttctaagaaccatcagttgagggaacagcaaaaaaccttaaaagaaaacctgagggtgctggagaaccgtttgagagctggactttgcgatagatgtatggtaacgcaggagctcgcgcgtaaaagacaacaagaattcgagtcttcgcacctccaaaaccttcagaggatcttcatcttgactaacgaaatgaatggactgaaggaggagaacgagaccttgaaggaggaagtgaaacgtctgcgaggccttggcgacagacctaagccacgggccaaggagggcaccagcgatccacccagtcctctgttgctcccctcaccaggtggttggaaggccatcaccgagaaacctccaggtggacacgaggaggcggaagaggaccaccagggcgtaggcctccggggggaggaaaaacccgctggacaccggacctctccggtggccaagatctcaccgggagccacattgcccgagtccagggccccggatatgtccccacagcggatttctaaccagctccacggcactattgctgtagtgcgccccggcagccaggcctgtcctgctgaccgcggtccggcgaacggcacaccccctccgctgccggcccgcagcagtccaccttctcctgcctacgaaagaggactctccttagatagcttcttaagggcttctcgacccagcgctatgactcatgaagcccctaagctaagcccaaaagtggatagactgtgtctcctaaaccgacccctcagcctccacctacaaagtccacactccagcccccttgctcccgcagctgccccttctgatcctcgtctgcaggacctcaaggccagggaagccgaggcttgggaggaacccaccgaattgctgggcttgccatccgctttagctggtatgcaggaccttcgcttagagggggccctacacttacttttagcccagcagcagctgagggccagggcgagggctgggtctgtcaggccaagaggtcagccaacacctggcgagatgttaccttccctgccggtaggcagcgattcagaggggcccgagaatgaaggcactagagccgctctggcagctgcaggtctctctggagggaggcatacccagcctgcaggaccaggacgtgctcagaggacagaggcagctgccactcaggactgcgctctggacaagcctctggacttgagcgagtgggggcgcgccagaggccaagatactcctaaacctgccggccagcatggaagtctatctccagcagccgcccacacggcctccccggagccccctacccagtcaggccccttgaccagatcgccacaggccctgtcaaatgggaccaaaggcacacgcgtaccagaacaagaggaggcatctacacccatggatccatctagaccgctgccgggaagtcagctgtcgttgtctagcccagggagtaccgaggatgaagataccgggcgaccactcccgccgccccacccacagcctccacctcacccgcaaccgccagacttggacggacaccccgaacccagcaaagccgaggtcctgagacccgaaagtgatgagctggatgaaacagatacacccgggagcgaagtcggtttaagctcacaggccgaggcgactacatccaccaccggggaaggacctgagtgcatttgcacccaagagcacggtcaaggccctccacgcaagagaaagcgtgcctcggaacccggtgacaaagcctccaagaagcctagtcgggggcgtagaaaactaactgcgaccgaagggcccggctcaccccgcgacgcagaggatcacagcccctcccccaactcatccccctgggaggagacctag

SEQ ID NO: 27917 - DNA, 1719 bp, Artificial Sequence
  Description of Artificial Sequence: Synthetic coding sequence
atgagaagacacatggtcacctacgcgtggcagctgcttaaaaaggagttaggcctttaccagctcgccatggatatcattatcatgattcgcgtgtgcaagatgtttagacagggacttcgggggttcagggagtaccagattatcgagaccgcccattggaaacacccgattttctctttctgggacaagaaaatgcagagccgggtgactttcgacaccatggatttcattgccgaggagggtcacttcccccccaaagcaatccaaattatgcaaaaaaagccatcatggagaacagaggacgaaattcaggccgtctgtaacatcttgcaagtgctagactcgtaccgaaattatgcggaacccctgcagctcctgctggccaaggtgatgcggttcgagaggtttggccgaagacgggtgattataaaaaagggacagaagggtaactcgttttatttcatctatctcggaaccgtggccattacgaaggacgaggacggcagctctgcgtttcttgatcctcacccaaaactgctccataagggaagttgcttcggcgaaatggatgtgcttcatgccagcgtgagaaggtccactatcgtttgcatggaagagaccgagtttctcgtggtggatcgcgaggactttttcgccaacaaactggaccaggaagtgcaaaaagacgctcagtaccgattcgagtttttccgtaagatggagctgttcgcaagctggagcgatgaaaaattgtggcagctggtcgcaatggctaagatcgagcggttttcctatggccagctgatttcaaaggactttggagaatccccattcattatgtttatttcaaaaggctcttgcgaagtgttgagactgcttgatctgggcgcttcaccttcttaccggaggtggatttggcaacacctggagctgatcgacgggagacccctgaagacacatctcagcgagtactctccaatggagaggttcaaagagttccagatcaagtcctatcccctccaggattttagcagtctcaagctgccgcatctgaagaaggcctgggggctccaggggacttccttctcaaggaagatccgcaccagcggagatacactgccaaaaatgctggggcccaagattcagtctcgcccagcccagtccatcaagtgtgccatgatcaacattaagcctggcgaactccctaaagaggcagcagttggggcctatgtgaaagtgcacaccgtcgaacaaggggagatcctggcctttctccctgaaggcgaatgcgatacacgccccttgatcctcatgtcgctaggcaacgaactcatccgaatacggaaagagatcttctacgagctgattgataacgatgatgaaatgatcaaaaaattgctgaaattaaacattgccttcccttccgacgaagatatgtgtcagaaattcctccaacagaattcctggaacatttttaggaaggatctacttcagcttttggtagagccgtgtcagtcgcagctgttcactcctaataggccaaagaaacgggagatctacaaccccaagagcgtggtgttagacctgtgcagtattaataagactacaaagccacgctacccaattttcatggctcctcagaagtacctcccccctctgcgcatcgtgcaggctattaaggcaccaagatacaaaattagggaattgctcgcatag

SEQ ID NO: 27918 - DNA, 1731 bp, Artificial Sequence
  Description of Artificial Sequence: Synthetic coding sequence
atgagacgtcacatggtcacttacgcgtggcagcttctgaagaaggagttgggcttataccagctggccatggatattatcattatgattcgggtctgcaagatgtttagacagggactcagaggatttcgcgagtatcagattattgaaacggctcattggaaacatcccatcttctctttctgggataagaagatgcagtcacgggtgactttcgatacaatggactttattgctgaggaagggcacttcccgcctaaggcaatccagattatgcaaaagaagcccagctggcgcacggaggatgaaatacaagctgtctgtaatatactccaggtcctggattcctaccgcaactatgctgagccactccagctgcttctcgcgaaagtcatgaggttcgaacgtttcggccgccggcgcgtaattattaagaaagggcagaagggcaactctttttacttcatatatctcggcacggtggctataacgaaggatgaagacggatcctctgcctttctggacccccaccctaagctgctgcacaaaggctcttgttttggggagatggatgtactgcacgccagtgtgagacgaagcacaatcgtgtgtatggaggagacagagttcttagtcgtggacagggaagattttttcgccaacaagttggatcaggaggtgcagaaggacgctcagtatcggttcgaatttttcaggaaaatggagctgtttgcttcttggtccgatgagaagctgtggcagcttgtggccatggcgaagatcgaaagattttcttatgggcagctgatcagcaaggacttcggcgagtcaccttttatcatgttcatctctaaaggctcatgcgaggtccttcgcctgcttgacttgggtgctagcccatcatataggcgatggatctggcagcatctcgagctaatcgatggacggccgctgaagactcatctgagcgaatacagcccaatggagcggtttaaagagtttcagattaaatcttacccactgcaggatttttcgagtcttaaactgccccacctcaagaaggcttggggtttgcaaggaacatctttctctcgcaagatccgcacctctggcgatacattacccaaaatgctgggccctaagatccagtcccgacctgcacagtcaatcaagtgtgctatgatcaacatcaagcctggcgagcttcctaaggaagcggcagttggcgcgtatgtaaaggttcacacagtcgagcaaggcgagattttggggctgcaccaagcttttcttcccgagggggagtgtgacacacgcccccttatcttaatgtccctgggcaatgagcttatccgcattagaaaggagattttttatgagctgatcgataatgatgacgagatgatcaaaaaactccttaagctcaatattgcttttccgtcagacgaggatatgtgccaaaagtttcttcagcaaaatagttggaatatcttccggaaggacctactgcagctgctcgttgaaccatgccagtctcagttgttcacgccaaaccggccaaaaaagcgtgaaatctacaaccctaaatctgtcgtgttagacctgtgctcaattaataagaccaccaaacctcggtatcccatcttcatggccccccagaaatatctccctcccttaagaattgtccaggctataaaagcacctcggtataagatacgcgagctgcttgcctag

SEQ ID NO: 27919 - DNA, 1272 bp, Artificial Sequence
  Description of Artificial Sequence: Synthetic coding sequence
atgagacggcatatggttacctacgcatggcaattattgaaaaaggaacttggattgtaccaattggccatggatattatcattatgatcagggtttgcaaaatgttccgtcagggcctcagaggcttccgggagtaccagatcattgaaacagcgcactggaagcacccaattttttctttctgggacaagaagatgcagagtagagttacctttgatactatggactttattgcagaagagggccacttccctcctaaagccattcagattatgcaaaagaaaccctcctggaggaccgaagacgagattcaggccgtgtgcaatattctgcaagttctggatagctacagaaactacgctgagccactccagctcttgctggccaaggtgatgagatttgagaggttcggacgccggagggtgattattaagaagggccagaaaggcaacagcttttattttatctatctgggaacggtggcaataactaaagatgaggacggctcgtcagccttcctggacccacacccgaaactgctgcataaaggatcgtgctttggcgagatggatgtgctgcatgcttctgtcagaaggtctactatcgtgtgcatggaggagaccgaatttttagtggtggatcgggaagattttttcgctaataaattggaccaggaagttcagaaggacgcacaatacaggttcgagttctttcggaaaatggagctttttgcctcctggtcagacgaaaagctttggcagttggttgcaatggccaagattgaaagatttagctatggacagctcatttccaaggacttcggggagtcaccgttcatcatgttcataagtaagggcagctgcgaagtacttcggctccttgatttgggtgcttcacccagttacagaagatggatttggcagcacctggagctgatcgacggtcgcccgctgaagacacacctcagtgagtattcacctatggaaaggttcaaggagtttcaaatcaagagttatccactgcaagatttcagttctctgaaactgccccacttaaagaaggcctggggactccagggaacatccttctcaaggaaaattagaacaagtggggatactcttcccaagatgctcggaccaaaaatccagtcaagacctgcccagtctatcaaatgtgcgatgataaacataaaaccaggagagctccctaaagaggcagcagttggcgcttatgtaaaagttcacacggtagagcagggcgagatcctgtag

SEQ ID NO: 27920 - DNA, 1302 bp, Artificial Sequence
  Description of Artificial Sequence: Synthetic coding sequence
atggaatatgaggtcaagaaaggcaagaaaggctttgtgagccccatccggcggttggttttccccaaggccgggagaagggccgcctgcagatcctccgtgtctaggcggcctctccactccatgcctctgtacccccctgattatttgatcgatccacagattctcctgtgcgattacttggagaaggaggtgaagtttctggggcatctcacctgggtgacttcttctctgaacccttctagcagggacgaacttttgcagttgctggatacagccagacagcttaaggagttaccactcaagacgaccgcggagcaggactctatcttatctctgtcagcccgatgtctactccttacatggagagataatgaagaacttattcttcgcatccccacccatgagatcgctgcggccagctatctgcaggacgatgcattgcacctgctcgtgctaaaaaccgggctgggcgtggatcccgttcctgccggagtcgacgcttcaccaggcggagccggcagagatcctggcccacccggaggcgcgcccgagaaacgccgcgttgggactgccgaacgcagacatacaatctgcagcctcgactggagaatggggtggggcggtggcgctgccgaggctagggcgggcggcggcggagggggcagtctcgaaagacaaagggccggcgcgcgcgcctctggaagctgggagcgaaggcagacattttcaggaagttgggagaggaggcacggcggaggcggaggagggggcggcgcaggaaaaccgggaggaagctgggagcgtcgccaggccggaagcggaggcgggggctcctgggaacgaagacaccctggaccgaaccctttggatccacaagacccgagcccagatgcctattgtaacctggtcattctggcagtggctaatagagatgccgcggaagagagctgtgctctgatctgtcaggtcttccagattatctatggcgaccagagcattgagtgcgtggatcgagctggctaccactacaccagcacccctgagaggccctggttgtgttccagaatcatggcccccagaacacccctcaagcatgtaactgctgctaggccacatctactgagtatggctccaacggcagccgctgcaaccaccgcggtctgggcttggagcagttaccgaatcacctggagcagatgcggggtgagttgggggccctcccgcagcagctccttaagatgctgctgcggctcgacaggttggggctgccccagcagaactattgcccaggcttgttag

SEQ ID NO: 27921 - DNA, 1716 bp, Artificial Sequence
  Description of Artificial Sequence: Synthetic coding sequence
atggagtatgaggtgaaaaagggaaaaaaaggcttcgtgtcgcctattcggcgtcttgtgtttcctaaagctgggcgtagggcagcctgtaggtcctccgtctctcgtcgaccactgcattccatgcccttatacccccccgattatctgatcgatcctcaaatcctcttatgcgactatcttgagaaggaggttaaattcctggggcatctgacgtgggtgacgtcctcgctgaatccctcctctcgcgacgagctgctgcagctgctggacacagctaggcaactgaaagaacttcccttaaagacaacagctgagcaagatagcattctatccctgtctgccaggtgcctcctgctcacgtggagggacaatgaggaattaattcttaggataccgacacacgagatcgctgccgcgtcataccttcaggatgatgcccttcacctgttggtgcttaagacgggattaggcgtggatccagtgcccgcgggtgtggatgcctcaccaggtggagccggacgggatcccggccccccaggcggtgctccagaaaagcgcagggtgggaactgcggagcggaggcatacaatatgctctctggattggcgcatgggctgggggggcggggccgctgaagctcgcgctggagggggcggggggggaagcttagaacggcagcgggccggcgcccgagctagcggatcctgggagcgcagacagacgttttctggttcatgggaaaggagacacggcggcgggggaggcgggggcggcgccggcaagcccggagggtcttgggaaaggcgccaggccgggagcgggggcggtggatcttgggaacggcggcaccctggccccaaccctcttgacccccaggatccttctcctgacgcttactgtaatctggtcatcctagccgtggccaatagagatgctgcagaggagtcatgcgcccttatctgccaggtctttcaaatcatttatggagaccagagtatcgaatgtgtggaccgggcaggataccactatacctcaacccccgagagaccatggttgtgctcaaggtctgagagctgtcataccgacggaacgtatgcttacgacgccgactttagctgctgctcatcttttaatggctcgcaggatactttcgaggcgtgctacagcggtacatctacacccagctttcatggaagccactgctcagggtccgaccattcaagcttgggcctcgagcagctgcaggattatatggtcaccctgaggtccaagctgggacctctcgaaattcaacagtttgcaatgctcttaagggaatacaggctagggctacctattcaagattattgtaccggcttactgaagttatacggagaccggcggaaatttctgctccttgggatgaggcctttcattcctgatcaggatattggttacttcgagggctttctagagggcgtggggatcagagaaggcggcattctgactgattcctttggaagaatcaagaggagtatgtcatccacgtccgcatctgccgtgcggagttacgacggtgctgcccagcggccagaagcacaagcctttcaccggctattggccgacatcacacatgatatcgaggctttggcacctgacgacgacgacgacgacgaagacgaaccccgcggttctcgcggaggttcagatgctgcagaggataattatctgtag

SEQ ID NO: 27922 - DNA, 708 bp, Artificial Sequence
  Description of Artificial Sequence: Synthetic coding sequence
atggaatatgaggtcaagaaaggaaaaaagggttttgtgtcaccaattcggcggctggtatttccaaaagctgggagaagggcggcgtgccgtagttctgtttcccgaaggccactccactctatgccgctgtacccgcctgactacctgatcgacccgcagattttgttatgtgactacctcgaaaaggaggttaaatttttaggccacctgacatgggtgaccagctcgctaaacccttcaagcagagatgagctgctccagctgctcgacacagcaagacagctcaaggagttacctctaaagactaccgctgaacaagacagcatcttaagtctgagcgcacggtgcttgctgctgacctggcgggacaacgaggagctgatactcaggattccaacgcacgagatcgcggccgcttcgtatctgcaggacgacgccctgcatttattagtgctcaagacagggctgggggtagaccctgtgcctgccggagtagacgcctcacccgggggcgccggtcgagatccgggacctcctggaggggctccagaaaagcggcgggtaggaacagctgaacgtcgtcatactatctgcagtctcgactggagaatgggttggggaggaggagctgcagaggcccctacgagatctacccgtcgcactccagctcccacaccaaccgcaacctggtccagttggctgtag

SEQ ID NO: 27923 - DNA, 975 bp, Artificial Sequence
  Description of Artificial Sequence: Synthetic coding sequence
gagcgccgccacggagggggagggggtggaggcggggcaggcaaacccggcgggtcctgggagcggagacaagctgggagcgggggaggagggagctgggagcgtcggcatccgggacccaaccccctggaccctcaggatcccagccccgacgcgtattgcaatctggtgattctggccgtcgccaacagagacgcagccgaggaatcttgtgccctgatatgccaagtgttccagatcatctatggtgatcagtccatagagtgcgtggacagagctggttaccactatacttccacgcctgagaggccttggctctgctctcggtcggagagctgccacacagatggcacgtacgcttatgacgccgacttttcctgttgttcctcctttaatggctcccaggatacttttgaagcatgctatagtggcacaagcacccctagctttcatgggtcccattgctccggatctgaccattcctcactcggcttagagcagctccaagattatatggtcacgctacgctccaaactgggccccctggagatccagcagtttgccatgctgctccgagagtacagactcggactgccaattcaggattactgtactggactgctgaagctatatggagatcgacggaagttcctgttgctgggcatgcggccgtttatccctgaccaggatattgggtattttgagggattcctggaaggcgtgggaatccgcgagggcgggattctcacagatagcttcgggaggatcaagcggtctatgagttctacctccgctagtgccgtccgatcctacgatggggccgctcagcggcccgaagctcaagcatttcatcgcctgctggccgacattacgcatgacattgaggcgctggcgcctgatgacgatgatgacgatgaggacgagcccaggggctcgcgaggggggtcagatgccgccgaggacaattatctctag

SEQ ID NO: 27924 - DNA, 300 bp, Artificial Sequence
  Description of Artificial Sequence: Synthetic coding sequence
atggatactggtagccgcgaagccgctttcacgagagacctgcccaggaagcctgcagatgcgcaggtttcccctgagatgagcatcactcacaaggagaaagagaacgcacatcttaaggaaattctgctctttgtgaatgctgaagcattttcccaaccgcagccccattccgcaccggtatgcgaaggccaacagctgactggcaagttctccacgagcgtactgaccagggctgggggcgacgcaagcccctgctcttgggaaagactgctgtgctacggatggtctcactgttag
